United States Patent 8,067,671 (METHODS FOR GENETIC CONTROL OF PLANT PEST INFESTATION AND COMPOSITIONS THEREOF) - sequence listing, part 54

SEQ ID NO: 155059 - protein, 321 aa, Heterodera glycines
  Coding regions on vcDNA: vcDNA=SeqID_81482; Strand=+; Position=1 -294,632-775,1230-1403,1921-2274
MFFLCPPIVLLPLALFCVASHGLTNHSKAFGNESESNRTDFFGTEPMEIPRHKSADGFDPMVDDVFALLSAGEEGEEEGNGTKVGITVEEEEEEEEQQSFRDAITSEPNCHLFVGFVDHFHSFPTNTLVTKLNGKTMNGKEAVVRLFLKTLVVVEKTWLPGCLAVFFDSRTLDLQLDEIAKLLWKDGQPKLGTSNGKNKWAASKKSDEELYCSEQVICLTNGHFGFIFPRPRRDSFNAFGTDCLDKTGREEETEGRRGRWRKRSEEKEEDGGGRKRLKEEEEDGGREVRRKKKMEEEEETEGRRAGGGRDGRRKRDEHGND

SEQ ID NO: 155060 - protein, 34 aa, Heterodera glycines
  Coding regions on vcDNA: vcDNA=SeqID_81483; Strand=+; Position=1-104
LADYLSLQVDPIHSIGNWQCQLGTQCERRGGGGG

SEQ ID NO: 155061 - protein, 21 aa, Heterodera glycines
  Coding regions on vcDNA: vcDNA=SeqID_81484; Strand=-; Position=1-71
FHSNYVFFMNRNIDNFTNWTW

SEQ ID NO: 155062 - protein, 16 aa, Heterodera glycines
  Coding regions on vcDNA: vcDNA=SeqID_81485; Strand=-; Position=1-49
EAIPEGFGLPINLGAS

SEQ ID NO: 155063 - protein, 305 aa, Heterodera glycines
  Coding regions on vcDNA: vcDNA=SeqID_81486; Strand=-; Position=1 -208,397-1106
  Homolog annotation: Hit_ID=AAG00551.1; Match level="QueryCoverage =67%, HitCoverage=90%, E-value=4e-24, Identity=34%"; Hit description =retinitis pigmentosa GTPase regulator [Homo sapiens]
MTIIVLILDFFFESGNTATGRQLPGGPPAPITDPVGAAEQCVVPAPLRWQQRELLHPFGASPSPRPHMRRARHNLSFDAAWQQCVAPDEAIGGNENDDGGDDENGRGNNSGGRNKKKGGGGGQKDGGGSKDGANGGGREEEEQNDNNGKRGEREREEERREEEEEEEQNGNNEERGEKKRREEGRGKEGGEQDRREDEEDEGRGEEETRERGDEKETEEAREKLKRGEEKGGGEKGGGKAKEGRSEGGGKAKEGRSESGGKAKEGRGGGAGEKKQPPPGSKMVGHLLFCEIRKRKCVLAIGGQSL

SEQ ID NO: 155064 - protein, 42 aa, Heterodera glycines
  Coding regions on vcDNA: vcDNA=SeqID_81487; Strand=-; Position=1-129
IRRGTTVMRRGTTVIRRGTKVIRRGTNLIRRGTTLLEGVKTD

SEQ ID NO: 155065 - protein, 59 aa, Heterodera glycines
  Coding regions on vcDNA: vcDNA=SeqID_81488; Strand=-; Position=1-3,74- 250
MSPQPIRNCAKMSPRNVPMSSFIASSRRTEVPSCRLKQRTSGMNDAGANKTVNAMKRYM

SEQ ID NO: 155066 - protein, 40 aa, Heterodera glycines
  Coding regions on vcDNA: vcDNA=SeqID_81489; Strand=+; Position=1 -78,367-411
MVINDSDDENSGDVPLSDEAAQLLRQKYSDLDGPNLTKKH

SEQ ID NO: 155067 - protein, 108 aa, Heterodera glycines
  Coding regions on vcDNA: vcDNA=SeqID_81490; Strand=-; Position=1 -145,191-328,828-871
  Homolog annotation: Hit_ID=NP_496090.1; Match level="QueryCoverage =95%, HitCoverage=21%, E-value=5e-29, Identity=56%"; Hit description =4-Hydroxybutyrate coenzyme A transferase (51.4 kD) (2J974) [Caenorhabditis elegans] emb|CAA87047.1| Hypot
MVSDGIMELLDRNVINNSKKSMFPGRVVVCFAMGSHKFYELMDNNPLFLFASAGFTNKTTTIMQQSKMTAINSAIEVDFTGQVASDTIGTCFYSGFGGQVDFINGAAL

SEQ ID NO: 155068 - protein, 167 aa, Heterodera glycines
  Coding regions on vcDNA: vcDNA=SeqID_81491; Strand=-; Position=1 -152,197-279,333-401,452-530,2368-2394
  Homolog annotation: Hit_ID=CAE73333.1; Match level="QueryCoverage =99%, HitCoverage=15%, E-value=2e-29, Identity=45%"; Hit description =Hypothetical protein CBG20762 [Caenorhabditis briggsae]
PPTSTRVYLRHFRPLSRRPCTKPGVAQQFNILKYLLLSAKTGFGVEDLITNIYQKWVSPRGSIRNIYQKWVSPRGSIRSDIYVVGSTNAGKSTLFNAFLQTLFNAFLQSDLCKVRAMDLVERVTTSIWPGTTTTSIWPGTTLSLLKFPIMNPSTQQLELLKSFTLTI

SEQ ID NO: 155069 - protein, 109 aa, Heterodera glycines
  Coding regions on vcDNA: vcDNA=SeqID_81492; Strand=+; Position=1 -228,624-725
MGRRGYCRSSHRKMGRNWPTKLWWCKQIAEQFTDQRRNHGQRHRQEGLGGIQIGWTQMPTATKAEIVGATATFNQSDKQWKNAFLAWFEASTNDFYNAYFCQFLDFYYF

SEQ ID NO: 155070 - protein, 99 aa, Heterodera glycines
  Coding regions on vcDNA: vcDNA=SeqID_81493; Strand=-; Position=1 -67,206-438
MKFSVQIDQLFLLIFLFSMVRISKNRGGNLLKGQFVTGFRPFECQKESNIDEAVPILRGVYCPNLGNCNKNDKFEQLANGLKLTLTSKDAASCQDSKFQ

SEQ ID NO: 155071 - protein, 109 aa, Heterodera glycines
  Coding regions on vcDNA: vcDNA=SeqID_81494; Strand=+; Position=1 -86,525-768
MMMMLTMIMMSEDSMSLLARHGLRWSGESPICAKSPIHRQQSTEIVRQNRLPAAICEEFLAKNRAQCPIDLIHLLQSVYVEKMCKKMPRYWSCLIVILFHVICFFYVCC

SEQ ID NO: 155072 - protein, 1477 aa, Heterodera glycines
  Coding regions on vcDNA: vcDNA=SeqID_81495; Strand=+; Position=1-4433
  Homolog annotation: Hit_ID=NP_498959.1; Match level="QueryCoverage =79%, HitCoverage=53%, E-value=1e-160, Identity=31%"; Hit description= zn-finger, CCHC type and RNA-directed DNA polymerase  and Integrase, catalytic domain containing protein
MLRQLEETDAREWNAFDQLMSGIRRKNGEDLDDLADRVITLVRRAYPGLTDHLVDDYAIKHLIRTFESSELALSLEMGRRPGMTFDQFVGMAARAEATQKATRRIASNNAYGKTNFGATLTRQGPEPKTNFQHSTGNRPKCFYCEKEGHIARNCFRRQAEEGNQNHNSQQNHNVTGSNKTPLSLYPSQSPAYKPEPNNANPQRPQNTQSRNFLRQNYLVEQKDLNHESADIKCAGVISNDSKMLEFFQKFWKQNDENFEPNSNETSLVGKIIAITVTIFDQEAPSMMDSGAQISLVQAIFLKELFEKQNFGKEKMIIFPKTRNVVDVNGKRVECYGIISLPVARRDCEPINIQFHITDAPIGLPILLGTNALGPLGFKILDSKHGELIEFELASEKSDSVRLIHTIMLEPYSTKLVELSVSKSFDQKNVLIASSGVINDVKVESSVDRVRNGKVFASITNFSLNSIILKENERVAIVETVDEIANAEDCLTNSWLFDNFQQKIDSECRNTNFSEWTPRIGALDSDKAKTLEKVLLESKDIFAFNDNELTQTEMIKHHIDTGEESPVKKRMRPVPYAYREKVATMIQDYLGRGIIRPSLSPWSSPIVIVPKKDGSLRFCVDYRGLNAITKKDCFPLPNIERTLLMLGGRKFFSTLDFISGYWQIKMDDESTEKTAFVTEFGLHEFTVMPFGLCNAVATFQRFMSHLFGDKLNDFVFVYIDDVLVASETFEQHLEHLKFVFEHIKEAGLKLKVAKCQFCTEELQFLGHVLTRNGIKMDNDKIKPILDMPTPKTKKELHSFLGFMTYYRKFIYSFGSMAAPLFKLLKKDVPFKMDNAEMAAISKLKGKILSDVVLYFPDFKAAMEDPTRKFLIMTDASKTGISAVLCQPDQQNRIRPIYFASRQCNKHESRYCPTELEALAVRFGVKKFAQYIIMIPTRVLTDHKALIPMFKSKNETGNARVDKWIMELSSRFILEIEYNPGKTNIIADVLSRSGALKPNETAEDKTVIGQIAIGNEPDCVGNEAEINEWIAATKESEFGHIYEFLQKRKLPEDPRDSQRILDTIQKFTVLNGLLYFHESNSGNLRLFVPKKFRTDLIEERHEGKCAGHLSGKKIFGQLAENYFWPNMRADCVNAALKCRICAHTRSPRSNVPQLKPVITSEPFELVCMDILSIGMSERGNKYVLVMVDHFTKYLITAAIPDKSVETVAKAFIQQLILIFGSPKRIHSDKGTEFVNKTFEEITKILRVERSMTAGYDPNANGHAERANQTILNMLKRSTESNWSWDDRLPFVTFAYNIAPSETTGFSPFILLFGRPVKFPSANGVNFPVNPLYTVDEESYLQLFRENLQQILMNAKVNADKAREKMENWFNSQPKVTANKYKKGERVMVLFPGANQRVAHKKLKWNIFGPYEIMEISTSSAKVVPVDKKSAEQISVPVERLIHVPEGIPNISTVPRGKNAYKNLLNAMTILKLLELNDVE

SEQ ID NO: 155073 - protein, 67 aa, Heterodera glycines
  Coding regions on vcDNA: vcDNA=SeqID_81496; Strand=-; Position=1 -63,340-453,540-566
MISQPLLLLVGAVLHHIVRMTGDSGSGLMKNTTIFGFKWASQAKRLVILQILHEQKASQNKVHFTRN

SEQ ID NO: 155074 - protein, 224 aa, Heterodera glycines
  Coding regions on vcDNA: vcDNA=SeqID_81497; Strand=-; Position=1-673
MDAQNRGELDESALLDSHGNSVFHENSQEQNLGRENGRNIQQQNLGINLDQRIAHLDLVDNWEFNPHLTSTPNVAAARIRQQEENLAINRQLAFQQHFFAEENFAAHPNVVAEHLEQRGQIHFAPARRPMNVQQRQNADYQPRLTHQQNYAQFEERAYRQQNPGNLFVRNQPARYENANPNCGYGTSGHVMADPAGGAQPPISILEYVLILDRLPELKGNEALT

SEQ ID NO: 155075 - protein, 164 aa, Heterodera glycines
  Coding regions on vcDNA: vcDNA=SeqID_81498; Strand=+; Position=1 -156,433-547,1042-1118,1320-1415,1743-1793
MAPKKFMPMELIVEIVTFLQFRRRWANVRVSRAFDHFLLEQIGFFLTKTNSSAKQCLTEFGQMVNNLPSKHKRNVFNESARELGVKLLFGNIIWFIQKWIPYIGQKIEWRPDKTNTDDIYLATAEQIVQLLMTNYEGKTAELMTHHIQHWSEQIAKLSTTVWIT

SEQ ID NO: 155076 - protein, 178 aa, Heterodera glycines
  Coding regions on vcDNA: vcDNA=SeqID_81499; Strand=+; Position=1 -71,437-644,686-943
MPSGEGPRNVHKFDFGFKEHQRIRIVNTDKFCLFYALASSMNYLIMDRFEFNRFMKNIVRQRDAAIELLRNCGIDGNEISYGVEQLPNVQKYWDEIYPGKYRVVAFEKSADPRKSIRVLWKAPMGREKVVPIFLENGHWDGLKNYVCFFNRGRKFCVECECFYDQDVYHTMDCRARCY

SEQ ID NO: 155077 - protein, 44 aa, Heterodera glycines
  Coding regions on vcDNA: vcDNA=SeqID_81500; Strand=+; Position=1 -51,98-166,399-413
MPIEEKEEKDVYRIVVRDLETLQDSIYKGDQKEHVINYISVILF

SEQ ID NO: 155078 - protein, 137 aa, Heterodera glycines
  Coding regions on vcDNA: vcDNA=SeqID_81501; Strand=+; Position=1 -46,415-779
  Homolog annotation: Hit_ID=NP_001004509.1; Match level="QueryCoverage= 84%, HitCoverage=8%, E-value=3e-10, Identity=31%"; Hit description =si:busm1-180o5.3 [Danio rerio] emb|CAD60788.1| novel protein similar to DNA polymerases [Danio rerio]
MPVKLESLKATFNLDCNVFVAEQLSIVPEKGYERCDRASVMAIKYLEWRSQRDGIEIRHTGNGREVKVGKYKLDGFIANNGARDKCIEVMGCYIHGCLNCYDPAAELIGGRTAQELNDETQERLVELRKTLDVEEVW

SEQ ID NO: 155079 - protein, 47 aa, Heterodera glycines
  Coding regions on vcDNA: vcDNA=SeqID_81502; Strand=+; Position=1 -22,1092-1213
MFLVFNRDNCKIFQELVDANCTKLADTKIIFLFYCKKKINWRIIELL

SEQ ID NO: 155080 - protein, 48 aa, Heterodera glycines
  Coding regions on vcDNA: vcDNA=SeqID_81503; Strand=-; Position=1-146
ITMSPGITHHWPLAKLSVTFTPSGLPPLPILGSDFIHNRSHAALVPEW

SEQ ID NO: 155081 - protein, 212 aa, Heterodera glycines
  Coding regions on vcDNA: vcDNA=SeqID_81504; Strand=-; Position=1 -120,295-501,547-858
MDSFVKTPKISRPLPTELLLEQIMCIPLMRLFNSNGGNQMNEIVQKFNMASRTRKVEFEGGNLDFSSLREENGLTKDEFRKGVLLYLCYGGNEKAMLVNNVAITVPILNYIFIRPLLEQLFEFILESPNPFTMQKRICVGGHHPIHLPKSLSLPARVMATKGIQPQVRSDDKEIYNLFNVHLKRVVGRVTIFYHIRFDDTFSVMSSHFVLEC

SEQ ID NO: 155082 - protein, 50 aa, Heterodera glycines
  Coding regions on vcDNA: vcDNA=SeqID_81505; Strand=-; Position=1 -89,530-593
MASIVLAVIWRTGTKTSPPSNNALLIRHPRGRNNGDGKSIMEEGLVYGNK

SEQ ID NO: 155083 - protein, 41 aa, Heterodera glycines
  Coding regions on vcDNA: vcDNA=SeqID_81506; Strand=-; Position=1-125
MELFVRQTATVRGHFQHLSVHARRFATTWRMGLYDGKRICG

SEQ ID NO: 155084 - protein, 380 aa, Heterodera glycines
  Coding regions on vcDNA: vcDNA=SeqID_81507; Strand=+; Position=1-1143
MRTKNLPSKLSNPEVLTSDESSASFESPAGTIYESFEALSIDSSKVASNLEGYTNVGAEIVIEGTESNENPAGSGYEEVRIECSSVIIACKKSPKSKPNVENSDNFMSLFENLELTDSEKLANQWEIDKILADTAPSLAGSSQIESSVIGFVCISHPILWALVQPDILGEQNELLDRKHLNLEFDQLIFQSTPSYVTAITLNPNNNWPHFTQISLNWNKQSLLGTRIKTSDLRQLTSPPKMGPSVNQIVPSSCCGIIREVIQNKITSQIIAIDVFLYGEENNQRFFTHQIDSSVNLMELEEGTRVQTTGFWAKTSAIEWQTSSDGIRDWWTEQIYVGTNLKIFGADEGEDNHQWLQNEQFLLSYRYLCAAMDLQQSPKRR

SEQ ID NO: 155085 - protein, 129 aa, Heterodera glycines
  Coding regions on vcDNA: vcDNA=SeqID_81508; Strand=+; Position=1-1083
SAPPPPFLCSNCAFPFDQFPHFFDLSANISFGQCHSPFYCLIKIARNPSNYLHPFPNLFKISPTLRGPQMVPFGQSVPSLFLIKWRTFSFDQCHFPILLFIKLPQIILVNRLLAISFDQCHPSPFILIN

SEQ ID NO: 155086 - protein, 182 aa, Heterodera glycines
  Coding regions on vcDNA: vcDNA=SeqID_81509; Strand=+; Position=1-549
MDLIRTEDGVNRMTRHLNRKINQTNRDLTELKDDTQTLITQVNTLANSYGTVQVLQKPNQAPKFNNPPILNYATPSPLKNQNNSFSNANASVLEAIPLNNSEEDSQDEEFQLNPSGFHHINMLFAQTSHSFTFTIFSGTSPLEFDRWARKFTDLLDCNGRKWDKSEKLARLKACLDGRAGRN

SEQ ID NO: 155087 - protein, 103 aa, Heterodera glycines
  Coding regions on vcDNA: vcDNA=SeqID_81510; Strand=+; Position=1-312
MRFFGIFMQKSPPIDSSTQRFVYSTIRLLYDSSTQPKCDDSSTRSNVNDSSIIRFVYSTIRLLSQNATIRLLLQKSSKTRIRTRTNFKAIFRGFLLKKAVSIV

SEQ ID NO: 155088 - protein, 85 aa, Heterodera glycines
  Coding regions on vcDNA: vcDNA=SeqID_81511; Strand=-; Position=1 -43,326-540
MLKLLISLLILNVQKIVRQGERNYKEKEKRRDSTRLFSAQWGVPIGAPMIRLLDDSSTQPKSDDSSTQPKSHDSSITRFVYSAKK

SEQ ID NO: 155089 - protein, 68 aa, Heterodera glycines
  Coding regions on vcDNA: vcDNA=SeqID_81512; Strand=-; Position=1 -77,148-277
MFNNLLPQHRHCLFLMRRLHLKTFLRPPPEIFKESQFLGLFVTLITNMTFVLLNSETWTRTRAKIQIH

SEQ ID NO: 155090 - protein, 101 aa, Heterodera glycines
  Coding regions on vcDNA: vcDNA=SeqID_81513; Strand=-; Position=1 -102,145-348
  Homolog annotation: Hit_ID=NP_509768.1; Match level="QueryCoverage =82%, HitCoverage=7%, E-value=2e-16, Identity=53%"; Hit description =SYnapse Defective SYD-2, liprin-alpha (130.3 kD) (syd-2) [Caenorhabditis elegans] emb|CAA90660.1| Hypothet
MVWSNERVIKWLEEIGLGAFVVNAVDSGVHGALMALDVTFDVPAMAHILQIPDSDSARRTLEEEFQKLVANCRGRGEPRDENGKGGSGEKQPQQHKTRSHK

SEQ ID NO: 155091 - protein, 324 aa, Heterodera glycines
  Coding regions on vcDNA: vcDNA=SeqID_81514; Strand=+; Position=1 -50,171-624,680-756,866-993,1040-1071,1442-1675
MSTAKTGIIKNTTAKTTINLLDKLANSSKGTNIVFSAAFQQNIPLGQIYVGFAGGSASPQANANDGVSSVASDQRLHFENGSEISFDQFVNSALRGETSVKGGTDQANNHLANCAANGVKREMLVPDATFMDKLRVAIRNIIQESPPNSKWNTFSRIRQNLYFDIICQVVSVHVPIAGLSVTYLRVCDGTKADIEDGHSFYSGVSFRETHAVQSQLFPEEAITDECKEFIYLIGCWDTFCTTAMGIEAGDIIKIFNAKMKTRQDNVIHFSLHGHTPNSEGRYKRAIECVRKAKRRIGDEMAMNGGTENEGDGTGGKRTRQSEDS

SEQ ID NO: 155092 - protein, 143 aa, Heterodera glycines
  Coding regions on vcDNA: vcDNA=SeqID_81515; Strand=-; Position=1 -171,266-523
  Homolog annotation: Hit_ID=CAE56950.1; Match level="QueryCoverage =87%, HitCoverage=85%, E-value=2e-35, Identity=56%"; Hit description =Hypothetical protein CBG24799 [Caenorhabditis briggsae]
IERERGVKIFLFTLFLRYLKMCPEAKERYHKLNGLDIDSPCSEPAFETIASNYLKVFVFDEVISAVEQTPADASSACQRLSSIGKMHRSKVNGIKFDDFQQLEAPFLYMIGEVLQDRFNEKAEMLFRKFFQFCLRFILEGFNS

SEQ ID NO: 155093 - protein, 218 aa, Heterodera glycines
  Coding regions on vcDNA: vcDNA=SeqID_81516; Strand=-; Position=1 -512,954-1098
  Homolog annotation: Hit_ID=EAK84409.1; Match level="QueryCoverage =61%, HitCoverage=11%, E-value=4e-11, Identity=38%"; Hit description =hypothetical protein UM03179.1 [Ustilago maydis 521] ref|XP _400794.1| hypothetical protein UM03179.1 [Usti
MGMPPAPPSLHSPLVGVRSPCEGGVPGPFPGGGGGMPSAASALPPGAIMGMPSPYGTMPPGMTTNNPNMNMMMLQQQQQLQLQHQQQQMMCHQQQQQQHHHQQQQMNAAAASACMNTQQQQQLQHQQDAIFKGGPPNTDWDLRVAQAGIYGTYVANSLINSSEQMIIAGHAAWPFALVTEACLVAARIRHVHAAVHADADAGAANPTQRAVPSVPLGT

SEQ ID NO: 155094 - protein, 161 aa, Heterodera glycines
  Coding regions on vcDNA: vcDNA=SeqID_81517; Strand=+; Position=1 -55,118-344,827-1015
  Homolog annotation: Hit_ID=AAG21337.1; Match level="QueryCoverage =96%, HitCoverage=96%, E-value=4e-71, Identity=94%"; Hit description =hypothetical esophageal gland cell secretory protein 8 [Heterodera glycines]
MISRRAIIIWAIALLALAAISPNISPNFSTADKGVDAVDAADEIIDDPKVEVPKNGVGKGTDDQTVQREEEAIKLEGLSVAEFKQLRESAEKHQFQAEVNRMMKLIINSLYRNKEIFLRELISNASDALDKIRLISLTNSTALAATEELSIKIKAKNFQNF

SEQ ID NO: 155095 - protein, 385 aa, Heterodera glycines
  Coding regions on vcDNA: vcDNA=SeqID_81518; Strand=-; Position=1-1156
  Homolog annotation: Hit_ID=NP_920205.1; Match level="QueryCoverage =83%, HitCoverage=21%, E-value=4e-36, Identity=32%"; Hit description =putative DNA helicase homolog [Oryza sativa (japonica cultivar -group)] gb|AAP52492.1| putative DNA helica
MHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKEESGNKIKIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWSDQMRWLFVSILVYGQPSNAIELWNKYKDQMYNPQGIITLAQHKVAELEALADIDWRLHSCFNLS

SEQ ID NO: 155096 - protein, 75 aa, Heterodera glycines; identical to SEQ ID NO: 124542
  Coding regions on vcDNA: vcDNA=SeqID_81519; Strand=-; Position=1-225

SEQ ID NO: 155097 - protein, 481 aa, Heterodera glycines
  Coding regions on vcDNA: vcDNA=SeqID_81520; Strand=-; Position=1 -78,119-811,860-1169,1273-1634
MNYSKLVFLLIFSISLISTAKEAKPLFNDDNVLLAFVKGSSKFEHFLADEKFDYNQSEKEILEQNYEKKLGLIFFMRKHWHCAKIGTDFEEYEQRECRKFRKYLDILYEYLFRVYAGLPVVKPQFYFGKTFTICLVTEVVQSLAPIWNFYFCPNFASGKGHKLDKLFVRNYELKLYNEQRLNYGAHLDNNHHKEKFQGIFVEMALQNANYAFRHNFDTFLAEMLKRAEKGSLHFPILITNNDGSLMIEQLAFESYFLTGERLFVEFVRGQSYFEQFCCDLERDGKLKDFVMAQEATLEEKQNFLAKEYETYLGILYLMRHNWHCDKKGEEIGEEKWRTKCERFHKYTNIVYEYLFKVYAKTEEPLLGQQFPVFKPTFNVSTLINEVLLYLHKCSVLFFDEELRNQNYYIFKIQLQNGHKLRNYKANFGTLEESLRKKFDKKLKTMLKKARENERRTREWSANYNDSSNLLWESPFFHRVSR

SEQ ID NO: 155098 - protein, 26 aa, Heterodera glycines
  Coding regions on vcDNA: vcDNA=SeqID_81521; Strand=-; Position=1-83
HHRVAIVTRKTIRRIDSNEWTMKKHN

SEQ ID NO: 155099 - protein, 170 aa, Heterodera glycines
  Coding regions on vcDNA: vcDNA=SeqID_81522; Strand=-; Position=1 -96,216-391,599-837
MSAAQVECQRRVTQLKRRAVETCEAPATIRAQVIKHVRHDEDVPPAAPLSLDALELPPSYRMYNRTENDEENFLLAYTGVFQIQGQAGPQRRDKWVFPIAYCLLTSKCEMIYTRMLQLIVQKWPNFAPETISLGFEQAVVAAVRTMLPLCRVQFCFFHLVGNMKKRIAAE

SEQ ID NO: 155100 - protein, 16 aa, Heterodera glycines
  Coding regions on vcDNA: vcDNA=SeqID_81523; Strand=-; Position=1-57
FFASLVNHNFFKKHPN

SEQ ID NO: 155101 - protein, 491 aa, Heterodera glycines
  Coding regions on vcDNA: vcDNA=SeqID_81524; Strand=-; Position=1 -818,861-1516
  Homolog annotation: Hit_ID=AAO52302.1; Match level="QueryCoverage =94%, HitCoverage=58%, E-value=1e-14, Identity=19%"; Hit description =similar to Homo sapiens (Human). Dentin sialophosphoprotein precursor [Contains: Dentin phosphoprotein (De
MYSEEEIRFNAQAMIRENNETNEEEALFQDEISMSISSGESPKRHKNDSVDSEKEIQSRLNDQAMTRQNKEINNENALSYGEKQSSFSKEINVHDQYEKTMASDELEEGEIEPEIRDKELPCWGNESDSNAANYHSKNNTLPSPSEKRQEYNKDHRHIAVEKQRQGREWTDRSKHRRRSQSPERAEKQRQGREWTDRSKHRRRSQSPERAEFNDSSKRQDLYLRNTSKDKDLRVRSDHRKLTNSRKNCRSNYSPDQHWQESPSKRRLILPENRAPVRFQIKKQSKPVNKHALDPDHNKTNIQSPNVKPRNNETSCSQQISSEQTHAETNIEKHEEQGNKKALDAELINDKSPNLQPSNEILSGAEKADKEVPNVEASNMEINSENEQLRMRNQQANIQETYADPMQLEANIETVQVQRRLTKKASIDLPESSHRGQINNEPTYSQRLEYIRTSLEHANIESSNSKDKEIVDPPATTAATNDQLQFLLSQIQ

SEQ ID NO: 155102 - protein, 206 aa, Heterodera glycines
  Coding regions on vcDNA: vcDNA=SeqID_81525; Strand=+; Position=1 -139,1402-1500,1751-1833,2071-2198,2428-2598
  Homolog annotation: Hit_ID=A88852; Match level="QueryCoverage=79%, HitCoverage=2%, E-value=1e-30, Identity=45%"; Hit description =protein unc-22 [imported] - Caenorhabditis elegans
HSHPAVLPEMRTIGHRQLFHSHCERLRLGFGGLAPGGGRSPCTARRALRRANDEHETESSAVDEDEYVVESDDDIPAVEHRSSVDMRRESLAEILDLGTSGTPARIGASLFPGKREERWVDPLPEKLQFQQQKNKIAELKCKYSRANAKVHWYKGRKELFSDCLKYKILIDKQSITLIINNPDPDDSGKYSCEANGVPTNSFITVE

SEQ ID NO: 155103 - protein, 254 aa, Heterodera glycines
  Coding regions on vcDNA: vcDNA=SeqID_81526; Strand=+; Position=1 -136,362-532,837-948,1012-1045,1763-2044,2174-2203
  Homolog annotation: Hit_ID=CAA33463.1; Match level="QueryCoverage =53%, HitCoverage=2%, E-value=2e-27, Identity=50%"; Hit description =twitchin [Caenorhabditis elegans]
PKAGEPPTEVPQERWVDPLPEKLQFQQQENKFAELKCKYSRANAKVRWYKGRKELFSDGLKYKILIDKQSITLIINNPDPDDSGKYKCEANGVPTNSFVTVEDSTDQQPLSYTARRSESRRPKSARKEAAALTPLDAMQCSHLTPPHPKNTVRCADEPLLANAPFNVPGRPYPPDSLYTTYNSIMLHWAPPLRDGGTPITEYELEKREHGTKLWEKADTNADPKANTKKQWEKDAFANVPDTRFKQFFAKTENR

SEQ ID NO: 155104 - protein, 221 aa, Heterodera glycines
  Coding regions on vcDNA: vcDNA=SeqID_81527; Strand=+; Position=1 -196,292-449,488-633,680-768,1287-1363
  Homolog annotation: Hit_ID=CAE58677.1; Match level="QueryCoverage =87%, HitCoverage=21%, E-value=6e-33, Identity=39%"; Hit description =Hypothetical protein CBG01851 [Caenorhabditis briggsae]
MFFKVIPFAANEEHCSKLVNGDYLKPAKFIFNELLITKELAKLSENTGIGVTPTFTQLLMSKIVRGCFPPELLTAWDAFKKRKPELAENERPDTYADEGLHFIVIGLSYGGKDLEAYTIKNGRECYSIFHQIALSIAIAEDVLKLEHRDLHAGNILVEECSVDEKIRYKYLGKQIAVRSNGVRASIIDYSISRIEKTKFHPIYENFSSPNSYSVFVCSLAL

SEQ ID NO: 155105 - protein, 148 aa, Heterodera glycines
  misc_feature (53)..(53): Xaa can be any naturally occurring amino acid
  Coding regions on vcDNA: vcDNA=SeqID_81528; Strand=-; Position=1-497
  Homolog annotation: Hit_ID=NP_917837.1; Match level="QueryCoverage =100%, HitCoverage=7%, E-value=5e-21, Identity=40%"; Hit description =B1158C05.18 [Oryza sativa (japonica cultivar-group)]
NRRTDSGMPHHCLQLKVGSVVVILINKSDREGLINGTRIVLEELGDDHLVGRXSINSNAIGGQVRCFLERSRNIFEDKTPGGLKYARLQFPIKPAFAMTIQKGQGQTIRTVGIYQEREVFTHGQLYTAFSRATDGNNVRVHAPKREID

SEQ ID NO: 155106 - protein, 53 aa, Heterodera glycines
  Coding regions on vcDNA: vcDNA=SeqID_81529; Strand=+; Position=1 -104,393-450
MAVRKRPGPENPCVGFAILKSFKFRDVKSKMFPKRSRGAQEKIMKTYKSYPYR

SEQ ID NO: 155107 - protein, 76 aa, Heterodera glycines
  Coding regions on vcDNA: vcDNA=SeqID_81530; Strand=+; Position=1 -150,593-673
MLTDEEEEENEDFGEESNGEEMSEGKGEEEERMAERFGGEEQRQDEEEEESFANSRRVEHPIRRQPTDPNFDEQSA

SEQ ID NO: 155108 - protein, 87 aa, Heterodera glycines
  Coding regions on vcDNA: vcDNA=SeqID_81531; Strand=-; Position=1 -153,203-313
MPKMEKIPKSEIKKCLICGGLSSFKYYSIPSCEGIVMAQALFDERNLIFKLRVNSFFVAQLCYRYYTCAKKAEIANCYLHTTVIVLE

SEQ ID NO: 155109 - protein, 481 aa, Heterodera glycines
  Coding regions on vcDNA: vcDNA=SeqID_81532; Strand=-; Position=1-1446
  Homolog annotation: Hit_ID=CAA82797.1; Match level="QueryCoverage =47%, HitCoverage=33%, E-value=7e-14, Identity=24%"; Hit description =gag protein [Ascaris lumbricoides]
MPKTSTPLNQRDQHGQRKEAVLQVHEAKPPRIKCARPSKCYHCKRRHPTALCRDQYKAKNGINTPSTSCSEEKPNANDGKRSTVIEQQQMCNAIQSKETRALLMTTKAAIFNPSRPSLSMMGTIFIDPGSHRSFISSSAAEQLDMNVLSTEECYLSSFGEREPKRYISDRVAIGILCPDQDRFIFNLNALKFLLNDLPVLQLNALDNDELQQKKLSLPNESRQPDILLGMDVWHQLNVQPIEQLPSGFTICQSKIGNIISGTGRIKLKQPSNISFVLMVNNDESPQSSKTAQRQKNIQQKEKDELRRHQRNKLLSSIATLRSRRKRESAPISSKSIVIDLSSDSDASGIEIIQNPVRDRQAKSPNEHSTAPIPMAVQRLTPTRKSSSVAKRPAFSSSKQPKGKAANPAQTSQTNELNRKMKALSPTASGSGANHHCVATLARSSDSTTVIDKGSQQNCLNMSSATISKTPCQQHSSEKTLN

SEQ ID NO: 155110 - protein, 88 aa, Heterodera glycines
  Coding regions on vcDNA: vcDNA=SeqID_81533; Strand=-; Position=1 -126,554-694
MVVSRATRFTYVEQQHTKHQNNCQNWHNSDLRVHFVVLMMVMICPNLEVSNLKKKIFRLLRSFGVRHPNIWMEPNMDIPHRPSNLSQT

SEQ ID NO: 155111 - protein, 40 aa, Heterodera glycines
  Coding regions on vcDNA: vcDNA=SeqID_81534; Strand=+; Position=1 -62,155-213
MPTNLFMETEWPKNTKNGGQHPTIEYHFVIFLEKEKCLVE

SEQ ID NO: 155112 - protein, 205 aa, Heterodera glycines
  misc_feature (2)..(2): Xaa can be any naturally occurring amino acid
  Coding regions on vcDNA: vcDNA=SeqID_81535; Strand=-; Position=1 -28,853-884,936-1191,1238-1337,1386-1471
  Homolog annotation: Hit_ID=CAE74210.1; Match level="QueryCoverage =99%, HitCoverage=44%, E-value=3e-32, Identity=41%"; Hit description =Hypothetical protein CBG21892 [Caenorhabditis briggsae]
FXVKKIRRIFTVLGIRGFYRGFFSSLMLYIGFFSSLMLYIPSAMVFWFTYYTFLTRLKSLRGEWKISAKSSGKNTVNIRGDSENLLVLQAFSGALGGICASLFTNPLEVLRVRIQVHRTNYWETVHRTNYWETIRRLYHFEGFRVFTKGLAPRMISSGINSCLILTGYEVIKRLCVLINSCLILTGYEVIKRLCVLPEFRDAIVW

SEQ ID NO: 155113 - protein, 32 aa, Heterodera glycines
  Coding regions on vcDNA: vcDNA=SeqID_81536; Strand=+; Position=1 -38,115-175
MRTQLFTIWFFFLILPDFAYRHYKDHKPPQFI

SEQ ID NO: 155114 - protein, 45 aa, Heterodera glycines
  Coding regions on vcDNA: vcDNA=SeqID_81537; Strand=+; Position=1-135
FLNNSHRCASIQKKEKIFGTKLVNQYIKKSIGNLSVVFLSISVLS

SEQ ID NO: 155115 - protein, 158 aa, Heterodera glycines
  Coding regions on vcDNA: vcDNA=SeqID_81538; Strand=-; Position=1 -21,613-687,754-975,1029-1144
  Homolog annotation: Hit_ID=NP_501793.1; Match level="QueryCoverage =97%, HitCoverage=26%, E-value=3e-27, Identity=38%"; Hit description =SH2 motif and protein kinase family member (kin-5) [Caenorhabditis elegans] emb|CAA93289.1| Hypothetical
DVMEEGLGLTHIHSKGIIHCDVAARNCLYTDGQVQVKISDFGMATKALSKQLESGAKLPVKWMSPDALTDHFFTQKDDTWAFGVLCWEVFTNGETPFAEMRGSVILAAVTNGYRLEFPNVTNGYRLEFPNDAPPKFVEFVMQHIWDPKRNNRYSMGAV

SEQ ID NO: 155116 - protein, 63 aa, Heterodera glycines
  Coding regions on vcDNA: vcDNA=SeqID_81539; Strand=+; Position=1-192
HKNGTDVEAALEARLSSAKDNLIRFGDEIYIKLSGDHGQSCMKITVSFSQAARSNSPSNNFVL

SEQ ID NO: 155117 - protein, 51 aa, Heterodera glycines; identical to SEQ ID NO: 124998
  Coding regions on vcDNA: vcDNA=SeqID_81540; Strand=-; Position=1-155

SEQ ID NO: 155118 - protein, 229 aa, Heterodera glycines
  Coding regions on vcDNA: vcDNA=SeqID_81541; Strand=-; Position=1 -10,555-1234
MIAQKEKLSTMKLCLFSILIVFLIAQIEIVAEKKKLEQKTFEEIFGEKWEEKENEQKKREIVQKFNKIKEKIKQKERKYSTKEWNKINDKILKKLGTNRKIIYQWIKELRIYKYQCKLKTDEQKIEIVQKFNAMKNEYKQKGRKYSTKEWSQNYEEICKKIGVSYGTIQKWKKQFGMGERMTEKEKMEKVKMYWQIKRENPKISAEKIAKILKINRRTIDKWKKQFGEE

SEQ ID NO: 155119 - protein, 16 aa, Heterodera glycines
  Coding regions on vcDNA: vcDNA=SeqID_81542; Strand=-; Position=1-47
SHSPGKKYGFPYNWTP

SEQ ID NO: 155120 - protein, 79 aa, Heterodera glycines
  Coding regions on vcDNA: vcDNA=SeqID_81543; Strand=+; Position=1 -186,615-668
MAIKYGPKIAKYGHKMAKISKYGNKWQKCQNMDINFSKLNVKFLQIYWLKLHMRYISKFFDSTSHSPGKKYGFPYNWTP

SEQ ID NO: 155121 - protein, 47 aa, Heterodera glycines; identical to SEQ ID NO: 150674
  Coding regions on vcDNA: vcDNA=SeqID_81544; Strand=-; Position=1 -40,88-191

SEQ ID NO: 155122 - protein, 219 aa, Heterodera glycines
  Coding regions on vcDNA: vcDNA=SeqID_81545; Strand=-; Position=1-660
MKLCLFSILIVFLIAQIEIVAEKKKLEQKTFEEIFGEKWEEKENEQKKGEIVQKFNKIKEKIKQKERKYSTKEWNKINDKILKKLGTNRKIIYQWIKELRIYKYQCKLKTDEQKIEIVQKFNAMKNEYKQKGRKYSTKEWSQNYEEIGKKIGVSYGTIQKWKKQFGMGERMTEKEKMEKVKMYWQIKRENPKISAEKIAKILKINRRTIDKWKKRFGEE

SEQ ID NO: 155123 - protein, 63 aa, Heterodera glycines; identical to SEQ ID NO: 155116
  Coding regions on vcDNA: vcDNA=SeqID_81546; Strand=+; Position=1-192

SEQ ID NO: 155124 - protein, 60 aa, Heterodera glycines
  Coding regions on vcDNA: vcDNA=SeqID_81547; Strand=+; Position=1 -58,936-1060
MHKLTSQNKVEICKNSYFIFTGSENYLILSVIDLTHEFCEAHNIIQNYYYSLRFVVDRPH

SEQ ID NO: 155125 - protein, 91 aa, Heterodera glycines
  Coding regions on vcDNA: vcDNA=SeqID_81548; Strand=+; Position=1 -129,440-572,792-805
MPLIFLLSFFLQILLFWFIEGHAGPIVARELMGELFETYKTDMHEEDDEQPSEVSVVNKKGKGSFSSQSTGSLDDDTYGGIAQRFGNVTIV

SEQ ID NO: 155126 - protein, 44 aa, Heterodera glycines
  Coding regions on vcDNA: vcDNA=SeqID_81549; Strand=+; Position=1-135
FALSDHSFFSPFLLISFLITFSPPPAFDHFFYCLSDHSNFCSFR

SEQ ID NO: 155127 - protein, 400 aa, Heterodera glycines
  Coding regions on vcDNA: vcDNA=SeqID_81550; Strand=-; Position=1 -139,240-318,476-512,568-705,977-1000,1065-1212,1309-1383,1456 -1541,1590-1731,2195-2376
  Homolog annotation: Hit_ID=NP_509897.1; Match level="QueryCoverage =99%, HitCoverage=30%, E-value=1e-109, Identity=50%"; Hit description= guanylyl cyclase (gcy-9) [Caenorhabditis elegans] emb|CAA91488.1| Hypothetical protein ZK455.2 [Caenorha
LSVYSLKNSLKETLIEINTEVEFDPYMTADEIIATGRLKHLRTRARIVIVEMGMDLHSVTAFMIAAYRSGMKTSDYVYIIPWLAHMNDHYPWESTNVEKQEVKMNDHYPWESTNVEKQEVKAAFDDAIVITAHGYDKKFIEDFERRFNMVTGVVSNHYATLSYMSLYDALYATLSYMSLYDALFLYGLAIRDAFEETKNKTIYLDGKTVWRKMTGRQFIGATGQVLMNNKAIRVPSYATYHTKNGTMTMKIVVELTARLGDRLKCLKMEHDCSEHVAHEVLSHYWSSSDGYMPVAHEVLSHYWSSSDGYMPTDMPRCGFDDSLCDYTAMYVLGSALLFLAVVIPFGYFLYVREKERMLYDMTWRIPREQIKLLGEGGKHQRRSDPSLGKSMGASAGSMVA

SEQ ID NO: 155128 - protein, 49 aa, Heterodera glycines
  Coding regions on vcDNA: vcDNA=SeqID_81551; Strand=+; Position=1 -43,639-745
MQKSDGRPCHFGGRNNGRKTEEKKQWQKRKQCQRRRKRRYHLNKRKKME

SEQ ID NO: 155129 - protein, 191 aa, Heterodera glycines
  misc_feature (22)..(22): Xaa can be any naturally occurring amino acid
  misc_feature (42)..(42): Xaa can be any naturally occurring amino acid
  misc_feature (48)..(48): Xaa can be any naturally occurring amino acid
  Coding regions on vcDNA: vcDNA=SeqID_81552; Strand=-; Position=1 -30,791-1075,1141-1230,1284-1381,1555-1575
  Homolog annotation: Hit_ID=NP_509897.1; Match level="QueryCoverage =97%, HitCoverage=15%, E-value=4e-41, Identity=52%"; Hit description =guanylyl cyclase (gcy-9) [Caenorhabditis elegans] emb|CAA91488.1| Hypothetical protein ZK455.2 [Caenorhab
ISIHSIQLFLNRWCSNCAPAIXKSATFCRSRNLQVNQLMANXHLMGLXLNSIDNQLNVKAKSAALFICQVYTMESCNRFSGVEHSAYLHYLRNASVYFGPGCNNEMLMLVIGRLVSRWNVPIVAHLSGDDALSDRTVFDTLGSVALTSATEMFDTLGSVALTSATEMARATITFLHLYGWKQVNIIRNNQL

SEQ ID NO: 155130 - protein, 76 aa, Heterodera glycines
  Coding regions on vcDNA: vcDNA=SeqID_81553; Strand=-; Position=1-422
SHGLGKTVNFTTRMDSIRRNFCKYLKTFKNSGKTIFLQFFQHGFVSVPCRPVSTIVQLQLRCEPSAVRGSSTHCTW

SEQ ID NO: 155131 - protein, 96 aa, Heterodera glycines
  Coding regions on vcDNA: vcDNA=SeqID_81554; Strand=-; Position=1 -53,321-558
MTLFRPISIAKLPHSFDGPRWLYFNKYGKQFLIVCSQQRSDQQQNLPPFLAAQLDENNDQPKQKRTKKKAVGMAKRTKTGAGNNKWKRPGKGATTK

SEQ ID NO: 155132 - protein, 74 aa, Heterodera glycines
  Coding regions on vcDNA: vcDNA=SeqID_81555; Strand=-; Position=1 -210,473-487
MMHNRVAETLSRFWHCVVWHPMTHPLISDHKGFVRRKSGTLKKQIRKEQLIVWKQTLSFCHCFPTSIKYSIVPD

SEQ ID NO: 155133 - protein, 137 aa, Heterodera glycines
  Coding regions on vcDNA: vcDNA=SeqID_81556; Strand=+; Position=1 -116,174-471
MQQLLFFLLLVADISHGKGQKEEKSEAKCDEKNNNEAIRLHNWGGNFKFCTQNVEYPRTTAEVQQIVRRAQKLRVFGSRHSYNKIADSCGTLLSTLGMNSIIAINGSRPTVTVQPGITYTDLAPTLCQLKMENKSGI

SEQ ID NO: 155134 - protein, 34 aa, Heterodera glycines
  Coding regions on vcDNA: vcDNA=SeqID_81557; Strand=+; Position=1 -6,533-631
MRNMNSAFALLSTNSSPLAHTYNCFPKRVYCTLI

SEQ ID NO: 155135 - protein, 135 aa, Heterodera glycines
  Coding regions on vcDNA: vcDNA=SeqID_81558; Strand=+; Position=1 -197,258-319,362-401,457-482,524-607
  Homolog annotation: Hit_ID=NP_508418.2; Match level="QueryCoverage =94%, HitCoverage=30%, E-value=1e-11, Identity=28%"; Hit description =salvador (XC902) [Caenorhabditis elegans] gb|AAB37990.2| Hypothetical protein T10H10.3 [Caenorhabditis el
HVDQRSQFDHPGFINGAFLPTIHGSSSFQSLLENEQEQNCNKDDREADEESDFLGEEDLNLINNEDVPEWLKLYSQAPFNSDHMLNFNLFKLNQLEAYDRMIMRLYKQDVINTVVKYEGPMSEIDNELMQRHNLT

SEQ ID NO: 155136 - protein, 206 aa, Heterodera glycines
  Coding regions on vcDNA: vcDNA=SeqID_81559; Strand=-; Position=1 -140,214-370,706-783,853-936,1209-1370
  Homolog annotation: Hit_ID=NP_498950.1; Match level="QueryCoverage =98%, HitCoverage=98%, E-value=1e-27, Identity=34%"; Hit description =putative nuclear protein, with a coiled coil-4 domain (28.9 kD) (3J918) [Caenorhabditis elegans] gb|AAA28
MPHSRSTTPNTNRDRSHRSNRKRSRDRSSEKRQKASRSSHKDRRRDRSRSSSRHRDSAADSARIYAPSDVAVELGSGNVNMARLDKRAVEWLQSKINEQIEMEKRLRQQIEAELKEEMENIHRREKESQERCNAMERALETKIKELEKAERKLNDERLEMLESKRRYEEERIELEKQRENVKKTEQQSILNKGGLMREKIRLSFGK

SEQ ID NO: 155137 - protein, 229 aa, Heterodera glycines
  Coding regions on vcDNA: vcDNA=SeqID_81560; Strand=+; Position=1 -113,320-410,598-925,982-1017,1439-1560
MGISLTTLLSQTLSKNGQRANKKGTTALTPLETLNSSRQLLVAVSTVRCATFACSAKTTTVFCSAAAPLRKHASPCFPFGWICYLGPVILWVSLFSPFCLWVALCRWFFGYDSLFNALLSVMFSISAASSFAAFGFFVFQVGSLIITLVTSVFVQMIYTLNGYTMHDFHRAGLRRMESEDFRERLALVFDMAAKEYIRNDNMNKRKTNPNKEKGKAMRIWGWGGQEMFS

SEQ ID NO: 155138 - protein, 99 aa, Heterodera glycines
  Coding regions on vcDNA: vcDNA=SeqID_81561; Strand=-; Position=1 -16,396-491,602-743,1175-1220
MRISTVEVISTSNKRLQVRPLRRGGNGWTRNVAFAWRALKEPITCASLPAQLFRYARTFRAVEFGLRIADPFLRSLDYVVYVMRMRRILLRLRRAQEMP

SEQ ID NO: 155139 - protein, 182 aa, Heterodera glycines
  Coding regions on vcDNA: vcDNA=SeqID_81562; Strand=+; Position=1 -38,93-198,496-734,902-1023,1065-1107
  Homolog annotation: Hit_ID=CAE57871.1; Match level="QueryCoverage =85%, HitCoverage=10%, E-value=8e-20, Identity=35%"; Hit description =Hypothetical protein CBG00911 [Caenorhabditis briggsae]
EKQSGFAVKLAVDANFGCWGKENRDCVKCRNFTMEHNVCAEQCHTERGHFIVSLSSADSAPVRHCLRCHEQCHECYGPSARQCSKCQNFQLWLNTALPLADNPYVDAGTAGAVKQCVAKCPNMTYPEDDVCVPCHKACRGGCTGPSARVGTGGCNQCNYALEGEHFGEYICLFGDEPEKAVC

SEQ ID NO: 155140 - protein, 68 aa, Heterodera glycines
  Coding regions on vcDNA: vcDNA=SeqID_81563; Strand=-; Position=1 -88,776-894
MVSKTGIFKAPKLHNVLKVGLEILNLIKQDKHNKTPISKMAFDVCFCLLIKWKMPKNDGRTVARQNSF

SEQ ID NO: 155141 - protein, 502 aa, Heterodera glycines
  Coding regions on vcDNA: vcDNA=SeqID_81564; Strand=+; Position=1 -544,587-773,793-938,985-1062,2080-2083,2338-2888
FIGGDISFIWSLIGHCGSAVTTFPSPICTCRADQMLHEQCCQHRTIDQTVELAEQYRAALQNGDKATAAVRSASMGITKPPLLRSINFDRIIPAPFHVFQGIGNAIVRELERQEGCAPIVQQFFRRIGARREQFRKRDLTGNSIRKILVRAKEMAELFTMEWPKAICRTLEHLGKIQNFSKAQMLSPNDLDGLERSIDNFKVFLAEQDRMSAFLSKKPKAHLLLFHFVPFARKHQFIGLLDEQGDEALHSVWRRLEQWWKCMPDAEQILQQLEHHFVNNWLLDTGRIDELKRNYEERKGEDDTDEEVAEEIDDECQIDLGVQSLGLYSPAFQSLGLNPPAFQSLGLNPPAFQSLGLNPPALQSLGLNTPAFQSPGLNSPGLQSLGLYSPAFQSPGLSFYAFQSPGLILLHFNYWDSTLQHFNHWDSILLHFNHWDSTLQHFNHWDSILLHSNHWDLTSPGPSASQSSRLNSAKFQSPELNSATFQSLGLNSPSFQSLGPNLT

SEQ ID NO: 155142 - protein, 153 aa, Heterodera glycines
  Coding regions on vcDNA: vcDNA=SeqID_81565; Strand=+; Position=1 -195,307-572
  Homolog annotation: Hit_ID=NP_387001.1; Match level="QueryCoverage =98%, HitCoverage=30%, E-value=4e-49, Identity=62%"; Hit description =PUTATIVE XYLULOSE KINASE PROTEIN [Sinorhizobium meliloti 1021] emb|CAC47474.1| PUTATIVE XYLULOSE KINASE P
MFLGIDLGTSAVKVLLISADQSVVGSASVPLKVSRPFDGWSEQCPSDWLRATREAIDQLRHSNPKAFAFCALRGIGLSGQMHGAVLLDAAGVTLRPCILWNDMRSHREADELNADARFRSITGNAVFGFTAPKLAWVRRNEPKIFAKIRWKKG

SEQ ID NO: 155143 - protein, 198 aa, Heterodera glycines
  Coding regions on vcDNA: vcDNA=SeqID_81566; Strand=+; Position=1 -225,488-674,721-905
  Homolog annotation: Hit_ID=ZP_00195070.1; Match level="QueryCoverage =98%, HitCoverage=39%, E-value=2e-63, Identity=62%"; Hit description =COG1070: Sugar (pentulose and hexulose) kinases [Mesorhizobium sp. BNC1]
MGVILSATDSLNWLTKATGASPDELTAELGGDLNAPGAVIFLPYLSGERTPHNDAIIRGSFTGLSHQTDRKALTQAVLEGVAFAFRDSLEALCKSGTKMPSRIIATGGGVRCAYWMKLIATVLGVQIEVPTEESGNLGAAFGAARLGIIAAEGIDPLSVCEPPTIGQSFSPNEQLREAFERNYRRYCALYPALRAIDQ

SEQ ID NO: 155144 - protein, 59 aa, Heterodera glycines
  Coding regions on vcDNA: vcDNA=SeqID_81567; Strand=-; Position=1-232
LIWTCKSTTFFRSFFVARFSKKFWGTDGVGGGMPTGATVEIFKYFVKKLLLISFQLSDH

SEQ ID NO: 155145 - protein, 30 aa, Heterodera glycines
  Coding regions on vcDNA: vcDNA=SeqID_81568; Strand=-; Position=1-90
TFKGFTGTGFPAVWLTGSMLNLKVVYSGKA

SEQ ID NO: 155146 - protein, 21 aa, Heterodera glycines
  Coding regions on vcDNA: vcDNA=SeqID_81569; Strand=-; Position=1 -25,642-679
MQIREKGKGSVLAVTMSDPNT

SEQ ID NO: 155147 - protein, 208 aa, Heterodera glycines
  Coding regions on vcDNA: vcDNA=SeqID_81570; Strand=+; Position=1 -151,481-593,640-800,856-960,1012-1108
  Homolog annotation: Hit_ID=NP_494893.1; Match level="QueryCoverage =91%, HitCoverage=56%, E-value=1e-76, Identity=69%"; Hit description =small glutamine-rich tetratricopeptide (36.5 kD) (2F192) [Caenorhabditis elegans] gb|AAA83170.1| Hypothet
MAANENMQTEDNKKGKVTNDERNLVVSFIQFLRHKVSSNQCTDEQIEGLEVAIQCLETAFFVSDRNYAFQPSKPLIEIFKAAEGLPDGDQEFPKPTQTDVEKSNALKEEGNELVKSNKFEEAILKYNEAIKLNRDPIFFCNRAAAYCRLEQYDLAIQDCRTALALDPKYAKAYGRMGVALSCQNRYDHAVEAYKKALELDPGNERYHE

SEQ ID NO: 155148 - protein, 43 aa, Heterodera glycines
  Coding regions on vcDNA: vcDNA=SeqID_81571; Strand=+; Position=1 -48,710-793
MTKCYPWSRIQYYRHSVPFRHWATQWQKFVDPSGWGGWQSAKI

SEQ ID NO: 155149 - protein, 134 aa, Heterodera glycines
  Coding regions on vcDNA: vcDNA=SeqID_81572; Strand=-; Position=1 -154,220-413,1240-1263
  Homolog annotation: Hit_ID=CAE71524.1; Match level="QueryCoverage =100%, HitCoverage=65%, E-value=3e-31, Identity=45%"; Hit description= Hypothetical protein CBG18459 [Caenorhabditis briggsae]
ALNCYICAENGLDEFGECKTSFPFSCDGYAKRFPKDEKIFCRTTRHKTANGGTFTVVKECIATFTVVKECIADSAHHVTFPRKPYQLAEECDVVDLNGVEVAYCLCGDQNLCNGEAIVGQFSAFEENDKEKIGE

SEQ ID NO: 155150 - protein, 76 aa, Heterodera glycines
  Coding regions on vcDNA: vcDNA=SeqID_81573; Strand=+; Position=1 -138,223-315
MSLSPYQMKSAKRKNLKNDQSLPVFVQVDDISSSVDLGNDGINPEQHSNTNSMESNSKEIEMREHLEEIESQTTRR

SEQ ID NO: 155151 - protein, 111 aa, Heterodera glycines
  Coding regions on vcDNA: vcDNA=SeqID_81574; Strand=+; Position=1 -172,266-336,963-1055
  Homolog annotation: Hit_ID=A34043; Match level="QueryCoverage=34%, HitCoverage=26%, E-value=2e-09, Identity=63%"; Hit description =hypothetical proline-rich protein 1 - polychaete (Owenia fusiformis) (fragment) sp|P21260|YPRO_OWEFU HYPOTHETI
MRSSGVRARRRAAHPPLRPPPPSPRPPPPSPRPPPPSPRPPPPPQKSHGHGNGTYWCLGLWCRYRRSRTGPDDVESQAPVAALVDSIVISPPTDSLQIFNSPDVQAMTRKQ

SEQ ID NO: 155152 - protein, 148 aa, Heterodera glycines
  Coding regions on vcDNA: vcDNA=SeqID_81575; Strand=-; Position=1 -95,290-485,697-852
MSSENPPSPMQRQQSSVQRQQSSVSDMGDPDELSSNTSERLEQCHFTQILFQVQVIFRLGRIRRKAQGPGSQENEQISFLMFFFAGLFFILPCVDECVVFYRVFNATQAVMMGNISSSTTLLAQTTLRHVLDTKTLSEILGNFLVEQP

SEQ ID NO: 155153 - protein, 24 aa, Heterodera glycines
  Coding regions on vcDNA: vcDNA=SeqID_81576; Strand=+; Position=1-76
ITGVSIIAVLFLVFLMPSQNLVRF

SEQ ID NO: 155154 - protein, 31 aa, Heterodera glycines
  Coding regions on vcDNA: vcDNA=SeqID_81577; Strand=+; Position=1-98
TICSRLNAGRDTFHKTEGLWALLNHLLYTHM

SEQ ID NO: 155155 - protein, 48 aa, Heterodera glycines
  Coding regions on vcDNA: vcDNA=SeqID_81578; Strand=-; Position=1 -82,153-217
MNTTNNGTLKWTVVIGFFDRNLGFRNKKKIYALFSHESNLEIINALIL

SEQ ID NO: 155156 - protein, 41 aa, Heterodera glycines
  Coding regions on vcDNA: vcDNA=SeqID_81579; Strand=-; Position=1 -106,151-170
MKNIPLEIAFWQFVLTSVISFFVFLLLFGLSQLWTVILNVI

SEQ ID NO: 155157 - protein, 135 aa, Heterodera glycines
  Coding regions on vcDNA: vcDNA=SeqID_81580; Strand=-; Position=1 -315,464-556
MLTNKSLPLLFYSEFAKCKRCRLNKCLTVGMNPRGVNCNKSNVHETLAFAQRMKQQMEQQQQQENANANQAEKAASSEATDIGTELSALTTEQSSEPPKWALTDSPMVQKNFARFILMKHMMEVERKVQDSRLEN

SEQ ID NO: 155158 - protein, 115 aa, Heterodera glycines
  Coding regions on vcDNA: vcDNA=SeqID_81581; Strand=-; Position=1 -196,268-358,546-705
RQAPMNMSYNDKVGFINSASKQLGDRLSEQNKKMHEMLKEDKNERSSTSHFDEGNKKGSSYNFEKFSSSESRPAPYSYSGKPADYFRGPTIRDVPPSNGSIGGTVTTWEWGTVSN

SEQ ID NO: 155159 - protein, 158 aa, Heterodera glycines
  Coding regions on vcDNA: vcDNA=SeqID_81582; Strand=-; Position=1 -167,303-328,478-505,1070-1200,1314-1438
  Homolog annotation: Hit_ID=AAH68856.1; Match level="QueryCoverage =99%, HitCoverage=89%, E-value=2e-21, Identity=57%"; Hit description =MGC82214 protein [Xenopus laevis]
MPREMLLRELADAEALFCLLRDKIDDELLARAPKLKVVSTMSVGYEHIDLEACKKRGIRIGYTPVPEAVRSAQKGILVDIEALTEALKNGLIGAAGLDVTDPEPFPTDHSLFRMDNCVILPHIGSATYATRDLMALTTEQNICNCLEGKEMVAELKID

SEQ ID NO: 155160 - protein, 368 aa, Heterodera glycines
  Coding regions on vcDNA: vcDNA=SeqID_81583; Strand=+; Position=1-1105
  Homolog annotation: Hit_ID=CAE64508.1; Match level="QueryCoverage =99%, HitCoverage=95%, E-value=7e-96, Identity=47%"; Hit description =Hypothetical protein CBG09238 [Caenorhabditis briggsae]
RREKRLRRRRLRTPTEAKAKKDAEEKAKKDAEAKAKKDAEEKAKKDAEAKAKKDAEEKAKTDAEAKAKKDAEEKAKTDAEAKAKKDAEEKAKTDAEVKAKKDAEEKAKTDAEVKAKKDAEEKVKKDAEAKAKKDAEEKAKTDAEVKAKKDAEEKAQKDAEAKAKKDAEEKAKTDAEVKAKKDAEEKAKKDAEAKAKKDAEEKAQKDAEAKAKKDAEEKAKKDTEAKAKKKDAEAKAKKDAEEKAKTDAEAKAKKDAEEKAQKDAEAKAKKDAEAKKEEEMKKQKAKPEEKPEAPAEGVAVVPEAKKAEETKERLKQEEKPVEVPPSPAEKKRKEAEEKKAQKDAEAKAKKDAEEKAKKDAEAKAKKDA

SEQ ID NO: 155161 - protein, 623 aa, Heterodera glycines
  Coding regions on vcDNA: vcDNA=SeqID_81584; Strand=+; Position=1 -169,262-1961
  Homolog annotation: Hit_ID=CAE64509.1; Match level="QueryCoverage =99%, HitCoverage=90%, E-value=1e-134, Identity=35%"; Hit description= Hypothetical protein CBG09244 [Caenorhabditis briggsae]
MPEAKAKEERRRRKLQKGWPRLKPRKDAEGKGKGRKENEEAKGLGPKEKPEAPAEGAEKKRKEAEEKKAQKDAEAKAKKAAEEKAKKDAEVKAKKAAEEKAKKDAEAKAKKKDAEAKAKKDAEEKAKTDAEAKAKKGAEEKAKTDAEVKAMKDAEEKAKKDAEAKAKKDAEEKAKTDAEVKAKKDAEEKAKKDAEVKAKKDAEAKKKEEEMKKQKAKPEEKPEAPAEGVAVVPEAKKAEETKERLKQEEKPVEVPPSPAEKKRKEAEEKKAQKDAEAKAKKDAEEKAKTDAEVKAKKDAEAKKKEEEMKKQKAKPEEKPEAPAEGVAVVPEAKKAEETKERLKQEEKPVEVPPSPAEKKRKEAEEKKAQKDAEAKAKKDAEEKAKKDAEAKAKKDAEEKAKKDAEAKAKKKDAEAKAKKDAEEKAKTDAEAKAKKGAEEKAKTDAEVKAMKDAEEKAKKDAEAKAKKDAEEKAKTDAEVKAKKDAEEKAKKDAEAKAKKDAEEKAKTDAEVKAKKDAEEKAKTDAEVKAKKDAEAKKKEEEMKKQKAKPEEKPEAPAEGVAVVPEAKKAGEKKEKLKQEEKPVEVPPSPAEKKRKEAEEKKAQKDAEAKARKDAEEKAKKDAP

SEQ ID NO: 155162 - protein, 44 aa, Heterodera glycines
  Coding regions on vcDNA: vcDNA=SeqID_81585; Strand=+; Position=1 -129,598-603
MAKECANIRVTVPICVQIGGTDEGQMDSEVTVDRRAIDANENTT

SEQ ID NO: 155163 - protein, 185 aa, Heterodera glycines
  misc_feature (169)..(169): Xaa can be any naturally occurring amino acid
  Coding regions on vcDNA: vcDNA=SeqID_81586; Strand=-; Position=1 -81,122-264,370-400,454-604
  Homolog annotation: Hit_ID=EAL29892.1; Match level="QueryCoverage =87%, HitCoverage=21%, E-value=6e-38, Identity=50%"; Hit description =GA19895-PA [Drosophila pseudoobscura]
MANELISPTPPDIENIFKRLRANPSNKVCFDCGARNPTWSSVTYGVFICISNKVCFDCGARNPTWSSVTYGVFICIDCSSVHRNLGVHLSFVRSTNLDTNWSWIQLRWIQLRAMQIGGNANAVAFFKQHGCESNDVAFFKQHGCESNDAQVKYHSKAAAMYKVSGVDKXYGEMANVGHSLDDQET

SEQ ID NO: 155164 - protein, 71 aa, Heterodera glycines
  Coding regions on vcDNA: vcDNA=SeqID_81587; Strand=-; Position=1 -21,233-356,435-505
MALVEFKLGVRDQCIVNVCDTSETRNDNSTNDPNAFYVIPEERYANRKDTARKWKQQLMTTATTTTDGKQT

SEQ ID NO: 155165 - protein, 167 aa, Heterodera glycines
  Coding regions on vcDNA: vcDNA=SeqID_81588; Strand=-; Position=1 -98,482-729,944-1101
MLKKGGTIGAEGETNLPVSLVIRFLKKREVIENPCPPICSPDDDLTVHIGDRQLTISAHWLMSVSPMVKQMLSVEMQEKHQRAINLDGLGITMEQFSEFADAISISSLGQPFFPNPQNVLTFLLIADYFQIDWLKERCGVHLANCVEIPFLERLLLIERYKLKNLMV

SEQ ID NO: 155166 - protein, 31 aa, Heterodera glycines
  Coding regions on vcDNA: vcDNA=SeqID_81589; Strand=-; Position=1 -30,90-155
MKTYKNSFCLIYFFLIVIFTVLTIVIFIPIL

SEQ ID NO: 155167 - protein, 38 aa, Heterodera glycines
  Coding regions on vcDNA: vcDNA=SeqID_81590; Strand=+; Position=1 -72,956-1000
MSFKRVNSVKPAVPMEKMGFPLNWILYFFLSYFIFYFH

SEQ ID NO: 155168 - protein, 64 aa, Heterodera glycines
  Coding regions on vcDNA: vcDNA=SeqID_81591; Strand=-; Position=1 -96,166-264
MIKLILHDAGPLQKHELVKKILETYKLNSKKHVNSRVKKTLRTYVGNGARSRSWKIFGGRIGRW

SEQ ID NO: 155169 - protein, 180 aa, Heterodera glycines
  Coding regions on vcDNA: vcDNA=SeqID_81592; Strand=+; Position=1 -192,1240-1388,1431-1543,1617-1702
MNPQGVSATKFSGQQILAFVQQMKQQMASLAAASTSANLTGFELCAQTNTTTKNGPQQLGSLNSIALCSNIAMPLYVLCNGFYSVQQNCEVFCNPAGMKPIQKFKNSFYHEDPIAMGMGDTLLCKAIEPFRRLKLSTEEFVLIRAIIYSNMVSPGLSDQAQKLLLSEAEKYSSLLMSILQ

SEQ ID NO: 155170 - protein, 451 aa, Heterodera glycines
  Coding regions on vcDNA: vcDNA=SeqID_81593; Strand=-; Position=1 -221,274-352,412-615,770-949,1095-1239,1285-1400,1804-2006,2079-2284
  Homolog annotation: Hit_ID=AAG23825.1; Match level="QueryCoverage =100%, HitCoverage=46%, E-value=1e-123, Identity=69%"; Hit description=guanylyl cyclase [Heterodera glycines]
MWDTRGGVIPQAVPPCGFDGNGCTVSVFELYKVRYISVTLTILFAIQKGYFISGIVLFVLIIGSSLLIMVYLIHSKIVENRKTNLLWQIPFAMMKRVKQRHGAERSHHSLRSNQTNVSALTHSTMDSLAQSKNFSLYTYNGDKCIVCTFGSMTAAAPLSVAEMAECRAMRLFDHENMNRFLGLSLDGPNVLAVWNFCMRGSIRDVILSENAMVKDVMFIQSAVKELCEGLQFLHNSPLQFHGRLKSSACLINERWQVKISYFGLRWLKSPQKMQAKDLLWLSPEQLRRATDGAEINVAEGSKQSDIYTMALIFTEIHLIRDCWTEAPNERPTIVKVLQRLRQMNAGQSINLMDHVFEMLEQYANKLEEEVQERTRELAGEKRNQVADRVKLGQSVEPEQFDCVSVFFSDIVQFAALSNQMRPLQVVNLMNDLYTIFDAIIDEHDVYKVESI

SEQ ID NO: 155171 - protein, 115 aa, Heterodera glycines
  Coding regions on vcDNA: vcDNA=SeqID_81594; Strand=+; Position=1 -103,337-582
PAHSIFDHLSAVRAVCHAFVPLTGKGTGRGTRGTDDCDETVKDEDEDLQLSSSDLYSLNTAVHYQPVPTATTTMANAMVSHACVAADHQTINDYHYFFIFAPHFHFFFLLPLSIY

SEQ ID NO: 155172 - protein, 49 aa, Heterodera glycines
  Coding regions on vcDNA: vcDNA=SeqID_81595; Strand=+; Position=1 -43,493-599
MQRQVQMRSFSILTAVHDIAAIQNRAVNPNFIRPNQLNAFNPSDRFSRY

SEQ ID NO: 155173 - protein, 127 aa, Heterodera glycines
  Coding regions on vcDNA: vcDNA=SeqID_81596; Strand=-; Position=1 -274,361-467
MIISNELINYFVGQIECEGNASLVGMEIRHANVSLGQEHVLNFVEINADNGVLRAGDKINVRIPIDGTIGKTEVINVSVNLFFEALRRHPHIGVRAPGQSDSGQLDSGQSDSGQFDSKDIPTVDNPT

SEQ ID NO: 155174 - protein, 79 aa, Heterodera glycines
  Coding regions on vcDNA: vcDNA=SeqID_81597; Strand=+; Position=1-240
MNVIYGPWRISVFLDGISRSKFFRKWIWAIHFEVDFINFDDEMFRRTINGQIEFLAIFIKQMLNRAPICDIMIKILVLL

SEQ ID NO: 155175 - protein, 221 aa, Heterodera glycines
  Coding regions on vcDNA: vcDNA=SeqID_81598; Strand=-; Position=1 -30,113-263,337-401,491-661,952-1198
MDFVTLDTNYKPPYMDLPFNNTLRKLQYAKNIIFRIQLNNVKSFGFIISLLHDRPEKNEDIGATIMEMNVRPTHISMTSFSVENKSSEPVKDSIDLSKAGALEINITLFKDDKITIQINDILKRNYTSEMPTWATNFVRVEEINKYKGGITLMEKPFIGIDTQLAEANEGQQQQKDGLPLTKRLMTVLNYGDVIRMEFLIKRQIGKLTIALMHEAKYFDKR

SEQ ID NO: 155176 - protein, 125 aa, Heterodera glycines
  Coding regions on vcDNA: vcDNA=SeqID_81599; Strand=-; Position=1 -48,115-444
  Homolog annotation: Hit_ID=AAP30767.1; Match level="QueryCoverage =100%, HitCoverage=100%, E-value=6e-32, Identity=59%"; Hit description=putative gland protein G21E12 [Heterodera glycines]
MTSHFLVGVAAFGAGMCFAKTYMEKPKSEDDKEAPKKEEATTGGDAEEKAKKKDKKGDGAAAADKKEEKRKDKHKSKEGKSDDSNRRSKKDKHGKKDKKDKKKDAAEPAANAGEQSTAETTQADE

SEQ ID NO: 155177 - protein, 113 aa, Heterodera glycines
  Coding regions on vcDNA: vcDNA=SeqID_81600; Strand=+; Position=1 -50,794-1085
  Homolog annotation: Hit_ID=AAL78214.1; Match level="QueryCoverage =85%, HitCoverage=49%, E-value=7e-09, Identity=30%"; Hit description =putative esophageal gland cell protein Hgg-20 [Heterodera glycines]
MSENTTEAERRQMENELFICADCWLSVFHLLPPSQLGLGIALLSHRFDCLVDEHFKTRKWMLGVIAIGNKIGENGKKEMKLQQCANFWEWRTVPIPQNPLPNKFIGFRHILIT

SEQ ID NO: 155178 - protein, 91 aa, Heterodera glycines
  Coding regions on vcDNA: vcDNA=SeqID_81601; Strand=+; Position=1 -149,713-839
MWGVIAIGNKIGENGKKEMKLTNFPEWRRMPIPQNPLPNKFIGFRHIRIRHLPMPFLVPISSFTFAFAFLFGVFGLVFRPLNCSTIQLGSD

SEQ ID NO: 155179 - protein, 61 aa, Heterodera glycines
  Coding regions on vcDNA: vcDNA=SeqID_81602; Strand=+; Position=1 -121,219-283
MSTNGPSGKGKRLNGYSMISGAILICQKVMKMMDMISSVHVVVKLLLKFLKPISWFLLFRI

SEQ ID NO: 155180 - protein, 57 aa, Heterodera glycines
  Coding regions on vcDNA: vcDNA=SeqID_81603; Strand=+; Position=1 -56,163-280
MIALLALILSSIAFRTMLRLESLLTLPKRLALPEVCFSAKASIPLRLGLLLTSECRT

SEQ ID NO: 155181 - protein, 69 aa, Heterodera glycines
  misc_feature (67)..(67): Xaa can be any naturally occurring amino acid
  Coding regions on vcDNA: vcDNA=SeqID_81604; Strand=+; Position=1-632
ISSDFLLAHNLKSNANLIQIQLNQNFKKINLKKGRISFSSSMTELLWIGWRNGFIPIRGSAFSIFIXSN

SEQ ID NO: 155182 - protein, 139 aa, Heterodera glycines
  Coding regions on vcDNA: vcDNA=SeqID_81605; Strand=+; Position=1-419
  Homolog annotation: Hit_ID=NP_500013.1; Match level="QueryCoverage =96%, HitCoverage=9%, E-value=5e-26, Identity=43%"; Hit description =predicted CDS, polyprotein family member (4B673) [Caenorhabditis elegans] gb|AAC02594.1| Hypothetical prot
SDFFKSFCSLLYTYKCYAIPHWSQGNAVVERSFRTFHNILAKYISNEEPDFDEFLECANFCYNTSIHSSTKETPFFLVFGRDPIFCIEQILNPNTEPENTSEVDNVKQKLVKSLRKAWESAAAVIKEAQLRSKVQYDKL

SEQ ID NO: 155183 - protein, 434 aa, Heterodera glycines
  Coding regions on vcDNA: vcDNA=SeqID_81606; Strand=-; Position=1 -699,1370-1975
  Homolog annotation: Hit_ID=NP_500013.1; Match level="QueryCoverage =55%, HitCoverage=16%, E-value=4e-38, Identity=36%"; Hit description =predicted CDS, polyprotein family member (4B673) [Caenorhabditis elegans] gb|AAC02594.1| Hypothetical pro
SFCSLLYTYKCYAIPHWSQGNAVVERSFRTFHNILAKYISNEEPDFDEFLECANFCYNTSIHSSTKETPFFLVFGRDPIFCIEQILNPNTEPENTSEVDNVKQKLVKSLRKAWESAAAVIKEAQLRSKVQYDKLVRNQTVQIGDRVLLRNYAGKVKTSKKFQLPWKGLYRVIEINGVLITIVSCTSPQTNPRIVHINQVKKYFEYSGPPCTTKNLQKDEEQALKELESREQTNGMQDPFSNFYFSPFVYEGESYCCVEQAFVMKKVRTYELNGVAAEVMRFVHKDDSTPNSPRWPDGHPRELKWFGREAEERASPATKRNWSENAQRSSIAFFVELKFRQNQHLAALLLATNDMWIAEACKDRKWAVGYYKDDPFLHNYTPENGAFGRNWMGNILMSLRMRMLNEQQSVAGPSRQIGKREDSIAYNYENSEELI

SEQ ID NO: 155184 - protein, 782 aa, Heterodera glycines
  Coding regions on vcDNA: vcDNA=SeqID_81607; Strand=-; Position=1 -276,706-2777
  Homolog annotation: Hit_ID=NP_500013.1; Match level="QueryCoverage =99%, HitCoverage=43%, E-value=5e-88, Identity=44%"; Hit description =predicted CDS, polyprotein family member (4B673) [Caenorhabditis elegans] gb|AAC02594.1| Hypothetical pro
EHDIVTTSDTPVSSKPHRTPFKYRDELQKHIDQLLASGVMVESDTPWVSNIVLVQKKDGGLRPCIDFRKLNEVTVPDHYPLPRLETIMERIDPKTTRDVKHVVGMASFFRKHVPNFSTIVEPLTRLTKKESNFEWGTEQAAAFNEVKRILSEKPILVFPNYDKPFHIFTDASNVGQGGALMQWNELAEAYEVIAYCSRTLSASERKWPAVQAELGAIIFALRNFKPYIFLTEIELHCDHKPLAFLLKKAEAHPHLARWLIELQNYNIKIIHVAGKQNLLADGLSRYPHERTQEIAIRDLAELEDIANFPVCLALNMKPRMVHEHFLLTITARDIEGKTFAIDVRKEQNDDSEVRKLIEFVNFGSFPEGTTEVEKEDIASRAENLSLSSGILYQHLPDQNARMYIPLSLRPLIFEAFHTSQINGGHMNIKKTLGKCRKFYWPMMHRDITNWTRQCITCQLRHSPNPSYRAEMQMPPKNTLFAQIALDLAGPLPLTQKGNKHILNIICTFTKYVISVPIPDAKSQTIALAFFKHCYLKFGGCTSLLTDNATAFTSDFFKSFCSLLYINKCYAIPHWSQGNAVVERSFRTFHNILAKYISNEEPDFDEFLECANFCYNTSIHSSTKETPFFLVFGRDPIFCIEQILNPNTEPENTSEVDNVKQKLVKSLRKAWESAAAVIKEAQLRSKVQYDKLVRNQTVQIGDRVLLRNYAGKVKTSKKFQLPWKGLYRVIEINGVLITIVSCTSPQTNPRIVHINQVKKYFECSGPPWTTKNLQKDEEQALKE

SEQ ID NO: 155185 - protein, 162 aa, Heterodera glycines
  Coding regions on vcDNA: vcDNA=SeqID_81608; Strand=+; Position=1-488
  Homolog annotation: Hit_ID=NP_500013.1; Match level="QueryCoverage =94%, HitCoverage=10%, E-value=6e-31, Identity=43%"; Hit description =predicted CDS, polyprotein family member (4B673) [Caenorhabditis elegans] gb|AAC02594.1| Hypothetical pro
FKHCYLKFGGCTSLLTDNATAFTSDFFKSFCSLLYINKCYAIPHWSQGNAVVERSFRTFHNILAKYISNEEPDFDEFLECANFCYNTSIHSSTKETPFFLVFGRDPIFCIEQILNPNTEPENTSEVDNVKQKLVKSLRKAWESAAAVIKEAQLRSKVQYDKL

SEQ ID NO: 155186 - protein, 314 aa, Heterodera glycines
  Coding regions on vcDNA: vcDNA=SeqID_81609; Strand=+; Position=1 -43,732-836,1112-1266,1324-1407,1454-1549,1590-1689,1740-1825,2001 -2087
  Homolog annotation: Hit_ID=XP_419589.1; Match level="QueryCoverage =93%, HitCoverage=43%, E-value=3e-50, Identity=40%"; Hit description =PREDICTED: similar to Dihydroxyacetone phosphate acyltransferase (DHAP-AT) (DAP-AT) (Glycerone-phosphate
SIHLFKFEVLKVFKRIFSHIWVNSARMCQIRQISADRSVPIVWLPTHRSYLDFLLLSLLSYHYRIQLPAICAADDFRASRLLGEALRRCGAFFIRRSFREDLLYRSVFSEYVQQILSHGDLLYRSVFSEYVQQILSHGDRPIEFFIEGQRSRTAKSVFPRVGGQRSRTAKSVFPRVGLLQLVVEPFIRAQVYDTILVPVTIDYDILVPVTIDYDRILEEKLFAWELVGFSKPRETTMGLLRAHSILSDNFGDIRVTVLLRAHSILSDNFGDIRVTVGEPISLRKYANGTLILWPFVALAILQTLNEFPLNSQPI

SEQ ID NO: 155187 - protein, 256 aa, Heterodera glycines
  Coding regions on vcDNA: vcDNA=SeqID_81610; Strand=+; Position=1 -744,1934-1959
  Homolog annotation: Hit_ID=NP_500013.1; Match level="QueryCoverage =91%, HitCoverage=16%, E-value=2e-50, Identity=43%"; Hit description =predicted CDS, polyprotein family member (4B673) [Caenorhabditis elegans] gb|AAC02594.1| Hypothetical pro
PDTKSLTTAKALLRHVYLKFGGCTELISDNATTFTSDFFKSFCSLLYINKSFSTPYWSQGNGATERTFRTFHNILSKYINPKEPNFDEFLDAATFCYNTSIHESTGESPFFLVFGRDPIFSIDQILDPSVHLPLPHNDLAEFKTLLVLSLRKAWNSAADSIKEAQNKSKVQYDKKFRNPNISIGDRVLLRNYTGKPGTSQKFHNPWKGVFRVINIEELHVTIVSCSSPQSNPFKVHINQLKKLFEISDPGFQRRNA

SEQ ID NO: 155188 - protein, 172 aa, Heterodera glycines
  Coding regions on vcDNA: vcDNA=SeqID_81611; Strand=+; Position=1-545
FSEMRIITSNCPLDQRSLGATDQMIPFFGGFSSSDQSLFVRSLFLSLSALQSEPSPPASADPCPRLFRPPRQRRSIPFQRRRLDESAPRGSARNSANETRVVLRVHEQLGGNGCAAGATGRGRTKADGLAIVAEIEFEGDGEENHRKEKKKRTEKQRKRRRKHRQREGTNWG

SEQ ID NO: 155189 - protein, 141 aa, Heterodera glycines
  Coding regions on vcDNA: vcDNA=SeqID_81612; Strand=-; Position=1 -79,129-282,665-778,842-919
  Homolog annotation: Hit_ID=NP_741710.1; Match level="QueryCoverage =88%, HitCoverage=7%, E-value=1e-21, Identity=42%"; Hit description =aboc, EXpulsion defective AEX-3, Rab3 Guanine nucleotide Exchange Factor, regulator of presynaptic activit
MHDAKSRLFQPGRISAEQSLCPRLIDYIVIVGRRPNATVRRRRHPPSAGGYVNVTAGGGAGPMAIPGGTVSHPELLRRYPSENHRDFELPRDVTYFCQPEGCVSFNGSAFRQLKKRNAFQEATFFVFTLTDKDSARSRFGV

SEQ ID NO: 155190 - protein, 66 aa, Heterodera glycines
  Coding regions on vcDNA: vcDNA=SeqID_81613; Strand=-; Position=1 -75,200-293,347-378
MFCVRRPRRRPQCSEPILRSYRRGKEHVVLELGSPMAIRDNDEDGANKEIIDQELEVTLEGNEKEC

SEQ ID NO: 155191 - protein, 135 aa, Heterodera glycines
  Coding regions on vcDNA: vcDNA=SeqID_81614; Strand=+; Position=1-408
MLQINLMIVFFSFLFVLIDGTDEELFDDLCENLQPSTSENFKKTKLEEMNAIKKEIVDNNENTEKQNANQIEMEDIKPKELQKIKKEKILEEQNIKVTKIELDKLSEESFENEFDEQADQNVSSADAEGYNDMVI

SEQ ID NO: 155192 - protein, 78 aa, Heterodera glycines
  Coding regions on vcDNA: vcDNA=SeqID_81615; Strand=-; Position=1 -172,351-415
MTKIFQTTKIEKKTFDKSQMDKAIAKDQMLNDNNKRMFKKLFNNSSKIVEIYETLLKEIRTILVATPKLEILINKNNV

SEQ ID NO: 155193 - protein, 39 aa, Heterodera glycines
  Coding regions on vcDNA: vcDNA=SeqID_81616; Strand=-; Position=1 -37,391-473
MAEAATIITTIWGEIHFAEKWAGPGSKKNPSWIQIQVKL

SEQ ID NO: 155194 - protein, 59 aa, Heterodera glycines
  Coding regions on vcDNA: vcDNA=SeqID_81617; Strand=-; Position=1 -12,246-413
MVNLTSNLQAAVHNDDFSDFRRAYDAPPGPAFSDANAIDGRTYGEPRVAYPAAIKSRKN

SEQ ID NO: 155195 - protein, 97 aa, Heterodera glycines
  Coding regions on vcDNA: vcDNA=SeqID_81618; Strand=-; Position=1 -68,119-341
MEGERQFAFDYIANVQRHVDAKGVFYEVSVRRMPCLPRPKSGGKCKGGEEKEKPTNLKLKVEAGVDKEMIKRLMGTEEGTEEKNYRSQTKAGTNVIK

SEQ ID NO: 155196 - protein, 76 aa, Heterodera glycines
  Coding regions on vcDNA: vcDNA=SeqID_81619; Strand=-; Position=1-228
MQRAPHVGAVIVEQTDDLFLTKNGRPRRVMSCQQLRKLLNGLVASVCNNSDHLDEADEHYDYDDIPPKSQQHQQLK

SEQ ID NO: 155197 - protein, 37 aa, Heterodera glycines
  Coding regions on vcDNA: vcDNA=SeqID_81620; Strand=-; Position=1 -82,936-967
MVHYAKDVSKNVSNTCSNNRSDREEVYKKENPLIVNF

SEQ ID NO: 155198 - protein, 31 aa, Heterodera glycines
  Coding regions on vcDNA: vcDNA=SeqID_81621; Strand=+; Position=1 -78,366-383
MALNGTYLFNLSLYCSNSMHEVRAVQIYFGK

SEQ ID NO: 155199 - protein, 232 aa, Heterodera glycines
  Coding regions on vcDNA: vcDNA=SeqID_81622; Strand=+; Position=1 -195,635-696,2034-2263,2378-2586
MPSPAQMSSPSPPTFASHFKYSVAVCHGIGTAGGRRSPMRRVSLPSALPHPRTPNTLSPKLGFLKEISEFDIDPPFISPAASSSSSADTSPMLLSPSFQRPASARLYRRNPQHRHSQPNSPGSRKSRFLNRQPPPMGDGRTAAVAKEAEDDGFRWTDVDGFYGRKNSIPLQQLLANDLLNGANLFGDRHDELKPNRGRMMISNGMDNNENNETDYDNTIDGSLLNVEQQQNE

SEQ ID NO: 155200 - protein, 93 aa, Heterodera glycines
  Coding regions on vcDNA: vcDNA=SeqID_81623; Strand=-; Position=1 -126,175-330
MKQQQQKQQEDENFRKMLEVLKNPRKFNISLTESSSSESPRREQKPVPSQQPLTTVTAPPALPPTGPTVPAVTVPQMYTANRDSSDSDSDFFK

SEQ ID NO: 155201 - protein, 115 aa, Heterodera glycines
  Coding regions on vcDNA: vcDNA=SeqID_81624; Strand=-; Position=1 -69,114-392
  Homolog annotation: Hit_ID=CAE67471.1; Match level="QueryCoverage =63%, HitCoverage=4%, E-value=2e-23, Identity=69%"; Hit description =Hypothetical protein CBG12974 [Caenorhabditis briggsae]
GERTFEGKSLHHLDTNELNPYQQVIEIVGKTLSSFDADGIIPVYGFGDEECTDQSCFNLVDRDDVDSACVGFEGLNGLNGCRTAKILQIVKQRCSACTTSECRPLPCRDRQILCH

SEQ ID NO: 155202 - protein, 87 aa, Heterodera glycines
  Coding regions on vcDNA: vcDNA=SeqID_81625; Strand=+; Position=1-375
IIFMQKIFFWVFGAVPLNRCAQIYGETESFRNSFTIACTLILRWIFAPHNCLSTPNGHLKKSIYFCFRGSPPEPMRPDLWGDRILRE

SEQ ID NO: 155203 - protein, 218 aa, Heterodera glycines
  Coding regions on vcDNA: vcDNA=SeqID_81626; Strand=-; Position=1 -141,255-394,509-687,1071-1267
  Homolog annotation: Hit_ID=AAH71003.1; Match level="QueryCoverage =98%, HitCoverage=59%, E-value=3e-17, Identity=31%"; Hit description =MGC80031 protein [Xenopus laevis]
TIIGNIEKERQKFMEELRKEGKCVDEIGLDGLLADVEAQQHIIAISSNPRNLTDEPPLTFALDSDIALVKQYADALFRLDPRLAVLRFELVPKLVPEDKFWRNYAYRISLVRKFVAEKTTSEQRQGSAKEEDKSKKCVETEHKQQQQPQKLQQTTADATPENDEEEKLEKELLNDLHEFEMVVDDGKEYGTDNANDEDGQMGDELDKHLDELLDNNSN

SEQ ID NO: 155204 - protein, 45 aa, Heterodera glycines
  Coding regions on vcDNA: vcDNA=SeqID_81627; Strand=-; Position=1 -108,739-768
MLLEIEKRLYPDGLPENAPNFVQKHFNLVGGTSTGALNYRHYHTF

SEQ ID NO: 155205 - protein, 79 aa, Heterodera glycines
  Coding regions on vcDNA: vcDNA=SeqID_81628; Strand=+; Position=1 -186,698-751
MAIKYGPKIAKYGHKMAKIAKYGHKWQKCQNMDINFSKLNVKFLQIYWLKLHMRYISKFFDSASNNPGKKYGFPYNYTP

SEQ ID NO: 155206 - protein, 51 aa, Heterodera glycines; identical to SEQ ID NO: 124998
  Coding regions on vcDNA: vcDNA=SeqID_81629; Strand=-; Position=1-155

SEQ ID NO: 155207 - protein, 76 aa, Heterodera glycines
  Coding regions on vcDNA: vcDNA=SeqID_81630; Strand=-; Position=1 -37,237-430
MLAPLCIYDNVGDFYRAKIPLRLKVKKKLSAKMALKEKKMVFATGRYYGAPTFAAPTFTPMSKIGLKVEFFQPLIA

SEQ ID NO: 155208 - protein, 151 aa, Heterodera glycines
  Coding regions on vcDNA: vcDNA=SeqID_81631; Strand=+; Position=1 -23,358-437,806-1158
MQNRKMNGRVRGCQCATRTCLWPAHRRPIRADDQAVFMTAFHLVCDYAEAELGPAEQKFMRTYRFRISIPPKDEKKWGTSLASAAYIGMVVLLTGRAVRANWCVTGALDSDGEVNEVAGIPQKVAAANFKLKTYIRIEREIQVGYVVHAII

SEQ ID NO: 155209 - protein, 118 aa, Heterodera glycines
  Coding regions on vcDNA: vcDNA=SeqID_81632; Strand=+; Position=1 -54,139-441
MSLPHPELSQLLEGLFAASKFHWKALESPRRGEKENEPKAILIELIDIYNELKLDDYKAIESCRKCDKKGKENGKNERENHDHKKRRFLRFVARSLEIEWDSNAFCADGQNDNDDAGN

SEQ ID NO: 155210 - protein, 417 aa, Heterodera glycines
  Coding regions on vcDNA: vcDNA=SeqID_81633; Strand=-; Position=1 -292,605-923,970-1179,1225-1657
  Homolog annotation: Hit_ID=NP_496955.1; Match level="QueryCoverage =40%, HitCoverage=21%, E-value=6e-14, Identity=29%"; Hit description =predicted CDS, putative protein family member, with 4 coiled coil-4 domains (2O436) [Caenorhabditis elega
MRDTNNGSLTPTRLEHPCSWEQCTLRGQFQLQRRVAQLRQQLAELQRTPSLVREPEKRPNDDDDKENRTPRGRPKKRFAEKKGSAQRADICQLTSVLSAETSAGIRVAFADVARQLADICEIDGLSTQFFLTGDLMFISKIFGHRGAASANPCFCCEAKNLPSEPGRQRTLERMRQQAAQFQEGVQNGVNVTQMSKQCAGMQFDPFFNIEPSMTIPPSLHIVACQGVFFGIFKELRHLCTRHGTEYEEQLEMRLRALGAYKNAWYQEYSGYHVRNILRGGGPMHVTEFLPQSPRRDNILMALELLAKLQSFAVADLLSADQIADFRATADQFRVHMLEHFRRHCSTSKFHHLVHHAPEFAENHGFWGLLSEQPVEKFHALFNDDLARKANTKDLHDILMFCARESAIRNAIFDSNEL

SEQ ID NO: 155211 - protein, 53 aa, Heterodera glycines
  Coding regions on vcDNA: vcDNA=SeqID_81634; Strand=+; Position=1-162
  Homolog annotation: Hit_ID=NP_498584.1; Match level="QueryCoverage =100%, HitCoverage=24%, E-value=4e-13, Identity=60%"; Hit description= ribosomal Protein, Large subunit (24.3 kD) (rpl-6) [Caenorhabditis elegans] gb|AAK29850.1| Ribosomal pro
QYAVTDQRKEDQKTVDSQVMEVIRKHPEKKFLFGYLGSRFHLAKGMHPHKMVF

SEQ ID NO: 155212 - protein, 217 aa, Heterodera glycines
  Coding regions on vcDNA: vcDNA=SeqID_81635; Strand=-; Position=1 -45,120-697,781-811
  Homolog annotation: Hit_ID=AAC95573.1; Match level="QueryCoverage =70%, HitCoverage=42%, E-value=1e-23, Identity=38%"; Hit description =orf 48 [Ateline herpesvirus 3] pir||T42963 hypothetical protein 48 - ateline herpesvirus 3 (strain 73) ref
SLLSAAIDEKMTQHESLLIATDQRIVHFLLLAFLLIAAVCLTLLLIKAIVDQFLKQKFGQNNNNTMDKEEEKRTEEEEKKENGKGGGGEKGERKEEAILGKNDREEEEQEEEKEEEEEEKVGDEREEFVGVGIEEEEKEKDGMEAFLEELEGATDEEEEEEEGEEEEKRTTEEEEEEFDSEEEKEEESDGGKERRETENKLGGKRAFCIIRWHNKKR

SEQ ID NO: 155213 - protein, 436 aa, Heterodera glycines
  Coding regions on vcDNA: vcDNA=SeqID_81636; Strand=+; Position=1 -47,98-242,449-652,696-770,815-872,919-1040,1088-1241,1308-1365,1414 -1465,1634-1711,1757-1846,2304-2530
  Homolog annotation: Hit_ID=NP_998650.1; Match level="QueryCoverage =96%, HitCoverage=42%, E-value=3e-58, Identity=30%"; Hit description =zgc:55729 [Danio rerio] gb|AAH47184.1| Zgc:55729 [Danio rerio]
MRTRISAFTVLSHLVRTFPGIMNDYLGTITINITKTLTDSAADGTMKIEILRFISLLLNTHEPERLVPFVETVLPHLAAAVGDHFYKIASEALLTTQSLLRVLRAQKTDFSKALPVMYSAVVSKLKIADIDQEVKEKNIATVGLLVALFSAELGKKITDECLPLLLERLRNEMTRQVALRAINHIVQSPTKLDLQPMLPELLSLCADFLRKNQRSLRLNTLTLLESLVCRFSHNGLQGPNLIKVVKEVPALICEQDLQIALIAVTFITNVVNSYPDQILADSLNNMFQSLITLVHSSLLQGTTLNRISEPVYNTGTSQFLHRQTYSSIAKATATVAQSNAEQTDSRTLVLSLRDAFRNAGPVINSECGECGTVGDADEIFKKGVEQIWELLMKYCDSAEESIRNVVAECIGRLIMVNPQNYVEEPFWFSQLYCSIV

SEQ ID NO: 155214 - protein, 41 aa, Heterodera glycines
  Coding regions on vcDNA: vcDNA=SeqID_81637; Strand=+; Position=1 -30,208-303
MELSEKGGVIASATSLTERKDMNEGRKIVFLNLTTTLFTIF

SEQ ID NO: 155215 - protein, 52 aa, Heterodera glycines
  Coding regions on vcDNA: vcDNA=SeqID_81638; Strand=-; Position=1-259
  Homolog annotation: Hit_ID=EAA56911.1; Match level="QueryCoverage =98%, HitCoverage=14%, E-value=5e-10, Identity=54%"; Hit description =hypothetical protein MG07266.4 [Magnaporthe grisea 70-15] ref|XP _367341.1| hypothetical protein MG07266.4
RISIPWRGHRDDQLEKESGIEGAIFVHANGFIGGTKSLEGAMRMAEETLKMN

SEQ ID NO: 155216 - protein, 108 aa, Heterodera glycines
  Coding regions on vcDNA: vcDNA=SeqID_81639; Strand=+; Position=1 -47,94-373
MSDNPKEAEEKMAKAIFISADCWLCVFDLLPPSQLGLGIALISHRFDFYVDEHFKTRKWTLKPIQIRRKNGENGTKEMKIVNSRWKPLPIPQIQLPRKVIGFKRIDIS

SEQ ID NO: 155217 - protein, 50 aa, Heterodera glycines; identical to SEQ ID NO: 135818
  Coding regions on vcDNA: vcDNA=SeqID_81640; Strand=-; Position=1-154

SEQ ID NO: 155218 - protein, 224 aa, Heterodera glycines
  Coding regions on vcDNA: vcDNA=SeqID_81641; Strand=+; Position=1-675
MPPVSIDFGEGNGEICAFQQRFEALIGQLPAECEPIAAAQKMEKLRFVHAVMVMANSDGERGERIKVKNQRKKKVKHSQQKRYKAPLLNEWTENNERAKGQRNAAQTEEPSWGDPIGEAVKVLRETTKMLEQMLDDWRGEERRGGHATLWHRKKDGAMAPPSPNGTVEGRTEAAEAVDTDQTAWKPTTENTRHQQPHSLLSSKISFPSELRRYRMTEERHEERI

SEQ ID NO: 155219 - protein, 286 aa, Heterodera glycines
  Coding regions on vcDNA: vcDNA=SeqID_81642; Strand=-; Position=1 -182,232-415,469-556,614-760,812-967
  Homolog annotation: Hit_ID=AAH55704.1; Match level="QueryCoverage =94%, HitCoverage=60%, E-value=6e-49, Identity=43%"; Hit description =Btbd2 protein [Mus musculus]
LFVLIFQFVFRFLQSLRWAFEKCRAKELQPTPDNLRLVLGSALSKIRFPLISPSDFATFVAPTKLLTDAEPTKLLTDAEMVSVFLYYHLGPKQPMPFPSTYRGLYTPELVVKRFQRIESSWGYTGTPDRVKFMVDTPVFIFMVDTPVFILGFGLYGSNRESCQYTVLIEIILNFNSGKSLASNECFFLSDGSPTTFRVLFDEPVEISSNTTYVASAKLTGNESHYGTKGLRKIKGNESHYGTKGLRKIKLERNGRPDINWHFQYAPGNNNGTSVEDGQIPEIIFCA

SEQ ID NO: 155220 - protein, 216 aa, Heterodera glycines
  Coding regions on vcDNA: vcDNA=SeqID_81643; Strand=-; Position=1 -141,209-413,460-626,675-809
  Homolog annotation: Hit_ID=NP_502244.1; Match level="QueryCoverage =28%, HitCoverage=9%, E-value=7e-13, Identity=62%"; Hit description =BTB domain containing (67.7 kD) (4M616C) [Caenorhabditis elegans] emb|CAB01179.1| Hypothetical protein F38
MASQKQLRDKKCSEVEDKTNDGTEREMTNSTSNFYKLTKSEPPIAFDRNLSSNLVVPSTSGRCANRRDEEETSNPKNAQLLEQTKCTPEQHEEKTDECPPKESNVRLTNKICKRRMNKVENVAHLNGRGGIGALGWQATLPSARERLTFMLMNDTLADIFFIFRGSDGSVQRIPAHKFVLSVGSAVFEAMFRFGDSSDCANGIRVGLLNLCHAIRN

SEQ ID NO: 155221 - protein, 45 aa, Heterodera glycines
  Coding regions on vcDNA: vcDNA=SeqID_81644; Strand=-; Position=1-303
RLIFSFFNFYSLFLSFNIPSHLKVQYFFIFINCTVIVGKCVNLER

SEQ ID NO: 155222 - protein, 181 aa, Heterodera glycines
  Coding regions on vcDNA: vcDNA=SeqID_81645; Strand=-; Position=1 -108,1235-1560,2008-2116
AAMTISIGFSVDIPAHVSYHYYQAAAHGVDQPQAKLVLCVVLCNLHGLVFLPAFLILFDSVVQHMRKRAAQRRAASAATDANGGGGAVNKRWPTPIPEANSSQESSLRVGTAPMSPPAQHRNGVGGQYRNGRTKAPAEQSRVTDRPMLDRFNSVDETDGGGTEMVASKPSMKSIVKVPATE

SEQ ID NO: 155223 - protein, 116 aa, Heterodera glycines
  Coding regions on vcDNA: vcDNA=SeqID_81646; Strand=-; Position=1 -110,423-663
  Homolog annotation: Hit_ID=NP_493603.1; Match level="QueryCoverage =99%, HitCoverage=10%, E-value=9e-20, Identity=40%"; Hit description =PaTched Related (111.8 kD) (ptr-23) [Caenorhabditis elegans] emb|CAB04167.1| Hypothetical protein ZK270.1
MREVKMIMLRFEAEHQQNWTVAMVKQYELAMRNTFQREYKSDRIAMYVLSKSVIEDEMVSVCSQVDQAVLIRQIRAGLSIIPYMSIGFAVMVICSVFCVYMRALYMHQHSAPKVMA

SEQ ID NO: 155224 - protein, 114 aa, Heterodera glycines
  Coding regions on vcDNA: vcDNA=SeqID_81647; Strand=-; Position=1 -153,713-826,1370-1447
  Homolog annotation: Hit_ID=NP_493603.1; Match level="QueryCoverage =64%, HitCoverage=7%, E-value=4e-12, Identity=45%"; Hit description =PaTched Related (111.8 kD) (ptr-23) [Caenorhabditis elegans] emb|CAB04167.1| Hypothetical protein ZK270.1
MSTTDRVRPASPSENGTAVTMRQRRSTLARQGSMLGGGFPERRRSSILVGQRSMDLQMEQTGNVGPRFVLFIIRMFRRWGRFVAKHDWKAMLLCLITSLIGFIVVMLTPYGTFN

SEQ ID NO: 155225 - protein, 18 aa, Heterodera glycines
  Coding regions on vcDNA: vcDNA=SeqID_81648; Strand=+; Position=1-54
MHTRPIWQVKQRLLTSQK

SEQ ID NO: 155226 - protein, 219 aa, Heterodera glycines
  Coding regions on vcDNA: vcDNA=SeqID_81649; Strand=+; Position=1 -180,228-316,420-507,570-621,703-741,793-845,902-929
  Homolog annotation: Hit_ID=CAE72708.1; Match level="QueryCoverage =93%, HitCoverage=19%, E-value=1e-44, Identity=56%"; Hit description =Hypothetical protein CBG19941 [Caenorhabditis briggsae]
LRFSLPFLGFVPLFRCSHRQVFIPGDIILGGLFPIHAGSRNTSDGTLCGRIKADQGVQRMVAMLFALEAVNRSPRVAMLFALEAVNRSPRLLPGLKLGAQILDTCSVETHALEQSLEFIKSVGSGVRTTNSTAPNGRRQKITAVIGSASSQNGRRQKITAVIGSASSQVSVMVASMLQLFKIPMLIPMLSYSSTGVELSERPRFAYFSRVFAYFSRVVP

SEQ ID NO: 155227 - protein, 53 aa, Heterodera glycines
  Coding regions on vcDNA: vcDNA=SeqID_81650; Strand=+; Position=1 -93,594-662
MTEAKRTKRGERVWQMGKEEKERKGQRERRRRFVWKFTSKELSVNLELLMSRT

SEQ ID NO: 155228 - protein, 178 aa, Heterodera glycines
  misc_feature (169)..(169): Xaa can be any naturally occurring amino acid
  misc_feature (172)..(172): Xaa can be any naturally occurring amino acid
  Coding regions on vcDNA: vcDNA=SeqID_81651; Strand=+; Position=1 -134,178-279,334-398,454-496,2164-2201
  Homolog annotation: Hit_ID=NP_497039.1; Match level="QueryCoverage =87%, HitCoverage=20%, E-value=3e-38, Identity=53%"; Hit description =putative protein (67.0 kD) (2O915) [Caenorhabditis elegans] emb|CAB07587.1| Hypothetical protein C38C6.6
QEGGRKGLSFKVVANMNGNTVVYNDRDVPIGTGSVRKVGGRSYEAVISKNLFITRLKDARRGPCCRELTEAVISKNLFITRLKDARRGPCCRELTGEECTEPIKLANPQFSHPSQRDLANPQFSHPSQRDDNGTTRLTWPDCFDMSIDVTLPPDCFDMSIDVTLPPGTXANXFSLQLN

SEQ ID NO: 155229 - protein, 65 aa, Heterodera glycines
  Coding regions on vcDNA: vcDNA=SeqID_81652; Strand=-; Position=1-223
RWANHRSEFVQWRKWGQWDEEKRKRSERRGGKGGATANDCLEKHSRLETAQRHKPIKELINELIN

SEQ ID NO: 155230 - protein, 37 aa, Heterodera glycines
  Coding regions on vcDNA: vcDNA=SeqID_81653; Strand=+; Position=1 -100,836-849
MVIKSATTVIRRGTTEIRRGTTVIRRGTTVTKREILE

SEQ ID NO: 155231 - protein, 21 aa, Heterodera glycines
  Coding regions on vcDNA: vcDNA=SeqID_81654; Strand=-; Position=1-65
RDVFFSALSIYCFMSRFLKRC

SEQ ID NO: 155232 - protein, 69 aa, Heterodera glycines
  Coding regions on vcDNA: vcDNA=SeqID_81655; Strand=-; Position=1 -69,170-310
MAGQLLEGSAAKNNGYDSKVYLKFSKASVDSIVGSLLTTMASSAVPLPKCDKLFVNSWFTVTSSLCSFG

SEQ ID NO: 155233 - protein, 28 aa, Heterodera glycines
  Coding regions on vcDNA: vcDNA=SeqID_81656; Strand=-; Position=1 -21,195-260
MNLFELKCGLSKCLVGRVFLIALMQKGN

SEQ ID NO: 155234 - protein, 39 aa, Heterodera glycines
  Coding regions on vcDNA: vcDNA=SeqID_81657; Strand=-; Position=1 -41,248-326
MKKRCKRGALPMVRSSRHNNQNKSASEMYFKNDDIAKFP

SEQ ID NO: 155235 - protein, 69 aa, Heterodera glycines
  Coding regions on vcDNA: vcDNA=SeqID_81658; Strand=+; Position=1-207
MLKLTRAQLNDGVPDQEQPPVGEQQSTQNSDISVDELPQRLKIWIVPSGAGDVSAVGYFLVKRIDARIW

SEQ ID NO: 155236 - protein, 41 aa, Heterodera glycines
  Coding regions on vcDNA: vcDNA=SeqID_81659; Strand=-; Position=1 -118,392-399
MIFLKFSSEKISQGFSSGKISVSQMITFFMKFFYFIGEGDP

SEQ ID NO: 155237 - protein, 164 aa, Heterodera glycines
  Coding regions on vcDNA: vcDNA=SeqID_81660; Strand=+; Position=1 -246,541-674,1312-1424
MVTAFHEANRLSDERRTSIQQFVDELQQGFRTETGVDSLQIELFGSVLSGFGSNDCDIDLCLINTGITKQEKVQPNGIISQEKRREWLNKLVQYLRKSELYTVISVADARTPIVKFEYHGEEGFHGEERERPAPLDYTLGASKIQIPGSSLTIEKNVICDYLLV

SEQ ID NO: 155238 - protein, 262 aa, Heterodera glycines
  Coding regions on vcDNA: vcDNA=SeqID_81661; Strand=+; Position=1 -50,792-1079,1130-1580
  Homolog annotation: Hit_ID=AAL78214.1; Match level="QueryCoverage =69%, HitCoverage=90%, E-value=4e-16, Identity=28%"; Hit description =putative esophageal gland cell protein Hgg-20 [Heterodera glycines]
MSENTAEAERRQMQNEIFICADCWLSVFHLLPPSQLGLGIALLSHRFDCLVDEHFKTRKWMMGNIEILYKIGENGQKEMKLHQSANFWEWRKVPIPQNPLPNKFIGFRHILITYIDSNVIAFLQRFRSFFASHQTNLSITTKSGDSHFLEIVVKNIWPMIKDKICAIGFLSPDEFCRFQQLVPSILSDNCCCCCPSLRAMFFYTGVLPNLPANDCANMSADQSVVKWLFSPRADGAPKVLRYSLQMNNKFPRKIDAFKRVII

SEQ ID NO: 155239 - protein, 99 aa, Heterodera glycines
  Coding regions on vcDNA: vcDNA=SeqID_81662; Strand=-; Position=1 -190,665-774
MTAPQKFIMPKTNRIVCYNCNKTGHISRHCRLSFTRKQSNCALKPPQHLNFMKKGADFRKNSEGQSLQRDFKLNRSAAEFTLAAPFNIELVDAVVIFPY

SEQ ID NO: 155240 - protein, 198 aa, Heterodera glycines
  Coding regions on vcDNA: vcDNA=SeqID_81663; Strand=+; Position=1 -438,499-657
MNQTDYGPMVLAHNGTSPSDQDKIRDEETDHWLTLTQTDQTTTDQNSTLSIDWMSNTIMKADHDATLSLGEDHGQTLEAKNDDEPNLENGHYGTTPTDYEPNEEKNAVDNADHNDMAVDGAHDLSSAEDYDGNDSISAKNQQENVEEALDDSKNAVDEKQQKVESDKHLDEYTWEQTLTKKCPLNCSENNLQCWRLSG

SEQ ID NO: 155241 - protein, 229 aa, Heterodera glycines
  Coding regions on vcDNA: vcDNA=SeqID_81664; Strand=+; Position=1 -55,109-192,268-381,786-873,951-1165,1208-1341
  Homolog annotation: Hit_ID=AAV34698.1; Match level="QueryCoverage =65%, HitCoverage=60%, E-value=1e-20, Identity=38%"; Hit description =IC5 [Globodera pallida]
MNSSSSTASFDDFDRNENEEKDDVIILNDDGQNEQNDHSVADKQLKASISQSKKMQNDQKEKKPNLEKGGELEKEQKKQEEKKNGWLSAFAKCAIPSNNFGIVYFEIKFVHLKKSAAIGFATKAMPFDGRVGLYGNSYGYESNGTLWVNGAYQTGHATFKFFDVVGCGIILENRQLFFTKNGRCLDHTDLFASSSVVPLFPCLSLHDNGDKILTNFGPNFEFDLNTLFC

SEQ ID NO: 155242 - protein, 67 aa, Heterodera glycines
  Coding regions on vcDNA: vcDNA=SeqID_81665; Strand=+; Position=1-202
MESDDAEAHAVDNDQNEVNDVVDADGMGNKNGQDRQQEDDHGGGGPIEVSISGMAFRAPKLSESEFE

SEQ ID NO: 155243 - protein, 63 aa, Heterodera glycines
  Coding regions on vcDNA: vcDNA=SeqID_81666; Strand=+; Position=1 -99,619-711
MHWMNFLDRKMISFIKRGLKCCLNDGGGSLIKMVRHTVNTSDACAEAPIAQAKQKAIASKLAT

SEQ ID NO: 155244 - protein, 128 aa, Heterodera glycines
  Coding regions on vcDNA: vcDNA=SeqID_81667; Strand=+; Position=169 -248,309-613
  Homolog annotation: Hit_ID=NP_506146.1; Match level="QueryCoverage =94%, HitCoverage=48%, E-value=3e-38, Identity=66%"; Hit description =putative protein, with 2 coiled coil-4 domains (5N52) [Caenorhabditis elegans] emb|CAB02877.1| Hypothetic
MTRCSVFVLTLLGVGMAHSLLMSGGSDLAPSANRVSRQCGCGGGCGGGGGGCGGGGCGGGGGGGSITLGVSCGGPSGGGGGGGCGGGGGGGCGGGCGGGGGCGGGCGGGCGGGGGCGGGCGGGCGGGC

SEQ ID NO: 155245 - protein, 203 aa, Heterodera glycines
  Coding regions on vcDNA: vcDNA=SeqID_81668; Strand=+; Position=1 -226,1001-1386
TFFDRWSSNGVKSGAPKNRAGGSVHFPATFCYNPQFAFEISEEDGPAEVMLALCQREEGCAFDGRPKNAKKLMKNECDVFCVFSSSQGSDRCRTFPAKFVPGRPVKFNALFVFHAFASQQWLLNFELIELRKPFQRQNRLLGVGRLALISNNESIEMEMELIRPIEKRKAPIGGEGKGRGKVGEETIGKARIEISAYDDPFYI

SEQ ID NO: 155246 - protein, 111 aa, Heterodera glycines
  Coding regions on vcDNA: vcDNA=SeqID_81669; Strand=-; Position=1 -288,607-652
  Homolog annotation: Hit_ID=CAD22154.1; Match level="QueryCoverage =100%, HitCoverage=51%, E-value=4e-51, Identity=72%"; Hit description= pherophorin-dz1 protein [Volvox carteri f. nagariensis]
PPPPPPQPPPHPPPQPPPHPPPPPQPPPHPPPHPPPPPHPPPQPPPPPPPHPPPPPPPLGPPQLTPSVILPPPPPPPHPPPPHPPPPPPHPPPHPPPFGPPFYSAPPPPWP

SEQ ID NO: 155247 - protein, 29 aa, Heterodera glycines
  Coding regions on vcDNA: vcDNA=SeqID_81670; Strand=-; Position=1-89
MLSQYFAQQFYLCPHNRQRFDKKLLYCEK

SEQ ID NO: 155248 - protein, 98 aa, Heterodera glycines
  Coding regions on vcDNA: vcDNA=SeqID_81671; Strand=-; Position=1 -225,1623-1694
MEEEEEDEEEEDEGCDGDNGPVHPMLAMMDAASKGADELAEMTHHQTQQRIPAAERTETAKTHKNFGEKGQLLLIYMPFYFIMSNENEYTSSYSTLRI

SEQ ID NO: 155249 - protein, 43 aa, Heterodera glycines
  Coding regions on vcDNA: vcDNA=SeqID_81672; Strand=-; Position=1 -30,206-307
MAFAIPYIESCKNLSPMGTAARCDGTARNVAAQGQTEQRKDTN

SEQ ID NO: 155250 - protein, 98 aa, Heterodera glycines
  Coding regions on vcDNA: vcDNA=SeqID_81673; Strand=+; Position=1-297
MKWAHVGGGTASTTTTTLVTTTDGDDQPLFQLEEMGGDTNEMVVVTSSSSSTNESDDGGGRDEEEEAVFGRHGGRRSGRKMRTNQQQKLDDDDDDDGL

SEQ ID NO: 155251 - protein, 100 aa, Heterodera glycines
  Coding regions on vcDNA: vcDNA=SeqID_81674; Strand=-; Position=1-303
MHKISHIFCFSKNSLLLLNQWQNRFSVGKCIATNNHNEINVEDIKQKCLKRLSTSMKPKPKPMMMCHRLIPWDLQKRAKSNRQQTPHNKSVYPNRPFVLD

SEQ ID NO: 155252 - protein, 30 aa, Heterodera glycines
  Coding regions on vcDNA: vcDNA=SeqID_81675; Strand=+; Position=1 -47,993-1038
MNQKMIKPYVINCCNEMKKMSPWELDKETN

SEQ ID NO: 155253 - protein, 78 aa, Heterodera glycines
  Coding regions on vcDNA: vcDNA=SeqID_81676; Strand=-; Position=1-327
IDFFVFGAVPPNRCAQIYGETESFGNSFPIVCTLILRWIFAPHNCVSTPNGHLKKSIFLFHKYFFRNCSETHQILFTC

SEQ ID NO: 155254 - protein, 190 aa, Heterodera glycines
  Coding regions on vcDNA: vcDNA=SeqID_81677; Strand=-; Position=1 -142,199-326,478-694,974-1059
MRKSIQENTEDKVSSICVMGYLLNIIDDLNEYIRETAADLSRESPENAESARLISNSSLLETLNLRVVGRKIESIANTITLTMEDEIRKLKQSENETETPEGMAADELSRSLPSFSVAPHNYATGVGHGLLSQMSTIGAYGNDRNFVRSIASAASEINSSFNDDEADLWLLTEVSAGSKLAFAASPCLLH

SEQ ID NO: 155255 - protein, 18 aa, Heterodera glycines
  Coding regions on vcDNA: vcDNA=SeqID_81678; Strand=+; Position=1-54
NSYNWRLFKGIQPVQEGV

SEQ ID NO: 155256 - protein, 91 aa, Heterodera glycines
  Coding regions on vcDNA: vcDNA=SeqID_81679; Strand=+; Position=1 -749,914-1209
LFEYPKRTLEKIDFFVFGAVPPNRCAQIYGETESFRNSFPIACTLILRWIFAPHNCLSTPNGHLKNRFFCFRGSPPEPMRPDLWGDRILRD

SEQ ID NO: 155257 - protein, 266 aa, Heterodera glycines
  Coding regions on vcDNA: vcDNA=SeqID_81680; Strand=-; Position=1 -96,155-332,404-930
  Homolog annotation: Hit_ID=NP_494447.1; Match level="QueryCoverage =99%, HitCoverage=66%, E-value=7e-22, Identity=32%"; Hit description =c-type lectin precursor family member (2D393) [Caenorhabditis elegans] gb|AAD12833.1| Hypothetical protei
MVLFALLPVQLMLVVAAVCLVIITQCCGGGQKNTEEPQMPAGPEGAEASAKPTGQSAAPGGTSAAGGTSAVGQQPAEASKKSLAPAGTASAAVPSTYAAPGTGTTLCTASQKTAPAGGTSTLGTASQKTAPAGGTSTLGTASQKTAPAGGTSTLGTASQKTAPAGGTSALGTASQKTAAAPAGGTSALGTASQKSAAAPAGGTSALGTASQKTAAAPAGGTSALGTASQKSAAGGTTLKSAPVGGASALGTASQKSAAGGAASQKA

SEQ ID NO: 155258 - protein, 53 aa, Heterodera glycines
  Coding regions on vcDNA: vcDNA=SeqID_81681; Strand=-; Position=1-210
FLLSTSADQPNTYIQYTYIYTNNDHTTVLQMIYVITDNRAIRHRYVGEQYGVF

SEQ ID NO: 155259 - protein, 344 aa, Heterodera glycines
  Coding regions on vcDNA: vcDNA=SeqID_81682; Strand=+; Position=1 -198,249-501,1225-1454,2169-2310,2447-2658
  Homolog annotation: Hit_ID=NP_741492.1; Match level="QueryCoverage =30%, HitCoverage=30%, E-value=2e-13, Identity=36%"; Hit description =bacillus thuringiensis toxin REsistant BRE-5, beta 1,3 -galactosyltransferase, Bt toxin resistance protein
MQFFGGLVFFFVIFHANGNPIVLTTTLAKALKATLTVGAVAAYTGWRALTKTNGILDGFGEQMKEKPHLFAPFFPLIFAIAGGEVLVEQDKFEMDYIFDLFERMTERDQLDKICFDGAEGEKNVIEKAEGNLPLFIFYAAMNDKKLDVYLSYCFCLFSPQSEAPPAVPAPAVGTGGDTFFRLRTIFVLGRPAADDAAQMNALESEAAAHGDLLVGDFMDTYFNNTLKVSLDEFPFAAFPPYIAAGAVLLTGQTIAEFYAAIPHVRLFRLDDIFAGILSHLLAITPQHNANFAFYRQSFADDSLALASSETLTTLIAVHDYLPEEMRETYGKAVKQQNQQKLKLL

SEQ ID NO: 155260 - protein, 106 aa, Heterodera glycines
  Coding regions on vcDNA: vcDNA=SeqID_81683; Strand=-; Position=1 -306,456-470
MVGEKQRSDQQRHHNERHLNEGREKHSNGRKSKTNGSDQKREEKQGKMKADGEKCQEKRKSVSGEERHELVDQKGERTMQSVKDGAVHHVGQEKGRTDVLKKFFEK

SEQ ID NO: 155261 - protein, 665 aa, Heterodera glycines
  misc_feature (429)..(429): Xaa can be any naturally occurring amino acid
  misc_feature (433)..(433): Xaa can be any naturally occurring amino acid
  misc_feature (546)..(546): Xaa can be any naturally occurring amino acid
  Coding regions on vcDNA: vcDNA=SeqID_81684; Strand=-; Position=1 -39,180-223,802-906,966-1214,1283-1328,1365-1464,1551-2248,2569 -2832,2902-3115,3238-3403
  Homolog annotation: Hit_ID=NP_505267.1; Match level="QueryCoverage =100%, HitCoverage=17%, E-value=1e-81, Identity=32%"; Hit description= regulator of Presynaptic Morphology RPM-1, Synapses of Amphids Defective SAD-3, Synaptic vesicle tag Abn
VSAQGDRTVVQVQQLWRNRHGHRKDGNGANTVRNCRVVRRFQNFGGSWGYSAHCVEAIQFMTNCCEITFCGVGLFGGRGEYTARLKLYRAIDKDEVGTEAQQQCVELLAETDEVLYECGTRETATLQLERPIAIIKDVWHLIWVQIQGPSSDCGTGGRETVRGPSSDCGTGGRETVRACCAEFRFRACCAEFRFRTSELSNNGTNVEVGQIPELYFLPIGRSLLRRRSLLRRESSSRPITMTIGWPSRFVRSSVNSVSGIHQLLLIVEWALDGAFRAGAEETDELINCDALWRQERAAFVAVLSIRLIRHFLCIPSAGKNAEEMVEFHRLLKGILCRKSWTSATFSKHCLIHKISKDRISAFVTAEAALTCTILAREFAPNSALVRMRLVEQLRRNNENGAKAKGKANDWWLFAVLCSMSRLDNVRKEXLKDXLANYWTDLLIPLRTFCQSFEFLFDGISLRLPSVAQRLITSLAHRLISRALPQPKTIGEAAPLQSPSRFRHISAHAQWEVGGNRHASAWDAVAFRVDGPGIALAGVGIFLPIFXVSKNPIHQRHSLGPQNEWHSVERVTGQTDTFPTQIVHFAHAFPLRPGACYAVKVRFEGPGKTLFGEGGLLSIQIRDQIRLHFLPCDLSRNGTTVSRGQFPFFLLTVADPKEKLQQKQKS

SEQ ID NO: 155262 - protein, 159 aa, Heterodera glycines
  Coding regions on vcDNA: vcDNA=SeqID_81685; Strand=-; Position=1 -117,481-564,967-1114,1179-1246,1762-1815
  Homolog annotation: Hit_ID=AAT37524.1; Match level="QueryCoverage =76%, HitCoverage=15%, E-value=7e-31, Identity=54%"; Hit description =epidermal growth factor receptor pathway substrate 8 splice variant B [Caenorhabditis elegans]
ATGDFDYSAPPNAMHQNHHHHHNHHSPSYNVEHLASFAVGSHFSVLSPADGVRKLKQMEQNSAIWWVPMIFSLFPNRISVSELNGNLVEEFPMDLVSDPTAHTSSDPRDTFNNMLLFIVLFIVLEHVVSDGGTVPTELHIFQCITVSKITDAIKLYKFN

SEQ ID NO: 155263 - protein, 86 aa, Heterodera glycines
  Coding regions on vcDNA: vcDNA=SeqID_81686; Strand=-; Position=1-258
MKKRMEEKMNEKRQKEGKRRGEGKRKWKKRREWKKDEGKGRDERKGRDEGKGRDERKRRDEGNGRDEGKETTEGWDAVLYYLLMAQ

SEQ ID NO: 155264 - protein, 92 aa, Heterodera glycines
  Coding regions on vcDNA: vcDNA=SeqID_81687; Strand=+; Position=1 -99,226-405
  Homolog annotation: Hit_ID=NP_498631.2; Match level="QueryCoverage =89%, HitCoverage=7%, E-value=3e-16, Identity=52%"; Hit description =myc and Mondo-Like, Mlx transcription factor InteractOr like, basic helix-loop-helix and cyclin C-terminal
MSSNANEPIHSGHFMTSNPHSEIPPDDEDEDVEVDVVDVDDANSLSAAQTADKSTAKGSLLKDEDRPVTFYKFGSQKTQSIVIDQSLNNLPQ

SEQ ID NO: 155265 - protein, 98 aa, Heterodera glycines
  Coding regions on vcDNA: vcDNA=SeqID_81688; Strand=+; Position=1-299
  Homolog annotation: Hit_ID=XP_316282.1; Match level="QueryCoverage =88%, HitCoverage=20%, E-value=5e-12, Identity=37%"; Hit description =ENSANGP00000020626 [Anopheles gambiae]
QISSQCDINSEFNEFLTFERAPINSDPFEWWKKHGPKLPMLSKLAMKYLSAPATSVPSEQTFKVARDVYDYRRSRLKPKTAEMLIFLNKAIPMLDYKY

SEQ ID NO: 155266 - protein, 74 aa, Heterodera glycines; identical to SEQ ID NO: 139487
  Coding regions on vcDNA: vcDNA=SeqID_81689; Strand=-; Position=1-273
  Homolog annotation: Hit_ID=AAS21248.1; Match level="QueryCoverage =87%, HitCoverage=10%, E-value=7e-09, Identity=43%"; Hit description =transposase [Anopheles gambiae]

SEQ ID NO: 155267 - protein, 142 aa, Heterodera glycines
  Coding regions on vcDNA: vcDNA=SeqID_81690; Strand=-; Position=1 -223,291-496
MFLISIALAFSIQFHSSVADPENQLGFKCTNVSNSQNYGCSAEGNVLRFFVIGDIGGEEYTVEGKQQQCTVEGHVEDTWMGTIKCLLKFSMECFCVIVGSVSSIQRPLMHTPFFRCEPWHCQTTIEPRPSGVIVHELLRTLP

SEQ ID NO: 155268 - protein, 113 aa, Heterodera glycines
  Coding regions on vcDNA: vcDNA=SeqID_81691; Strand=-; Position=1 -122,341-442,613-730
MPPEFPTVPNGNKSVVIFFIFPIDSKDRCGGQSARIHVGFEIGQWRRALPRNGTPSHFVRKAQRIGARFVGLDTLPSATELLHKYENSLFAFGPDFSLRKALADYLPLAKPIV

SEQ ID NO: 155269 - protein, 26 aa, Heterodera glycines
  Coding regions on vcDNA: vcDNA=SeqID_81692; Strand=+; Position=1 -37,940-983
MAKIGTEGAAEEEKETVKSQGGKKTI

SEQ ID NO: 155270 - protein, 213 aa, Heterodera glycines
  Coding regions on vcDNA: vcDNA=SeqID_81693; Strand=-; Position=1 -132,180-335,432-461,1000-1324
PTNTRLVATSAAFPIPVQPQPVFLYGSTPPFGSPPLLISQFTNWTSPMESGGFMSGAGFYNINAFNTANATASSEGKSPQKQSETSFESEEEHSKRTTAEEDDSECHVSFTVATSVLHGHDESEHSFGSVGWNLELPPLPVGQLNIPIPLCPSKFLLLLTSLCSDRLPMSLTPSRVTRQSPIFAQSFDRPTPPMLRLNSSPIQSRHCPLCRNW

SEQ ID NO: 155271 - protein, 85 aa, Heterodera glycines
  Coding regions on vcDNA: vcDNA=SeqID_81694; Strand=-; Position=1 -244,1024-1037
MRRGTRAIRRGTTAFRRVIRRGSTVIRSGTTAIRRGTTGNRRGTTAFRRVIRRGSTVIRSGTTAIRRGTTGNRRGTTVIKREILE

SEQ ID NO: 155272 - protein, 24 aa, Heterodera glycines
  Coding regions on vcDNA: vcDNA=SeqID_81695; Strand=+; Position=1 -22,269-321
MYLFNFYSLIDHIYMYRMIPTMSD

SEQ ID NO: 155273 - protein, 111 aa, Heterodera glycines
  Coding regions on vcDNA: vcDNA=SeqID_81696; Strand=+; Position=1 -39,345-641
MPVRKSKWTTLGSHEGHGTYCVQAGAPLPEPAAASPPRSAPLPSPAAARSAPLPAPAAASTQHKGAIAAFAGRCQSTSLGSLACAGRCQSTSLGSLACAGRCQSTSLGSLA

SEQ ID NO: 155274 - protein, 207 aa, Heterodera glycines
  Coding regions on vcDNA: vcDNA=SeqID_81697; Strand=-; Position=1 -21,639-1226,1997-2023
  Homolog annotation: Hit_ID=AAF76983.1; Match level="QueryCoverage =98%, HitCoverage=97%, E-value=3e-36, Identity=44%"; Hit description =fibroin heavy chain Fib-H [Bombyx mori] sp|P05790|FBOH_BOMMO Fibroin heavy chain precursor (Fib-H) (H-fibr
GGGDTFGYGSGKGAERGGLAADGDGSYGAGKGADSGSGKGAERGGLAAAGAGKGAERGGLAAAGAGKGAERGGLAAAGAGKGAERGGLAAAGEGSDGSLGLSAGSGGSGKGAERGGLAAAGAGKGAERGGLAAAGAGKGAERGGLAAAREGSDGSLVLSAGSGAGKGAGAAAGEGKGAERGGLAAAGSGKGAPACTQYLSHGHYDSE

SEQ ID NO: 155275 - protein, 64 aa, Heterodera glycines
  Coding regions on vcDNA: vcDNA=SeqID_81698; Strand=+; Position=1-196
ITGSIVLSSPQHLCLRPHLHKSINSPNFFNTQTSCMFYSFRQLPNAGETEATTKVAPQQQPSPF

SEQ ID NO: 155276 - protein, 490 aa, Heterodera glycines
  Coding regions on vcDNA: vcDNA=SeqID_81699; Strand=-; Position=1 -691,837-955,1013-1117,1263-1466,1905-2258
MRKFRAEFCTMLKEILLIGIALKNDQTNKIKSDRKVNNMVITNDGKMPINRIYHENLIDNQQNHTVTDLSDRKENGKSDEKMHKQSDQKLRKSHRKKKTPLPLITLNYQQQNTVGEQRNDTVTDANDQKTTVPATDQKMNGQSDQIESEPQLIAIRDQLHRNNFARLISGDDETARAAWHNLTDEVQFGVITVLLGRRGGRDGGKKYSNTRAQFLKYLAKWKKLRDQTELDERLFDEYNKQNSEQILDRNYVQNMQQIKYNTQTDIYTNLLIKILRANGFDGIEMHKQKQIEEELEKIRDTVAKWSNGTGALLLGGSSLMGVQTADSDIDTVCIVPAHIHLDAFFGTLHCLSSGEEKEGQKCEDDSLFYMLGQFNNPEGFSSLKSMLHLCFILPVLQLADFGSVRAIANTSVPLIRLISRSGHQFDIVFASVAQMESISMAQLLNGNAETFGQLAQKMATELMEEGDGILEREEEETVKIARMARSLSGD

SEQ ID NO: 155277 - protein, 128 aa, Heterodera glycines
  Coding regions on vcDNA: vcDNA=SeqID_81700; Strand=+; Position=1 -146,253-493
  Homolog annotation: Hit_ID=CAE59344.1; Match level="QueryCoverage =100%, HitCoverage=12%, E-value=2e-18, Identity=46%"; Hit description= Hypothetical protein CBG02689 [Caenorhabditis briggsae]
VGLLAVDEAHFISQWGHEFRPGYRQIADIRNVLTGVPVIALTATATDPNYRKNLFIEVQKRTQSLRWRLSSLISNMRSNSNFSFEKCVQNDLERLLEDDPKTGPNFGGPTIIYCQTRELVNQLTQQLR

SEQ ID NO: 155278 - protein, 133 aa, Heterodera glycines
  Coding regions on vcDNA: vcDNA=SeqID_81701; Strand=+; Position=1 -209,268-460
MEMVPFELVNECTKEKLTLAKANENELDKSWIMKRCKIGETAAVNWEDGNWDNNCNNVFFWLFSGTNCIGPLSPPPPARRRRSGTKHHKGRNQRIETWRKKCQFEAELRTVKTGENVHPNVVANPTEMEKQFS

SEQ ID NO: 155279 - protein, 33 aa, Heterodera glycines; identical to SEQ ID NO: 128175
  Coding regions on vcDNA: vcDNA=SeqID_81702; Strand=-; Position=1-100

SEQ ID NO: 155280 - protein, 97 aa, Heterodera glycines
  Coding regions on vcDNA: vcDNA=SeqID_81703; Strand=+; Position=1 -11,72-354
MNRRWICNDVWMDILPSFDHAQLGLKLALLSPRFDALVDKHFDGKSELTIWRSIEIRRKDKGPETKLSVRMDDKFVEFPLPDRPLPSKIRFKNLRIG

SEQ ID NO: 155281 - protein, 123 aa, Heterodera glycines
  Coding regions on vcDNA: vcDNA=SeqID_81704; Strand=-; Position=1-372
  Homolog annotation: Hit_ID=CAE56537.1; Match level="QueryCoverage =87%, HitCoverage=10%, E-value=3e-10, Identity=34%"; Hit description =Hypothetical protein CBG24264 [Caenorhabditis briggsae]
MADQLMLSFKQKINAGKYATAEPFLAKLGIQTTSEEEKRFITENLDDWRVITATWFEMARHIGTVQSLATVDGFAGRHKASLLCSKIHYCREQYNLALEYALSAGNEFKLVPRAEDKKGMTLW

SEQ ID NO: 155282 - protein, 167 aa, Heterodera glycines
  Coding regions on vcDNA: vcDNA=SeqID_81705; Strand=-; Position=1 -111,181-418,490-561,885-965
MGTDGHPTENGVRTERTKGKGLSAEVLPTGRTVQKGTRAIEILEVILKMSDGWLVTIPLRDEDLADEEIVERAEDFIRIRKDYLASLLQKLIDIYHRSDMPMSVLDTATLIMDPLYCIGQRKAAKTVEIDLPSRRISPLNSVRGEDKENRETTDTAKYGVDYDEMDK

SEQ ID NO: 155283 - protein, 253 aa, Heterodera glycines
  Coding regions on vcDNA: vcDNA=SeqID_81706; Strand=-; Position=1 -63,111-384,1069-1323,1426-1595
MHDFARNRLFFKQTARELVPVDDDRVQKSDQCIWATFGGDLATLLSHALSTEDRLWAYLSCAAEALLDEELLKEHKKKDGELMALATDIQRREGMDLPKDVPAIFAELRNVSELTFVSEQKEVLENAMKIGFDVPNLCRDVYRRFKDKHNFGPNVAREALRKAAEELILAWKWLAFCETETVWDAIIEANFLLRKFFLYGLMSEALQLMQLAPEKLPEIALRTFQTEFPDKEIPTKLKDAQREFDCYQLYFVS

SEQ ID NO: 155284 - protein, 76 aa, Heterodera glycines
  Coding regions on vcDNA: vcDNA=SeqID_81707; Strand=+; Position=1 -94,261-397
MCRKYNEKWAEEHNDLTCEQFAKQKNVKDILDAIKFRDKQKTEEEIKKREYAKCPGCKTHVERIEGCKFVIWEDYF

SEQ ID NO: 155285 - protein, 108 aa, Heterodera glycines
  Coding regions on vcDNA: vcDNA=SeqID_81708; Strand=-; Position=1 -18,367-675
MGALKASFSIASYRVNFIIFVCFCSSSFADDSIFELNNKFTGEKLAMKKINNDGCFLLVRCPISRYENKWTKWEEEAIELNICGQWSKIDIGINEEGIGDGCVIRVHN

SEQ ID NO: 155286 - protein, 243 aa, Heterodera glycines
  Coding regions on vcDNA: vcDNA=SeqID_81709; Strand=-; Position=1 -108,337-459,522-611,797-996,1183-1393
MAGHVLIVERICATIYVSTYEQYSSWKFTIVWLFIMITTSLAVTICQISVSNSFYKLSYIAIVLYFGATIASLIEIFALSMITKINQKLFNSRVGGGTNQQLSVRYQLNENIRTGRQLAPNFLCHFITVFITFIVTMNSQFGIITNIEPMTMFYQVLFLSHAFNDLALPVAMLCYHPLLNRKAKASLATIKQLLRNSSTVSPQEETAQPLDTDGRPISERIQQENQDNEAYFKQLASAWGDRA

SEQ ID NO: 155287 - protein, 48 aa, Heterodera glycines
  Coding regions on vcDNA: vcDNA=SeqID_81710; Strand=+; Position=1-198
KKDERDNYLSLIRCQKLIRSMTSFFKKCSFLRSSARQCSSAQAFLLYP

SEQ ID NO: 155288 - protein, 21 aa, Heterodera glycines
  Coding regions on vcDNA: vcDNA=SeqID_81711; Strand=+; Position=1 -53,114-126
MASASARIRGRTRRPSARKRH

SEQ ID NO: 155289 - protein, 222 aa, Heterodera glycines
  Coding regions on vcDNA: vcDNA=SeqID_81712; Strand=-; Position=1 -85,134-313,373-599,644-817
  Homolog annotation: Hit_ID=NP_001004509.1; Match level="QueryCoverage= 73%, HitCoverage=11%, E-value=2e-15, Identity=31%"; Hit description =si:busm1-180o5.3 [Danio rerio] emb|CAD60788.1| novel protein similar to DNA polymerases [Danio rerio]
MFGITIDPEQMAVNKGKRSIAKLCLNNLWGRFSLRNFGLAQTVITDDPAVLAEYLDNKSIDVMSIDELNETTILISYMQKKEWVEEHEFISLWTTSAARLLLLRAMQMVGRTPECRLLYTDTDSLIFAHLIANCPLQTGPHLGQFTDEYPDHEIVEYCSGGTKQYGLKLKRNGSVEHALVSAAAVVGAGASINASLLPPMAPPPHLPLSMAPPPLQSRHSRP

SEQ ID NO: 155290 - protein, 36 aa, Heterodera glycines
  Coding regions on vcDNA: vcDNA=SeqID_81713; Strand=-; Position=1-112
KFRCLTCAWIFELDLDLWKKPALDPSLGRILIYSNV

SEQ ID NO: 155291 - protein, 82 aa, Heterodera glycines
  Coding regions on vcDNA: vcDNA=SeqID_81714; Strand=+; Position=1-309
LISSQNSCQFKTAKKAEFSKFFISIFFYSSKFSVIFSRLIEPVKSFRMISRLFDSVNNFKSYIDSKLAQTELARRSWPVPPV

SEQ ID NO: 155292 - protein, 458 aa, Heterodera glycines
  Coding regions on vcDNA: vcDNA=SeqID_81715; Strand=+; Position=1 -139,328-473,515-567,610-742,795-969,1027-1093,1151-1213,1278-1586
  Homolog annotation: Hit_ID=AAK94490.1; Match level="QueryCoverage =100%, HitCoverage=35%, E-value=1e-169, Identity=70%"; Hit description=PAZ/Piwi domain protein [Heterodera glycines]
YEFIIRPATDFEVNDLSFITNDVSKMERPLEQFLNIATAQKANMDGKKFFGFSSSPVYLLAPFDYGFKTNECPVFDSNHSFLGVGVNKRCRIIEGDQGPGQMTPADQGPGQMTPAIVIQTKKSAFHIPDMCILDKAKTLLFSAFHIPDMCILDKAKTLLFRENQGRFETGGFTQSDYEALCNGLVGIYAEPRYGTSGRFFRISIYAEPRYGTSGRFFRISDITKPNTGNGLNAENTFITHQVSGKISVKQYFEDTYRKTLQYPKAPLLVNYRRIGDPAYYPYPKAPLLVNYRRIGDPAYYPMELCFVLDCQRVKSSQQHPEQLCFVLDCQRVKSSQQHPEQIRKMIKETAVPPTVLQAHKMIKETAVPPTVLQAHNERVKESLQLVDNEYLTNASVHFDTTPLHVDYRVLGPPATLYRNNHRVTPAASNCEWHPGDALVNAQIDTVAYALPAGDVRRL

SEQ ID NO: 155293 - protein, 176 aa, Heterodera glycines
  Coding regions on vcDNA: vcDNA=SeqID_81716; Strand=+; Position=1-8,63- 280,337-508,557-654,792-826
  Homolog annotation: Hit_ID=AAK94490.1; Match level="QueryCoverage =93%, HitCoverage=15%, E-value=5e-76, Identity=86%"; Hit description =PAZ/Piwi domain protein [Heterodera glycines]
MWSNICQLKTEISVDKYAGEMRNKGIVCKPPVRVSICWFTSVNKVLEVLHKEALNGGVKFCLIGHAKGSEGDDVHATIKAFEQQTEIVTQAITFDVLKDVLDKGSPLTVANCIHKTNVKMGGLNYALHVDDPSVAELFDGQTLFLGFAMNFPDGFAPSESAAPINVGRDNRKTTQG

SEQ ID NO: 155294 - protein, 98 aa, Heterodera glycines
  Coding regions on vcDNA: vcDNA=SeqID_81717; Strand=-; Position=1 -156,245-385
MHDIALDENMAPGNYVYPSYEEGGDRQRQSQQQLQGHHPSYESNETLRQQQQEVGDDWDSLESFSFEMLGFGAGRQMEAPPRQNNASGAVGHSPKPPS

SEQ ID NO: 155295 - protein, 476 aa, Heterodera glycines
  Coding regions on vcDNA: vcDNA=SeqID_81718; Strand=-; Position=1 -108,247-358,414-515,711-918,1035-1161,1218-1283,1363-1448,1495 -1564,1624-1680,1746-1828,2059-2315
  Homolog annotation: Hit_ID=CAE67542.1; Match level="QueryCoverage =100%, HitCoverage=73%, E-value=1e-109, Identity=47%"; Hit description=Hypothetical protein CBG13067 [Caenorhabditis briggsae]
LSDTAVIAQQSPPNAEPDSLFAQQSVAGEDIPWWQRNFLLQQPTLVNAWNAVFPTVVVNIFGIVIFLRMGWIVGTAGLFQAGTAGLFQAFVVLALCTLFSSVTVLSAIGICERCQIRSGGIYFLVSHVLGKRIGGAVGLIYTFGQACATALVALGFGESMAKLAGIFSPVAIKTLSVLVLVVLNANFAGLRFIIRLQLLLMCFLAIAIGDFLLGAVLFTPLDSGIFEMSAERLSLNWHSHYGPANCEMSAERLSLNWHSHYGPANCTPNNAMALLGQESFNNAMALLGQESFFSVFGILFANFIGVLAGVNMSGNLVNMSGNLVDPLRNIAEGELSALGASFALASFALCFLIMLILGASVDRHSLLHSLLCDVMISERLSLTKLLFLGGLYIASLFSKDSPSKDPLKATVLVTAVAVLLVLLGNLNQMAILSSMPFLLTYAFVNYSYVSLAMSDDLDSLEHAKVSKTKGGGKEKK

SEQ ID NO: 155296 - protein, 47 aa, Heterodera glycines
  Coding regions on vcDNA: vcDNA=SeqID_81719; Strand=-; Position=1 -82,492-553
MEKVSYYYYYYCEKSNLKELMTLNLGKRGPLSLYNKNTTAYYTIIFD

SEQ ID NO: 155297 - protein, 38 aa, Heterodera glycines
  Coding regions on vcDNA: vcDNA=SeqID_81720; Strand=+; Position=1-115
MDKRRNERPKIMGEKNKKKKSTAAREEKDEDRAEEERK

SEQ ID NO: 155298 - protein, 187 aa, Heterodera glycines
  Coding regions on vcDNA: vcDNA=SeqID_81721; Strand=+; Position=1 -370,455-648
MDYFRFSIHFLVLRQRIPLSEIVPMRNLSNKEILTELVELLLLKKSQKNREEQTNGQKEDKKGKKGDKNGEKRNKNGEKGNKNGENSKSGKKKNADKAKESRLLRLMNTMVNNLNGTANLRKGDDQRKRRKKRMPDNLLRFILNLLFVGIIFCLVMMLILMSGEAMVLTGRNLKANFEEQTSNQNEN

SEQ ID NO: 155299 - protein, 55 aa, Heterodera glycines
  Coding regions on vcDNA: vcDNA=SeqID_81722; Strand=+; Position=1-168
WGWHDAYVAPKHGSNGHGHDECWQYQFRQFATIQYGSVSKGDRGRHCRGYPGEIF

SEQ ID NO: 155300 - protein, 128 aa, Heterodera glycines
  Coding regions on vcDNA: vcDNA=SeqID_81723; Strand=+; Position=1-387
MKFCVLQSPKIHFTFAKKPKKHIHVPKIQTLARSIFIDALYGRAFLLAVLLFGKLERLYWSASEKWPKWQKAPTDKTKELSDAFNDASRLFLLHGPVQLWEISQVYSDAIQKFITEERRKFTKAKSEV

SEQ ID NO: 155301 - protein, 197 aa, Heterodera glycines
  Coding regions on vcDNA: vcDNA=SeqID_81724; Strand=+; Position=1-594
  Homolog annotation: Hit_ID=NP_702892.1; Match level="QueryCoverage =72%, HitCoverage=11%, E-value=3e-10, Identity=29%"; Hit description =Plasmodium falciparum trophozoite antigen r45-like protein [Plasmodium falciparum 3D7] emb|CAD49281.1| Pl
MVVLMLLKAMIIIVLICYVISNDKEKDKAHTSIGNSKAHKSDLYSDKSNLQPDDAQINQQHLNANRDSNKFDHNHNNGTNTNYDANQHDQHHHANGVDGDSDDNQLDQLYANHQLVQLHANGNNDHPENDNLDDNNNSDKSKIVDLDDEFWDQLPELTKLPELNGVEFVGNHIKYTNQPKSDTHKDKEINNSKRTLS

SEQ ID NO: 155302 - protein, 395 aa, Heterodera glycines
  Coding regions on vcDNA: vcDNA=SeqID_81725; Strand=-; Position=1-1185
  Homolog annotation: Hit_ID=XP_318550.1; Match level="QueryCoverage =83%, HitCoverage=34%, E-value=1e-68, Identity=45%"; Hit description =ENSANGP00000020240 [Anopheles gambiae]
MAADIVPFHRRPFALTIEDECLLYADRVVIPASLQKDVLQLLHRGHPGMKRMKGLARQYVYWPGMDEQIENFVKMCNECTMEAKAPVKTELHSWPKSDGPWKRVHLDYAGPFMGKMFLIIVDAYSKWPEVFEMRSSNSAATIDKLRSLCASYGLPEILVTDNGTQFASKEFKEFVTENGINHLFSAPYNHMSNGQAERFVDTFKRTCRKIKGEGASEMLTTFLATYRTTPCEALPECKSPAELFLGRKPRTTLDLLRPKPKAPIIRDEAMEKQFNRRHGAKPRSFAVGDKVLARHRLSQPWRPGKVTKCKGVIYDVEFFDGKFGRFHANQLLVRSTDENGTNALNVFNDAFDLPLAPPLVQHGGQAQLPVVAPAAVIAPAVAEEPVVGEADRAPE

SEQ ID NO: 155303 - protein, 263 aa, Heterodera glycines
  Coding regions on vcDNA: vcDNA=SeqID_81726; Strand=+; Position=1-792
MKYLAWDEKSEENGGNETDQNGTIGQKDGQNVTKNDQIFDENLEMKEESARNCDQLEQMHFSNAIDKKKREIVKKFHRIKEKIKQIGKKYSKKEWQKIERKIAKKLRVNQRKIYKWKREFGMMKNKNYSVEEKRIMYFSKFDQIYAKLKMKLHEKLEGKREKCKKIIAKHLGIHIKTIFYWKKQLKVGKYFINQKNDDEKTEIVEKYLEIKNKFMKNGKRKDWNEFTAKIKQIFGVHNKTIERWANKIGINQKPLSDPHSLGI

SEQ ID NO: 155304 - protein, 178 aa, Heterodera glycines
  Coding regions on vcDNA: vcDNA=SeqID_81727; Strand=-; Position=1 -7,247-776
  Homolog annotation: Hit_ID=E86336; Match level="QueryCoverage=93%, HitCoverage=34%, E-value=2e-30, Identity=43%"; Hit description =hypothetical protein F14O10.11 - Arabidopsis thaliana gb|AAF88160.1| Contains weak similarity to an unknown pr
MEGFGSADRHRQENKVEEKVEEEQKVEEEQKEKAEEEQKGEQEEEQKEEEEQKVEEKVEQKMEEKVEQKMEEEQKVEEEQKEKAEEEQKGEQEEEQKEEEEQKVEEEQKVEEEVEDEQKVEEKVKVEEKVEEEEKVERNRKWKRNRKWKRKWKRNRKCKRNRKWKRNRKWKRKIKLNS

SEQ ID NO: 155305 - protein, 140 aa, Heterodera glycines
  Coding regions on vcDNA: vcDNA=SeqID_81728; Strand=-; Position=1 -162,244-503
MMAAATQSATVGSTPAPPVQHHVSFITPLMANNNGTKAMIDDNMLVAVVGDHGEGGSGGAVGCFEEPADKRSRHASRDSCGSVNDQEIKQLLTSRQQQQQQQQQLAEKKQLQQHQQLPYASSTVGVVVHHQQQQQPKTFP

SEQ ID NO: 155306 - protein, 195 aa, Heterodera glycines
  Coding regions on vcDNA: vcDNA=SeqID_81729; Strand=+; Position=1 -219,1960-2101,2932-3158
MAAATAVNCAGAVHQQLLLLDVYAAAEVTVFPTVVVAPLVAGATGAASAAVVQSSPQFRYRSGGTVTGTVVVDHINSENGGCCDDEHATREEKAEEGHRLGSRRRHFGKNGEKEANGQQDADFKDARGNPRHISIIVHDHICGESRVETGVHRIVQQNIGPPNFANGKSDIATRKNAKDWRTRGEWDNRPYVTVL

SEQ ID NO: 155307 - protein, 248 aa, Heterodera glycines
  Coding regions on vcDNA: vcDNA=SeqID_81730; Strand=+; Position=1 -92,146-216,1012-1351,1608-1767,1810-1891
  Homolog annotation: Hit_ID=AAH44091.1; Match level="QueryCoverage =88%, HitCoverage=51%, E-value=2e-57, Identity=46%"; Hit description =Cbs-prov protein [Xenopus laevis]
MPYDPRAREESCWHEDSVEDRFGRYPFRKYPNENPAKIMDSVLDAIGHTPMVGQNGKCEFFNAGGSVKDRIALRMLEIAEQSGRLRAGMTVIEPTSGNTGIGLALACAVKGYHCVIVMPERMSREKELTLKALGAKIVRTKDKARYDSEQSHIGMAFKLRKETPNSVVIKKANPNCIIVGVDPIGSILGGEDEHAGHKYNVEGIGYDFVPTVLDMEDIDKWEKVGDLDTFQMARKIHRMEGILSGGSS

SEQ ID NO: 155308 - protein, 154 aa, Heterodera glycines
  Coding regions on vcDNA: vcDNA=SeqID_81731; Strand=-; Position=1 -180,481-631,1052-1182
MCWQQARDSNPERRFQYENRFSWTMDKQHHQQQQQQQPVETVQLVQQQHQQPQQQEKFVMPCFNLRASAGLPIGVPQMQQYHHHQQQQQQQFVAPSQFVLQHQRQAYCTNEHISPAHPIGIAMPSNNVQLPATGPTVAHSHYMLLPAPAAHHHT

SEQ ID NO: 155309 - protein, 217 aa, Heterodera glycines
  Coding regions on vcDNA: vcDNA=SeqID_81732; Strand=-; Position=1 -172,657-774,893-1110,1450-1595
MTSKVGREEIIQLFSNYGKLLGVTVFKGYAFVQFSYGTEADLSVSALNGYNWHGATLDVKLAMHGQQPTPGVPPPAQALKPIFGAFPIGAPTKSIVGKRNKNEQPQQEAAAKDLKRMKIDTATGGTGGGAAAPAGSVTESVPKNGANKAFAAQMDSAGIGTVVPPHANAEILDTLICGGCRFVTHSLAEFVEHRKRPCKLPSKIGQLGTPEIIEIEI

SEQ ID NO: 155310 - protein, 46 aa, Heterodera glycines
  Coding regions on vcDNA: vcDNA=SeqID_81733; Strand=+; Position=1-138
MTTNFVYMLKEHPKITKDKYQQIWELEENPIVIWHDGSVHFNSVRL

SEQ ID NO: 155311 - protein, 199 aa, Heterodera glycines
  Coding regions on vcDNA: vcDNA=SeqID_81734; Strand=+; Position=1 -112,189-265,678-974,1619-1732
MDPGLDFSLIKIQTNHFWATWVFPGPGFSWVFVQETPGQAIFWQLGFSWDWISLDFCSRNPVQVDYPQQDDTDDSADDESDKEKYDFLSWQKKLRQPQRSFKLPSESKYNPFQRFDPFQRLGPFQRLGVYGSRKEMENYLDIFGNEPSSSVTAPLIGSIKNAEIDQQNSEDEKGSSTSTKRVNPFLKPDGSSYNKDKDE

SEQ ID NO: 155312 - protein, 309 aa, Heterodera glycines
  Coding regions on vcDNA: vcDNA=SeqID_81735; Strand=-; Position=1 -47,108-383,441-789,1093-1350
  Homolog annotation: Hit_ID=AAL78214.1; Match level="QueryCoverage =46%, HitCoverage=77%, E-value=2e-10, Identity=26%"; Hit description =putative esophageal gland cell protein Hgg-20 [Heterodera glycines]
MSDNRNEAEQKMAKAIFISADCWLCVYDLLPASQLGLGIAMISHRFDFYVDEHFKTRRWNLGSMKIKMKFEADGTKEMDVVNANLESFGIAQKPLPKRVVGFKAISLKYFNDNVITFLGRFRPIFAARPINLTIDTFKDMELILRNIWPMIATNICAIQLSTTFFRYLREFVPSFLDDCPSLRVVNAYSYGFFAEFPCDDSANASNGQTLAKWLFTPRSDNVPKAFANASSPVNFIAIIHFPSPFGFSVVPFDLINELTREQLTMKKMNDINRVLLIRCPIVRDESKWAKWEEEAIGWNFMDQWNRIDI

SEQ ID NO: 155313 - protein, 52 aa, Heterodera glycines
  Coding regions on vcDNA: vcDNA=SeqID_81736; Strand=+; Position=1 -18,365-505
MGYYATEKDANWGGEGSSLNKFDWVVTSVFVQSLEPAEAYANDDGEQQKTEE

SEQ ID NO: 155314 - protein, 338 aa, Heterodera glycines
  Coding regions on vcDNA: vcDNA=SeqID_81737; Strand=+; Position=1-1017
MASERKKAKITENICGQRQPHPKQPKWDFRSIAYFEQYPTESQMDESVPTQHSAADIRQTGMGQHSISTNADGGQEQKPLYEEITNHIHKMERFSVQRHVTEFVLNAQHEQPDEALRQALHQLVNRAVQNAEKQSGRSVSKLGIMVAGKGLTDPVVLPLRPPAQNNIDVVMAEMDKLGQSEGDEGGVNKKTLLLSEPVEIIVTCLTIPAGSAPRFFPHQNWGYNQTQIIHISNRDNYCLFHALAAGRAYHDYEIFRSSRSPPDNQAPLFAAIKNRTDFCKDYEAYNRLLSNTGRMESVVEDLMKNSGIIIGQDSYGIDHLLPVQQYWVIFVYNFNILC

SEQ ID NO: 155315 - protein, 750 aa, Heterodera glycines
  Coding regions on vcDNA: vcDNA=SeqID_81738; Strand=+; Position=1 -1511,1634-2375
  Homolog annotation: Hit_ID=DAA04499.1; Match level="QueryCoverage =42%, HitCoverage=22%, E-value=4e-36, Identity=29%"; Hit description =TPA: pol polyprotein [Schistosoma mansoni]
MKEDVKMLIEACEKCQMRKIQPGQAKSAPSVPIEPSNSPFQRIHCDLMGPLKRTERGNLYIFLAIDSFSKWVMAKAIPDQKANTVSEIFVEIVVHQHSTPEIVVTDQGRQFTSGIFNDLAKIYGFEHVTTTPYHQQANGMAEGTMRIMANIISQMVNEKGNNWDEILPHAIFSYNVSIHSATKFSPFFIINLRQPKLPTDRLLKLPSPDELVSDISVYTRIQTEKAAKAWEIVRNEILKAQERNREENDRIRKASEREFEIGDLVLFKKEVLSHKFDQRWLGPMRCVGVEKEKKNVILQSIDGRAKLRKVHQEKVKHFNGPAILPLRQSDEPLNWEKYVDDPNLEQEEIESESGESDCEKTQENENAQPKNKMGLKVSKYGFESSDDENDWNIVAFVRENQNSEDDEGPEVIMDRNPEIEIMPIFTILEVLIEGSFTEVYTGWRDPVTISLISSIPENLVRENWEIYVNGNGSRFVMAWIFGESFEIFIVNEFDQIMLGIDAQIKENLEIGYGPNFVTLRDSEGMISDQDDLEEVNDFSRTDINVINYVKPFKNLLDFSNEIDEDEGNEELVENAGERERNMNNSLEILGRMENEQLNEKGRLNKLDKKQNKRYESHSFFKELDRMTSPAPLHFESLIEDEEESLRRLERRLQEQLNKVRQTLAQEQLEESHVKTREEKCLEQLKQQTVQSTVNQKGTAEKEEKSGELCKKRESEAKKAEPEAKDRKTDEEGLVQAKMEKEKNTVEDVCL

SEQ ID NO: 155316 - protein, 106 aa, Heterodera glycines
  Coding regions on vcDNA: vcDNA=SeqID_81739; Strand=-; Position=1-321
MKIRHKSYWKFVKMIKKLKTLCQRDIFQRKMNKSEGFWLRPSRTGSGQKFSGPDRIGIFKNDRIPDPVSHNPVNPVIRSIWIFPKIAGPDCRIQKNPVPDPVRLGL

SEQ ID NO: 155317 - protein, 29 aa, Heterodera glycines
  Coding regions on vcDNA: vcDNA=SeqID_81740; Strand=+; Position=1 -78,488-499
MSSIWQIGLFKKTSKTTAICLECEANYKA

SEQ ID NO: 155318 - protein, 141 aa, Heterodera glycines
  Coding regions on vcDNA: vcDNA=SeqID_81741; Strand=-; Position=1 -88,522-682,1161-1420
  Homolog annotation: Hit_ID=NP_495470.1; Match level="QueryCoverage =96%, HitCoverage=60%, E-value=5e-31, Identity=47%"; Hit description =ribosomal protein L10 (25.3 kD) (2H403) [Caenorhabditis elegans] gb|AAA82424.1| Hypothetical protein F10E
AKELHKVSALLRGQSGLMFTNAKANEVQRFFAEHTEAEFAQAGAVASADISLPAGPMPAELHLHGAMEPQLRKLGMPTRLENGAIELLEEFTVCKTGDQLSADQARILKQFGHRLAQFRVRLLARWSKKKGFEQIDGGAEE

SEQ ID NO: 155319 - protein, 97 aa, Heterodera glycines
  Coding regions on vcDNA: vcDNA=SeqID_81742; Strand=+; Position=1 -88,129-261,1147-1219
MAIDRTLNCNNRATNCIRTPSKPWAIAIKTVWACPTCAAAVPWRRASAIPPALARPAAKCPPRRRRPPGQTQPRVFGVAEYEYTLYITPCLTLGPSE

SEQ ID NO: 155320 - protein, 136 aa, Heterodera glycines
  Coding regions on vcDNA: vcDNA=SeqID_81743; Strand=+; Position=1 -128,253-298,340-402,455-627
MEKRLNPSALPTLMLSNFGGYSVETLCTLGKEFVLELMTRMISIVSTLKMDIKGDNKKDLDIVRIQLDYSRLIFLCLTEVRLRIDLKLAEGIGENQNLKDVRPSDERLLELLSEPNQPEENAKKANLAERFEQNRK

SEQ ID NO: 155321 - protein, 44 aa, Heterodera glycines
  Coding regions on vcDNA: vcDNA=SeqID_81744; Strand=+; Position=1-133
INNFPVFFPRVVANNVEQPANRAKRFTSFGSLSTIGGRVGCVVS

SEQ ID NO: 155322 - protein, 92 aa, Heterodera glycines; identical to SEQ ID NO: 125147
  Coding regions on vcDNA: vcDNA=SeqID_81745; Strand=-; Position=1-304

SEQ ID NO: 155323 - protein, 92 aa, Heterodera glycines; identical to SEQ ID NO: 125147
  Coding regions on vcDNA: vcDNA=SeqID_81746; Strand=-; Position=1-304

SEQ ID NO: 155324 - protein, 453 aa, Heterodera glycines
  Coding regions on vcDNA: vcDNA=SeqID_81747; Strand=+; Position=1-1362
  Homolog annotation: Hit_ID=AAL96724.2; Match level="QueryCoverage =35%, HitCoverage=25%, E-value=5e-09, Identity=23%"; Hit description =similar to Plasmodium falciparum. Hypothetical protein [Dictyostelium discoideum]
MADDDLEIKFKNLQGKVRDLEDKLMGHKIINVPSGIKMPKFDGNGDFYKFLREFNMYATAAGWHPPECVRLFPLFLEGEAKEIYQNIPGDEKKNWRNLTEKMADQTKRLDGPMWARRMLAKIKMGKETVTEFANKVRELVEQASPNPDYTNDARENESIHYFLSGLPTNLKRKLFFMEKPDTLVEAIAQTKRVQQVREELENDEKGDELRSQIAELKEQVNAIEINNKPNNEINGGRQFMNSNWRGNMRGRGNFRGLNRENHWRTNQNVRQNFANSRNIGNYSNNYPRNPNYMPLGGNQNWNNNMGNTRPGGFWNQRGNFPNNRGNFTNFRGNLRGQRNDQQRYRINMVGEESESKIQKSRSPTPALTFLTISTIFCLLFGGSMAQYQLCSERVAMTKVSLPNISDCKIPEQQKATERKVTLFLPVRMPKQFPIYNCYQKITKTCTGNFLFIW

SEQ ID NO: 155325 - protein, 118 aa, Heterodera glycines
  Coding regions on vcDNA: vcDNA=SeqID_81748; Strand=-; Position=1 -153,228-431
MRIPSPLLAANYVLATVAICAAIFALGLWFFVLKSNQYNPTLAIVEDDDTTVEEFFDTDGMASKMVASRAENQLIRQMEQPIKLDEYGMAPMDDGTKMVSKKLFRVNDTHLAQSRFES

SEQ ID NO: 155326 - protein, 78 aa, Heterodera glycines
  Coding regions on vcDNA: vcDNA=SeqID_81749; Strand=-; Position=1 -122,368-482
MQFYTIKIASTGSEVCSREDAPYFCQLVRQFGEQFYNESAKSITDKMRIGPFGPVAPIVPAKVNNGQQRKKRRMRLRN

SEQ ID NO: 155327 - protein, 78 aa, Heterodera glycines
  Coding regions on vcDNA: vcDNA=SeqID_81750; Strand=-; Position=1-324
FKNNLKSFSQSNGQFGFGCSPSPPRLFLCRGRGGGAGAEGNGHLVRETDEGVHISRFARGRREFVGAVGVTVLIGAKV

SEQ ID NO: 155328 - protein, 87 aa, Heterodera glycines
  Coding regions on vcDNA: vcDNA=SeqID_81751; Strand=-; Position=1 -72,419-610
MADSVGSKLTRKLLFFLKHMLIEPETAAENVVFCVLHDLGTNQYRNADRANKLASSARKARNVDALVRLAHQMTVPFRARPSAAPAA

SEQ ID NO: 155329 - protein, 78 aa, Heterodera glycines; identical to SEQ ID NO: 155327
  Coding regions on vcDNA: vcDNA=SeqID_81752; Strand=+; Position=1-324

SEQ ID NO: 155330 - protein, 203 aa, Heterodera glycines
  Coding regions on vcDNA: vcDNA=SeqID_81753; Strand=-; Position=1 -282,613-942
  Homolog annotation: Hit_ID=CAE73450.1; Match level="QueryCoverage =95%, HitCoverage=34%, E-value=4e-29, Identity=53%"; Hit description =Hypothetical protein CBG20899 [Caenorhabditis briggsae]
MRNDPFGQRYLRDECAVFDYNAWDDVDWPEEKEAEIHQTIQAQMADAVPESVSLSLLENPKDRWEAFFETHNNKFFMDRKWLSREFSELFVRPKVADGTLDFVLCIFVLSAVRPDRLRAAVSNLVALLRPGGMLLLKDYGRHDLTQLRFKSGRLIQHNLYRRGDDTLVYFFTTEEMDELFREAGLEKIQNFMDKRLVGKEQNA

SEQ ID NO: 155331 - protein, 29 aa, Heterodera glycines
  Coding regions on vcDNA: vcDNA=SeqID_81754; Strand=-; Position=1-97
MNFFHAEAAEILNKAAKRRISSQIHYESK

SEQ ID NO: 155332 - protein, 187 aa, Heterodera glycines
  Coding regions on vcDNA: vcDNA=SeqID_81755; Strand=-; Position=1 -141,775-866,921-1181,1232-1301
MAKIAKYGHKWQKCQNMDINFSKLSAKFLQIYWLKLHMRYISKFFDSTEPRIESPATLSGVTVPLEQDEEEQKKDDEGGDQTAEKKVEEAAAADEQPKEGAAEAAEAEKSATKEKTTEDTEETTETTEGSTTETSELPARDRLQHRALARWRSFVTWGPTHRLVPTIRTSLAQRGVLGLRTPLLKAQ

SEQ ID NO: 155333 - protein, 49 aa, Heterodera glycines
  Coding regions on vcDNA: vcDNA=SeqID_81756; Strand=+; Position=1-149
LQIYWLKLHMRYISKFFDSVRRSDKDGFRFAISRSTFGNWSRIFSAITC

SEQ ID NO: 155334 - protein, 276 aa, Heterodera glycines
  Coding regions on vcDNA: vcDNA=SeqID_81757; Strand=-; Position=1 -480,855-1205
  Homolog annotation: Hit_ID=CAE61250.1; Match level="QueryCoverage =90%, HitCoverage=36%, E-value=8e-18, Identity=27%"; Hit description =Hypothetical protein CBG05053 [Caenorhabditis briggsae]
MAFCSDKPEVSRKSRRYYALRSDHPAELECLLEANPLPTLVKWTKNGRTITEHTEKTIDRMKNWAIKGILLIEGNLLRSAVRIPFVNFRESAGIYKCEAENIIGVTEPNLEIHVVVAEAPKFTRSPAPKYIVKAGERVEIECEGFGEVPIRRVWSRKEDGETAPQCATNFRVQCEGQQRLAVYWMPGYPGGDHSQSFRIFYQQIRNDTPPITANEAWKVTGQRTDQSKLHVDHLELFGEYEFKLEASNRIGTTNCTIPGTHYSRKGRVSQTKKEGA

SEQ ID NO: 155335 - protein, 101 aa, Heterodera glycines
  Coding regions on vcDNA: vcDNA=SeqID_81758; Strand=+; Position=1 -148,219-376
  Homolog annotation: Hit_ID=CAG29667.1; Match level="QueryCoverage =92%, HitCoverage=19%, E-value=2e-36, Identity=79%"; Hit description =translation initiation factor 2 gamma subunit [Allacma fusca]
VSYHLLRRLLGVRTEAGKKAAKVSKLAKGEVLMVNIGSLSTGGRVIAVKGDAAKIALTDPICTESNQNIALSRRIEKHWRLIGWGTIRRGTTIAVPQPSIG

SEQ ID NO: 155336 - protein, 477 aa, Heterodera glycines
  Coding regions on vcDNA: vcDNA=SeqID_81759; Strand=+; Position=1 -277,401-561,602-721,867-932,1075-1238,1293-1370,1655-1783,1866 -1915,2025-2090,2249-2426,2470-2509
  Homolog annotation: Hit_ID=NP_491357.1; Match level="QueryCoverage =94%, HitCoverage=94%, E-value=1e-120, Identity=50%"; Hit description= pyruvate dehydrogenase phosphatase (50.7 kD) (1E937) [Caenorhabditis elegans] gb|AAF40007.1| Hypothetica
RVPKVLASDFPHRHFTLRRAAIDQLLKANERRFILSDDHQQSVLRVDVAQVAANRPIEDFYSASKCLHSNAFLFGIFDGHGGAACARHVCTRLFDYICCSALDKHRVVQIPVGEQIQWLGANAPHSLPQEKDDAHLRNVREYHRKLFRSGVSPATTVRSSFRSGVSPATTVRSSLQAAFLALDDDLSKGAMPDQSGRICRMSVNVAASGSCALVVHVRKNNLHVANVGDSSAVLGVCLPNGLIARQLTRPHTSENVNEIHRIRSAHPATENRTILRGDRDRLLGELYPLRAFGDVRYKWPLELQKVVLEPLGMPAPSNLLSPPYLTALPEVFYHQLTNNDSFLVRKSLGLWEFLDPDTVGLWEFLDPDTVINGILDHALGAQTLSDFRPDSQQSLGEILGSLETRKQGYASKPLDENSATHLIRSALGGCSGGTELQYARLEESLMLPPGMARNYRDDITIMVVHDITIMVVHFKTP

SEQ ID NO: 155337 - protein, 17 aa, Heterodera glycines
  Coding regions on vcDNA: vcDNA=SeqID_81760; Strand=+; Position=1 -10,706-749
MSPWGRQKDKNQASSVT

SEQ ID NO: 155338 - protein, 90 aa, Heterodera glycines
  Coding regions on vcDNA: vcDNA=SeqID_81761; Strand=-; Position=1 -123,490-568,624-692
MDPISKAKENLRGPEKYKVINAVRKKRKHLLQLNFDHIPIIMALFVSCMAAFEKLKVEQPDLVDRLTDCAGFSIGGICALVAAEVLSFSD

SEQ ID NO: 155339 - protein, 68 aa, Heterodera glycines
  Coding regions on vcDNA: vcDNA=SeqID_81762; Strand=+; Position=1 -92,907-1021
MQEKFKQNQFNLMASDRISINRTLPDYRIEKTPTIAGGLFAIDKKFFYEIGSYDQGMQVETSNYSLFV

SEQ ID NO: 155340 - protein, 317 aa, Heterodera glycines
  Coding regions on vcDNA: vcDNA=SeqID_81763; Strand=-; Position=1 -191,267-498,538-603,966-1028,1081-1212,1258-1277,1320-1422,1474-1620
  Homolog annotation: Hit_ID=CAE62813.1; Match level="QueryCoverage =97%, HitCoverage=45%, E-value=3e-48, Identity=53%"; Hit description =Hypothetical protein CBG06989 [Caenorhabditis briggsae]
MFPFNTPYNHLLNWSLVCFLIPWFYSYYNEQHRLSSMPVEQAMLKSWDTVISQPSIKFRKIMVGINCNVDVIVSGVSMVNKLNISSPNPIADKEVLNGFEDLYEAFVHFFTRGAPAERCMVNDAAFDRMVHTVEDKHLRAQHYIGGNAALMAQKIASSFPAATAIMQFRPDLIILSGIHGLEAQNQDVRLEKLRLIKRSLMQVNPLIPIHLQLGSMADDQQVHDILERIIPNVDSLAINEQELTYLSKVGDGPYKERYPIIAGTLHAHKAVEMLYWLLTTYGHDRTNPESKRYNQRLQRIHYYSLTYHIMVLFATTK

SEQ ID NO: 155341 - protein, 138 aa, Heterodera glycines
  Coding regions on vcDNA: vcDNA=SeqID_81764; Strand=-; Position=1 -303,362-475
  Homolog annotation: Hit_ID=CAE59729.1; Match level="QueryCoverage =66%, HitCoverage=15%, E-value=5e-21, Identity=47%"; Hit description =Hypothetical protein CBG03165 [Caenorhabditis briggsae]
MGGGANGNGRKGKWQNENAKKRHKVRPLPQRTKTPPFDSEFQICHNSAATVPHLPLATVSAAVTVSPLMTPNAKLELCCQKQQLPSTCQQFCNFDTFTQEKLLIALLGSHCPSAQLSKAFDCATSKVDHSECCRQEGM

SEQ ID NO: 155342 - protein, 176 aa, Heterodera glycines
  misc_feature (2)..(2): Xaa can be any naturally occurring amino acid
  misc_feature (34)..(35): Xaa can be any naturally occurring amino acid
  Coding regions on vcDNA: vcDNA=SeqID_81765; Strand=+; Position=1 -25,1316-1538,1580-1670,1804-1834,1884-1961
  Homolog annotation: Hit_ID=BAB78536.2; Match level="QueryCoverage =97%, HitCoverage=63%, E-value=1e-35, Identity=49%"; Hit description =cold shock protein-1 [Triticum aestivum]
TXPAPFGGDRCRETGHIGRDCPNSGGGGGRGGGXXTNSGRFTSVYLGGDSVCYNCNEPGHFSRECPQGRGGGGGGSRGKTSNGGGGDIVCYNCNESGGGGDIVCYNCNESGHFSRDCTQPRGGGGGGGGGGGGGSRGGGGGGSVCYNCNKGGGGGSVCYNCNKPGHFSRECPDGRR

SEQ ID NO: 155343 - protein, 81 aa, Heterodera glycines
  Coding regions on vcDNA: vcDNA=SeqID_81766; Strand=-; Position=1-246
MALLSGHRMSLLSGHRMSLSSRSPNCTLESVIEWNSRVGHRMTLLSGHRMSLLSGHRMSLSSRSPNCTLESVIEWNSRVGH

SEQ ID NO: 155344 - protein, 558 aa, Heterodera glycines
  Coding regions on vcDNA: vcDNA=SeqID_81767; Strand=-; Position=1-1677
  Homolog annotation: Hit_ID=XP_318550.1; Match level="QueryCoverage =86%, HitCoverage=50%, E-value=1e-111, Identity=46%"; Hit description= ENSANGP00000020240 [Anopheles gambiae]
MNYSQIEKEGLALVFAVQKFHKYLFGRHFVLQTDHKPLLTIFDNKKGIKACTANRLQRWALILLAYDFEIEYQNTADFGQADALSRLIAKAPVPEDEFIVATITESSNLATVNAFTAQFPIVHEDIVNATKADNLLQEVKGFIMNQWPNKMDMSDDILQFHRRREALSFENGCIMYADRIVVPASLQTEVLKMLHRGHPGMKRMKSLARQHVYWPGIDHQIEEVVRKCEPCATEAKAPRKTELNSWPKAEGPWKRVHMDYAGPFFGKMYLIIVDAHSKWPEVFEMRSTGSAATIEQLRSLCARFGLPETLVTDNGTQFSSNEFKEFVKENGINHLFSAPYNPMSNGQAERFVDTFKRACRKLKKEGAQNVVNTFLTSYRTTPNDALPDSKSSAELFLLRKPRTTLDLLRAKPSAPLIRDEAMEKQFNRRFGAKPRKFCLGDKVFARHRQSQSWRAGIVSQCQGVIYEVKFPNGTSNRFHANQMTARHMDHQGNDELNIFNDAFGLPLAPPDGPNEAALPADQQAAPAQETDEANASRGHVRVDRPQRNRDPPQRYSPS

SEQ ID NO: 155345 - protein, 126 aa, Heterodera glycines
  Coding regions on vcDNA: vcDNA=SeqID_81768; Strand=-; Position=1-381
MVVRLPAAPIAVILVFAAFVIAVHADNDHYPAYPKGPSPHYPPRGKIPSWMHSQPLEPPGYNPSAQNDDKHEQQQNDQQPHQSHARPGRSAAAVGASAALDGRSVAASGRASAPALPIGLASAQKQ

SEQ ID NO: 155346 - protein, 93 aa, Heterodera glycines
  Coding regions on vcDNA: vcDNA=SeqID_81769; Strand=-; Position=1 -23,566-821
  Homolog annotation: Hit_ID=CAD90187.2; Match level="QueryCoverage =89%, HitCoverage=1%, E-value=3e-23, Identity=59%"; Hit description =Hypothetical protein ZK1151.1b [Caenorhabditis elegans] emb|CAD90176.2| Hypothetical protein ZK1151.1b [Cae
RTFGERNYYDLRLSQYHDSVISIHGPGVKQELHRQVPQPKTGATVVTEELELLNRRFAELSSVILERKNIVNVLIQNWRRKQQVGDIIKHINR

SEQ ID NO: 155347 - protein, 157 aa, Heterodera glycines
  Coding regions on vcDNA: vcDNA=SeqID_81770; Strand=-; Position=1 -326,397-541
MTVQSSILCKCSSHINRKVIAFLHRIQRLFATDITLELAIFFRQRQSWDVVTYGIWPALNAAGIVKIRFHNINNVTALQTHISPTILHDCANLRSIDVNHIYRPLTGQIGDEFNGADTPDDQALYEWLSTPRADGRPKLLKTYFSRSDVNWTAQMKT

SEQ ID NO: 155348 - protein, 165 aa, Heterodera glycines
  Coding regions on vcDNA: vcDNA=SeqID_81771; Strand=+; Position=1 -30,269-389,439-533,811-1060
MNRIGSALSKSVFIPRLFCHRFFASGPTDARQNVLVVIVDFNGEQQLLVNGKYSELLGRSPDFPFPGNVKPLAEMQQQQQQKFPFPLDALPTKQLGNGLGAVMPLHKIVEPSFVVSDDRTAIPRALRHHRMWQMGENDGRMTANTTTAKYEWTVAGVDGIRMLCE

SEQ ID NO: 155349 - protein, 53 aa, Heterodera glycines
  Coding regions on vcDNA: vcDNA=SeqID_81772; Strand=-; Position=1 -87,289-363
MWFVGDVGKTIYFVVRQSPAQFWICSCLQARNPQVRETDLASLGIKPNYLMHI

SEQ ID NO: 155350 - protein, 55 aa, Heterodera glycines
  Coding regions on vcDNA: vcDNA=SeqID_81773; Strand=-; Position=1-165
MLSSSACCTLLAALISAAFFAAANPPTVKQCLCSEIQPCTQKYMNTWKACMEQCK

SEQ ID NO: 155351 - protein, 235 aa, Heterodera glycines
  Coding regions on vcDNA: vcDNA=SeqID_81774; Strand=+; Position=1 -417,807-1097
MKPKQQKLARIEWTSEEEEEDEEKPPSGDEAEAESSEEEEYAQKQQAKEVEVVHRDRDEEEEEEEPEETQFASHPSDEALLKTPEALPSKAGGPTRMSKSRSLQEMIRHYWSLGRNHGTTSATTTTNANGGIGTPNRNEFCYKHSILLMIQSLSQRRRSRHCAATAVGISAAAGSAMPRARSTDERLFAALASHTQQLVVSGENMVCIGVLFIPEISVPILKTLETDINPTTWPH

SEQ ID NO: 155352 - protein, 42 aa, Heterodera glycines
  Coding regions on vcDNA: vcDNA=SeqID_81775; Strand=+; Position=1-130
ARHFEKSLDLDSMLDLDLDFLDKNPGKSRLLETWIQAWTWIF

SEQ ID NO: 155353 - protein, 144 aa, Heterodera glycines
  Coding regions on vcDNA: vcDNA=SeqID_81776; Strand=+; Position=1 -419,928-943
MGGGWVSQPASPMIPRDRPSSLLLPPPPLFSAGSCSPLPTTNHYHGNDDDDDDQQDAAAQQRRLRQQHAAAVRSEPNVCGSGKQQQSMLPFLRSLRQLKLFKRRSASELSLVLELLRNVGGGGDDSNGAMVNGCAEDANGLLIF

SEQ ID NO: 155354 - protein, 135 aa, Heterodera glycines
  Coding regions on vcDNA: vcDNA=SeqID_81777; Strand=+; Position=1 -70,334-477,878-976,1036-1128
KAFESSEPKRTRDSAAIDPVDLKAKKGGHGRPKATPRGVADNAFESRLTDALDTANRHAKAAANAKYQTVQALQLHTKLMKEAVDSDVKQKGGERGGDSAKWDEVKRAKAEADRRAKLDTEKEGTARDAIKELEK

SEQ ID NO: 155355 - protein, 62 aa, Heterodera glycines
  Coding regions on vcDNA: vcDNA=SeqID_81778; Strand=-; Position=1 -184,522-526
MVIRRVTTVIRRVTTVIRRGTMVIKRGTKVIRRGSTVIRRGTTVIKRGTKVITRGTTVIRRD

SEQ ID NO: 155356 - protein, 69 aa, Heterodera glycines
  Coding regions on vcDNA: vcDNA=SeqID_81779; Strand=-; Position=1 -17,450-642
MRLKKLTDTKVIRRGRTVIRRGTTEMRRGTTVIRRGRTVIRRGTTEMRRGTTVIRRGATVIRRGTTVKK

SEQ ID NO: 155357 - protein, 29 aa, Heterodera glycines
  Coding regions on vcDNA: vcDNA=SeqID_81780; Strand=-; Position=1 -41,398-446
MKNAGKKRLNNVEKVILHAEKESDFYFCL

SEQ ID NO: 155358 - protein, 126 aa, Heterodera glycines
  Coding regions on vcDNA: vcDNA=SeqID_81781; Strand=-; Position=1-381
MDMVRTMLKQMVQDGWETQEKKKHCPFDVQKPKPDGLRVRHARAVRQFAGAGGGGAHQRVGGGEAQERHSALSDAAAAGGGQTEAGRGGGARVLPNGHHFLSRRRLLHHFGRQCTPLQVTKSVITV

SEQ ID NO: 155359 - protein, 148 aa, Heterodera glycines
  Coding regions on vcDNA: vcDNA=SeqID_81782; Strand=-; Position=1 -82,129-253,315-554
  Homolog annotation: Hit_ID=AAC72366.2; Match level="QueryCoverage =90%, HitCoverage=11%, E-value=7e-52, Identity=74%"; Hit description =guanylyl cyclase [Heterodera glycines]
MEQFDSTSKDLFRNGSLMNTETAGTFQGETGRITLDSDGNRQPTFFVTMLNAANVPTVTMTVNISKGVLNLDRLYTSEASLWVNWGGVRPLTTPLCGYNGTQCGQNATVYILIGSALVLLLLFIALLGIGYALRSNCQSTDQTIIGKD

SEQ ID NO: 155360 - protein, 28 aa, Heterodera glycines
  Coding regions on vcDNA: vcDNA=SeqID_81783; Strand=+; Position=1-91
TVYALIIAQSLLIPQSPIIPQSTRCFEK

SEQ ID NO: 155361 - protein, 77 aa, Heterodera glycines
  Coding regions on vcDNA: vcDNA=SeqID_81784; Strand=+; Position=1 -69,696-860
MLFYPISVSLILFTFFAGSAEAQNDAGVLGPVEETAGQIGRNLSCSAIHAAVRAIITAHPDWHQWFYEARHESFFVF

SEQ ID NO: 155362 - protein, 38 aa, Heterodera glycines
  Coding regions on vcDNA: vcDNA=SeqID_81785; Strand=+; Position=1 -70,1032-1078
MRWSVQTFVCLLHGEFALCKAGGAAEVMLLTNEKTVFS

SEQ ID NO: 155363 - protein, 49 aa, Heterodera glycines
  Coding regions on vcDNA: vcDNA=SeqID_81786; Strand=-; Position=1 -123,187-213
MPNLRSCGSMAPCKCNSAGIGPAGSEMSAEATAPAWANSASGQTPGNAE

SEQ ID NO: 155364 - protein, 50 aa, Heterodera glycines
  Coding regions on vcDNA: vcDNA=SeqID_81787; Strand=+; Position=1-152
MPSPFSWAGAIELLEAFTLCKTGDQLSADQARLLKQFGHRLAQFRVRLLA

SEQ ID NO: 155365 - protein, 77 aa, Heterodera glycines
  Coding regions on vcDNA: vcDNA=SeqID_81788; Strand=+; Position=1 -87,465-611
MTVVTRSKHIHAPGVLSLAIDQSGSDAQTVFCCSSDETLGLWTCAGAGALEVDIRNTANNCRGVIAVFVSLLLLFAA

SEQ ID NO: 155366 - protein, 52 aa, Heterodera glycines; identical to SEQ ID NO: 139662
  Coding regions on vcDNA: vcDNA=SeqID_81789; Strand=-; Position=1 -6,316-468

SEQ ID NO: 155367 - protein, 53 aa, Heterodera glycines
  Coding regions on vcDNA: vcDNA=SeqID_81790; Strand=+; Position=1-161
MPVKWSQSHFCIIRIKWFWPILGRRKKRFAENGSDCSAAVGDGGSNDDGPGME

SEQ ID NO: 155368 - protein, 38 aa, Heterodera glycines
  Coding regions on vcDNA: vcDNA=SeqID_81791; Strand=-; Position=1-114
MSTASTFGLQNFLAQTAFAAATATNKEHSSQKSEEEEE

SEQ ID NO: 155369 - protein, 80 aa, Heterodera glycines
  Coding regions on vcDNA: vcDNA=SeqID_81792; Strand=-; Position=1 -109,177-310
MVLTRKKTEKFKEMRNSSTEANRKRKEWRRKRAQKGALKQTEAVPTAEGEGTSTQATESGPSTSTFDLRMSKKHYFRSEN

SEQ ID NO: 155370 - protein, 125 aa, Heterodera glycines
  Coding regions on vcDNA: vcDNA=SeqID_81793; Strand=-; Position=1 -78,179-405,561-633
MTTPPGPIVRRMTLGSDHPLYTYAVQPVLMLNASKWQWPHSVRRMQRLLTKATTATNDDKTATETTTTTAPQQQSQDGAATTAATAQPSVTNTDSRMMFTIKKNKCTNGTHAFRRQLFFYDSFFL

SEQ ID NO: 155371 - protein, 112 aa, Heterodera glycines
  Coding regions on vcDNA: vcDNA=SeqID_81794; Strand=-; Position=1-338
MELFFALSLLRFFLANCSFILVNGAGSSNKSQGISNTSKAKSSSVKLADLFALDPLRVTLSDLIKEERSGKMGDRTEKKGTLAELIRMEKIKEDEFDQLMEEMRENQHLIEE

SEQ ID NO: 155372 - protein, 32 aa, Heterodera glycines
  Coding regions on vcDNA: vcDNA=SeqID_81795; Strand=-; Position=1-96
TVYALIIAQSLLIPQSPIIPHPSLRGVLKNNP

SEQ ID NO: 155373 - protein, 168 aa, Heterodera glycines
  Coding regions on vcDNA: vcDNA=SeqID_81796; Strand=+; Position=1 -132,179-320,610-842
MPPNLGKTKNDNRAPKANNSFTSSNEKTPKKLPEDFEKLSQFLQEFINHQDKKSLKKTVQKPLNISKLTAEEARKDDEHREQRPKMEMPKETISLFANSTRGTIIGTVPLSVEIGNDRDEMEEQRKLTDEMSQVEVIKKVKEEGIDKVDEAEHGKVDFSIFNYLKRNF

SEQ ID NO: 155374 - protein, 80 aa, Heterodera glycines
  Coding regions on vcDNA: vcDNA=SeqID_81797; Strand=-; Position=1 -76,199-365
MLCTKLSRHMIDVKQKLWEGVYRERDLFATQMMPSSAHVEDDYWMDSYIRSVSAKCVHIIKMDTQQKTWQSFGDLFIVQC

SEQ ID NO: 155375 - protein, 330 aa, Heterodera glycines
  misc_feature (6)..(6): Xaa can be any naturally occurring amino acid
  Coding regions on vcDNA: vcDNA=SeqID_81798; Strand=-; Position=1 -25,1030-1175,1269-1631,1679-1809,1889-2038,2128-2201
  Homolog annotation: Hit_ID=CAE69446.1; Match level="QueryCoverage =97%, HitCoverage=52%, E-value=1e-100, Identity=56%"; Hit description= Hypothetical protein CBG15634 [Caenorhabditis briggsae]
KKRNSXEGSNLELAELKTVSTLGVGGFGRVNLVKHIDTERVYALKVLNKRHVKEMNQEHVLNERSILLSCHCDFIVRLHKTFRDSERLYMLMEYCPGGEVWTMLRNWGRFDEATARFYCAAALEAFDYLHRRMIIYRDLKPENMLLDIDGNPKLVDFGFAKKLPTEGSRAWTFCGTAEYVAPEVILNKGQDSAVDLWSLGIEYVAPEVILNKGQDSAVDLWSLGIFMFELLSGSPPFASTDPMHTYNSILRGVQLLAWPRYMGDNARNLICKFCRRDPTQRLGYARIEDVRQDIWFKNFDFASFRNHSMRPPIRPKVKTETDGFCYLRFA

SEQ ID NO: 155376 - protein, 195 aa, Heterodera glycines
  Coding regions on vcDNA: vcDNA=SeqID_81799; Strand=-; Position=1 -293,466-580,631-809
SHWSGRCSLTSGPYAICMFNHPSIAERQINIGLFSQKGQQNSAQFDNPSAKKTKSYAEAVRFELADGGNSDEPMMEWEGQQNQREDSTHDDGTLSDNVHSLQPVAPPSLNLELICVQLFLQNKLETILACGMFSSRTKVVATTNQTLDKKKCFASLEIHWTDNSKERCVVKKYQFFMVTDNEQHQMNSAAFATSE

SEQ ID NO: 155377 - protein, 27 aa, Heterodera glycines
  Coding regions on vcDNA: vcDNA=SeqID_81800; Strand=-; Position=1-81
MTRASAGCALLSSSAALALLLPDHVFL

SEQ ID NO: 155378 - protein, 90 aa, Heterodera glycines
  Coding regions on vcDNA: vcDNA=SeqID_81801; Strand=+; Position=1-273
MAIQKLEQQLRMLSAENEQLRAQSARLSAMFGVVGQGNESEQQQQMQMQLHFLLNELIPKNEELLIIQVEKIHGEMVLNLKKGDHKSMFF

SEQ ID NO: 155379 - protein, 255 aa, Heterodera glycines
  misc_feature (16)..(16): Xaa can be any naturally occurring amino acid
  misc_feature (237)..(237): Xaa can be any naturally occurring amino acid
  Coding regions on vcDNA: vcDNA=SeqID_81802; Strand=-; Position=1 -44,541-593,638-818,928-1072,1172-1290,2058-2263
  Homolog annotation: Hit_ID=NP_490844.1; Match level="QueryCoverage =76%, HitCoverage=56%, E-value=8e-46, Identity=51%"; Hit description =deoxyribonuclease/rho motif-related TRAM (1B833) [Caenorhabditis elegans]
ACVLLATTLLNPPKTXYGVPHFCQIMDYMLKNVPNVYIAVPNVYIATDFICAFPTETDADFAESVQLLSKYQFPSVFINQFYPRPGTPAARLKKINTIEARRRTAEMTRCFHAYRRYTDERIGEEHFVLICERASDGRHLVGHNKCYDECVSASKKSLLGHWAHVRIVSVSKFYMKSEIVSFPDFEESKSLIHLGEMSLFSCAQCIEVFAVVLRHYHHFKTRFFHCRHFLSDAANFXNLARKGNPPRGRDVLLHR

SEQ ID NO: 155380 - protein, 169 aa, Heterodera glycines
  Coding regions on vcDNA: vcDNA=SeqID_81803; Strand=-; Position=1 -214,276-355,1168-1383
  Homolog annotation: Hit_ID=CAE69083.1; Match level="QueryCoverage =37%, HitCoverage=14%, E-value=3e-16, Identity=65%"; Hit description =Hypothetical protein CBG15101 [Caenorhabditis briggsae]
MDIEDSIGRLPTEFDEAISADEKENGKRFFNVRIMRRNKMRESEEGEEMTTDGGGRGQRDECRADRSILPWDCTVFLRTWGCSHNNSDSEYMAGLLVQAARGDLRSFSLSSLVAQAHKALSVDGCRELWLTSEDLGAWGRDIGHTIVDLLRALVQVIPDGCMVSPFVLT

SEQ ID NO: 155381 - protein, 301 aa, Heterodera glycines
  misc_feature (26)..(26): Xaa can be any naturally occurring amino acid
  Coding regions on vcDNA: vcDNA=SeqID_81804; Strand=-; Position=1 -265,311-434,499-659,721-823,873-917,964-999
  Homolog annotation: Hit_ID=AAG21336.2; Match level="QueryCoverage =90%, HitCoverage=93%, E-value=1e-109, Identity=78%"; Hit description= hypothetical esophageal gland cell secretory protein 6 [Heterodera glycines] sp|Q9BN19|HSP6_HETGL Putativ
KNEELLIIQVEKIHGEIFEFKERGSXNDCDDSFKQFDELEENPAHKYSKEAQKGFEMEDEEVTIREPSGTKESFKLPINMPPVKFSFCVSCGYRQAYEQFAQILREVSCGYRQAYEQFAQILREKYPGIDIHGENYPPGILRTVGAQVIGMVKIALIVCVVSVIGMVKIALIVCVVSGRSPFPTLRLETPTFFQWMLSNRLSAALMLFLFSNAIEGMMLQSTGAFEIYIESERIWSKLESGRVPSPPELFQAIDSHLAIRGGAIDSHLAIRGGGPGRFGSPSSFGIDGSFGSPSSFGIDGS

SEQ ID NO: 155382 - protein, 73 aa, Heterodera glycines
  Coding regions on vcDNA: vcDNA=SeqID_81805; Strand=-; Position=1 -137,242-328
GPYEEQLQNMVGELPKTLDQAEATPEQQKRTARHSRQKRESSAEENERLATISDESFPAVSAFVQRWPIASQK

SEQ ID NO: 155383 - protein, 848 aa, Heterodera glycines
  Coding regions on vcDNA: vcDNA=SeqID_81806; Strand=+; Position=1-2544
  Homolog annotation: Hit_ID=NP_494149.1; Match level="QueryCoverage =87%, HitCoverage=47%, E-value=1e-120, Identity=35%"; Hit description= predicted CDS, putative protein of ancient origin (2C297) [Caenorhabditis elegans] gb|AAF39854.1| Hypoth
MVRQKQTFFNNNDLPTTSAALSHGKDGFQAPVQKSGQMNRRVQSSLNKKRLHENNDNELNFELSSKRKNTVEQIINLDEVSNDFFKNNDCEEIKNQKKIGESAIRKELSRMRMSDEKINIVQKYDRNRKMAQKNKHTSLYLIAGEFRVNDLSSYNLGEFDVKCIHCPAIHFQEENNKIKGTQEFYDCCNYGKNSNLEEMIQEYPMDLRVLFQPEIDQNNYTQIGELHNDFKKKLRYLNSSFSCASLGCMRFKFPDKNVPIFKIQGSIYHSYNSVARPNEEELPTNGQLYFIDTDEAINYRLSAYKDQLTKLSNDNTIALIAYIESYLRENYVYSQSYKMMKEVFEKAVEISKNTDCEIPDITMLFDVREGTDLRRYNITKSNEVCAIIFRDANDDIPAANIVVHLKGSKKIETIFPLSPMVEPMCYPIFYPLNYQGWHYNIKNLEGKKISLCDFTKYKLFFRREGKFLPHHYSNKLFQQWLVDQAARIEWSRLNYIKLHQKELCKGTYNEIDNFLYAKAAEIGAQVKKKVILPSTFSGGPRNLHESFMDAMAIVNEVGRPDLFLTFTCNPKDFDIQKCLLNSQQSYDRPDIVARVFHLKAIQFLKEIIDGKIFGKVAGFCYTIEFQKRGLPHIHMLLTLDPENKWKNTNDIDRFISAEIPNEEEDKDLYNLVSVLMIHGPCGPDFTDAVCWCNKKKKCSKKFPKQFREKTEINENGYPLYKRPNNGQTVIKKDWKTGKTKVISNQDVVPYNRYLLKRFKAHINVEKVADIKAVKYIYKYIFKGYDAATVRCVTTEKGSVKELIYDEAGSFLDARYLSPVEACWKIFKFPLQEKSHSVQRLPVHLENEQ

SEQ ID NO: 155384 - protein, 303 aa, Heterodera glycines
  Coding regions on vcDNA: vcDNA=SeqID_81807; Strand=-; Position=1 -77,127-373,417-556,598-1045
  Homolog annotation: Hit_ID=CAC37683.1; Match level="QueryCoverage =72%, HitCoverage=54%, E-value=4e-10, Identity=26%"; Hit description =putative recombinase [Chironomus tentans]
MKYIYADGTFASAPTLFSQLYVILAGRGGWVFPVLHCLLTCKSQSTYEKMFDMVRNRWPTFSPTNASMDFEQAMVNALRAKHPQCSINFCLFHLVRNMKSRLTDEQTHRFTTDAAFAQAAKMITSLAFVPLEDLTPALAALEDYLPGELEGVLDWFIINYVGRLRNNGTRTRPLFRPEEWSVYERTMNGSDRTNNFAEAYHRTLQHAIGHGHPPIWKFINILRERQKLIDVDFEHFLAGNAPPLKAKRYREADRRILSILKRYNQEKAQPQINDDHQYGQNQNNPNLFNEMLRGFPAIIKWNE

SEQ ID NO: 155385 - protein, 87 aa, Heterodera glycines
  Coding regions on vcDNA: vcDNA=SeqID_81808; Strand=-; Position=1 -84,1001-1180
MSHPIWQIGLFKRIKEDSVDCLECKQKNSQSLALNHQCVASFVLLIDVPFRLSVNSNFIEMLRSLLADRTKSNGFCWIPFAYSQMVR

SEQ ID NO: 155386 - protein, 144 aa, Heterodera glycines
  Coding regions on vcDNA: vcDNA=SeqID_81809; Strand=-; Position=1 -124,166-476
MEGVSTSNDLNVGESDDEENCEPVHFQRGKTIRGALCLWHQGFRFLKIRSDGSWFRCERRNCPATAKLEDEGLMTGVLGPKEHHHGLAPSRFHAESKRNQMKQLITENPKQQPSQLRAQIRTNVNDEVFELLGTNEALDQMTNR

SEQ ID NO: 155387 - protein, 214 aa, Heterodera glycines
  Coding regions on vcDNA: vcDNA=SeqID_81810; Strand=-; Position=1 -446,527-644,889-969
MADQTDVFGVASSSIGKPIRVELGTGSRKTIISGNLLTTDPESGSIVLVEKRQQNKTSDQGKCSQRFILIPGSSVHSAKLVTINEGTIGTVKKDGQLEEGTKSNAELREKADGIESGDEATIESHGKRRANKTNRIHGLGFITEPCPKLEKPHVLVQNIDNGQTEGQMPSTVISLQSSGIKIYPPYGKNDIIGGGSIVVKELLHKLSTENVFDE

SEQ ID NO: 155388 - protein, 229 aa, Heterodera glycines
  Coding regions on vcDNA: vcDNA=SeqID_81811; Strand=-; Position=1 -260,318-444,738-1040
  Homolog annotation: Hit_ID=NP_491397.1; Match level="QueryCoverage =91%, HitCoverage=40%, E-value=1e-40, Identity=44%"; Hit description =putative protein, with at least 7 transmembrane domains, of bilaterial origin (55.2 kD) (1F150) [Caenorha
MLIDNVWVVQLFSIVALTSFSLYSTYLFPINYFDLLYRCAVHLGHWELIEPISQQNNAIPSQQQRFGIRQQNEQQQQNETYESFSESASVPYQDGTRLLFKGNLYIARSHAHYHTVSAEPDNKLHFRLFKIAKNPVALASYTCVFQCALIAFEFWLLLLTNDWQQIVTLVLLMFANYLLLAKMFKDRIIIDRIYNPSEEDLQLIKQLQEENERSRREIGKRKLERNQKR

SEQ ID NO: 155389 - protein, 104 aa, Heterodera glycines
  Coding regions on vcDNA: vcDNA=SeqID_81812; Strand=-; Position=1-315
MTKNMSNLVVPMVWLNESALIDSATRAQISRPVTALWGTFVVGIVFVCAGVVFLVTFVGVFIANKMTNRSCPNDSLNLIADPPTEGDPTEAQPLAAADQLTTDQ

SEQ ID NO: 155390 - protein, 205 aa, Heterodera glycines
  Coding regions on vcDNA: vcDNA=SeqID_81813; Strand=-; Position=1 -141,340-539,589-609,665-822,878-972
  Homolog annotation: Hit_ID=NP_499625.2; Match level="QueryCoverage =99%, HitCoverage=38%, E-value=3e-40, Identity=39%"; Hit description =CD36 antigen family member (60.2 kD) (3N544) [Caenorhabditis elegans] emb|CAB11566.3| Hypothetical protei
VFISVSVDELLFNGYQDPLISEICSNVLFKMMCKLANIPDRIGLFYGQNNTDDGQYAVDTGLNDPDFLDRVYSFKGIEGKLSDDHWYGERARMINGTDAELFGPNLMDAPKLQIFIGQLCRSFDLEVRQPALTAGLPVFRYAQPDSALDIAVQRSQGFCNPNSPLFFNESVQPVGCAPSGLLDMSSCFPGSPPIFFSASHFRNAH

SEQ ID NO: 155391 - protein, 451 aa, Heterodera glycines
  Coding regions on vcDNA: vcDNA=SeqID_81814; Strand=+; Position=1 -324,383-631,1619-1740,1892-2243,2407-2583,3062-3191
  Homolog annotation: Hit_ID=NP_741762.1; Match level="QueryCoverage =25%, HitCoverage=18%, E-value=1e-42, Identity=63%"; Hit description =homeodomain interacting Protein Kinase HPK-1, protein kinase HIPK2 (hpk-1) [Caenorhabditis elegans] gb|AA
MRRKKWRSKLNIPEAMLLISGQHLQVVGAAVESGGGGSTSSAVGVKRRQTSTTKHRLREGDAFPKAEDSADTPPSLSQVASSSGDSSSGVSSSASIQYLGTRRPTAIKIEEEDSLTSAPSSSSSTSARALAAHIGNPSNGRAQRTVAAPSHPKKQQHQTEDKGHGETHKPQQTHQRKDNQRDKGQGIGGKLLFVDPSTSHHPSKASVVQQPLRDIEIAAAAGNGMFGGAILGGGFSVAGNSSSSAAAALYQQQQQQHLSGHGLGAVASNGGGAFLMKNGTGCGGNLRAAAHHHHNNTNSHHNFVQPTTTALLKPMGGGTQIGQTQQPGQSKQHQSGHHKSRQSTEGEYQLIKNEVLSSSYGNQYEVLEFLGKGTFGQVVKAWKKGTNEIVAIKILKKHPSYARQGQIEYDFLKQNKFTPLPLSSIRPIVQQVLTALLKLKQLELIHADLKP

SEQ ID NO: 155392 - protein, 886 aa, Heterodera glycines
  Coding regions on vcDNA: vcDNA=SeqID_81815; Strand=+; Position=1 -964,1069-1386,1635-2676,3166-3499
  Homolog annotation: Hit_ID=NP_502797.1; Match level="QueryCoverage =38%, HitCoverage=95%, E-value=6e-55, Identity=35%"; Hit description =HASI (4P602) [Caenorhabditis elegans] emb|CAB16520.1| Hypothetical protein Y57G11C.19 [Caenorhabditis ele
MANKFVLVPQEIYRGLTSATDTGDINLDAVRHDLTRARAERTNPSAKNVSYNQQLRRYLQMRREVADKPARVELVKGLSVLMRRGGADDEAEVVDTPPRPPRPPPPPPLPGQHPPRRPPSPPGPGPSPPGSPPPRPQRPPRPPRAAAPPSWRDGRVEEWRKKRNDIQQRQPVVRDLLAEAAAAPLPESDEEDDYMLESDSLCQHHHNIMATCPFCLTTRTQLRRWTLHSTGLQPEESYIMAMTICIAKNTGSIILLPLLAHPRLVHSQKLKHLDLHRVLASRNNHNHCSILGHPHHNKLIANLKGSQSSIWIRDHPHHGKPETVPRHQQPSPAAPQVPPVPPPRRGTKRRHPPENGDESGELRIRKRVRQARRVRVYYSPEPGPSTSAQSDEQQQQQQRELFAIPSNQLTMAQRIELIYIKCNRYANPEKMEMINTTLDKLYNDPSSPAAFAGVSALWKEARKKLKQLRKKDVQHYLEGHRTYTLMRPRRVRFPRAKTVAAGFMTDVQVDLADFQALSRHNRGHRYLLVAVDVLSKRLFVVPLKNKKAEEMLDAFKELVKQMPMVPHRIFSDKGTEFKNKLLKEFFEEQEIEKHEPVHSSVKASVAERAIRNVKQRLYRYFAERETLNWVDVVQQIVDGINSTPSRVHGMRPIDVNFENAQKVWKRIYESPQKRKKPRFRKDEFVRMSREKGQFEKGYLPNYGDEILEIDEVLKAVRPVRYKLRDDRGEKFRGTFYDQELARVRKDADTSYRIEKVYRKRRKPDGTTEMLVKFIGYEKAPAKPLDSPPRYEKAPAKPLDSPPRHEQVPKKPLDSPPLYDESKLQKPQKSPEKPTTSTPTKPSTPPASTPPPLPKPATPAAVSKPSQPIAPATPTAKSVATPTPAKT

SEQ ID NO: 155393 - protein, 247 aa, Heterodera glycines
  Coding regions on vcDNA: vcDNA=SeqID_81816; Strand=-; Position=1 -40,452-534,606-696,976-1064,1168-1288,1463-1562,1650-1867
  Homolog annotation: Hit_ID=CAC21848.1; Match level="QueryCoverage =55%, HitCoverage=63%, E-value=4e-15, Identity=35%"; Hit description =hypothetical protein [Globodera rostochiensis]
MLTFTNLSTEADEEVYCCDSSIIFGQKLDNSESTSDQQLMKEISQKLARMEMELRETEQLCIMEDLRIEEATSDDQFTAHLHNDRKAILERISELENRQKEKFSNVKQPNCWDANACHYEIEVTDAQKLTAAIQEWEGDRRIFRSVFAKHPLPYATTTDFHNIFYFEILIIRMRWTILFGFSVKQLMPLNEKIQDYTGTYVFSNCGEFWANGSRKGETAKFSRDDVVGIGVDFGTHQIFFTKNGQRL

SEQ ID NO: 155394 - protein, 87 aa, Heterodera glycines
  Coding regions on vcDNA: vcDNA=SeqID_81817; Strand=-; Position=1-264
MLGLGWESNPLVHPFHGQALPLSYRGTSALSFMDYQARFPRFNRPASFFFQSYRMILRMFNLDASRRSFEALKLSFYFVVMFIFMIV

SEQ ID NO: 155395 - protein, 856 aa, Heterodera glycines
  Coding regions on vcDNA: vcDNA=SeqID_81818; Strand=+; Position=1 -361,457-2378,2455-2742
  Homolog annotation: Hit_ID=EAL50634.1; Match level="QueryCoverage =49%, HitCoverage=79%, E-value=9e-54, Identity=36%"; Hit description =hypothetical protein 19.t00007 [Entamoeba histolytica HM-1:IMSS]
MHGFDPRLPSEVTLGKVEDNFSDMAIYVQELTKRMEEVKTTVKENLRKCADQMIKQQKWTKEIPWREGMLVLKRKIDKRNKLEQNYDGPFRIVTVEKPNLTLKEMHADAMGFTVHMDQCNHGEEETEINAISMEMLTEFDDGNNLNKHGLLFLMEIILDGIVITALYPKDSFEFSSIPKSMVQSQWEIHKTREGDEYLTAWIFDENIQLFITEEREDLIIGNEIQAWLNQNGNVICENREATYWETYLDMDGLIYKNKITPEFWITYNEPEMCKEYESRSCSSSTIFLNAEECSNSNLQDKKINILPLSLIMANADSPILISDEELSDDEIHLRKLLLSEQQQQQLREQQFNPDRPYSSTVHSLPTNQVQIVTPAQGQQLKRDQQLALINQKIKEMEAAKRQIEEEETVEEEARIVREKAWKAEEQKKRTKRELDEKMKKREEEKKAEERAKKDKEEVKAAFKKIGMSTEVGGKEDGNKQKKNKSKKNQKGKDTESGNLEAEKLNDGHREAKKDAEEKATREAEAKKDAEEKATREAEAKKDAEEKATREAEAKKDAEEKATREAEAKKDAEEKATREAEAKKDAEEKATREAEAKKDAEEKANREAEAKKDAEEKATREAEAKKDAEEKANREAEAKKDAEEKANREAEEKRDAEERAKREEEEKEAAAETKRDAEATAKIHSEKEKKGKREGNVSINVEGAKKKIMETISEKWIPKIVGSIFDPRGEELGDDWTIKKMPRKPGKRGPTERGKKRRANEGNTLKSAVISANETRAIPPEGMGWKRHVPCFQAAPPGPGFKRRHHDVSPIRRMDSTGQGTSAASGTEEKIVKIRKLLLQAADLLGEMADELFPYKK

SEQ ID NO: 155396 - protein, 35 aa, Heterodera glycines
  Coding regions on vcDNA: vcDNA=SeqID_81819; Strand=+; Position=1-105
TGQMRGQFQLEVLPKVGHAVHEDSPELVAKIFVTL

SEQ ID NO: 155397 - protein, 308 aa, Heterodera glycines
  misc_feature (2)..(2): Xaa can be any naturally occurring amino acid
  misc_feature (19)..(19): Xaa can be any naturally occurring amino acid
  Coding regions on vcDNA: vcDNA=SeqID_81820; Strand=-; Position=1 -680,729-937
  Homolog annotation: Hit_ID=NP_500013.1; Match level="QueryCoverage =76%, HitCoverage=16%, E-value=6e-42, Identity=39%"; Hit description =predicted CDS, polyprotein family member (4B673) [Caenorhabditis elegans] gb|AAC02594.1| Hypothetical pro
TXLKIDNVTTFASYFFTAXSSLLYINKSFSRPYWSQGNGATDRTFITFHNILSKYINPKEPNFDEFLDAATFCYNTSIHESTGESPFFLVFGRDPIFSIDQILDPSVHLPLPHNDLAEFKTLLVLSLRKAWNSAADSIKEAQNKSKVQYDKKFRNPNISIGDRVLLRNYTGKPGTSQKFHNPWKGVFRVINIEELHVTIVSCSSPQSNPFKVHINQLKKLFEISGPPAEATEIPNTIGFAEATEIPNTIGFNHTPDISPKTLPPDTQKSNVPQILPTSIDKEQAVFSQRDLLHKNKYNLRSRPRSNSF

SEQ ID NO: 155398 - protein, 396 aa, Heterodera glycines
  misc_feature (80)..(80): Xaa can be any naturally occurring amino acid
  misc_feature (220)..(220): Xaa can be any naturally occurring amino acid
  Coding regions on vcDNA: vcDNA=SeqID_81821; Strand=+; Position=1 -21,1525-1746,1811-1887,2027-2877
  Homolog annotation: Hit_ID=NP_001004509.1; Match level="QueryCoverage= 97%, HitCoverage=26%, E-value=5e-53, Identity=31%"; Hit description =si:busm1-180o5.3 [Danio rerio] emb|CAD60788.1| novel protein similar to DNA polymerases [Danio rerio]
KKDNCPLLAELHGMEVLLVWECQFRRTLRTNTRLRKLYKERSVDVGPARLAKHALFGGHVEPFWLLHKCAPDEEIVYIDXVSLYPFCMNARPFPIGTVSLYPFCMNARPFPIGTPHVWTGEQLGGQPFRGLLFCRVLPPTGWFEPLLPYRTQADGRLIFGLCARAELRQQRICHHTERERGWTAAYTHVELNCALSIAYRVLSIHEVWHYADNGNGLFTXYVTTLLRLKAEASGWPAGCDTEAARAEHIRQFAEQEGIHLRPDNIGHNPGLRQLAKDLLNSLWGKMAERSERDEVVYTNSARDFHELLMRPEQEVVSFTHLNDQLDRCVVRKREPFARTPEHNNLAVACFVTSQARLCLYDWLEEVRRVRGRSLYCDTDSVLYVNSGAEGVREGNA

SEQ ID NO: 155399 - protein, 77 aa, Heterodera glycines
  Coding regions on vcDNA: vcDNA=SeqID_81822; Strand=+; Position=1 -125,377-487
KELVSEFLNKFQTLAAQTADVGAFMGRISLEAYALLKGCYDNVHVPSAHLWQQIDFFWDPNVDKNADDVRRFKQMRW

SEQ ID NO: 155400 - protein, 89 aa, Heterodera glycines
  Coding regions on vcDNA: vcDNA=SeqID_81823; Strand=+; Position=1 -26,91-334
MARRNSKTQLIAFFECFRIIPRMFNLVEKEKSYGRKIRSTTFRLTTFCPTPLFSYSQRLHNRRVAQLLTIFFDELASGGKIKKFDYIFN

SEQ ID NO: 155401 - protein, 54 aa, Heterodera glycines
  Coding regions on vcDNA: vcDNA=SeqID_81824; Strand=-; Position=1-385
TFLVLFESIRKMLLACKFSKIFIYAQKNLSKKSSNYWVFEFLLAITFLKLNENF

SEQ ID NO: 155402 - protein, 87 aa, Heterodera glycines
  Coding regions on vcDNA: vcDNA=SeqID_81825; Strand=+; Position=1 -135,360-488
MAFNGMFANITFDGSQSRMDWYLNKVKRRVTDIIDHVQIYVSTELQFIVTLTQLDFLKIQYPVSNGSKRRGKIPVKVFMKIKKERNF

SEQ ID NO: 155403 - protein, 23 aa, Heterodera glycines
  Coding regions on vcDNA: vcDNA=SeqID_81826; Strand=-; Position=1-69
MDYGDEQKRNKMNKMVTNRMKGK

SEQ ID NO: 155404 - protein, 137 aa, Heterodera glycines
  Coding regions on vcDNA: vcDNA=SeqID_81827; Strand=-; Position=1 -106,622-929
MQCFLLLFAAPIVLFSLFVTTNGGQMCFSSWTSVQSGRSPAQLSVPLAHGGMEVMLCFHGQPTTTWEQQAWMMPSSSSSAHQMPFQFGGFSADATQPKAGQSVQNVAAPQMVPSAAATGVGGSTLEQQPIVVGRVSH

SEQ ID NO: 155405 - protein, 44 aa, Heterodera glycines
  Coding regions on vcDNA: vcDNA=SeqID_81828; Strand=-; Position=1 -70,1242-1306
MNRYQTVFAYSQVLAVESILTDLAINQCARVNQQHHNTQWRCVW

SEQ ID NO: 155406 - protein, 500 aa, Heterodera glycines
  misc_feature (6)..(6): Xaa can be any naturally occurring amino acid
  misc_feature (30)..(30): Xaa can be any naturally occurring amino acid
  misc_feature (33)..(33): Xaa can be any naturally occurring amino acid
  misc_feature (233)..(233): Xaa can be any naturally occurring amino acid
  misc_feature (451)..(451): Xaa can be any naturally occurring amino acid
  misc_feature (455)..(455): Xaa can be any naturally occurring amino acid
  Coding regions on vcDNA: vcDNA=SeqID_81829; Strand=+; Position=1 -152,460-1819
  Homolog annotation: Hit_ID=NP_498506.1; Match level="QueryCoverage =97%, HitCoverage=82%, E-value=2e-75, Identity=37%"; Hit description =RNA-directed DNA polymerase family member (3I9) [Caenorhabditis elegans] gb|AAA21080.1| Hypothetical prot
KVDLNXFQYKRNIKHKFKKDGNFFEINKNXPIXKKYYFQNFIIFKVIFKSSFPICGWITLAKLSIVFPLFKKGDKCNPENYRPISLTCSLCRVMERILSQNIYNFLLKNNKISEYQFGFVRNRSTTSQLITVVAIINGKNVDCIYIDFQKAFDSVPHNLLLKIGKIGIKGKLLLWIKGFLSNRIFRVKIGDSLSSSKKVTSGVPQGSVLGPLLFLIYINDLPDALPSGVKIKXYADDVKIYICYKARSDTENMHKALHNLFEWANKWQIKVSIQKTFVLYLGSKNPKETYKFDGNTINAVDTIRDLGVNIDNKLQFSGHVNQITRNAYLRMRSLFRIIKSKSSKIWITLYKTYIRPLLEYAPEVWNPSLQKNIKQIEKCQKYFTKRVFFKCSLPPIPYLNRLEYFQLPTLENRRKLFDICSWHKIVYGRTDLKLFSIFNPSTRFHPLLQIXLKIXTGQKIHSLCWEGNKLWNQLDKELIKTNSLNQFKTKLRFTRVIKPE

SEQ ID NO: 155407 - protein, 70 aa, Heterodera glycines
  Coding regions on vcDNA: vcDNA=SeqID_81830; Strand=-; Position=1 -41,404-575
MKTLAGVELMTKVLFMPVYNKYCTYNLYNIIEFFHLLNELVADPNYWTVHYVQRLSVPMQSVAFPLDNKN

SEQ ID NO: 155408 - protein, 402 aa, Heterodera glycines
  Coding regions on vcDNA: vcDNA=SeqID_81831; Strand=+; Position=1 -124,456-1539
  Homolog annotation: Hit_ID=AAA59875.1; Match level="QueryCoverage =67%, HitCoverage=70%, E-value=3e-36, Identity=41%"; Hit description =mucin
MSREKGQFEKGYLPNYGDEILEIDEVLKAVRPIRYKLRDEHGSWVCGLHSISYPYSWSTIGTLDEQWIDIHFTDRRATDEDRQRVIRVPVPKASHSRVEQLREFLSVTLRNHSGAKLQPLPREVEENRNRTTTKPLGSPPPLKRQKRDTVFDASRKQIAPPPLHNENDDDEEIIEESPPHHEEEDDEGPIEESPPHYDEEQNDTVTAPVTPKVPVPAPVTSPAKPTTVKTPATPSVTTPAPPTTAKLPVTVPSPTTKPITPTPPPTTTTPTSTTKSTTGPLPTTTTPTPTTKSTTSPPPTTTVPPAITKPSTGPPPTTTVPPPITKPSTGPPSTEKPITTVPPPPQTTTTTSTPAISAVPSPSVKPTIPVPPAQLKSSGLSPKSKTPISTVKPATSSVRFPL

SEQ ID NO: 155409 - protein, 480 aa, Heterodera glycines
  Coding regions on vcDNA: vcDNA=SeqID_81832; Strand=-; Position=1 -190,234-293,338-552,593-994,1047-1155,1210-1302,1346-1495,1630 -1721,1766-1897
FETRPSSHGGAFAFRYDVEMVQLTRNKSLTSGGGDDGKNGLLRGVCFELIKFVHDSTQGFGQAAQFVYDNRKILFTNKRIEQFALEIDTEKVQGIVRDFLRGSPVKIEVRPCQTDKHELDLNGIVSSISHHPDQQSDRSLRTFLEMLSSQPFLNAGTHDIIGAGRLFKRQICKELEDGIVTREGIAKGVRVIDNNGEPKAALVADGLLCILLVECLSFSLVKTCAFFASRNLEEIVMEMVQKRRFNINNASQMDRFWSHFNHLFRGVSGYLTYAPSRVIVIDAISQRKIFDVDGRSMSMVDFFRTKKNIPINGQLPAVRQQQDRETLFPMSCVIILPGQRVTIDKMSEFISRELLSANTQPPARRYAAIEMTMKQIGATSSGFLANFGVRLSAESTVKIGVHQMPKINPAVRFLEPSDILSQWVVAFPGHLEESTVRNFVTQMIRMGQQKGMVLPQPTFVRIEIDHVLMASAVVAFFKYI

SEQ ID NO: 155410 - protein, 57 aa, Heterodera glycines
  Coding regions on vcDNA: vcDNA=SeqID_81833; Strand=-; Position=1 -38,304-439
MAEDNAQNVLVLLCAYLLFEYYYSFSSLLPWILFCRGRTDCSRECAHVEVTRQWPIG

SEQ ID NO: 155411 - protein, 195 aa, Heterodera glycines
  Coding regions on vcDNA: vcDNA=SeqID_81834; Strand=-; Position=1 -39,363-443,485-625,1371-1421,1539-1636,1681-1858
  Homolog annotation: Hit_ID=NP_502120.1; Match level="QueryCoverage =51%, HitCoverage=26%, E-value=1e-24, Identity=51%"; Hit description =tRNA -methyltransferase (4M60) [Caenorhabditis elegans] emb|CAA97418.2| Hypothetical protein B0035.16 [Ca
MKNNKVMFREAIEAVKRVDKDKLERVWQYFRPFAIIRDQMLLSKTDLQEIDRYIEGADMTMTPYRLELRKQIRQLESSSVAPARPGDTNWDPQDEASDSSSCPQSEDLTDSEKLCAFLGIKLHIVNFVKQYWNDVFINFVDNCSFGRTIVPDVGCNKKIKFNLLRKVAFEELGADALATGHFARTSQGGAFDMSL

SEQ ID NO: 155412 - protein, 242 aa, Heterodera glycines
  Coding regions on vcDNA: vcDNA=SeqID_81835; Strand=+; Position=1 -177,224-368,500-699,1118-1324
  Homolog annotation: Hit_ID=AAH46643.1; Match level="QueryCoverage =71%, HitCoverage=27%, E-value=9e-10, Identity=31%"; Hit description =RBM6 protein [Homo sapiens]
MMKWARRQEKINMSFKLNSNEVAAESCESQDSLLTVARRNLCVNSADERNVNEKSEAAKRLWDDDDEVEAAPPPDAVLPGRMRGLTNRQARVRIARAELSGGLAAVDDQQQQPTPIGDGAGGQQQKQHTDTDLTSSFDQEKFVDRNKFSCLLCRRQFANSETLDKHIQLSNLHKASETQSELNNMCKELALVHPAQRWTRIYHGKCGIDKRPFSGSETWKKLLDKTDGTRKQIYPHILDGRS

SEQ ID NO: 155413 - protein, 162 aa, Heterodera glycines
  Coding regions on vcDNA: vcDNA=SeqID_81836; Strand=-; Position=1 -93,153-259,298-389,597-670
  Homolog annotation: Hit_ID=EAA13587.2; Match level="QueryCoverage =100%, HitCoverage=21%, E-value=4e-31, Identity=44%"; Hit description= ENSANGP00000014333 [Anopheles gambiae str. PEST]
MDLVLIVQQYINEMVRLAGPGMKAILMDKETTSCVSCAYAQSEMTSCVSCAYAQSEMMQKEIYLFERLDSVVIREPIKFLKCVVFVRPTQENVQLLSEELQSPKKFLKCVVFVRPTQENVQLLSEELQSPKYSQYYIYFSNRIPKADVKILPESDEQETVRE

SEQ ID NO: 155414 - protein, 66 aa, Heterodera glycines
  Coding regions on vcDNA: vcDNA=SeqID_81837; Strand=-; Position=1-312
RTAVRVVFVRPFPYGICSDRDKWRYGSRSQIRTTCSLSVTVYKNSIQRDMLIKNGKYRSVSKLKII

SEQ ID NO: 155415 - protein, 155 aa, Heterodera glycines
  Coding regions on vcDNA: vcDNA=SeqID_81838; Strand=+; Position=1 -112,153-204,246-416
  Homolog annotation: Hit_ID=CAE57456.1; Match level="QueryCoverage =98%, HitCoverage=33%, E-value=1e-37, Identity=51%"; Hit description =Hypothetical protein CBG00420 [Caenorhabditis briggsae]
YTTNFPHSRQRTVYVGGFGGEVNEKILTLAFIPFGDIVGVSIPLDNETGKHRGFGGVSIPLDNETGKHRGFGFVEFELPRDAAAAIDNMNDTEIYGKTFVEFELPRDAAAAIDNMNDTEIYGKTIRVNFARPPKVNERSQRPIWADDEWLKLYGQ

SEQ ID NO: 155416 - protein, 41 aa, Heterodera glycines
  Coding regions on vcDNA: vcDNA=SeqID_81839; Strand=+; Position=1-124
MKSTGGNLEPMPFVRKWGSAVDGENGAEASQPVISDERFEN

SEQ ID NO: 155417 - protein, 222 aa, Heterodera glycines
  Coding regions on vcDNA: vcDNA=SeqID_81840; Strand=+; Position=1 -98,687-757,857-922,968-1008,1070-1155,2189-2243,2638-2834
  Homolog annotation: Hit_ID=NP_492093.1; Match level="QueryCoverage =91%, HitCoverage=10%, E-value=9e-72, Identity=66%"; Hit description =protein kinase C family member, UNCoordinated locomotion UNC-13 (207.2 kD) (unc-13) [Caenorhabditis elega
QQTTYHLMFDTCCEKCEPSEESVKFWSEFIEYMMGIIEDDKNIYTPVLSQFPQELNVGQGQLSAATLWNLYKTDLKDALLEHAKTKHAKTKRCKTPDYMNLYFRVKSFYSKNLYFRVKSFYSKYVAELPQYKESIPEFPEWFVPFVMDWLNENDEHSMDILRNAYNRDKVDNFPQTSEHTKFSNSVVDVFTQLNEALKVLKQVDFKHLNSLAILIFSAAKIY

SEQ ID NO: 155418 - protein, 214 aa, Heterodera glycines
  Coding regions on vcDNA: vcDNA=SeqID_81841; Strand=-; Position=1 -153,199-354,399-734
  Homolog annotation: Hit_ID=CAE65641.1; Match level="QueryCoverage =94%, HitCoverage=37%, E-value=4e-20, Identity=27%"; Hit description =Hypothetical protein CBG10699 [Caenorhabditis briggsae]
MYVCVFKTLNAYQITDKKLHLILRDDESAMKLATNLLGYNSMQCFAHKIQLAVGDGLKLLGGFFDVKERMKKAIRRIIKSRIIADDFKALQIENDLPLKTLQKDVEVRWNSTYLMVSRFLENKSAIEMMPAQDAKFPCFTSTEWTMMRTLCKILQPIYRATMHIQNRKSGISGVLPLYKVLKQNLTHWTAVDDFPEIRKRIAESLEERMKGLLY

SEQ ID NO: 155419 - protein, 187 aa, Heterodera glycines
  Coding regions on vcDNA: vcDNA=SeqID_81842; Strand=+; Position=1-653
  Homolog annotation: Hit_ID=CAE65641.1; Match level="QueryCoverage =94%, HitCoverage=32%, E-value=9e-20, Identity=29%"; Hit description =Hypothetical protein CBG10699 [Caenorhabditis briggsae]
MVSKVCFWVKLKMYVCVFKTLNAYQITDKKLHLILRDDESAMKLATNLLGYNSMQCFAHKIQLAVGDGLKLLGGFFDVKERMKKAIRRIIKSRIIADDFKALQIENDLPLKTLQKDVEVRWNSTYLMVSRFLENKSAIEMMPAQDAKFPCFTSTEWTMMRTLCKILQPIYRATMHIQNRKSGISGVL

SEQ ID NO: 155420 - protein, 130 aa, Heterodera glycines
  Coding regions on vcDNA: vcDNA=SeqID_81843; Strand=-; Position=1 -99,258-338,397-520,881-969
MSNLLKRKMADGQSEENAGRIETVDDQQQQQQKEFCEKCAKMETELRETKQLCKMKDLENRALKSELEKQNLMAERNALQAKIDMMEKEKEKQQNEQQGKYVSAGQMKPILDKINELEEKQNEQSKGEKN

SEQ ID NO: 155421 - protein, 133 aa, Heterodera glycines
  Coding regions on vcDNA: vcDNA=SeqID_81844; Strand=-; Position=1 -14,69-190,257-373,439-587
  Homolog annotation: Hit_ID=CAC21848.1; Match level="QueryCoverage =83%, HitCoverage=52%, E-value=5e-20, Identity=45%"; Hit description =hypothetical protein [Globodera rostochiensis]
MRIYFRIAIGLATEQMPLNEMVGTYNGTYAYGTGLFDCANFWGHSGNRRFMSGDLPSFSAGDVVGCGVNLDTRQIIYTKNGHRLDTSGLFVRTVCNLFPCVSLPFRHAEIVAYFGPNFKYNLANELANDYDRD

SEQ ID NO: 155422 - protein, 380 aa, Heterodera glycines
  Coding regions on vcDNA: vcDNA=SeqID_81845; Strand=+; Position=1 -125,176-268,349-485,533-748,821-1069,1176-1498
MAESKSELGDELWTGMEGPPVKEMKLETRAEEEEDEFDEQFLNEPKTIPMDTETLTAADSLRSHFGSLTKGNHAWEPPTSSASILKNPEQQQPSLLSDITEVFSAQQNVLGPSTSIGKITEMTHNVPFQFNAKVTVKELISQSFGETKGEELAKIVQAKGRPITMAKDRSTEQSNKSGETQRQDNLRRKSGLANALLPSPFTDGFAGSTNNRLTSHRIASPACASTSNSLSEPPFEENPQKNYEMVLTSTPSTQSLPCYESLSEESDTETGGEEVTTKKSSSVLCSASVAAAPLNFFSLLDLMDENEQQSQRRMEDDATDATVDTAPSFSTVSPLQNQQQCLSFFATAGQWAEANKRDKNGTERGEAAECVYEPLSEDET

SEQ ID NO: 155423 - protein, 149 aa, Heterodera glycines
  Coding regions on vcDNA: vcDNA=SeqID_81846; Strand=+; Position=1-450
MSLALCAAPFFLFALSSASPPFLATFNGCPQLIDGQLLDFVNSGGIRLTKSKTGNCDRLISCDLIGAPVEVSERRKRDETMPIDGTTVQLTKVEWYVNGRKIQRTNEGTEREETAENAQSENERTERSAIGVGEASRTNFEGKGSNLEE

SEQ ID NO: 155424 - protein, 66 aa, Heterodera glycines
  Coding regions on vcDNA: vcDNA=SeqID_81847; Strand=-; Position=1 -49,101-249
MSVPSKNKQFPKNIDDDDDDVDTDPSPEEVEKWTPEQVIEWEKRIFGKMPPEEELWQEIIDSGDKN

SEQ ID NO: 155425 - protein, 111 aa, Heterodera glycines
  Coding regions on vcDNA: vcDNA=SeqID_81848; Strand=+; Position=1-336
MAYGRLGRPYNVNVAAHFYVRHRIKLRHPFLHCVIERFPEGQEDRFYPLELCKIEEVDESKWLGQIFTEIDNNNISATNSTNFADTQTSNDDSKSVDGRDEYSQNDCYSLW

SEQ ID NO: 155426 - protein, 351 aa, Heterodera glycines
  Coding regions on vcDNA: vcDNA=SeqID_81849; Strand=-; Position=1 -176,671-962,1001-1280,1324-1611,1652-1671
  Homolog annotation: Hit_ID=NP_001004509.1; Match level="QueryCoverage= 82%, HitCoverage=19%, E-value=2e-32, Identity=31%"; Hit description =si:busm1-180o5.3 [Danio rerio] emb|CAD60788.1| novel protein similar to DNA polymerases [Danio rerio]
MRHFRTNHLKPGHLALVPEKGYDSCGDNQSDLAMSFMQWYAEKYAVRIQNAFSAEGEKSCVTDYPVGHPTLHVPCEDVDWRRPEDNPYPLAILKVFVIPPRKIDVPVLPVKVDDRLCFPLCMSCCKKYPNGGVRETYNCQHTDKQRGWISTCTSLELNAALEEGYRVTMLLRVLEYNKSDNQLFRPYMSEFMVQKLHASGFDEEIRGNFEAEERFIKECRENFDIKIDRAKMIPNKGKRALAKLAVNNLWGRFSLRNYGLSQTFITDDPSELGNYLDNRRIEVTGLDMLTPERILISYNQKKDWVQEHPCSNVVISLFTTSAARLHLLKAMQKVARTSGCTILYTDTDSLI

SEQ ID NO: 155427 - protein, 101 aa, Heterodera glycines
  Coding regions on vcDNA: vcDNA=SeqID_81850; Strand=+; Position=1-306
MYGRKTKGELIPQLYTMYGRKTKGELIPQLYTMYGRKKKGELIPQLYTMYGRKTKGELIPQLYTMYGRKKKGELIPQLYTMYGRKRRKKGRGSAKTDPYCS

SEQ ID NO: 155428 - protein, 94 aa, Heterodera glycines
  Coding regions on vcDNA: vcDNA=SeqID_81851; Strand=+; Position=1 -126,223-280,335-433
RYLSTHICLLIHCCQSCQSMMNNHPVAPLSWRRIVEHLQYIKVHVLEASFARAWVHEVGHPGCHCPYYENAQIVEASAVGGRGAQPIDNAFPAK

SEQ ID NO: 155429 - protein, 533 aa, Heterodera glycines
  Coding regions on vcDNA: vcDNA=SeqID_81852; Strand=-; Position=1 -303,344-622,1372-1905,1956-2178,2229-2368,2441-2563
  Homolog annotation: Hit_ID=NP_741481.1; Match level="QueryCoverage =86%, HitCoverage=34%, E-value=7e-45, Identity=37%"; Hit description =PDZ domain-containing guanine nucleotide eXchange Factor (163.8 kD) (pxf-1) [Caenorhabditis elegans] emb|
FSVPPSSSGSLRASRSNPDISANSVHYPFASCSSAVPSVASHRHSSFSTNCGGGAAGTNAAFGGIVQPLQMLKVYRVDQNFRYLPVLAETSAKQLMLMALQEFGLPVGENDGWWALYECSVSRDGVTKQGRLPDSAANLAERVGLNARLYLRDMRRPDESNLLPDELIPELVKQTRLTLYTLNAQCIAAQLTLQMMDPSRNMSRYRQQLAQFAQDPPVIPIYPVLRKDLIFAHEANPTFCNDAQQLVNFEKLRMIAQIVRNIQRYSSVPYDQSVLIGGANVRNLRGNSHKIRIGWQRLCRGLFGLLHFFIGQLLDPGTMRKSGGNVAALGHGSGRFASSSGGAVSRKKLHERTMMQIRVKAYLQNIPIIDSEIDLDRISLDCEPPLSSASGASSSSQQQFHHSNSNVPSRRRLPSPSPSSLSSQSNQSNIVHSHERHRGMINLPKFGVESPQAISKMLSLVQNSKIKSRTQGYGRAIHSSKDELPPSGQLKGMALISRKDLPWPAAERTTTTKGSFCDRWSSHNQQNEEQKTQ

SEQ ID NO: 155430 - protein, 1281 aa, Heterodera glycines
  Coding regions on vcDNA: vcDNA=SeqID_81853; Strand=+; Position=1 -46,503-4301
  Homolog annotation: Hit_ID=NP_507780.1; Match level="QueryCoverage =86%, HitCoverage=71%, E-value=1e-103, Identity=27%"; Hit description= predicted CDS, DNA polymerase type B, organellar and viral family member (5T899) [Caenorhabditis elegans
MTTCLSEGQAPPTCEDPQAELRSCVHKAVEEAIQDAQNTLGGANKVGVIISSELLDQGDIILPITPITLNVVDAVFNQFCKVEQSKSKHVNLYGAPFVVTVTVLNTVGLPRRRTTKGSAPPIHSSQSHIFKINNNDNYCLFYALELMRYYSLYKRGIITRDNWRWINNNQTTVLRQKAQQLLREAGIPTTETEYDAEVYIHQVQGLWNVKYPGEYKIFIFNDYQMRPITKSDITDYQFPILLYHNNNHFDGIKTLSKFFNKRYYCISCESAYSHKFEHSSKCSSLCHGCREVGVDYPCEAQQGYFKKCLHCNNYFYNNDCYERHLHKDLCTKFQRCEDCGVIYNVKVHGNVGHQCGERFCRLCKQFHLKEEDGENPCKSCFIQPLKPHKLKPYRIIAYDFEATQDKKVGNKFEHEVNFAAATVICTECINNDNWNKSLQGNPCKICGPYRTITFSPFDYTETTVDQKIVTQQPLSEFVQWLLFDHNKKFPTVAFAHFGGRYDMTMIIKEVLAQGIHNPDIIKQGNRLYELKIKDNEHCPLTILHDSYNLMPIKLSGLIKSFGLHIKDKQHFPHMFNKSSNYDNILSHLPPREEYCPDQMKIPDQQKFDKWYNNNYNQPFNLKEKLPEYCCNDVQILTHALVELRREFKQLTQRNGKHGGIDILWQAMTIASACVKNFALNHLKPNSLAIVPEKGYTPQQNQSALAIKYLDWYSHINNVNIQTAHSRYGEYVFKREGQVYQVDGYIKGTNGKRDKIIEVNGCLWHGCEECFEDLDDETKMPNGKTLGQLREREVRKHEILSRYVDLEVIWEHEINEQLKKDKQMREFFDNWKDHSPIKIRDAFHGGRTGPMKLLHTAKPGQKISYKDFTSLYPWTNFSTDYPLGHPKIISFRLNEQTVNWRAPSDNPYKGLLKVLLLPPNRNINVTVMPIKFDERLLFPLCEKCAKHITNEHPNGLKDDNYSCPHFNPNDRAFVSTCTHLELNAALEAGYTVRKLFHVLQYDQWSDNIFKSYVSEMMALKIHATGFPSWCSSEEEKKEYIEENRHRFGILLNNEKMKAEPGKRYIAKLCLNSLWGRFSMRNLLSKAIINNDESLIRQYTDDKKIELVDLEMIDDDNDVFMLTYKPKEEFVDENKYSNVVISLFTTSAARLYLYEALKKVADTPDCEILYFDTDSVIYVHPEENDPLPTGKGHLGELTDENPDHNILEFISAGCKNYGLKLQRKDTGEIEHDLKIRGFTLDAQTVQKIHYDTVKDQILRYGSEDPPDPIIVNYLHFIRPNPNP

SEQ ID NO: 155431 - protein, 189 aa, Heterodera glycines
  Coding regions on vcDNA: vcDNA=SeqID_81854; Strand=-; Position=1 -80,233-402,491-575,1035-1270
VVSDGIGGYSAEKHQFSLIEKKHSSADLICVKWLMILAVLRALPPVLARVVAVVRHAVASSVGAARVPPFHVLHHLAKNDCTSAIWTSRSVVGTLKTFLESMDGSATVGWPGMVRLIVADRRLLRDVITTRRTVTDAVVVRVLARPVVGARPVARAVAHRRAAVVRLAVRRVASARRRRRENAETGRRR

SEQ ID NO: 155432 - protein, 27 aa, Heterodera glycines
  Coding regions on vcDNA: vcDNA=SeqID_81855; Strand=-; Position=1 -64,112-131
MAQPNEFRIQKYKARPTIQISELKHYF

SEQ ID NO: 155433 - protein, 196 aa, Heterodera glycines
  Coding regions on vcDNA: vcDNA=SeqID_81856; Strand=-; Position=1 -73,120-212,613-699,823-1158
MLSFIYTGDLAKLNGYNAMAVLYAAKKYNIPGLVDASLQVPVSSLRNVFLAYAQAAENRRAMLGPALYEIRFPLISTEEFTKKIVPSDVLSKDEVIAVYQFHSLPNYRWISDGLFPMQFPTNRRISNRKTGTILMDIENVSEFAREDVESSRYSEKMTINGLSWKIMAQIKTKNGSTDNNEKWLGIYLLGVAREAQ

SEQ ID NO: 155434 - protein, 32 aa, Heterodera glycines
  Coding regions on vcDNA: vcDNA=SeqID_81857; Strand=+; Position=1 -15,200-283
MAMSKHQNGTLPQILQKCASKSVYVLTKAEED

SEQ ID NO: 155435 - protein, 125 aa, Heterodera glycines
  Coding regions on vcDNA: vcDNA=SeqID_81858; Strand=+; Position=1 -264,309-422
  Homolog annotation: Hit_ID=AAO51573.1; Match level="QueryCoverage =84%, HitCoverage=9%, E-value=3e-09, Identity=37%"; Hit description =similar to Dictyostelium discoideum (Slime mold). Adenylyl cyclase
MPTLQAEQHPPPLSPQTNNVQQQQPTVPSPLNERQQSVQPTQGEHPQIRANATLQPNVVQAQQQQQQSHQFLGLDHDNDDQLLNQIFLDLTTSAEMQPIALDNNNNNNNNNNNMVVNDFWFCLFV

SEQ ID NO: 155436 - protein, 19 aa, Heterodera glycines
  Coding regions on vcDNA: vcDNA=SeqID_81859; Strand=+; Position=1-59
MPMPMPDVAEEEEEEPDAK

SEQ ID NO: 155437 - protein, 46 aa, Heterodera glycines
  Coding regions on vcDNA: vcDNA=SeqID_81860; Strand=+; Position=1-143
KRGYDYIRFGRRSSAVAAIPKLAKQQRKKSADTSGARTAYDYIRFG

SEQ ID NO: 155438 - protein, 91 aa, Heterodera glycines
  Coding regions on vcDNA: vcDNA=SeqID_81861; Strand=-; Position=1-276
MHVTEFLPQSPRRDNILMALELLAKLQSFAVADLLSADQIADFRATADQFRVQMLEHFRRHCSTSKFHHLVHHAPEFAENHGFWGLLSEHQ

SEQ ID NO: 155439 - protein, 50 aa, Heterodera glycines; identical to SEQ ID NO: 131515
  Coding regions on vcDNA: vcDNA=SeqID_81862; Strand=+; Position=1-156

SEQ ID NO: 155440 - protein, 266 aa, Heterodera glycines
  Coding regions on vcDNA: vcDNA=SeqID_81863; Strand=+; Position=1-801
  Homolog annotation: Hit_ID=NP_491240.1; Match level="QueryCoverage =95%, HitCoverage=19%, E-value=1e-59, Identity=45%"; Hit description =zn-finger, CCHC type and RNA-directed DNA polymerase  and Integrase, catalytic domain containing protein
MDAFGLLDDLKRKISNSAINLCENINSSATFTTEAADKFIRELKATFSTTFEEGLGLCTKELAHLQLKDGATPIYRKARPMPHHSKEIVEMELDRLEQLGIIRKAEHLTWAAPILVVKKGDGSARLCIDYSTGLNDALLDFQHPLPIPDDIFATLNGGKFFSQIDLKDAYFQIQLDDDSKKICGISTHKGNYFMERLPFGVKSAPGIFQSIMDKMLAGLNFATAYLDDIIVASRTFDEHTDHLKEVFDRLQSFGFRVKISKCAFFQ

SEQ ID NO: 155441 - protein, 550 aa, Heterodera glycines
  Coding regions on vcDNA: vcDNA=SeqID_81864; Strand=+; Position=1-1653
  Homolog annotation: Hit_ID=NP_491240.1; Match level="QueryCoverage =96%, HitCoverage=39%, E-value=1e-118, Identity=41%"; Hit description= zn-finger, CCHC type and RNA-directed DNA polymerase  and Integrase, catalytic domain containing protein
MVTKNINATSLLKVGVFVNKKKTKFVADSGTEVNIIDEDAYDKIGRPKIQECEEKGKLFDGTKVAFIGKGVATFQFGDIAIDQEFYVAKRGSLNLLSISTMDAFGLLDDLKRKISNSAINLCANINSSATFTTEAADKFIRELKATFSTTFEEGLGLCTKELAHLQLKDGATPIYRKARPMPHHSKEIVEMELDRLEQLGIIRKAEHLTWAAPILVVKKGDGSARLCIDYSTGLNDALLDFQHPLPIPDDIFATLNGGKLFSQIDLKDAYFQIQLDDDSKKICGISTHKGNYLMERLPFGVKSAPGIFQSIMDKMLAGLNFATAYLDDIIVASRTFNEHTDHLKEVLERLQSFGYRVKISKCAFFQEEIKYLGLIIDKNGRRPDPSKIQAIVDMPAPTNISSLRSFLGMVNHYQQFVRNMRFIRKPLDDLLKHEAKWNWCDNCRKSFQKLKNILTSDLLLTHYDPKLEIIVSADASELGIGAVISHRFANGTIKAIAHASKSFAPAEKNYSQIEKEGLALIFAVQKFHKIIYGRKFILQIDHKPFSPFRK

SEQ ID NO: 155442 - protein, 370 aa, Heterodera glycines
  Coding regions on vcDNA: vcDNA=SeqID_81865; Strand=+; Position=1-1113
  Homolog annotation: Hit_ID=AAG23159.1; Match level="QueryCoverage =52%, HitCoverage=84%, E-value=1e-86, Identity=78%"; Hit description =polyprotein [Heterodera glycines]
MKRMKQLARQYIFWPKLDKEIEDYVQNCEPCQLAAKAPIKTDLHSWPKPTGPWQRIHIDFAGPFFGKTFLIVVDSFSKYPEVFEMANSTASATIEKLRYLFTRHGIPETIVSDIGTQFSSSEFAKFVAANGITHLFSAPYNPMSNGQVERFVDTFKRAFRKLKGEGKPNKEIIDTFLITYRTTPNDSLPDLKCPAELLLGRRPRTTIDLLRPPPHQPFEIDLEMERQFNKKFGTKNRRFILNEKVFARHRSSQHWKTGVISGTSGVIFEVKFPDGSFGRFHANQLRNRKTADNFDQSLAILNEAFELPLPPALPNQPPDAENANLGPNQLENEVAEPIQDNLAAPIEDVPIQRRYPQRQRRKPNRFSPGP

SEQ ID NO: 155443 - protein, 150 aa, Heterodera glycines
  Coding regions on vcDNA: vcDNA=SeqID_81866; Strand=-; Position=1 -138,511-672,853-1005
  Homolog annotation: Hit_ID=AAB42377.1; Match level="QueryCoverage =96%, HitCoverage=37%, E-value=5e-22, Identity=37%"; Hit description =BmSERPIN [Brugia malayi]
MPYKGEKEFMFVLLPKKRFGLTEVLAQLDGKRLVKLIKKRDKCKVKVQLPKFTLKATHELNEPLTNMGMATAFTDSANFEGISNNKPLLISKVVQKAVIEVNEEGTVAAAVTEEEVECGSSKEERFVANHPFCAFLIRDDTVLFSAIFRK

SEQ ID NO: 155444 - protein, 385 aa, Heterodera glycines
  Coding regions on vcDNA: vcDNA=SeqID_81867; Strand=+; Position=1 -373,870-1654
  Homolog annotation: Hit_ID=AAG23159.1; Match level="QueryCoverage =45%, HitCoverage=84%, E-value=5e-74, Identity=70%"; Hit description =polyprotein [Heterodera glycines]
MVNHYQQFVRNMRFIRKPLDDLLKHEAKWNWCDNCRKSFQKLKNILTSDLLLTHYDPKLEIIVAADASELGIGAVISHRFANGTIKAIAHASKSLAPAEKNYSQIEKEGLALIFAVQKFHKMIYAQNSPTFSQGPSRNETDETTRPTIHIWPKLDKEIEEFVQNCEPCQLAAKAPIKTDLHSWPKPTGPWQRIHIDFAGPFFGKIFFIVVDSFSKYPEVFEMTNSSATATIEKLRYLFTRHGIPETIVSDNGTQFSSSEFAKFVAANGITHFFSAPYNPMSNGQVERFVDTFKRAFRKLKGEGKPNKEIIDTFLITYRTTPNTTIDLLRPPPHQPFEIDLEMERQFNKKFGTKNRRFILNEKVFARHRSSQHWKTDNFFERSITL

SEQ ID NO: 155445 - protein, 106 aa, Heterodera glycines
  Coding regions on vcDNA: vcDNA=SeqID_81868; Strand=-; Position=1-321
MALTIEQLLQEISQQNQNPSLSGIDVFELCDETTNIEDWLQQFCFALDCSAPNLKDEQKVKLLMTKLSKAAFSEYKKSCLPKDVTDSNFAKTEQQLKALFAKPQSV

SEQ ID NO: 155446 - protein, 16 aa, Heterodera glycines
  Coding regions on vcDNA: vcDNA=SeqID_81869; Strand=+; Position=1-49
MQVAGMQYPIKADLGE

SEQ ID NO: 155447 - protein, 77 aa, Heterodera glycines
  Coding regions on vcDNA: vcDNA=SeqID_81870; Strand=-; Position=1 -31,556-758
MIPLFLRISQAVNPMKGAGKSDTGKSDTGKSDTGKSDTSGKSDTAGKSDTSGKSDTSGKSDTAGKSDTRKSDTDFNF

SEQ ID NO: 155448 - protein, 113 aa, Heterodera glycines
  Coding regions on vcDNA: vcDNA=SeqID_81871; Strand=-; Position=1-339
MNESTCEKPVNSSKSSATIESGSERKPSGTGKATESVSTKKKGREVKRGTDDQITDQILEGVETDQIRTEQGIITDKLKKAKQQGQNKAIEGTFSFASLKYHNPNEGKRFSGE

SEQ ID NO: 155449 - protein, 117 aa, Heterodera glycines
  Coding regions on vcDNA: vcDNA=SeqID_81872; Strand=-; Position=1 -198,239-394
MDFCASKVWNCFEKISQSTNVQCNLCQKVLNRSDTSTKGMWSHLKSMHLKEYKELQLQEPKRSKNKTIDSFLLKKHDEQKEVEEMLTNFMVQQNCAFSVFENSILKLTQRAYPNFEV

SEQ ID NO: 155450 - protein, 251 aa, Heterodera glycines
  Coding regions on vcDNA: vcDNA=SeqID_81873; Strand=+; Position=1 -62,126-206,254-387,612-757,809-1141
MNSFSLLTVFLSLVINCSPIRPLSSDVGIWKTCNGKNGIIMVENGCTKLLLCYQSEMAKNKKIGKRFGVGKGNIGKLKFVECAEEIAEDQWHDAEPLGNELQEALSSAAFLDDFMPFVLAFEFGATFCAENGGTNKLCKEKCLTLAPFVGTTKSHGKTTVTTTSIPTTTERQTFAFAEFVPHFGTNCSKIVFPVEVAKFILNITAVPYRIACNVYEQHYEIGQSVEDYLVNSNKSFFMLAWKCRQPNAQSD

SEQ ID NO: 155451 - protein, 145 aa, Heterodera glycines
  Coding regions on vcDNA: vcDNA=SeqID_81874; Strand=+; Position=1 -73,189-491,547-608
MTEHAKVGLGKKHRLTVVDCLRYKISRKWVRFSLGEGRFWIKFGISPDAISLPSNIIFKKRGVSKWRDLNNYVINQSIIINHKGCGLEPENLISRRRKRQFRPFHGTQKGKWTSFPIVISFLEDKLPKDYRAWEAAIKVGADMIM

SEQ ID NO: 155452 - protein, 204 aa, Heterodera glycines
  Coding regions on vcDNA: vcDNA=SeqID_81875; Strand=-; Position=1 -150,340-456,534-626,685-939
MDTAQNCKNLSDDQQVAAFQVLAEEQGGDLKARIDQILIISGLNLPNNKQANIDNVLMKVNVSDDQFKQNIEEAKQKLSSSKAKETADQLEDLFLDGSLPFIDKVKKSVELVQELPEEIRTECEPVLMVINSITRCPFKEQCTPSEEIGGGNIGNVGQGGGGGIGLQQGQNKQGQQQLQQNQQEQPCFHIKLLKVCTISKNQKE

SEQ ID NO: 155453 - protein, 31 aa, Heterodera glycines
  Coding regions on vcDNA: vcDNA=SeqID_81876; Strand=-; Position=1-93
MGKEMHDLKAEAESIRNVAIFGVCICTVASF

SEQ ID NO: 155454 - protein, 49 aa, Heterodera glycines
  Coding regions on vcDNA: vcDNA=SeqID_81877; Strand=+; Position=1 -26,66-198
EGHLHTFAKMSSDGMTKFWRCEFKKSISHYFGVSPGNFSQLSNEPVNFC

SEQ ID NO: 155455 - protein, 237 aa, Heterodera glycines
  Coding regions on vcDNA: vcDNA=SeqID_81878; Strand=-; Position=1 -556,616-773
MLFLLFIFVFLIINNSTDKTLSVNLCKKCRPTFAEIFGEEWQNEIIIGENENETDQNANFHQNDQNESTDQNDQLDFQQKNEIIHKFHAIKEGIKKRGKYSAKVRNKTEQKIAEKLGINRPKIYKWKKEIGIYYYKKKKQEFIDQIDEIKRMPKNGRQKQFAKELGISKETLRKWKKEFGIEMSKSPIRFTEEQKMSKMNDYYEMKKANPSLSDKEIADILKIGTATLKRWKKENNS

SEQ ID NO: 155456 - protein, 242 aa, Heterodera glycines
  Coding regions on vcDNA: vcDNA=SeqID_81879; Strand=-; Position=1 -81,182-445,977-1147,1408-1620
  Homolog annotation: Hit_ID=NP_740900.1; Match level="QueryCoverage =99%, HitCoverage=12%, E-value=1e-21, Identity=37%"; Hit description =chorein A (359.3 kD) (1J482) [Caenorhabditis elegans] emb|CAB02304.1| Hypothetical protein T08G11.1a [Cae
MVRDYREAWIHFRTHKTPRKAVMDTIEEAEDALDVFNLNIARQQAEFEIDKQTDLVRVEDQPQEGWVGWAKNWWFGGSPKGKEAAAPEDAQIFEKLEKELTPQEKERLFDAIDYQVMFKYHAPAVNKALDVFRPPKSVRLHQLTTLAIARYEDVKAIGLQLANLPNHNSLTNITDQRLRSLVAKAYDNFQLRLSNLRLIFSDSFANCMKARGDKSSDDHLLKPTGMCIDMLRATIDDVQIPM

SEQ ID NO: 155457 - protein, 157 aa, Heterodera glycines
  Coding regions on vcDNA: vcDNA=SeqID_81880; Strand=-; Position=1 -96,126-292,339-397,470-623
  Homolog annotation: Hit_ID=NP_740900.1; Match level="QueryCoverage =83%, HitCoverage=4%, E-value=2e-35, Identity=52%"; Hit description =chorein A (359.3 kD) (1J482) [Caenorhabditis elegans] emb|CAB02304.1| Hypothetical protein T08G11.1a [Caen
QKKRTKMSVKPSRKNCYDWRRTDEAAKVDKKEPNMPSDDTFTEKLIAQIIKNLQVHIKRVHIRYEDKFSNRERPFATGITLDSLNFQTTDENFKLIVQKETVKIFYKLVSMSSLSIYSNANSNFISDNKGKEKIINSLQRTIAVNEEKPEGYRYGGY

SEQ ID NO: 155458 - protein, 63 aa, Heterodera glycines
  Coding regions on vcDNA: vcDNA=SeqID_81881; Strand=-; Position=1 -144,324-371
MRRQWENKFARLAETSRKTRRSNKAGTASHEVGHSVIIWLLGVRQFLKANKVSQKLSNDNKNI

SEQ ID NO: 155459 - protein, 51 aa, Heterodera glycines
  Coding regions on vcDNA: vcDNA=SeqID_81882; Strand=+; Position=1-268
ELLVLFDSSMCLLLICKISKILVKFQKSYGQKELKNPLIRTFFCSDFFVHK

SEQ ID NO: 155460 - protein, 93 aa, Heterodera glycines
  Coding regions on vcDNA: vcDNA=SeqID_81883; Strand=-; Position=1 -48,1006-1239
MTLSKKFLPRPYVSASANSIFRMLSNNTKNEKQLHCDRAGLISTDPVRMLKKMCFGPFCRHNQIKTKINKCDPNVIKPKNGEKISEIWHLIRK

SEQ ID NO: 155461 - protein, 42 aa, Heterodera glycines
  Coding regions on vcDNA: vcDNA=SeqID_81884; Strand=-; Position=1-126
DFQLVTFENFIQQILFHFQKGIRLDQRFRILVNVIQAATREI

SEQ ID NO: 155462 - protein, 66 aa, Heterodera glycines
  Coding regions on vcDNA: vcDNA=SeqID_81885; Strand=+; Position=1-201
MALVSFDLFPKRADIQLAIMEMEQDGYANFGRKGKSWVINRDAKKYEHKIVKYVHKICTKNREICA

SEQ ID NO: 155463 - protein, 213 aa, Heterodera glycines
  Coding regions on vcDNA: vcDNA=SeqID_81886; Strand=-; Position=1 -439,482-682
  Homolog annotation: Hit_ID=AAD34306.1; Match level="QueryCoverage =92%, HitCoverage=57%, E-value=8e-43, Identity=48%"; Hit description =transposase homolog [Haemonchus contortus]
MHRRPKVGRSPKTTERQQRQLVRLVKTDPKKTAGDVRRHSADVLGVQISHSTAQRILRRHNLNARRPARKPLLKECHRMARLAFARAHAHWTVEDWRKVIWSDESKLNLFNSDGAIHVRRPPGKRFDPKYTRGTMKFGGGDGVMVWGCFTGDTLGPLVRIEGNLTSEGYRNILEDQMLPFARDHLAPGWTFQQDGAAIHTSQLLMGPVRRLPG

SEQ ID NO: 155464 - protein, 235 aa, Heterodera glycines
  Coding regions on vcDNA: vcDNA=SeqID_81887; Strand=+; Position=1 -96,161-293,330-450,640-763,978-1118
  Homolog annotation: Hit_ID=A35810; Match level="QueryCoverage=82%, HitCoverage=28%, E-value=1e-41, Identity=45%"; Hit description =alpha,alpha-trehalase (EC 3.2.1.28) precursor - rabbit gb|AAA63460.1| alpha,alpha-trehalose glucohydrolase sp|
DFKVSSMDSKNVDKLKTFVREHFGSADKFLDSPQPVDWKENPPKLQPQPVDWKENPPKLQNIADPELKTFANQLHELWKKLGKKMPESVKAKENKSTLIYVPNPFVVPAKENKSTLIYVPNPFVVPGGRFREFYYWDAYWIVRGLLASGMTESVKHMCNNYAEMVNKFGFVPNGGRIYYNKRSQPPFLTFMVNDYFAETGDTEYLKTILPVKRSIWRGVMAVRTMAFRVQTHLEG

SEQ ID NO: 155465 - protein, 237 aa, Heterodera glycines
  Coding regions on vcDNA: vcDNA=SeqID_81888; Strand=+; Position=1 -164,306-426,476-906
TGLPKPIVECHAELAKLLNDSKIEVSSIDQLTEKFWMVYYKAKDEHVVEHSTSNDTDSIFYDYLTRLGDPLPGGEQLGELADEYPNHTIMEFICAGPKAYGLWLRNNATGEDEYKLKVRGITLDSDACERMTFEKMKDMVLNKLGQADNNVRFNYPSKNFKITKKGEIFTVPLVKQFNPTVNKGVVRDKGLRVVPFGFSNQEWCKWNCPGACTCLFNPDLNVNMFTEEELNDPDIMP

SEQ ID NO: 155466 - protein, 339 aa, Heterodera glycines
  Coding regions on vcDNA: vcDNA=SeqID_81889; Strand=-; Position=1 -396,563-644,687-1225
  Homolog annotation: Hit_ID=AAA93301.1; Match level="QueryCoverage =72%, HitCoverage=65%, E-value=6e-33, Identity=34%"; Hit description =HASI
MVTDEDEDEEIEVSKFLTPTSQTQGSNRSPRTNKKAAKQQKLIEKKDHLLAIIMSDPQRFGATDRGKIINPKTGREFIDSDLAWSIERLVDPRPENAPSPRGTKELKRKLAQNPLASSLLNRLFVGSGFVGQRNTTYTLFKPKREKFRRLRTVPTGFMTDVQADLADFQALSRKNSGYRYLLLAVDVLSRRMFGAPVKSKRPVDMKRAFEELFEQMPRVPDTMYTDRGLEFVAKPLKEFYAEKGIQKFETSSKKKAAVAERAIRTVKTRLYKYFSANNTSVWVDVLPKFLSAINNSVCRATGLRPNEISDTNAREVWKRVYGEGLAQLDKSPKIRAGET

SEQ ID NO: 155467 - protein, 73 aa, Heterodera glycines
  Coding regions on vcDNA: vcDNA=SeqID_81890; Strand=+; Position=1-472
LIKYDHFFAVCCIVANSIHLEQFCDFVDRRIRLQLLHFDQLTDVVSFSHIMTEGVSKFECPNSILMPSLAMNR

SEQ ID NO: 155468 - protein, 372 aa, Heterodera glycines
  Coding regions on vcDNA: vcDNA=SeqID_81891; Strand=+; Position=1 -110,168-399,1168-1592,1637-1885,2002-2101
  Homolog annotation: Hit_ID=XP_395051.1; Match level="QueryCoverage =80%, HitCoverage=46%, E-value=3e-13, Identity=28%"; Hit description =similar to CG7896-PA [Apis mellifera]
MGRDNTLPQALFRPLDKLRELFLSGNGLRTVRIEIGGTEIKLANDQGLISLAGPILDRLDLSRNRLCPSRKNSNDTFGIEWPPARQLSLENANVLELNSTHWTFGEVKVEQQQKLANNSIARLPPELFEQYTQLNSLDLSQNAFYHFHFGDSSHQQQTTLIFLNLSQNRLRSVSLPTLSSLTLLDLSYNILTEFASLSSLPSLEHLHLSGNAGIRLTIAAEHPALLRLHLANCSLTKMPDLSRLIALRELDLRTNGLESVPGHLLPSRGVNALDVEGNALRELGWDWRAEQLAALRDLRAVGNPWECACEFAPPVVQQLFTPQTQQTTVRAATEGKAGLIKGHFSVGGNVHAETNTEKLRMSTEKQQNSSKT

SEQ ID NO: 155469 - protein, 177 aa, Heterodera glycines
  Coding regions on vcDNA: vcDNA=SeqID_81892; Strand=-; Position=1 -92,815-944,1237-1389,1470-1628
  Homolog annotation: Hit_ID=CAE63328.1; Match level="QueryCoverage =80%, HitCoverage=16%, E-value=1e-58, Identity=77%"; Hit description =Hypothetical protein CBG07725 [Caenorhabditis briggsae]
MLPLDGIKLKDLEAGFMSRQHKFALFYPDGKNIYKDYKELELSAKNLDEVDAWKASFLRAGVYPEKEHQPTSDENGHVEEPSSLDPQLERQVETIRNLVDSYMRIINKTIRDLVPKAIMHLIVNKLGDFLKDELLASLYQHGGDTVAPFGFIFVHIKNAFCCLGTIDGGVAARGSKA

SEQ ID NO: 155470 - protein, 104 aa, Heterodera glycines
  Coding regions on vcDNA: vcDNA=SeqID_81893; Strand=+; Position=1-313
  Homolog annotation: Hit_ID=CAG02854.1; Match level="QueryCoverage =66%, HitCoverage=3%, E-value=2e-18, Identity=60%"; Hit description =unnamed protein product [Tetraodon nigroviridis]
LQKVGINPSSISFGNVTMESDKYIVVRETVGDTAQVVIVDVANPTDVTRRPVSAETALMNPVSKILALKCMYSITGLVYDRITFLSREDLTNIRSRTEGQSQDS

SEQ ID NO: 155471 - protein, 381 aa, Heterodera glycines
  Coding regions on vcDNA: vcDNA=SeqID_81894; Strand=+; Position=1 -147,220-579,641-967,1025-1336
  Homolog annotation: Hit_ID=CAE64972.1; Match level="QueryCoverage =96%, HitCoverage=21%, E-value=1e-144, Identity=65%"; Hit description= Hypothetical protein CBG09806 [Caenorhabditis briggsae]
MITKYGYVHLFDLETGISIYTVRVSTETVFASTEYKVNNGVLGINRSGQVISVGLDETTIIPYVTQQLQNPDLALKLASRCNLPGAEELFVRKFNLLMGNGNYADAAKVAATAPQKILRTPQTLQKFQSAVQPQGKGAAPILIYFTTLLEQGSLNKYESLELCRPVLAQGKKQVVEKWISEGSLDCSEELGDLVKQYDINLALSIYLRGNVPHKVVQCFAELGQFEKIILYAKKVNFEPDYLFQMRQVLRTHPENSSKFALMLLNEGPSGEPLADINQIVDCFAEAGNIQQCTAFLLEALKSDDESQGHFQTRLLEMNLMSNPQVSDAILGNRMFNHYDRASIGQLCEKAGLPQRALEHFSDLYDIKRSRCAHTTFQFRGY

SEQ ID NO: 155472 - protein, 203 aa, Heterodera glycines
  Coding regions on vcDNA: vcDNA=SeqID_81895; Strand=+; Position=1 -86,453-978
  Homolog annotation: Hit_ID=CAE64509.1; Match level="QueryCoverage =98%, HitCoverage=76%, E-value=4e-53, Identity=50%"; Hit description =Hypothetical protein CBG09244 [Caenorhabditis briggsae]
MPRLTSRKTQNTRLSMMPRLKPIKTQKTTIKKAAQEKAQKDAEAKAKKDAEEKAKKDAEAKAKKDAEEKAKKDAEAKAKKDAEEKAKKDAEAKAKKDAEEKAKKDAEAKAKKDAEEKAKTDAETKAKKDAEEKAKKDAEAKAKKDAEEKAKKDAEAKAKKDAEEKAKKDAEAKAKKDAEAKKKEEEGRSKERPEEKAEAPAEG

SEQ ID NO: 155473 - protein, 153 aa, Heterodera glycines
  Coding regions on vcDNA: vcDNA=SeqID_81896; Strand=-; Position=1 -245,311-371,500-655
MLRSVFLLLLVLLIGWLIASAARNQITDFISFITPLIVNLFIAEPVAHSVMCTNIKSVLIGIITCVPILASASGAPILLLNSSDYRTAYKKAIMRRKGNSSTKNDSSSKFCDLFAKIFVVLFFKHLSFLSMSRMFNLVDSDKSHGKFLFKIFI

SEQ ID NO: 155474 - protein, 54 aa, Heterodera glycines
  Coding regions on vcDNA: vcDNA=SeqID_81897; Strand=+; Position=1 -151,805-818
MIRRGTTVIRRGTTAIRRLIRRGSTVIRSSTTVIRSSTTMIRRGTNVIRREFLE

SEQ ID NO: 155475 - protein, 294 aa, Heterodera glycines
  Coding regions on vcDNA: vcDNA=SeqID_81898; Strand=-; Position=1-885
MVGNGNELVETEDDENSVNFMNLFANLELTDSEKLPSHMEIEKIFSDTTPPPADLPPIESSVLGFVFISHPILWALVQPDILGEQNELLDQKNLSLESDQLVFQSTPSYVTTITLDPNNNWPHFTQISLNWNKQSLLGTRLKTIDLKQMTSPPKLGPSVSQIVPSSCCGIIREVIQNKITSEIMAIDVFLYGEETNQRFFPHQLDSSVNLTELEEGTRVQTTGFWAKTSAMEWPTSSDGVRDWWIEQIYVGTNLKIFGADEHEDIHQWLQNEQFRLSYRYLCAAMDLQQSPKRR

SEQ ID NO: 155476 - protein, 61 aa, Heterodera glycines
  Coding regions on vcDNA: vcDNA=SeqID_81899; Strand=+; Position=1 -51,397-531
MPKKLLKKEGIRKMRDFIIKIGNKPQMLFAGVIVLPIFVLQHCVWKCRPVCIMMQGTKEVL

SEQ ID NO: 155477 - protein, 64 aa, Heterodera glycines
  Coding regions on vcDNA: vcDNA=SeqID_81900; Strand=-; Position=1 -44,283-433
MGKEQFREADTTRKVKYMHVQRYHGKQKYLPYIGVDTAELSRIFRNTVNAIQLIRCIKLNGRIN

SEQ ID NO: 155478 - protein, 71 aa, Heterodera glycines
  Coding regions on vcDNA: vcDNA=SeqID_81901; Strand=-; Position=1 -119,547-643
MLPSESLNWYFGCFLALHSTHSASLSFSLLFSNNPIFQIGLENFVAFVRLIKHVMSPKRLRKWRKRRNEEN

SEQ ID NO: 155479 - protein, 41 aa, Heterodera glycines
  Coding regions on vcDNA: vcDNA=SeqID_81902; Strand=+; Position=1 -107,277-295
MTTEWATVTVAKVGLNVLGFRYQSNSMKITKNLAHRRSSAK

SEQ ID NO: 155480 - protein, 84 aa, Heterodera glycines
  Coding regions on vcDNA: vcDNA=SeqID_81903; Strand=+; Position=1 -90,487-651
MVKHWSCPYEIWCDKFLREHNCRREELCKEVFLSALPHFGVFFVVSAYIFLGSLAFRQLDTQMAKLPFHDVLLFAFTTITTIGG

SEQ ID NO: 155481 - protein, 52 aa, Heterodera glycines
  Coding regions on vcDNA: vcDNA=SeqID_81904; Strand=-; Position=1-159
ERLAFFVSKNGKLVHPTGNGTVSATQPLSTANDMDRPDGAGHRHQHSPEQYW

SEQ ID NO: 155482 - protein, 125 aa, Heterodera glycines
  Coding regions on vcDNA: vcDNA=SeqID_81905; Strand=+; Position=1-380
  Homolog annotation: Hit_ID=YP_117020.1; Match level="QueryCoverage =97%, HitCoverage=2%, E-value=3e-27, Identity=40%"; Hit description =hypothetical protein nfa8110 [Nocardia farcinica IFM 10152] dbj|BAD55656.1| hypothetical protein [Nocardia
RGWGGGEIEVRGWGGGEIEVKGWGGGEIEVRGWGGGEIEVRGWGGGEIEVRGWGGGEIEVRGWGGGEIEVRGWGGGEIEVKGWGGGEIEVRGWGGGEIEVKGWGGGEIEVRGWGGGEIEVRGWGG

SEQ ID NO: 155483 - protein, 223 aa, Heterodera glycines
  Coding regions on vcDNA: vcDNA=SeqID_81906; Strand=-; Position=1-676
  Homolog annotation: Hit_ID=AAG50685.1; Match level="QueryCoverage =99%, HitCoverage=96%, E-value=1e-53, Identity=48%"; Hit description =hypothetical protein [Arabidopsis thaliana] ref|NP_173948.1| proline- rich extensin-like family protein [Ar
HPPHPLTSISPPPHPLTSISPPPHPLTSISPPPHPLTSISPPPHPLTSISPPPHPLTSISPPPHPLTSISPPPHPLTSISPPPHPLTSISPPPHPLTSISPPPHPLTSISPPPHPLTSISPPPHPLTVNSPPPHPLTSFSPPPQPLSSVSAPPHPLTSVSAPPHPLGSMSPPPHPVTSSSPPPHPLTSVSPPPHPLTASSRPPHPLTAISPPPHALASISPPP

SEQ ID NO: 155484 - protein, 43 aa, Heterodera glycines
  Coding regions on vcDNA: vcDNA=SeqID_81907; Strand=+; Position=1 -66,292-357
MAKNVRKHTNLRFAQNNRQKLRRLIYLNGCIGRVSKFYIEKIA

SEQ ID NO: 155485 - protein, 163 aa, Heterodera glycines
  Coding regions on vcDNA: vcDNA=SeqID_81908; Strand=+; Position=1-492
MPTVREILESLQKRVKRPRIATNEDSVLNVERTDAEQQIEGTSPRNNLDVASSDDEENCEPVQFKRGETIRGALCLWYQGVNSFFFLIFGRAERLQKSTKRRQRYIIKEQNVVRILDEADFESQEGLTNALNLIGLVMQGFVEGLHIRGNEDSEEETDDTDGN

SEQ ID NO: 155486 - protein, 337 aa, Heterodera glycines
  misc_feature (153)..(153): Xaa can be any naturally occurring amino acid
  Coding regions on vcDNA: vcDNA=SeqID_81909; Strand=-; Position=1-1027
  Homolog annotation: Hit_ID=CAD26968.1; Match level="QueryCoverage =99%, HitCoverage=99%, E-value=2e-59, Identity=38%"; Hit description =transposase [Meloidogyne chitwoodi]
AADKENIHTLLHIQFQLGHKVAQAARHINEAVGANVCKERTARHWFQQFREGRTSSKTQGRSGRPLMVDKNVLAQRLRRQPDSSSAELSARCHKTTAWRWLRKSGRRPRRTKWVAHHLTDQQKQRRLDLYLSNIARHRRGHVLNRIVTCDESXYICYDGTTQKIVWRKKNEDPILVPSQLHQKKRMLCIFWFVHGPLYWELLPPGTILESLYINQLRAVVSYRIQRQQGQFDGPMVFRQDNAPPHCSRLTTQYITNTLNWKVLPQPPYSPDLAPSDYHLFLSLKNFLRDKRFTEDAEVEEAVGQYLTSKIGTDFFRRGIRKLPSRWMLRVRGNYFVE

SEQ ID NO: 155487 - protein, 243 aa, Heterodera glycines
  Coding regions on vcDNA: vcDNA=SeqID_81910; Strand=-; Position=1 -453,500-778
MSVHHHSVIAFLRSNHQIFDKRGTNLYLWIPSPHSTNGQPIWDVLAREIWPIFSANIRCLGFSRGDHLDNLRRRTSPTILTDLNQLTSIDSYGLSPAAFGDDFDGPNATISAGQALSKWLHSPRKDGQPKRLRCEDYNEQGNTNWIDSFKEHFLRANAISSVSYQIHFSFRVPSMPMVPFELVNEWTKEKLTLTKENENDLENWIMKRCKIGEAADVQLQKDENWGNNFNNVAIWLFSTDCIG

SEQ ID NO: 155488 - protein, 68 aa, Heterodera glycines
  Coding regions on vcDNA: vcDNA=SeqID_81911; Strand=+; Position=277 -287,354-546
MNRRWICNDVWMDIFPSFDHAQLGLKLALLSPRFNALVDKHFDGKSELTIWRPIEIRRKDKGPEPKLS

SEQ ID NO: 155489 - protein, 25 aa, Heterodera glycines
  Coding regions on vcDNA: vcDNA=SeqID_81912; Strand=+; Position=1 -43,581-615
MIVGKTRKKNSNWHDNIYEIIPKKN

SEQ ID NO: 155490 - protein, 71 aa, Heterodera glycines
  Coding regions on vcDNA: vcDNA=SeqID_81913; Strand=+; Position=1 -175,248-288
MAWTPDGRVLAVSSMEGFNSFITVDSSKFGTTIELQNAVTPFGDEVAMSPLNKAKKNIHKMFYLAKKPDTF

SEQ ID NO: 155491 - protein, 224 aa, Heterodera glycines
  Coding regions on vcDNA: vcDNA=SeqID_81914; Strand=+; Position=1 -145,196-297,806-1119,1166-1279
  Homolog annotation: Hit_ID=NP_508615.1; Match level="QueryCoverage =86%, HitCoverage=49%, E-value=5e-19, Identity=33%"; Hit description =choline/ethanolamine kinase (39.7 kD) (XE193) [Caenorhabditis elegans] gb|AAB52502.1| Choline kinase c pr
MARMHKIPLDPDSANVPMFVAKCEQWLANLPTHFEQVEMQQNFDQNFNGSSLSEQLTELIKALETSESPLVVFAHNDLLLFNILFDEEGTGDVHFIDYEYAGQNYQLFDIANHFCEYAGCAHRIGCTSFMTTYWFSGVDECPDYGMNSASEDERRHFLRRYFVYFGQPIEEECEMDKMLCKIRHFEAAAHFSGLCGPSIRQQNPRFNLITCVTRSPAIVTALGL

SEQ ID NO: 155492 - protein, 43 aa, Heterodera glycines
  Coding regions on vcDNA: vcDNA=SeqID_81915; Strand=+; Position=1-132
SQEGVLQQQGTAQNGNKEEEAKRQAERQEMAKNSILTQAKAEN

SEQ ID NO: 155493 - protein, 187 aa, Heterodera glycines
  Coding regions on vcDNA: vcDNA=SeqID_81916; Strand=+; Position=1 -84,476-640,923-1100,1819-1952
MRCVRRPVTRRDLDDSRKQFKELTEHILSKRGELSAIAQLAQRIEGEISAYLAELSRRNESPAPGLQRHHCVEAAQRAQDDYEFKCLQIKALLGAKQELSQLLRRVANCSMQYEQKVEEVNGWMAELERAISHANVGTSGATADRLDLLSRLNQKAVEGQPRIEAVEATGQQLDEATAQTDAHQRLQ

SEQ ID NO: 155494 - protein, 105 aa, Heterodera glycines
  Coding regions on vcDNA: vcDNA=SeqID_81917; Strand=-; Position=1 -165,242-394
  Homolog annotation: Hit_ID=NP_490770.1; Match level="QueryCoverage =77%, HitCoverage=35%, E-value=3e-09, Identity=39%"; Hit description =phosphoglycerate/bisphosphoglycerate mutase (24.9 kD) (1B166) [Caenorhabditis elegans] gb|AAK21514.2| Hyp
MIHFKFPRKLSFKTEKIDKVFASPFKRTVHTASLLLDGNPNHHNTYINVEPGFGEFYKLCSAKLGFMDTAKLKEYFPLIDLNYLPVYNKRWVNEVQNNTINNINN

SEQ ID NO: 155495 - protein, 64 aa, Heterodera glycines
  Coding regions on vcDNA: vcDNA=SeqID_81918; Strand=-; Position=1-623
FFTKPLSNINFDYIFKKKNSTAPSGTMQKQLMDFANIVPMLRFGGEKFGQKITCNYDILCLVNL

SEQ ID NO: 155496 - protein, 75 aa, Heterodera glycines
  Coding regions on vcDNA: vcDNA=SeqID_81919; Strand=-; Position=1 -84,161-304
MGIYDAVLKNIRYQLKEKEEFCDKCTETDYGISYKYEDFLQSLDLIEHELRNIQITMTDEDTNNVQQYWTIGKLK

SEQ ID NO: 155497 - protein, 253 aa, Heterodera glycines
  Coding regions on vcDNA: vcDNA=SeqID_81920; Strand=-; Position=1 -207,253-408,468-565,678-804,974-1144
  Homolog annotation: Hit_ID=CAE67663.1; Match level="QueryCoverage =83%, HitCoverage=89%, E-value=1e-23, Identity=27%"; Hit description =Hypothetical protein CBG13226 [Caenorhabditis briggsae]
MDVHDEEVEIIGTRSNERQMDRAHRQEQQQEKFYSQQQMSEESEEALFCISKHDVKEISQVVKAMAFRDHCTLNVSNEGIRLAVDDQHNQQGSAYFRSEHFQDFNFRTQTCSIKIPMRPLMEALNMFSGTMTMVQISWNGEGFPLLVILEDEGSMSILPLQILEFDFDNENVTAKAILNSLPIREIMRDLDDSAETVELPTNCDQLELLNVTTDRVQHRYRMSLFKRLKDSIRLCNKLSFRIDKNGILSSQMM

SEQ ID NO: 155498 - protein, 15 aa, Heterodera glycines
  Coding regions on vcDNA: vcDNA=SeqID_81921; Strand=+; Position=1-46
MWSYVSLPMHRQMDC

SEQ ID NO: 155499 - protein, 88 aa, Heterodera glycines
  Coding regions on vcDNA: vcDNA=SeqID_81922; Strand=-; Position=1 -68,131-192,260-426
GVTNSSSISHISIRTFAISTSIMTHGALVLMTPIGASVSRTSRVVLERVQRFTDRMILQFRKFNVILFGRSYSIEMLLNGHSLLHKLV

SEQ ID NO: 155500 - protein, 196 aa, Heterodera glycines
  Coding regions on vcDNA: vcDNA=SeqID_81923; Strand=+; Position=1 -188,233-413,456-548,598-724
MPSRNLSAKKKQQNSLVRDESTSSPSRTPKSVSKASNSNSSQQKLQKKHNSSELSTISSESVEKDLSSSMSTNPHGHPTDKKWTIGEKVLCRYLNSEHIYYEAKVMFLKDLSGGDVGYGIHYPGWSNRHDEVVPQHEALIRFKNYSDEEATKAKEDVKRAQQMLNAKKRKQSELKNRSQAHDESSRSSTPGSADNA

SEQ ID NO: 155501 - protein, 63 aa, Heterodera glycines
  Coding regions on vcDNA: vcDNA=SeqID_81924; Strand=+; Position=1 -97,705-799
MPSTRNTHFASFVGSEGCGKRFHIGFFCKQKSSRPWALNKIHVIFGDFKQQKWPKIPKSVKMK

SEQ ID NO: 155502 - protein, 371 aa, Heterodera glycines
  Coding regions on vcDNA: vcDNA=SeqID_81925; Strand=-; Position=1 -91,974-1454,1508-1643,2251-2658
  Homolog annotation: Hit_ID=NP_495890.1; Match level="QueryCoverage =63%, HitCoverage=15%, E-value=4e-23, Identity=31%"; Hit description =RNA helicase (rha-1) [Caenorhabditis elegans] emb|CAA90409.1| Hypothetical protein T07D4.3 [Caenorhabditi
MSDIKQSLYAVLGKRKLGTPNYNIKPENRGAVNGRGVGSNKKVAETSCALSIVRQLYHMGNWLIPHKCNAINSGLGTLPGATGYQLSKKKASPENVRLPATYYENYVVHSLFQLPEIKVSVDPSLVERIDAHLTQNGIESVDNLIDFASDSKPKTLFMEKKVEEFPFSDNEALPSQNIVWAPPQENWNAWNASNIDNQTLAFRSLEWISNDLLTREKIKKIPARLTASRQALPVFQTTLFTNYFGNCPIIEITQRVHPVQYFFMEDVIQMLKYMPPVPEPERKKKKKRKSNSDSKAAGATAKNGENTEEMNETEDSMELSENLMRCGDGYGPEVNKALRRMDEREIPLDIIEVTSHDKSVVNKLGHLATAQ

SEQ ID NO: 155503 - protein, 125 aa, Heterodera glycines
  Coding regions on vcDNA: vcDNA=SeqID_81926; Strand=-; Position=1 -252,309-433
MVWSTFKPILSFKAPIKNGQPFDCLVCHKQNAKLMKLNRHLNPELSALFRSPNDLMHEFGVKLNQVIAFQQAHQQKLEGHLMNEAQRANEWTKSMQKKMQKLSVDRDKMKADLEKSKEEMNKTEG

SEQ ID NO: 155504 - protein, 61 aa, Heterodera glycines
  Coding regions on vcDNA: vcDNA=SeqID_81927; Strand=+; Position=1 -18,83-250
MQQQQQSDQQPMAQPTLFPIGAMPSMSSSSISSTKQPRDVSGIFSIDSLPFDCQNMGVGGW

SEQ ID NO: 155505 - protein, 199 aa, Heterodera glycines
  Coding regions on vcDNA: vcDNA=SeqID_81928; Strand=+; Position=1 -244,619-974
  Homolog annotation: Hit_ID=AAL77223.1; Match level="QueryCoverage =67%, HitCoverage=7%, E-value=9e-11, Identity=35%"; Hit description =Bck1-like MAP kinase kinase kinase [Podospora anserina]
MHYTETFSRNNSNSSIAELNQQQQQQQQQQRLQLQQQQQQQQRARSAAQQQQQLQLQQQATEFEVGIGLNQRRKSGVYMLGNMNGKEHQDIKPTLNGGVLVGGAGSAAGGSGGGGGAAIAGTACPLPVAAAAPNAAALSASNNATATVAATSTPMSTSVMMNFMNNMLTTAKSTLQGQGVSVFYDQNGLPVEEKNICFL

SEQ ID NO: 155506 - protein, 36 aa, Heterodera glycines
  Coding regions on vcDNA: vcDNA=SeqID_81929; Strand=+; Position=1-110
VSLFDLFFNATEPCSLSALRIGTTDYEIVRDSAWLD

SEQ ID NO: 155507 - protein, 63 aa, Heterodera glycines
  Coding regions on vcDNA: vcDNA=SeqID_81930; Strand=+; Position=1 -47,363-507
MAEDDKVEALFRRAENSTKEQRLEAIRQRNFIDAKFGYQPYTESTARDAWLINVQQALLLIGK

SEQ ID NO: 155508 - protein, 42 aa, Heterodera glycines
  Coding regions on vcDNA: vcDNA=SeqID_81931; Strand=-; Position=1 -62,405-471
MQQLNYRLLNACRTGNVEQGTSVNNERSSTAKTELAPFSRPI

SEQ ID NO: 155509 - protein, 93 aa, Heterodera glycines
  Coding regions on vcDNA: vcDNA=SeqID_81932; Strand=+; Position=1 -168,365-478
MSGFYESRQLHLKLEIGPVDYFFNYSPFDMSNKLMVLLTQILHPMLNVFYSPAAPSVNLATKTTSYRLIMKKRRMSLIAFVVIYRTISEKDLF

SEQ ID NO: 155510 - protein, 58 aa, Heterodera glycines
  Coding regions on vcDNA: vcDNA=SeqID_81933; Strand=+; Position=1-178
DDEEDGDESEEDEEEGGDELEEEEQEGGDESEEDEEEGGDKSEGSDMDIDELSEGMEM

SEQ ID NO: 155511 - protein, 154 aa, Heterodera glycines
  Coding regions on vcDNA: vcDNA=SeqID_81934; Strand=-; Position=1 -278,984-1123,1285-1331
MPLQSVAFYMGELPKLPPAFESANDNGNYNANANVPWNGSEALTKWLFSSRPENDLPPKVLRCRVYNSDIESWIARIEQYKTVMVNFGFKFVLQFLLVRSPIARDEKKWIKWISAAIEGQYVLPRNLITIWENDDNAEKAFLSQFAAQLVSKNE

SEQ ID NO: 155512 - protein, 104 aa, Heterodera glycines
  Coding regions on vcDNA: vcDNA=SeqID_81935; Strand=+; Position=1-522
SPRGPAQLGKCPHGGARRPKGPQKCENSRRNSADAEAAQHQRRHHALELIHEAEPVEQQQLRYKLLRPAADAVKQVVNCRNILNAYRNSHPHSDRMGYCAFSLL

SEQ ID NO: 155513 - protein, 150 aa, Heterodera glycines
  misc_feature (5)..(5): Xaa can be any naturally occurring amino acid
  misc_feature (20)..(20): Xaa can be any naturally occurring amino acid
  Coding regions on vcDNA: vcDNA=SeqID_81936; Strand=-; Position=1 -80,235-375,436-553,871-943
  Homolog annotation: Hit_ID=NP_494786.1; Match level="QueryCoverage =99%, HitCoverage=10%, E-value=2e-29, Identity=47%"; Hit description =twk-8 protein like family member (2E730) [Caenorhabditis elegans]
LYFVXLGEISYSLLQLFYIXFCFFFSFFRVSPLLFSPFSAHCYIALMLIYLGVGLAVTTMCIDLVGIQYIQKIHYFGRKFKGTDILQIHYFGRKFKGTDILQILRRKRMLERRFAMGEGKELIEYVAHAREQTENEKISLRSEQQEMVPT

SEQ ID NO: 155514 - protein, 128 aa, Heterodera glycines
  Coding regions on vcDNA: vcDNA=SeqID_81937; Strand=-; Position=1 -79,478-657,707-834
  Homolog annotation: Hit_ID=AAQ11976.1; Match level="QueryCoverage =68%, HitCoverage=25%, E-value=5e-09, Identity=37%"; Hit description =TDPOZ3 [Mus musculus] ref|NP_997154.1| TD and POZ domain containing 3 [Mus musculus]
MEPFQFFGRSNGESVEERRIFGCSFFAHRAILSSASDVFEAMFHYDEGQIEVPDIEIGAFKVMLTFAYTKRFNGLNANNLLEVLKAADKYNITGLVKECANVSIQKLPNVFVAFEQALLLKMEVKKEF

SEQ ID NO: 155515 - protein, 74 aa, Heterodera glycines
  Coding regions on vcDNA: vcDNA=SeqID_81938; Strand=-; Position=1 -135,348-437
MPGDVSQAGIDWPSLLGGSRLTRLIPLAGSPLPFKRPSEWEEFIGVSGVNGSFLQPIRGTSNIEITEAQPPIFV

SEQ ID NO: 155516 - protein, 187 aa, Heterodera glycines
  Coding regions on vcDNA: vcDNA=SeqID_81939; Strand=+; Position=1 -105,210-667
MPPASLADLASTASSLLYALQSSQSSAVMAANTILQNFVSGVQPSLVSALNNSSPALNVHHHKVEPAEHQSQQQQQQQHQSVFVTTAATVPPPATVNTVSPTVSTAVPPFPMASKSLSPSSSSRSVTPTVSGPTSAGPLHHHHLMSSNRSESCLEQFGQQHSKHFQAMHGGQSQGKGETIGQLESNI

SEQ ID NO: 155517 - protein, 349 aa, Heterodera glycines
  misc_feature (347)..(347): Xaa can be any naturally occurring amino acid
  Coding regions on vcDNA: vcDNA=SeqID_81940; Strand=-; Position=1 -103,189-282,328-362,412-747,802-932,987-1053,1111-1212
  Homolog annotation: Hit_ID=NP_497599.2; Match level="QueryCoverage =98%, HitCoverage=46%, E-value=2e-58, Identity=29%"; Hit description =myotactin, LEThal LET-805 (479.6 kD) (let-805C) [Caenorhabditis elegans] gb|AAK21414.2| Lethal protein 80
SYTIQQLHPHSKYRIGVAARTQLGAGERVTREVQTDESAPTAPPANFRVDNVGEQNAELSWHAPPCVHTNGDITEYEVHTNGDITEYEYEIAAAYEIAAADRLSAQIPRLTDVTRTTRVHLTGLLPSTAYSARVRAFTARGAGPWSPEVRFQTRPVALSVVQYDPKPRVYSTGPQEAQLVWQTDQQGANYFDKFACKWAPVGTQQYEERVFPAYNPCDVQLVEERVFPAYNPCDVQLVQRYQLPPSTTQVQTHCGQITGLSRDPAVAFQVRAKPREQSWQAFQVRAKPREQSWQPWSPPQRPSLIVECERLSSLHSLIVECERLSSLHKTGGSPIKEHFTWSLLPQXLA

SEQ ID NO: 155518 - protein, 74 aa, Heterodera glycines
  Coding regions on vcDNA: vcDNA=SeqID_81941; Strand=+; Position=1-225
MMNRKKIENLQKCRKRKFLDNNDSENETLSADHREQNENNNDRDDDFEDRPYGDGAVSPLLCEDVHRNDAATAA

SEQ ID NO: 155519 - protein, 253 aa, Heterodera glycines
  misc_feature (57)..(57): Xaa can be any naturally occurring amino acid
  Coding regions on vcDNA: vcDNA=SeqID_81942; Strand=-; Position=1 -202,443-550,612-744,866-1158
  Homolog annotation: Hit_ID=NP_497599.2; Match level="QueryCoverage =90%, HitCoverage=23%, E-value=6e-39, Identity=31%"; Hit description =myotactin, LEThal LET-805 (479.6 kD) (let-805C) [Caenorhabditis elegans] gb|AAK21414.2| Lethal protein 80
RKCTLSSFSPSLPSPPHLHSLPAAVRFRRSIICDPRTDFWCRGHFQHQQIRTKWSRXTLCVACRDVCSDGSLQVKWRSEGSGRGVFGYRLLYRAPGAGWNPFGQIVPYVGEGQIVPYVGEGEENSVLLSGLSVGVPYEVKIQALDRNSYVLYTSPEVRSSPTCLVPLLPPSNLAIDTPDPGHVRVTWMPPPQSAWRCANAEVELQASTEVRRSTTVLHSAGGRTKWAFYRSARASLTRISHVLESETDHPWAI

SEQ ID NO: 155520 - protein, 449 aa, Heterodera glycines
  Coding regions on vcDNA: vcDNA=SeqID_81943; Strand=-; Position=1 -101,144-319,407-518,841-1212,1402-1619,1664-2033
  Homolog annotation: Hit_ID=NP_497599.2; Match level="QueryCoverage =98%, HitCoverage=10%, E-value=4e-52, Identity=28%"; Hit description =myotactin, LEThal LET-805 (479.6 kD) (let-805C) [Caenorhabditis elegans] gb|AAK21414.2| Lethal protein 80
PEESGEMRLEYAGNNEIRIDWPHLEDPLLQHYEVVLSEMVTDEQQKKTDEAAKGAGEGERMERSRVGPKQHTAYFAELRPDTQYRVGVVAYADHEPKRIYHMLIRTNTEPMQKLSQKPVIVEMREGRHEVHWKSEPTVPATHFVVEFRLGNDSKWRRAAAEIKPPKENGHQSLAARLTELEDNALSVRVVFVDERSRAVAVTGEQLIAHRADEKSCERMAPAVPKADEVGTESVRFSWEQSKCEGDIQGYEHAHGHSPWSVAIGVTTAEGKDEDELLKLEDQKTDAVQPKASAENLYRLRIVLAPPHSFLVWSPPPEHRENIARFKVSYKPTASASAPWTSLVQSPAELQCPPGLSTYAETDYCLNLQGLDFGRQYEAEVTYELKEPKGRWSQRGSPLFFILVKTSSEEQRIGITSPDDQLPGISVSEVRVEPTEGAKTIVRWKVNGQS

SEQ ID NO: 155521 - protein, 90 aa, Heterodera glycines
  Coding regions on vcDNA: vcDNA=SeqID_81944; Strand=-; Position=1-273
MAIEHSFVGGLLFAPFHCFVRPFSTTRAFGTITGIGTIATIGRFSTKCRANANKICAKFHGTKQKQRRRPMPAEKLMKAIRDREREKDHF

SEQ ID NO: 155522 - protein, 102 aa, Heterodera glycines
  Coding regions on vcDNA: vcDNA=SeqID_81945; Strand=-; Position=1-309
MAQVRVAYQAVVKRCQFGCRLDCNRHFYIGTDIGGQQQRAVEMEADEEPLNYDRAEEEDEEAINADANNVPKPTENENGANFASMRQKRADQNEDWHQDSRI

SEQ ID NO: 155523 - protein, 178 aa, Heterodera glycines
  Coding regions on vcDNA: vcDNA=SeqID_81946; Strand=+; Position=1 -121,405-491,1104-1248,1293-1359,1412-1528
  Homolog annotation: Hit_ID=NP_510568.1; Match level="QueryCoverage =88%, HitCoverage=21%, E-value=4e-18, Identity=29%"; Hit description =aspartyl beta-hydroxylase (99.5 kD) (XQ205) [Caenorhabditis elegans] emb|CAB01887.1| Hypothetical protein
VHQRSVHNLLGLSARPWWTVEQSECAKQLKTMERQWTAIREEALKVWSKRKSLFVEEALPIGSSGMMGGDKIVRFVGRHANLALLWAHQLCAGGTAWPGGTFGCTNSGGQRDKVHPQKGWRPGRFLVFDTSFEREISFEGAPSNAIRLALTMELWHPQMPMELRGKIRAADGSDEERK

SEQ ID NO: 155524 - protein, 32 aa, Heterodera glycines
  Coding regions on vcDNA: vcDNA=SeqID_81947; Strand=-; Position=1 -42,107-163
MYKSDITRSFQRNRLDIPRAPGLGLLLGDDVF

SEQ ID NO: 155525 - protein, 245 aa, Heterodera glycines
  Coding regions on vcDNA: vcDNA=SeqID_81948; Strand=-; Position=1 -219,356-451,653-712,834-914,975-1082,1159-1332
MKQMADEKAFLDTVRNSLVLLIVGIITILLAMNAKNVWHFFAPAIVVKSTKKKRKNSPTASIGTKSKMNSVIKCSNEEMEQKETVLHQLPLPVKKQIIEKAEDFEAQIDEIEHNGVESAQPKIIKGEDNADDSIQILSVKQPKRKMRMTKTRFQDDEETVDQKEVPPHNFSLVLSTQKESEQQKRAESPEVDLDTVVKLMESGLSQADIARQLNVHNIYYIVTKCRKQGLITGSRPITRKKAGKT

SEQ ID NO: 155526 - protein, 44 aa, Heterodera glycines
  Coding regions on vcDNA: vcDNA=SeqID_81949; Strand=+; Position=1 -83,362-413
MWPEMLSLINILSTFSALGKNAILFRNRPFQIQQNKEKIQICEL

SEQ ID NO: 155527 - protein, 25 aa, Heterodera glycines
  Coding regions on vcDNA: vcDNA=SeqID_81950; Strand=-; Position=1 -3,135-209
MKLGQNFIFLSNKLCFCQINSECLD

SEQ ID NO: 155528 - protein, 393 aa, Heterodera glycines
  Coding regions on vcDNA: vcDNA=SeqID_81951; Strand=+; Position=1 -805,1126-1314,1405-1592
MVLIIILIFFATFNGIFGVGEGGEENDLFSDLWKNYFNAKNVQKANVGRNGGQKVTNRVKMEERDGGVEMGAVGIRMPPKLAQMVIKSEPTAAAAVFDQLLKNVKHEPKEEEFEQLDIGKMGVVGIRMPPKLAHSVIKDEPPFDQQREHQQKQANKEPNHLDYGIERMEETENSLESNGKISQKSAKKLAKKKRQWQKEVDRTPQQFKKEENSKSDIKVLIEQFDQMKKKFRKKIHFVDRKINVNLESKIAKRLGTCRTKLYKMKRENGLLTRNFSNEQKKEIIHRFEIIKEEFMRKFKIKTNAKISDKIARKVGVNLETINRWKRSFGSTAKPIYTSAEQLEFIRKYDALKIQNPLISDQNTAQMIGTNAISIKRWKKKFGIAYPCKRRRIT

SEQ ID NO: 155529 - protein, 33 aa, Heterodera glycines; identical to SEQ ID NO: 150970
  Coding regions on vcDNA: vcDNA=SeqID_81952; Strand=+; Position=1-249

SEQ ID NO: 155530 - protein, 181 aa, Heterodera glycines
  Coding regions on vcDNA: vcDNA=SeqID_81953; Strand=+; Position=1-546
MRQHTSFSRLPAADSISQQNQHQQQQDINNNNAVVDDNDVEAEDEAAAAEMPGAPAATAQQRWEDSTGGGDDGMEEQRRDGNGGDEEEVAGDEQQQLQQRRQQMFKRKLLLAQDNDGTAAASGANDSGETSPRALARSHVELFTRMRSICGRMNRLKRKRTPRPGSPESLVAFLCDSAKFQ

SEQ ID NO: 155531 - protein, 146 aa, Heterodera glycines
  Coding regions on vcDNA: vcDNA=SeqID_81954; Strand=+; Position=1 -136,223-290,399-592,747-789
  Homolog annotation: Hit_ID=NP_499254.1; Match level="QueryCoverage =91%, HitCoverage=79%, E-value=1e-39, Identity=41%"; Hit description =transmembrane cell adhesion receptor precursor; matrix receptor, muscle attachment protein, MUscle Attach
MSNGLIMSHLSAECTDLAQGYTCKCRSGFRDVSPSKEKPGRVCRAMVNECQFAHLNDCHQNAQCLDLEDGYQCKCENGFKDVRPERPGRLCQQMVNECARADTNSCDKNAKCVDEEASSEERHTKLAFVIKKFQPWKRPNTVKPWL

SEQ ID NO: 155532 - protein, 115 aa, Heterodera glycines
  Coding regions on vcDNA: vcDNA=SeqID_81955; Strand=+; Position=1 -249,467-564
  Homolog annotation: Hit_ID=NP_499254.1; Match level="QueryCoverage =100%, HitCoverage=55%, E-value=6e-42, Identity=35%"; Hit description= transmembrane cell adhesion receptor precursor; matrix receptor, muscle attachment protein, MUscle Attac
SPDGLQGRICVRNSFCRDPKLNNCSRKAVCYEEGQGYRCECARGYVDKSPDGTPKGRVCELPPAPAQPQRHPCQDGSHDCHTKASCRAVGATGFVCECLPGYEDKSPDPKNKGGR

SEQ ID NO: 155533 - protein, 422 aa, Heterodera glycines
  Coding regions on vcDNA: vcDNA=SeqID_81956; Strand=-; Position=1-1268
  Homolog annotation: Hit_ID=XP_319741.1; Match level="QueryCoverage =88%, HitCoverage=85%, E-value=4e-44, Identity=29%"; Hit description =ENSANGP00000006515 [Anopheles gambiae]
FLQLDHGRATASTIAKCTPAKVTNAAPQNAAPANLSNANLASSIDARLSTFHYNPEVGTTFECWFKRYGKLIEDDGSTLPEASKVRLLLGKLGEEEYSKYRDTISPTQPDQVNWNDTISQLKQLFAETRSLFVRRFECFKIRQQQGQDISSLIAQINASCENADLSLTKEQLKCIILVIALNDEHHDLRQKALKMLEDSQKNGTNISLKKIEEELRAIQLVKESALSLVNPPIATNAIRTRPRQWADPAQRQSGGSNQKQTPNANSSGKPTRGQPTHPCGSCGKSDHWRSDCTFRDATCLKCNKKGHISTICRQKKAKAAPNNHRAFHTVKVDANCLHVGTTQGRWWKLCILINGRQTSMNGDTGAQATIISLQTWRELGEPELTPSDIDAKNCNDQPFALLGKFQCTVQIADKPPQTLIAY

SEQ ID NO: 155534 - protein, 188 aa, Heterodera glycines
  Coding regions on vcDNA: vcDNA=SeqID_81957; Strand=+; Position=1 -127,193-632
  Homolog annotation: Hit_ID=XP_309989.1; Match level="QueryCoverage =67%, HitCoverage=45%, E-value=8e-14, Identity=30%"; Hit description =ENSANGP00000015194 [Anopheles gambiae] ref|XP_319667.1| ENSANGP00000022407 [Anopheles gambiae]
EYSKYRDTISPTQPDQVNWNDTISQLKQLFAETRSLFVRRFECFKIRQQQGQDISSLIAQINASCENADLSLTKEQLKCIILVIALNDEHHDLRQKALKMLEDSQKNGTNISLKKIEEELRAIQLVKESALSLVNPPIATNAIRTRCQFKRKANAWSTDASMRIMWQIRPLALRLHIQGRHLPQVQQK

SEQ ID NO: 155535 - protein, 143 aa, Heterodera glycines
  Coding regions on vcDNA: vcDNA=SeqID_81958; Strand=-; Position=1 -121,334-644
MRTEIFSQIFFICILSLYSIDTAPPKNESTEKEASSSGSAGTYTIRDYAMDIKKHLAKVEIEKLIQEAKEWAQDLGLVVIHRVATPTPPRPRPPTFLAIFGENPDPEPRRFIPRQPRPLTPIGVGVKYTPLRMAFSWEKMQKS

SEQ ID NO: 155536 - protein, 261 aa, Heterodera glycines
  Coding regions on vcDNA: vcDNA=SeqID_81959; Strand=-; Position=1 -184,907-991,1102-1307,1649-1830,2147-2272
  Homolog annotation: Hit_ID=NP_493982.1; Match level="QueryCoverage =75%, HitCoverage=38%, E-value=1e-57, Identity=55%"; Hit description =solute carrier family 2 member 3 (2B799) [Caenorhabditis elegans] gb|AAK31540.1| Hypothetical protein H17
MAETNLDKVVSTRDQEQREKLISKAKEGLVETTTEPDGSKRAPPPVKARVGKQNLDEFIRGRDIIKEWISESYTNMTGVSTTVEEMDSTWALAVGIIAVGGMFGGIMVGTVADKLGRRKSLLYNNILAIIAAALMTLAKYVNVYYLITIGRFIIGLNTGFNSGLSPMYLMEISPNNLRGSIGSLHQLFITIAILASQIIGLPQIFGSANLWPLIFAFTLVPVLFQLCALPFCPESPKYSLIVQGRKDQAEKDLKWLRGGND

SEQ ID NO: 155537 - protein, 92 aa, Heterodera glycines
  Coding regions on vcDNA: vcDNA=SeqID_81960; Strand=+; Position=1 -102,179-355
VEIAIRSLDTAFFDSGSFNSKIAVIVPSKELIWSGSDFRASINSLVQLRPLDKRDSPTPLFSAHVPLKLERVRVELVLGPSVNQDGHLRTGG

SEQ ID NO: 155538 - protein, 82 aa, Heterodera glycines
  Coding regions on vcDNA: vcDNA=SeqID_81961; Strand=+; Position=1-246
MWFKYAEDYGLNHLLDWRLWSMHANCADVRPERLDYDSSVELKEWSEVSFDQLLSFDRLQTVGVDRTAYLQAALRLPQSVAK

SEQ ID NO: 155539 - protein, 157 aa, Heterodera glycines
  Coding regions on vcDNA: vcDNA=SeqID_81962; Strand=-; Position=1 -215,1022-1280
YKTFILVNCASEQIENGEYFCRFVSGRIRLQIVFDIDQKGNGKTETQLYNGIYQEKCTLYESSFSQNALSFRKRQCIARELRGEHLPIDLAILSELTEEAEGLSVVGRGFVEERFEMGGRIGAGKLKQYIAKKGRSNGLNKADRICRERERDTRGRE

SEQ ID NO: 155540 - protein, 82 aa, Heterodera glycines
  Coding regions on vcDNA: vcDNA=SeqID_81963; Strand=+; Position=1-249
SIASALLRDVLLQFAGPNPSAHFESLLYKTPSNNTESLRLFRQLTQNGQVDRQVFTPQFSRYALPFPGKRIFSISDQHVSLV

SEQ ID NO: 155541 - protein, 487 aa, Heterodera glycines
  Coding regions on vcDNA: vcDNA=SeqID_81964; Strand=-; Position=1 -196,277-543,596-1054,1797-2338
  Homolog annotation: Hit_ID=NP_703411.1; Match level="QueryCoverage =51%, HitCoverage=9%, E-value=2e-14, Identity=25%"; Hit description =hypothetical protein [Plasmodium falciparum 3D7] emb|CAD51431.1| hypothetical protein [Plasmodium falcipar
MRLAERFGADVFVWMNWLEMDRHNQCTKVQKLMDDLHLYFRLLYDAYCIAAEMEDAMRIFSFALPAIKTFVDESRNKMLNLTEINKEWGKLSRLIKKVADNAQNVVAQTEEERKKYEEPIPIIQKLHFAEFMELLNRKEEEDGSEKEELERMLEDELNKNNQQKMSDFLTENDLKRFYEAIENKKTILNGNEKGQNENNENKKAKKEEKKRRKKEKKKTKKEEENNKLNEKMEKKQINGENEGENGQFGQKEKKEKQNSDEKNCKESGKSLGGKAVEKRRDITEYNARRKLIKHNLAEELAKIHSINDFYNDAFLYAKYEEFVAKPSIEMQRIIDVGAFLNEIGHRLKAMGELERFNHTGNPQKSMGQLRNEWDTFLEQFGKLEVPKLEKMEKKVSKFMQLFLNNLQNTKQFEPDEITKQIKVQIHLKNLSMALLKNNEFNEKWKNYENKTKKEKLFYLLGERFGAERFEKVKFEWKRMAEQTELGK

SEQ ID NO: 155542 - protein, 207 aa, Heterodera glycines
  Coding regions on vcDNA: vcDNA=SeqID_81965; Strand=-; Position=1 -97,169-314,516-896
MRVVHVLFTHFHDFLKHVALNGINFTKIIDYDGIGQKELLEFYIKHLIESNNFDEASLEDEDKIAVLIKLLSLCSSRKENKLIEIFAGKSAPIRMLCPLMHFIDFLEKQLTNEHQFWQFPRKCFQMEISEINRKQMKVLGAEHFNYLAAFIENAKEKDEFMQILREKHGALYRMRLLVGGKNAIQRMWEMPKIRNKLLNRNCKQTEK

SEQ ID NO: 155543 - protein, 506 aa, Heterodera glycines
  Coding regions on vcDNA: vcDNA=SeqID_81966; Strand=-; Position=1 -251,328-524,607-1239,1325-1451,1502-1814
MMQNDEMERFIKLYKKIDINEIDCHKIAENVFQNVPLTDEKNATNIFLNDLRQLHFNAILFLLDRKNEVGKAPEIGQVGQYKLWEFSKFFNDTKIENETNFSYQFRILRIKEDKQSVVLLKKLKWKIKELIGPIYLSILEVLRPIELQIDTIFDEEYATEYAMILSTDRQIAKQAEFRLSIRIYFSKIWNKILDAKISKNEMEKCRIVHFWDGGELVQMTQTFIHYEEKETFEKIFEFSAKIGEKNEKEKGIENKSGKLKKKASKKGKSRICDDILDKVRSNLLDTHSELMANLSGETNAFSKLLKNSLETEKGALAKLCDFYSAKNLIGNDNKKCSPNSVEVMAKMEQKYPKLTQMLRNKLTDEQIKKLQNRNYLKYLNEKSEQIEWTRAKFMMDILAHYQIFKNQLNDPNNLSFQTELIDQNMGTMELSMDSISVINSVKEIEQLQGNLITQLKNSSNLFPELKHSLAKGHVEILKKLCAEKEFQNQLRGKSKFRKESSLSSNA

SEQ ID NO: 155544 - protein, 132 aa, Heterodera glycines
  Coding regions on vcDNA: vcDNA=SeqID_81967; Strand=-; Position=1 -166,270-346,491-646
  Homolog annotation: Hit_ID=NP_509110.1; Match level="QueryCoverage =91%, HitCoverage=97%, E-value=6e-18, Identity=36%"; Hit description =esophageal gland cell secretory protein 11 like precursor family member (15.3 kD) (XH214) [Caenorhabditis
MFANKLFLLLIAAFSLCVFGIDFGGTKQNGAAKGKLLCGGKPYKGAKVKLWDKDTLDPDDLMGETETDEEGKFEVNGSETEECLRRIDIEIGDEFISRLTDSDKAEKMFDAGILNLSGHFPGETRECLQSKK

SEQ ID NO: 155545 - protein, 62 aa, Heterodera glycines
  Coding regions on vcDNA: vcDNA=SeqID_81968; Strand=-; Position=1 -112,236-312
MQGEKLSNFSNSSVTYKAIQAQAIKTQDSSLKSPESEVFLNYSKTDTHQSLEFSYIFPLFKS

SEQ ID NO: 155546 - protein, 131 aa, Heterodera glycines
  Coding regions on vcDNA: vcDNA=SeqID_81969; Strand=-; Position=1-396
MPAVKPKFQYDELLEPVLDEIEHLIRISMFYFDENFKRTESYKLKGFSQLETKPILLNEKQLKYFQNNFQKNSEVKIRKLFEVKMSLMFKNTKENAEKEKVEMEEETDEQKWKKYRNKFLGFLNSPFLPIV

SEQ ID NO: 155547 - protein, 50 aa, Heterodera glycines
  Coding regions on vcDNA: vcDNA=SeqID_81970; Strand=-; Position=1-154
LQICWLKLHMRYISKFFDSVRRFDKDGFRFAISRSTFGNWSRIFSAITCN

SEQ ID NO: 155548 - protein, 123 aa, Heterodera glycines
  Coding regions on vcDNA: vcDNA=SeqID_81971; Strand=-; Position=1-372
ERVEQLCWFEEEAFLAFVKGRPNFDKFYEKTDESIKKKMVQYRSELKNLTFDQLREHLAQKFAARLSAVHLLWQNWNCANVVEEVQGEDRAKCQTFRRHLDIVYEYLFRVYVEGNGREGSAEK

SEQ ID NO: 155549 - protein, 166 aa, Heterodera glycines
  Coding regions on vcDNA: vcDNA=SeqID_81972; Strand=-; Position=1 -161,286-423,578-651,832-957
  Homolog annotation: Hit_ID=CAE61945.1; Match level="QueryCoverage =94%, HitCoverage=94%, E-value=1e-31, Identity=44%"; Hit description =Hypothetical protein CBG05943 [Caenorhabditis briggsae]
LIVSKNKTKSHKIQLHIHKLFSVLTQNYFQRHLLKKNETLRLTYDMLRRPHHIGNHKAWMAWNTQNLKEFEQQPGLTIAQDEIIRRFCRALFFEFLPEIGVQLVIKRRGNCAFVTGFLCWNDRTPFLQLYWLWGFTEEILSNLLKHPLKLELQFVRSLDHLIVANI

SEQ ID NO: 155550 - protein, 112 aa, Heterodera glycines
  Coding regions on vcDNA: vcDNA=SeqID_81973; Strand=-; Position=1 -42,688-837,1000-1146
  Homolog annotation: Hit_ID=EAL26508.1; Match level="QueryCoverage =87%, HitCoverage=70%, E-value=8e-18, Identity=48%"; Hit description =GA18077-PA [Drosophila pseudoobscura]
MEAQKTGNGEINPLFANLVLHETLERIHVDEFYGDIPRGIFLIRGENVVLAGEVDDTKPNPFKKVSMEEILRLQAEKVEQRQKQQRTRQELMHGSGQQQAKSHADALMDEFC

SEQ ID NO: 155551 - protein, 90 aa, Heterodera glycines
  Coding regions on vcDNA: vcDNA=SeqID_81974; Strand=-; Position=1 -108,881-1045
MASRGRGVIVNVASAAARCHWYYYGVYSAAKAKFLGAELLFQCIPSPLFNWLMRNESHKRRALALAEQKSEAQNGRREKGEEEEEEEKDG

SEQ ID NO: 155552 - protein, 246 aa, Heterodera glycines
  Coding regions on vcDNA: vcDNA=SeqID_81975; Strand=+; Position=1 -144,452-533,630-700,875-976,1032-1225,1286-1433
MNNENVNNAMVNDTRVNVNDNCQNPNDTRVHVNDTRSVFASINPLKRRVDEVAKYGSLDEQLDVTHVIQHTPFRNRHQSPLLLDDLTKQHASSLLFGSQVAISLVKSAAQTSASSADAMTMITETPKSSHYSTATRTVPIDFEDERVSESPQLPPPPTVPIPMGHLNDSEFEQWHETEMDEAMEGYCDAVKQYTDKYGRLAAEKKRLLSQIDAVKERIFKFRSDFSEAYQQNEEKRRALCADLTNI

SEQ ID NO: 155553 - protein, 205 aa, Heterodera glycines
  Coding regions on vcDNA: vcDNA=SeqID_81976; Strand=-; Position=1 -72,175-321,466-609,652-705,885-998,1469-1513
  Homolog annotation: Hit_ID=NP_496386.1; Match level="QueryCoverage =97%, HitCoverage=97%, E-value=3e-61, Identity=59%"; Hit description =ump-cmp kinase (2L419) [Caenorhabditis elegans] emb|CAA93264.1| Hypothetical protein F40F8.1 [Caenorhabdi
MFKVIFVLGPPGSGKGTQCQRIEKNFGFVHNFGFVHLSAGDLLREERQREGSTFGELIDRHIREGSIVPVEITCKLLENAMVARSDTAAGFLVDGFPRNKDNFDGWQREMGTNAKVLFVLSIQAPIEICVQRCLICVQRCLNRGQGRTDDNEESIRKRIVTYNQQTVPIIDHYASLNLVKTVDSTKGPDLVFAEIRAVFEQSGIG

SEQ ID NO: 155554 - protein, 149 aa, Heterodera glycines
  Coding regions on vcDNA: vcDNA=SeqID_81977; Strand=+; Position=1 -108,164-357,415-562
ENYGLDELSADARSMKISAGAMTILTETPKSSHHSTATRTVPIDFEDERVSESPQLPPPPTVQIPMGHLNDSEFEQWHETEMDEAMEGYCDAVKQYTDKDGRLAAEKKRLLSRIDAVKERIFKFRSDFSEAYHQNEEKRRALCADLTNI

SEQ ID NO: 155555 - protein, 217 aa, Heterodera glycines
  Coding regions on vcDNA: vcDNA=SeqID_81978; Strand=+; Position=1 -418,649-884
MHVDFDPFKVEWSALTQISPEVVVQYGGYNVFRGVPYPRGSGIGSVFRSLLRYLIPIGKEIGTAIGRQGLESGNRVLSNVLEGRDLKESLVSEGKTGLKNLLEKAANNINAQKGQGFDFKRYTKRNDAREGGAIGKAKKVPPTNVSVVRSYFREVLPLVTITQESPYLFRLYSDNLWTDLSRIYLFLDLSIEKPDVDGNWVSIAATDAQVGTIQGIG

SEQ ID NO: 155556 - protein, 98 aa, Heterodera glycines
  Coding regions on vcDNA: vcDNA=SeqID_81979; Strand=+; Position=1 -184,329-441
MQTLKANDTTKYRVRVHDVKLYAKMIDVQSSLNLSIYKTLEKQPATYAVRKTEIKSCFISEVYAGGMIYPIVPYKLDFAKDIFVRPFVDMYEGGTWHG

SEQ ID NO: 155557 - protein, 112 aa, Heterodera glycines
  misc_feature (65)..(65): Xaa can be any naturally occurring amino acid
  Coding regions on vcDNA: vcDNA=SeqID_81980; Strand=-; Position=1 -94,306-394,681-914
  Homolog annotation: Hit_ID=Q8WQ53; Match level="QueryCoverage=68%, HitCoverage=33%, E-value=6e-13, Identity=50%"; Hit description=Ras -related protein Rab-21 emb|CAC85935.1| Ras-realted small GTPase [Geodia cydonium]
MLADKVVIFIIGNKIDLARHRTVPKEEAKEYSQSIGANFCECSAKTNEGVSELFSKLAIEMLNKXPKRRKTPMESARLLSNGITGRGGALELRTKMKHMRNGNDAENVADDA

SEQ ID NO: 155558 - protein, 445 aa, Heterodera glycines
  misc_feature (17)..(17): Xaa can be any naturally occurring amino acid
  Coding regions on vcDNA: vcDNA=SeqID_81981; Strand=+; Position=1 -177,327-425,465-530,576-636,684-823,931-1060,1112-1152,1214 -1357,1503-1614,1655-1760
  Homolog annotation: Hit_ID=CAA87378.1; Match level="QueryCoverage =87%, HitCoverage=82%, E-value=3e-66, Identity=38%"; Hit description =Hypothetical protein E02H1.3 [Caenorhabditis elegans] pir||T20413 hypothetical protein E02H1.3 - Caenorhab
KYETRNQQNLEILFIFXFFFRALLKTKLVESREGCEWTRCGRTDRGVSAFRQVAAVTVRSTDVSSFDSFWSEGNAERKDRITSTVELSYVKMLNGVLPHSVRVLAFAPVRRGFSYVKMLNGVLPHSVRVLAFAPVRRGFSARFNCVARFNCVQREYTYIFPRTAIAIKWLNDACARIKWLNDACARLCGTHDFRNFCHIDRNEKRLATSYVRTIKEARVDQLGSAELSDSFQLLRLTVKANGFLWHQIRCIVSLLWEIACGNEEPELIDDLFDLIDDLFDIEKFPARPQYKMANELPLCLPQYKMANELPLCLFDCTFDEPIDWKFDFIALGSVVNTLQKKWAEHQINSFIRAANIKEMLDGLNFHMANSPNGLDEFVRTEPTPKKFIPIRKRSLCEGLEERRRKAQKKKKKFIPIRKRSLCEGLEERRRKAQKKKKNEERMEKG

SEQ ID NO: 155559 - protein, 102 aa, Heterodera glycines
  Coding regions on vcDNA: vcDNA=SeqID_81982; Strand=-; Position=1 -149,301-455
  Homolog annotation: Hit_ID=CAE60241.1; Match level="QueryCoverage =99%, HitCoverage=21%, E-value=7e-25, Identity=52%"; Hit description =Hypothetical protein CBG03814 [Caenorhabditis briggsae]
QLDFVLVRIVQSAQLRTHKYFRVAVPQAITGQALVQHIQEVLSVEDTNEALHFATILLHFGYLFPVIDVHSQAVREDNTLYRIQLPYFWPSHAHQADNVEYG

SEQ ID NO: 155560 - protein, 52 aa, Heterodera glycines
  Coding regions on vcDNA: vcDNA=SeqID_81983; Strand=+; Position=1 -84,130-204
  Homolog annotation: Hit_ID=NP_491359.1; Match level="QueryCoverage =100%, HitCoverage=26%, E-value=2e-15, Identity=69%"; Hit description= NADH dehydrogenase (ubiquinone) Fe-S protein 4 (NADH-coenzyme Q reductase), LiPid Depleted LPD-5 (lpd-5)
MALSFASREDAINFCEKNRWSYIVEEPPSREIKPKAYGSNFSWNKRTRVSTK

SEQ ID NO: 155561 - protein, 44 aa, Heterodera glycines
  Coding regions on vcDNA: vcDNA=SeqID_81984; Strand=+; Position=1-132
MSAINVLEAMNLLKPEQVTVQNLLIENGQLIETVAEYQRMGKIV

SEQ ID NO: 155562 - protein, 470 aa, Heterodera glycines
  Coding regions on vcDNA: vcDNA=SeqID_81985; Strand=+; Position=1 -202,257-376,429-532,573-966,1874-1989,2187-2493,2719-2889
FALGFGQSESYATEFYYDEKLEIALASEYKQKFFCQNDNESLPTAEVIDQILLLTFSLALRLQFNAIFAIYPMFDIFHSNEIKHWQVRTLLTAYKQLSNAKGITEHGVFPFKLSQLSDDKKYAYWLLTFIEEEQPTNKQYIENFNFIIKISEFSLSPFDVYKVLEAILSNVNEKENTVHKNGSAEVPKLYEFVREYFNAKLNSEKASNSPKSPSLSIDCVLVHLGYQLQMNAYQKFRELTEKHQRNTNGCAKWSKDILEIVDLYEFGEGLGYRKWQFIHVWFRIAPVELELFNEPIQNYANAIEIDTHQCRALTQFANDALDKMVKENIDKNEHFDRLQIVLQILSEMKDTENYEKLKKLLENFEQKIANEKNKSLLKEPTKFLRQLIGEYSCKGYCTQINGRGKRDFGSGLMISVNKIMPIFGQILIEALKKSYGQTVEYNVKEQKLSFPSELGEHLLGRLDEMIKMFE

SEQ ID NO: 155563 - protein, 58 aa, Heterodera glycines
  Coding regions on vcDNA: vcDNA=SeqID_81986; Strand=-; Position=1 -66,115-225
MGELEPYLLIRHICWGESPPGENCALLSRMDLQPTPAAKMLPPIILGMDSQLKTIVMC

SEQ ID NO: 155564 - protein, 108 aa, Heterodera glycines
  Coding regions on vcDNA: vcDNA=SeqID_81987; Strand=-; Position=1 -65,788-838,923-988,1037-1180
SRCGQKKRIIRLWPSGPRNTENVSSSHRRFGHLSEKIEDSQYDFHALKERKRLGRMDEEKLFAASEEGREMETKVSEMKSIRIGQEYEMQLAKWLDACDMRPLRKPIT

SEQ ID NO: 155565 - protein, 113 aa, Heterodera glycines
  Coding regions on vcDNA: vcDNA=SeqID_81988; Strand=-; Position=1 -121,648-812,1387-1442
MEGGTEDDKSEKEKVSNCSHREEKVKEYGPIVCAALVCVLEKEKHVFYQQTCKNENSNTQRDCQGYGQNGAIKTFGKGDWKCKCAKSKVNQGKDIDLSALGLPCKLLVQNLLN

SEQ ID NO: 155566 - protein, 58 aa, Heterodera glycines
  Coding regions on vcDNA: vcDNA=SeqID_81989; Strand=-; Position=1 -112,1274-1338
MIHLLTLTLLLFPTLALSKLNTVNFKSDDIVLLDEIRASWPIGRWKKDAKQFKVWTNI

SEQ ID NO: 155567 - protein, 127 aa, Heterodera glycines
  Coding regions on vcDNA: vcDNA=SeqID_81990; Strand=+; Position=1-382
  Homolog annotation: Hit_ID=XP_320121.1; Match level="QueryCoverage =75%, HitCoverage=52%, E-value=2e-11, Identity=35%"; Hit description =ENSANGP00000018066 [Anopheles gambiae]
MDAQQLQQILDAALKKSAEVFAAALNTQNQNPNAGSSTTASLAASINARLEKFNYNPEVGQTYDAWLNRYGKIVQQDGASLPEQSKVQLLVGKLDEEEYKRYVDSIAPKATEQFNWLETVANLKKIF

SEQ ID NO: 155568 - protein, 661 aa, Heterodera glycines
  Coding regions on vcDNA: vcDNA=SeqID_81991; Strand=+; Position=1 -887,938-1604,1665-2094
  Homolog annotation: Hit_ID=XP_318550.1; Match level="QueryCoverage =98%, HitCoverage=71%, E-value=1e-154, Identity=41%"; Hit description= ENSANGP00000020240 [Anopheles gambiae]
MEAIKPIEFSHWAAPILAVKKRNAKTRACIDFSTGLNDALELHRHPLPRPEDIYNAIAGSKHFSRLDLRDAYLQLELSEESKKLCTINTHRGLFQCQRLPFGIKSAPAIFQSLMDKIITPINGAFVYLDDVIIANTTLDQHVKTITKVFDKIKQFGFRIQQEKCSFLQKETISLGHIISENGFRPDPSRAEAIRKMPAPHDKSTLRSFLGALTYYGKFIKQMREIRSPLDELLKKDVPWNWETDQQKSFEKAKEIMLSDLLLTHFDPKLPSLWPLMLQKEELVQQSAINFPTKVNVQIEKEALGLVFAVQKFHRMLYGRKFILLTDHKPLLAIFGSTKGIPIYSASRLQRWALILSNYEFDIKYVNTKAFGNADVLSRLIANYPRPSEDILIANICNDTDCCVNFVFEAKIEQLPITAKIIADETAKDEILQQISAFTKQGWPQKFDNIKLSPFLPKKAQISEIEGCLAYGERIIIPSTLRNNILKSLHFAHPGIVRMKAIARNHVYWPGIDSEIERLPWKAANGVFERIHIDFAGPCADGQTYLVLVDAYSKWPEVWQMERTSSQLTISMLKSFVHRLGIPKEIVSDNGSQFRSAEFAQFCKEFDIKHTFTPPFHPMSNGAAERFVDIFKRSMKKCRQEGKDWLQKVLLAYRTTPNTALN

SEQ ID NO: 155569 - protein, 46 aa, Heterodera glycines; identical to SEQ ID NO: 137992
  Coding regions on vcDNA: vcDNA=SeqID_81992; Strand=+; Position=1-356

SEQ ID NO: 155570 - protein, 36 aa, Heterodera glycines; identical to SEQ ID NO: 127729
  Coding regions on vcDNA: vcDNA=SeqID_81993; Strand=-; Position=1-111

SEQ ID NO: 155571 - protein, 103 aa, Heterodera glycines
  Coding regions on vcDNA: vcDNA=SeqID_81994; Strand=+; Position=1 -78,425-658
  Homolog annotation: Hit_ID=CAE61593.1; Match level="QueryCoverage =67%, HitCoverage=4%, E-value=6e-22, Identity=72%"; Hit description =Hypothetical protein CBG05508 [Caenorhabditis briggsae]
MGHSGEKRNSAQTEANNNQGRSTIVTACDFVFVLAMTIELALKVVAHGLFFTPNAVVRDVGGVMTLFIYASSFWFLIWMPNHVEQNSLAQLLMIFRAMVSGEA

SEQ ID NO: 155572 - protein, 191 aa, Heterodera glycines
  Coding regions on vcDNA: vcDNA=SeqID_81995; Strand=-; Position=1 -48,454-687,1154-1447
MGNAIFDPSPCPCRESTTPDSLSMPVLESLQQRLHALGPGVDNVFTVMDKLEGALGGDSGAETKKHRLALEQLRRDYSALVSECNSALDQARSKETLKARFDADTDSLRSLLEDTAHKLHNDLIGKDALKLGQFPFKLKISRISMPYSRVLLVILLFFKQFKAYLLVRSLPFQNPTCPDHYHKVPFSNFRL

SEQ ID NO: 155573 - protein, 95 aa, Heterodera glycines; identical to SEQ ID NO: 124528
  Coding regions on vcDNA: vcDNA=SeqID_81996; Strand=-; Position=1-700

SEQ ID NO: 155574 - protein, 71 aa, Heterodera glycines; identical to SEQ ID NO: 134376
  Coding regions on vcDNA: vcDNA=SeqID_81997; Strand=+; Position=1-262

SEQ ID NO: 155575 - protein, 256 aa, Heterodera glycines
  Coding regions on vcDNA: vcDNA=SeqID_81998; Strand=-; Position=1 -185,230-346,938-1191,1242-1445,1516-1527
MMAQWQEQQKDDVSTNSPHHSAQGDHQQKKGNEFRRGTTKRAVGTMPTAEADGTTTSAEGAAPSGTLAGRRRLFSSDEDLLDIPPNFQYSSARLPPDFYTQTVLVEGPAELYHSVSLPYLINGQATVPHKQWTATEQATAAVSRRTEIQLLSDDRQQLLTSATGGSGVGITPTHTVTAPTRSLDTHSPAEFKIQKFPNDADERVGDRMPTNWPPHGIDDSEQLQQLRTDANNVYFAKILEFDDEEEEDSTGRAAFI

SEQ ID NO: 155576 - protein, 44 aa, Heterodera glycines
  Coding regions on vcDNA: vcDNA=SeqID_81999; Strand=+; Position=1 -132,1315-1317
MTLWPFVVVLTRAIVAITRLHIWHKEGARMCCNVMNWHTDYSND

SEQ ID NO: 155577 - protein, 160 aa, Heterodera glycines
  Coding regions on vcDNA: vcDNA=SeqID_82000; Strand=-; Position=1 -99,650-783,1028-1136,1544-1684
MRTSQQFDTIIRVPFYRRRVTVFDDQEKEINAELIKSFWQPFPHSSHHDAAPYELVFPVIVPPLGFRTYFVFGDGQKREKNNLRTSKRNNNEQQQNQQQQQNDGGDELTTISNEFFRLTFGTDGLLQSVADLRRNQTVQLRQQFLYYHGMSNNATPRQAF

SEQ ID NO: 155578 - protein, 40 aa, Heterodera glycines
  misc_feature (35)..(35): Xaa can be any naturally occurring amino acid
  Coding regions on vcDNA: vcDNA=SeqID_82001; Strand=+; Position=1-132
DIQFTLTNYSEIFYNSKLKNDKKNLKLNFNIFGPXFLKEL

SEQ ID NO: 155579 - protein, 174 aa, Heterodera glycines
  misc_feature (24)..(24): Xaa can be any naturally occurring amino acid
  Coding regions on vcDNA: vcDNA=SeqID_82002; Strand=-; Position=1 -48,303-431,620-700,911-956,1012-1082,1419-1526
  Homolog annotation: Hit_ID=CAE68642.1; Match level="QueryCoverage =83%, HitCoverage=14%, E-value=1e-30, Identity=47%"; Hit description =Hypothetical protein CBG14532 [Caenorhabditis briggsae]
LSPYNSFKKGPKILKINSKIDKNXFKHVMLTMGGDFHYTNSNMWFTQLDKLIAAANKQLSNNITVFYSTPACYVKALNEAQPKLPIKSDDFFPYASANHSYWTGYLTSKPGIKGLIWTGYLTSKPGIKGLIRASSAFLQLSRKFASFALLSNASAVGKFGTAQALCTHHDAVTS

SEQ ID NO: 155580 - protein, 405 aa, Heterodera glycines
  Coding regions on vcDNA: vcDNA=SeqID_82003; Strand=-; Position=1 -196,952-1650,1943-2265
  Homolog annotation: Hit_ID=NP_501697.1; Match level="QueryCoverage =41%, HitCoverage=8%, E-value=1e-15, Identity=28%"; Hit description =predicted CDS, integrase, catalytic domain containing protein family member (4K310) [Caenorhabditis elegan
MDLSPHYLSLEGKLSPLVLDKYFVINDAEDNQNWNTTKFRNALSRAIEQIKNRQEVRQKVSTSQKIPYLLDEPKITIGSDFYNYFDIRPIKHLNSGFWISNSKIGKILSGDGKVTWTNLNDKNVNTKDEYNVSAINSSAIQCETEITDQVELDKNKELIKLVRQHDSLNSVGFGDLSEKEENMREKMIKNISFNGKRYQSKLLWIEEEAEKLPTNFAMAYSQLKSNLKRLRTNPKLLQLYHKTILEQINDQGSVEITNPLVDPNQKGQKIHYLPHHGVVKETSEHTKLRIVYNASAKSEKYNHPIIKQLAQNIYVDNLLVGINHKKDFQMVYELIKKVFAKAGMNVREFVSNELSELQKLPKEDRIEKETVKLLGIWWNVKNDEYFIKMPKFEPNNKQEEKYYLK

SEQ ID NO: 155581 - protein, 19 aa, Heterodera glycines
  Coding regions on vcDNA: vcDNA=SeqID_82004; Strand=-; Position=1-57
GPGSRSRVLKSSGPGPGRA

SEQ ID NO: 155582 - protein, 31 aa, Heterodera glycines
  Coding regions on vcDNA: vcDNA=SeqID_82005; Strand=+; Position=1 -69,555-581
MAFQEKLEKNVMAQIDVKVQTKEFRHLSPND

SEQ ID NO: 155583 - protein, 285 aa, Heterodera glycines
  Coding regions on vcDNA: vcDNA=SeqID_82006; Strand=-; Position=1 -87,1181-1378,1755-1874,1934-2049,2614-2791,3149-3307
  Homolog annotation: Hit_ID=CAE62158.1; Match level="QueryCoverage =84%, HitCoverage=88%, E-value=2e-30, Identity=37%"; Hit description =Hypothetical protein CBG06205 [Caenorhabditis briggsae]
MPRIQLKRCRQALLKLAFAHLVKNVSYCTDLETSGTPARIVEIPENVTVVEGELAIIKCVVEGNPAPTIVWKKGGRKMPLTDDRVRCQTDGDTGHVSLIISKCRPQDGGEYTLMVKNAHGKHKVGAKLLVTPAAESNLDFRAKQKKRGTGISNSEQEKQRQRSDAEPKSKAERRKRQVYVVEEPRDTFVVPLNSQHANEKENATFECEVNDKEIDVKWFHDGAEIGMDGRHFKERAGCRRRLLIINVLIEDHGEYKCTAKDDETMAQLIVHPKFVKKAERKPVTF

SEQ ID NO: 155584 - protein, 79 aa, Heterodera glycines
  Coding regions on vcDNA: vcDNA=SeqID_82007; Strand=-; Position=1 -160,207-286
MHFLPPLSYLITLIADSTPSLTFIEQIGRMELVQSIVQFMEKIGLGTGENNKKKKQRIERRSATNKNLKEPWNHPEALN

SEQ ID NO: 155585 - protein, 81 aa, Heterodera glycines
  Coding regions on vcDNA: vcDNA=SeqID_82008; Strand=+; Position=1 -70,269-444
MALLNEHTVVSIFQCLAFLTFIVVMVICPITAHGDEVPIHRKIDFASIERLSGIFGSLHGVTLFLGYPLVPHIPRLLYSFL

SEQ ID NO: 155586 - protein, 266 aa, Heterodera glycines
  Coding regions on vcDNA: vcDNA=SeqID_82009; Strand=-; Position=1 -13,460-1247
MARKIGFVTTCGWTILPSFNYAKLGLKMALLSDRFDVLVDAHFDGKSEFTIWRAIEIEKEEGPKPKMFIRIDGSFVDFPLSVRQMPNKICFKNLWIESVLTFVYAKAFLSFFSYIDHSVIKFLRSKKRFFDRRGTKLEVFVHSIYTDVQPIWDVFTREIWPIFAKSIRHLCFPNANHLDNLRRRTSPTLLTDLDQLNFIDSGGLLPDGISDDGPKATAGQALSKWLHTPSKNGKANELYCCAYFCEITWINTFKEVIELLNCSLND

SEQ ID NO: 155587 - protein, 155 aa, Heterodera glycines
  Coding regions on vcDNA: vcDNA=SeqID_82010; Strand=-; Position=1 -100,386-544,813-995,1268-1293
MVHKFPLNLAFFSVPKFVRLFLLVVLAFHRSKPNQRCIYSANYSNDLSESTKGSLVSFLQKWGVEEKRRIKPCQEGVACQTYRCKDGKDGHDFFLVTACATPDDLTGLQCSHRDFDPFCLDGKPDCKTCRKRECLDPDRMKLEGPKKELILALCC

SEQ ID NO: 155588 - protein, 56 aa, Heterodera glycines
  Coding regions on vcDNA: vcDNA=SeqID_82011; Strand=+; Position=1 -6,265-429
MIVNVRVVHRPSVLSQEYRTAFDSADFRLLGFRFRYIVKKRVSMLRKGRLKIAFMH

SEQ ID NO: 155589 - protein, 142 aa, Heterodera glycines
  Coding regions on vcDNA: vcDNA=SeqID_82012; Strand=+; Position=1 -21,546-833,891-1010
MNSEAYWPADQRQIDEHSCSGPYPGKKDDEKAPKWYLVAQIVANGVVAARAQLAEQWSALIWVDNDIAQKTWPLEVGDSVKVVSVEWTQTATGWASAGDWLIMGPFSSAAWEQFEFLREGALEAVELRPMVSTRALRERANF

SEQ ID NO: 155590 - protein, 292 aa, Heterodera glycines
  Coding regions on vcDNA: vcDNA=SeqID_82013; Strand=+; Position=1 -186,234-407,547-654,701-841,1078-1118,1256-1406,1459-1536
  Homolog annotation: Hit_ID=CAE66585.1; Match level="QueryCoverage =63%, HitCoverage=57%, E-value=1e-93, Identity=80%"; Hit description =Hypothetical protein CBG11904 [Caenorhabditis briggsae]
GTAPAINYGINGQNDKRMAQVLCMDWAQDKRHLVSSSQDGKVIVWDGFTTNKEHALTMPTTWVMACAYAPSGQMIACGGLDNKCSVVPLDPQEDILQKKRSVATHTSYMSCCTFIRSDNLWDVESGQMIQNFHGHLGDVFAIDIPKSDTGNIFISGGADRHALVWDIRTGQCVQSFEGHEADINTIRFHPNGDAFATGSDDASVAFCSPVMAIIASAPDGTAICTASWHVTGKQLFLSDKSLNISDLQFIGNAKDENAVEIDQSLFEGDIDFDDDDEDYNPEADVGSEDESK

SEQ ID NO: 155591 - protein, 107 aa, Heterodera glycines
  Coding regions on vcDNA: vcDNA=SeqID_82014; Strand=-; Position=1 -114,369-451,514-642
DGVAVGQARFHRSADGQVATEWTIFVDNGTESARPTPYIPTEGTTFEAQVNSIIQIGAQWVRSDSLPYLCEGDLSRAYYVLDDAVFLLNAMLYQTKGEPMIFKCKVS

SEQ ID NO: 155592 - protein, 586 aa, Heterodera glycines
  Coding regions on vcDNA: vcDNA=SeqID_82015; Strand=-; Position=1 -405,825-1100,1157-1775,1990-2450
  Homolog annotation: Hit_ID=CAE69665.1; Match level="QueryCoverage =23%, HitCoverage=47%, E-value=2e-14, Identity=32%"; Hit description =Hypothetical protein CBG15913 [Caenorhabditis briggsae]
MTGMVRGQQLRQWSSPPFANAPRDNTAVPVEAPTFNQRRFYFHSFDNDGNDPVDQFLDFLTHHGPKKAHTVCVAHNGGKYDFHLILEALHRRNMPPKRLCTTGLKIYSMRLSGRNQRRVTFKDFINYFFCELDALTLCNAKKANALIRDASDEQLLCLVEICLYILKGRVPLRPRHLNKLKAHAQVLRRLARTRCSRSAKKDLLQHGDGLPAIVGLIASIALPLIADHTKRYLLVPEDIYQSLAAPPPSDGTPIGLVRNRIKQIKNDDAINDAERAVKYEQELKRLNKLAKDEDERPVGVKLENLNDVVDAMPKPINIKRPIVVATRRHLKVGRARKENVEQLEEDDDEIPWPSSSIKRQPTQTEILKLIYKNAQSLGVSEEGQVLRAGGRPFITSSVDDIVSHLLNKDKRGQNKEPTEFKEFVERARQNPLLTTQRTYTLHRQAKRRYRRLPTLALGLHTEWQADLAIFDRLGKQNRGYKYLLVCIDTLSRQVFVEPVKTKTSANMIIAFDRIFKRSKYIPWKVLTDQGKEFTARAVQQFFRTKDVEHFCMLTSPQFHAGMADVRIVASKSAFTATLRRGTRTSG

SEQ ID NO: 155593 - protein, 175 aa, Heterodera glycines
  Coding regions on vcDNA: vcDNA=SeqID_82016; Strand=-; Position=1-525
MGQKRREEKVIKIELNERNENSQSAAVDQMGEEMGNDRNDQMGNYTDQNLFKSDQNINDQQKREIVKKFNAIKEKLREKGKYKRKDQSKIERKIAKLLGTNRKLIQKWKNELNLNKKKMKKQLYDEKKREFIERFDEFKELYGQGKQKEFAKGLSISEATFLRWKKELGTKLPQK

SEQ ID NO: 155594 - protein, 43 aa, Heterodera glycines
  Coding regions on vcDNA: vcDNA=SeqID_82017; Strand=+; Position=1 -121,186-196
MKWKKEQLKKKYKKSPKTAQECKVCGRVARFKYYKIQSCDEIY

SEQ ID NO: 155595 - protein, 95 aa, Heterodera glycines
  Coding regions on vcDNA: vcDNA=SeqID_82018; Strand=-; Position=1 -217,404-474
MLFGIDDCLGNHLRHGVRPSKRLRLTPLDAVVGGGGRSDGGVVGVTKSMSIPILTLHESFHQFFDPFEDWDKVVLTYLHFSDRMCHFQLPFPKIK

SEQ ID NO: 155596 - protein, 38 aa, Heterodera glycines
  Coding regions on vcDNA: vcDNA=SeqID_82019; Strand=+; Position=1 -41,188-263
MISMANVTLSSFLSPFFAPLIRETIWNDVEQTQLQYGS

SEQ ID NO: 155597 - protein, 89 aa, Heterodera glycines
  Coding regions on vcDNA: vcDNA=SeqID_82020; Strand=+; Position=1 -38,123-354
MSEFTSSDGSGKSVSSKVSESESYDATTLGKLMNLDAKVVEWLEKEPYTDDDPLLVLDFLGPFNNLHGDYNQNKAFLVQKLVCLNSKLT

SEQ ID NO: 155598 - protein, 175 aa, Heterodera glycines
  Coding regions on vcDNA: vcDNA=SeqID_82021; Strand=+; Position=1 -183,1675-2019
MDARVLHVDYVVVGGGVAGVCVVQELCDLLERDEVAGTSNHRIVFISGAEGFVKRVANQRQSVRKVHVISDVELIGLSDQRPSSFAIDSAVSFCELPSHFLGAQTDWPLWAQLSNGERWLGCDLIVDASGVVPNSDQWKSDCPEVVPLCLSPENVPQFVLSFLLPKIMAFWSTNR

SEQ ID NO: 155599 - protein, 105 aa, Heterodera glycines
  Coding regions on vcDNA: vcDNA=SeqID_82022; Strand=-; Position=1-424
LLDPVNTESCKYLYPDPICLTLFPGSKNIEELLVHFIMDARVLHVDYVVVGGGVAGVCVVQELCDLLERDEVAGTSNHRIVFISGAEGFVKRVANQRQVEMSVQA

SEQ ID NO: 155600 - protein, 78 aa, Heterodera glycines
  Coding regions on vcDNA: vcDNA=SeqID_82023; Strand=+; Position=1 -35,155-356
MSVFSSSDSATCSNSEAFFESAEELGEALDLHPDVIKYLKEAPRSDEDPILVLDYTDLFNGLQGTLKDNKTWVANLLV

SEQ ID NO: 155601 - protein, 121 aa, Heterodera glycines
  Coding regions on vcDNA: vcDNA=SeqID_82024; Strand=-; Position=1 -194,658-826
MEQLSEIYAIRALLRHYWKKGTNAEETVRKICAVEGPNVVDIETAHNWFSWFESGHLTLEPKKTIWLPSETWDEVFKFVPFSDLHQHVQMTCQRFWALSEPILNRLCPRVAKPIKICWESE

SEQ ID NO: 155602 - protein, 156 aa, Heterodera glycines
  Coding regions on vcDNA: vcDNA=SeqID_82025; Strand=+; Position=1-471
MTFVKTTVEALKQLQTSFTSDQMPIFNTLITTLSSQIDLLNGSISQLRSTALSTEGMPISAEELERQRSVVIIGMPEHNDSSPAKRAEMDRSKINCLFDSLGIECGTIAYRMGRSFNPAQKSPRPLKILLPSRGFQKQALAGARLDCVCWERYFER

SEQ ID NO: 155603 - protein, 58 aa, Heterodera glycines
  Coding regions on vcDNA: vcDNA=SeqID_82026; Strand=+; Position=1 -84,138-378
FRNSFVFVLSFHLHCPTDWKMITDMQLGIMANVLGVSIFILVIFYHYIVANQKKQSPQ

SEQ ID NO: 155604 - protein, 277 aa, Heterodera glycines
  Coding regions on vcDNA: vcDNA=SeqID_82027; Strand=-; Position=1 -6,353-487,546-587,637-774,944-1018,1068-1157,1262-1336,1562-1834
MRRRNELERLYNGARQEPIWLCIVSSTGPEKQKQTIDNFLFYLEEYLNYPISNRPTVEEEKELSDRFLLLVKFFYHCEETIAWKYLKTTTSRTVQQFLDELSSFFALAVPTDQTSSADSDLRPLPVVTESVPEESIYDPPWDDRPLRFIKTMAALQSHRSTNVLPTVPSTSADSDPRPLPVVTESVPTSDLTALFAEFLRTNCVGHVPKEFLVNHLEEAIKILNLGGGQSDDNSKMSKFRKVLRSMCLLIIESDRAQCVFTGSPCVTFLDQSPGRDF

SEQ ID NO: 155605 - protein, 93 aa, Heterodera glycines
  Coding regions on vcDNA: vcDNA=SeqID_82028; Strand=-; Position=1 -108,810-904,986-1061
ETINLDCPPQLVPVPGEGAIPYRYCSPSAPINDGIQMYVRLNQQILFPLNWPVTTVPVIHTPGPVPHRPAQRILHVCTQAKTMALYVAECSCK

SEQ ID NO: 155606 - protein, 179 aa, Heterodera glycines
  Coding regions on vcDNA: vcDNA=SeqID_82029; Strand=-; Position=1 -140,214-409,563-763
MQNYFLLPLLPLYHDNGLRIMHEKLRNPILDTLTQLQNAIGKEKKAREQKMNAIQPSSRMNNVEISNKCTNFVVMANKTGRKSQENNSKKENEPNELELNFLENIGVGAQKKVQFLIYWPKICGKKVKLHSFKTQKSVYMREWHDKYLEDMKKVLGQKRTQPRNLLTEQKYKSLMEKVK

SEQ ID NO: 155607 - protein, 191 aa, Heterodera glycines
  Coding regions on vcDNA: vcDNA=SeqID_82030; Strand=-; Position=1 -263,1011-1234,1676-1761
MPTEDDFFGIKSLDSMPLPQLYQHRAKVPKSTFKRREQSGGRSDEADVFEAHFFPELSEKEEQEKMDGKNGADTDAQTFIEEQFFPRRVQQQQQMMPPLDSPPMTTTEIDTAEADDAAELFELNQSDGTSGIKQLWALIDPIWKFDRAELVDCMAKRVIYETDDLIALDKPFQMAFSSGPDDQPQLDRILQ

SEQ ID NO: 155608 - protein, 153 aa, Heterodera glycines
  Coding regions on vcDNA: vcDNA=SeqID_82031; Strand=-; Position=1 -325,1723-1859
MQGHEADITIVTTTVTKQQQFSNWQRANFSKDRKSEFWGDAQRVNVALSRGKHGLIVIGDFLELGGSPIWSRFLNKAIEFTVVTSPSVVKSIKSPSSSYVRGLLVDDSGTSIIPSSLFFVQITKISTKEDRLIFVDSIITHHGCTANLGHFCA

SEQ ID NO: 155609 - protein, 60 aa, Heterodera glycines
  Coding regions on vcDNA: vcDNA=SeqID_82032; Strand=+; Position=1 -65,112-231
ALVTSSGDHSPPAVVSANVAKEVPNSQQQNDWDAKVCHKDIEIIGEKQLTINCKGNRFGI

SEQ ID NO: 155610 - protein, 19 aa, Heterodera glycines
  Coding regions on vcDNA: vcDNA=SeqID_82033; Strand=+; Position=1-57
GPGSRSRILKSSGPGPGRA

SEQ ID NO: 155611 - protein, 34 aa, Heterodera glycines
  Coding regions on vcDNA: vcDNA=SeqID_82034; Strand=+; Position=1-102
MVFRLGLLLVLLICLVHMASSKIAEDDYCGVEDN

SEQ ID NO: 155612 - protein, 117 aa, Heterodera glycines
  Coding regions on vcDNA: vcDNA=SeqID_82035; Strand=-; Position=1 -186,273-438
MSILVPGKILSRFHIAQSLHEVEKWIAPEAIPIGYGGKRVVEGADLPTGCNRPTEYGKGDYLTDGMVWERFGVGKVNYEQSVVGVGDSWTRELRAKAGQMLVYEYFANRNFEITVEN

SEQ ID NO: 155613 - protein, 137 aa, Heterodera glycines
  Coding regions on vcDNA: vcDNA=SeqID_82036; Strand=+; Position=1 -87,222-336,752-799,855-910,1154-1259
MYIRELESPDEHSLVLFNPLRSCFRPTRDELFSAIACQRRSIARLDTERARFRRLNGAQFRVVVRLSGGFLPNFAAVMPQQQNVVNVAAVLANANPNGQNYNRLHAELSETIARLTVEISQLGYMYEQLTERLEHLT

SEQ ID NO: 155614 - protein, 32 aa, Heterodera glycines
  Coding regions on vcDNA: vcDNA=SeqID_82037; Strand=-; Position=1 -81,589-606
MALMDMTMDPVVMAAVTISIGFSVDMPGQNYY

SEQ ID NO: 155615 - protein, 373 aa, Heterodera glycines
  Coding regions on vcDNA: vcDNA=SeqID_82038; Strand=+; Position=1 -123,220-321,655-758,1065-1095,1174-1214,1474-1509,1565-1615,2132 -2223,2279-2306,2349-2392,2440-2495,2565-2658,2797-2817,2874-2973
  Homolog annotation: Hit_ID=CAE59287.1; Match level="QueryCoverage =98%, HitCoverage=78%, E-value=1e-107, Identity=55%"; Hit description= Hypothetical protein CBG02620 [Caenorhabditis briggsae]
YPLKLLWLFDGLNEEPYGLLPLVNLMGKGGPTSVKSVQRIGSYQWRLEDDEPVILVPGMPLESFYWAGGRLKQDGGVVIYNVNHLKVRDGQLDSAILAAKLFGTKAKKEINFDEFDIITDAINLQKIFAFAQEAINLQKIFAFAQEAGEGLFRIDCERVGKVGKTMLMSRMEASDLMEIGHMTFDQGLKAKMAKPRSKHCTGPFFQLVSFQFGQFQFGQFKILARYEVDCADFAAAKAFKILARYEVDCADFAAAKANREPFQESEELNREPFQESEELPQKQQFEENSSIGYIEFNSSIGYIEFGQVPSNLPLQLVTTYPQGAGFPFFTWGQMFFTSADFFTSADQEVVGFFKGNGDFSKPAFYGLNDISKL

SEQ ID NO: 155616 - protein, 625 aa, Heterodera glycines
  Coding regions on vcDNA: vcDNA=SeqID_82039; Strand=-; Position=1 -578,629-1392,1438-1664,1716-2024
  Homolog annotation: Hit_ID=NP_001004509.1; Match level="QueryCoverage= 88%, HitCoverage=38%, E-value=1e-74, Identity=32%"; Hit description =si:busm1-180o5.3 [Danio rerio] emb|CAD60788.1| novel protein similar to DNA polymerases [Danio rerio]
MKHFRTNHLPKKHLAIVPERGYDNAQNQSLLALRFFHWYAEEHGVVVQTAHSAGGEKKIGQYSVDGWVEEERRAIEVNGCVWHGCNECFPNDNMLMPNGKTAGEVRERDEKRLEFIESQVSRVDVYWECQIKRMLNRDPDMRESFGDYVDDGPLDIREAFMGGRTGPLKLYHKAGEGEKISYYDFTSLYPYVNFSTTYPIEHPKVLILNENVEWTSARDNPYKLSLLKVWVIPPRKCDVPVLPVKVNKRLCFPLCMQCCLDYPKGGVDFDYQCEHDDQQRGWVTTCTSIELDAALEEGYRVTKVFRVLKYRHGDDKLFRPYIAEFMSQKIEASGFDASIKGNEELEQQFITECAEKFGISIDKDNMKVNKGKRSLAKLCLNNLWGRFSLRNFGLAQTLITDDPSVLTEYVENSSIDIISIDELDEKHQLISYVQKKEWVEEHECSNIVISLWTTSKARLLLLKAMQKVVRTPGCRLLYTDTDSLIFVHPIGMNPLETGPHLGQFTDEYPKHEIVEYCSGGAKQYGLKLRRNGQDEFVLKLRGITLNYDVMQNQSLCYDTFKEEVLRYAQTGEYEPINVMYPNFLRPDIRGGGHVTSGPLQKCYRPYVGKGIVGPNYDVLNFGHTL

SEQ ID NO: 155617 - protein, 42 aa, Heterodera glycines
  Coding regions on vcDNA: vcDNA=SeqID_82040; Strand=-; Position=1 -91,291-328
MFIRNIIFIDHLMSRLLKIITIDGNFTSYREEFMTRVRNLIN

SEQ ID NO: 155618 - protein, 100 aa, Heterodera glycines
  Coding regions on vcDNA: vcDNA=SeqID_82041; Strand=-; Position=1 -199,380-483
MVIVYRPYVSRWRRAWTVIKAKPRFWLKYYPEFSAGWYMLVPSVIICLGTRFYFGGYPNNFGMGWNEKPFYRQFFEVRRPDDPLVLKWRLPEVLHLLFHF

SEQ ID NO: 155619 - protein, 210 aa, Heterodera glycines
  Coding regions on vcDNA: vcDNA=SeqID_82042; Strand=-; Position=1 -191,344-785
  Homolog annotation: Hit_ID=AAK58437.1; Match level="QueryCoverage =56%, HitCoverage=85%, E-value=1e-15, Identity=46%"; Hit description =glycoprotein gp2 [Equine herpesvirus 4]
MASEKFLKLSWHPLQSLFFAATISVSHFTPSPPLFRELVDDSRAPQPTTDGPRQCVVEAAPERVAAPRTAGQKRGRGRPKTVKKGRARRGKSAAQQQRTTADAATNTDATGAATVTTDAATTATTPATTTTADGATVTNANEPGATTTTTAATTNTEVTAATAPTTTADGAAATNTDATGAATTPTTNAATNTEAPAATTPATTADVALD

SEQ ID NO: 155620 - protein, 82 aa, Heterodera glycines
  Coding regions on vcDNA: vcDNA=SeqID_82043; Strand=-; Position=1 -82,693-857
ISAFRRLMPNTFAFLRYILSPLRFLNYSVSLLLSSVYQSVYNLAEMTVDIVTPGTTQTATRTRTRRTASRRRASTAARSVSR

SEQ ID NO: 155621 - protein, 49 aa, Heterodera glycines
  Coding regions on vcDNA: vcDNA=SeqID_82044; Strand=-; Position=1 -47,106-205
MSDNQKEANKEMEKAIFISADCWLEVFDLLAPSQLGLGIAMISRRFDYF

SEQ ID NO: 155622 - protein, 37 aa, Heterodera glycines
  Coding regions on vcDNA: vcDNA=SeqID_82045; Strand=+; Position=1 -11,77-179
MNRRWICTDVWMDIFPSFDRPKLGLQMALLSYRFDVF

SEQ ID NO: 155623 - protein, 63 aa, Heterodera glycines
  Coding regions on vcDNA: vcDNA=SeqID_82046; Strand=-; Position=1 -30,81-242
MNDNSTNNNTFYLAFKDLHPSWSLIGCALTYGIIATFGIIFNSSVIGVTFLTKCVISVDKFLE

SEQ ID NO: 155624 - protein, 101 aa, Heterodera glycines
  Coding regions on vcDNA: vcDNA=SeqID_82047; Strand=-; Position=1 -204,535-636
MVVLIPLKVRDANELLRQEAASDFPTTSRNIVRETRSNLPIDVRVGSAPSASNMAWNYKYQKRKNQEESCPRGFAQLYTVSTIIDHCSVPCVYVLLPGKSL

SEQ ID NO: 155625 - protein, 72 aa, Heterodera glycines
  Coding regions on vcDNA: vcDNA=SeqID_82048; Strand=+; Position=1 -109,901-974,1289-1324
MNIKGNQRLSTFLRKMIKEDEMWGVSVADFQAAPADDTKLLKCPYLIACKLKSHHPKSELETIENPGKNVFK

SEQ ID NO: 155626 - protein, 215 aa, Heterodera glycines
  Coding regions on vcDNA: vcDNA=SeqID_82049; Strand=-; Position=1 -64,158-361,438-662,712-852
  Homolog annotation: Hit_ID=AAN32892.1; Match level="QueryCoverage =97%, HitCoverage=97%, E-value=9e-95, Identity=82%"; Hit description =secretory protein 4D06 [Heterodera glycines]
MFSLLLSIFPIVFLVCCNAMPNFPCCPGSQQVVAVMSNYIGTFTSEDKSTVCSTAKNTVEGIKNELSYRIGCPRGGQAQIVNEIDRQLTNIAKMEINYEDECPYNLGFARAMFDLAAAAAGHAGNDTEWQNMKSKFVQESQAIKAIGQEMNIEVTDVHIGHPSKGISAHQISAHQNVPSPSHVIANPGQHFGWPERKTHRCHRILTFESKEKLNK

SEQ ID NO: 155627 - protein, 101 aa, Heterodera glycines
  Coding regions on vcDNA: vcDNA=SeqID_82050; Strand=-; Position=1 -64,177-418
  Homolog annotation: Hit_ID=AAN32892.1; Match level="QueryCoverage =87%, HitCoverage=41%, E-value=1e-36, Identity=85%"; Hit description =secretory protein 4D06 [Heterodera glycines]
MFSLMLSIFPIVFLVCCKAMPNFPCCPGSQQVVAVMSNYIGTFTSEDKSTVCSTAKNTVEGIKSELSSRVGCPSGGEAQIVNEIDRQLTSNYNTISRSLEI

SEQ ID NO: 155628 - protein, 105 aa, Heterodera glycines
  Coding regions on vcDNA: vcDNA=SeqID_82051; Strand=+; Position=1 -195,732-854
MLSKVCFPKCLLLLLFGCIIGNKFSLCDQILSPQTTEEKDYSECGIPDFDPFNERSAEDSSEISHSCTEPGILTKTGTGTYGDQKSRDRDLDFRPGLGPTGDFPK

SEQ ID NO: 155629 - protein, 29 aa, Heterodera glycines
  Coding regions on vcDNA: vcDNA=SeqID_82052; Strand=+; Position=1 -66,123-146
MAISFFEKFSMQQTLSNMKRSAKNGYLFF

SEQ ID NO: 155630 - protein, 29 aa, Heterodera glycines
  Coding regions on vcDNA: vcDNA=SeqID_82053; Strand=+; Position=1 -66,123-146
MAISIFEKFSMQQTLSNMKRSAKNGYLYF

SEQ ID NO: 155631 - protein, 179 aa, Heterodera glycines
  Coding regions on vcDNA: vcDNA=SeqID_82054; Strand=+; Position=1 -211,266-407,774-960
MKRRVAPLTTATAPAEQHQIIGPESPKPHEETPKNVEPKDELATKKHKVDDRELWKLAKGKFLLTTYLCHDDWNRLYNNQQKVKRLEGDRFAFGFEMCEECVWANCRATDLLAPMKKKMRRVPFGSVQGVRKSAGEEQRKNAYGTTPWAHQHGIWADDQRTAAQYNGSAQPNGSRTSSW

SEQ ID NO: 155632 - protein, 29 aa, Heterodera glycines
  Coding regions on vcDNA: vcDNA=SeqID_82055; Strand=+; Position=1 -66,123-146
MAISIFEKFSMQQTLSNMKRSAKNGYLYF

SEQ ID NO: 155633 - protein, 185 aa, Heterodera glycines
  Coding regions on vcDNA: vcDNA=SeqID_82056; Strand=-; Position=1-558
MVLVSTFCAQLLNCPVKSLRDRLNHPEDRALVLKHIIGRKVRTTYNDRNGLTKTFFVTGISAQGAAFLPAYGQLRNPFNINVAAHFYARHRIKLHFPYAPCIIERFSGGGEDRHYPMELLELIDDNMDMDINNNNEHWLGRLFTEIDDKQSSSNLSDTTMRLVFEGDMDEDSGRNECSQSTVPLY

SEQ ID NO: 155634 - protein, 23 aa, Heterodera glycines
  Coding regions on vcDNA: vcDNA=SeqID_82057; Strand=+; Position=1-70
LMEREGLLKIIRNTQRYQKPFMQ

SEQ ID NO: 155635 - protein, 33 aa, Heterodera glycines
  Coding regions on vcDNA: vcDNA=SeqID_82058; Strand=+; Position=1 -99,255-257
MMISLINDQWNTNEKNLVIFPFFFFYTKFGLKH

SEQ ID NO: 155636 - protein, 51 aa, Heterodera glycines
  Coding regions on vcDNA: vcDNA=SeqID_82059; Strand=+; Position=1 -111,815-859
MIAFNFTQIVMRRTNWENASFPKNSSILLKESDVHLKVLYDLFYVTFRWDD

SEQ ID NO: 155637 - protein, 109 aa, Heterodera glycines
  Coding regions on vcDNA: vcDNA=SeqID_82060; Strand=+; Position=1 -170,396-555
  Homolog annotation: Hit_ID=CAE66802.1; Match level="QueryCoverage =97%, HitCoverage=30%, E-value=6e-19, Identity=39%"; Hit description =Hypothetical protein CBG12164 [Caenorhabditis briggsae]
MRLFNSIALVLSAFFFVLVGFVPENLPFVAILIMTLNLAAVACNTGGFYKCATLVTRQYAHFVVAGIQFEKSVTLFVAPFLYALFISDESSLVQWRAIFIGMAVVLLIV

SEQ ID NO: 155638 - protein, 98 aa, Heterodera glycines
  Coding regions on vcDNA: vcDNA=SeqID_82061; Strand=+; Position=1 -73,395-565,802-855
ATRVSVFGQKTGFWYCWVLKRRVRSNAGEVKEKEKKKGLLRTVSSLFTNSKKKSSSSSKENHLQEFVKRHAKLVPPQNLEKTFPNGLCFPALLSSFVQ

SEQ ID NO: 155639 - protein, 351 aa, Heterodera glycines
  Coding regions on vcDNA: vcDNA=SeqID_82062; Strand=+; Position=1-1056
MAKVANRKRNERRIRAVQDLARHLNHRMNRHRHRQRDGKRDPSEERHIRMTAERYADQLSRLGDDHIHRLQHQFPQLPNPRRRRSEVGGNLKGGKSQPKLASMVVRPPQGELLPSKDVGGAAPGASNSHSRNENEEEGREKAEKERGSRPRVLPPPGDSFGELLEKEAKARAEVAELEARAKKAKMEREEEEQKLKSAKEARLRDLETQADDLRQMLGDASWPWSRGKDGKNGEAVAPRAGKAVAMPAVPMEDDGVSLADSEMEVVPAGGSVARSDEMTKTGGRSAPAKGGSHSWEGFLVFGVDDGKPRELSREEEDYFGGGALDHPVAFPRREKRGKRNKWSNGSTSRRN

SEQ ID NO: 155640 - protein, 90 aa, Heterodera glycines
  Coding regions on vcDNA: vcDNA=SeqID_82063; Strand=-; Position=1 -23,73-157,495-590,648-715
  Homolog annotation: Hit_ID=NP_505950.1; Match level="QueryCoverage =94%, HitCoverage=14%, E-value=1e-20, Identity=57%"; Hit description =mammalian SKi Interacting Protein homolog (60.2 kD) (skp-1) [Caenorhabditis elegans] emb|CAA98552.1| Hypo
MSSIKLNEILPSPIQNEGKDEWANVVTRDPWFKGHEVAINHNAASKTVAIKEPPPYGHRKGFVPRTPEDFGDGGAFPEIHIAQFPLGPLK

SEQ ID NO: 155641 - protein, 141 aa, Heterodera glycines
  Coding regions on vcDNA: vcDNA=SeqID_82064; Strand=+; Position=1 -124,176-475
MAKKKLLLKLQGRRGAEQLKKRREERKAQTAKATEARLAKNTAPQPNTDAETPQPSEEEPSTSEAPARDNDGRPPSTPTPMTPQEMDVPSVEMVDTDVQIPSTPADEDQQAEPVPSTSTARCDLMATPSTSKCAGAFGLDD

SEQ ID NO: 155642 - protein, 194 aa, Heterodera glycines
  Coding regions on vcDNA: vcDNA=SeqID_82065; Strand=-; Position=1 -282,862-884,1136-1322,1378-1470
  Homolog annotation: Hit_ID=CAG02595.1; Match level="QueryCoverage =53%, HitCoverage=45%, E-value=5e-38, Identity=72%"; Hit description =unnamed protein product [Tetraodon nigroviridis]
MVFLAFIHPNLKEDKIHVAKFFATVRGTTPGGMEQMGRIGIGRDGRHFRCAAVDSAMHWERCAWAGLDLGLPRGRGRGRMEVRTVAPVLPGAQRTKNHALINAIDYTRHTLDGAASLLNSNRYFPSRATIKESSIAKIGSVCRRLYRIFSHAYFHHRQIFDSFEEETALCNRFTKFVQKYQLIAVDHLIVPIGP

SEQ ID NO: 155643 - protein, 66 aa, Heterodera glycines
  Coding regions on vcDNA: vcDNA=SeqID_82066; Strand=+; Position=1 -82,271-441
LNKFLNFLRNCFSKMKSSIPHFPSVPAAPNSVSFSAIRSGAQNCESQCIRNEIENRDSCPIKLILA

SEQ ID NO: 155644 - protein, 48 aa, Heterodera glycines
  Coding regions on vcDNA: vcDNA=SeqID_82067; Strand=-; Position=1-144
MDGTFAVQQWIQQCIGRDAHGLDLILDCPAGVDEGSSIKYQKRAGSER

SEQ ID NO: 155645 - protein, 116 aa, Heterodera glycines
  Coding regions on vcDNA: vcDNA=SeqID_82068; Strand=+; Position=1-572
  Homolog annotation: Hit_ID=CAE71161.1; Match level="QueryCoverage =96%, HitCoverage=29%, E-value=7e-28, Identity=50%"; Hit description =Hypothetical protein CBG18017 [Caenorhabditis briggsae]
RSAATLLPIIAENIEVGTSIVSDGWAAYGGINNMQQQYNHRFVNHQLHFVDPTNPQIHTQGIEATWRALKQSLKHLHGTNPELLQTYLYQYAFRRYHSNTKIFQNILEEMRHNYPV

SEQ ID NO: 155646 - protein, 384 aa, Heterodera glycines
  Coding regions on vcDNA: vcDNA=SeqID_82069; Strand=-; Position=1 -200,335-623,831-1010,1055-1109,1151-1338,2031-2275
  Homolog annotation: Hit_ID=CAE71161.1; Match level="QueryCoverage =16%, HitCoverage=16%, E-value=4e-14, Identity=62%"; Hit description =Hypothetical protein CBG18017 [Caenorhabditis briggsae]
PAEQPACLIEFSRGRLTAEGACPSLYMGLQNGLSTPNDVNLNGSIGCLLCHGIMNIVELLRNESVTLKRITAYHPVTLCWMYFNLCSPEQNSLLQRINNRVEHHDYQQNGHGLNNSLGVPRQRFTILQPNDGDVMPPGALAALGDLSYETLVREYLGEDGPAVAMKSLSKSNPKQRKFKPIFTQIWFFFQPYASVTTPKPETVLLLGHSSSKHFGCSDERNWQIYAKHGQGGLKRMRSWEGAKYNRGRMLNRAYEWVFGMVERGTNSVRFFPVADRSAATLLPIIAENIEVGTSIVSDGWAAYAMSDKSVYSTSIQIDMTLFTDVTPPDVHYALHHQSELAPAPVLFSLIYLFVMLRIKVNSPTRSQEDIDRWQVTSHRADGPN

SEQ ID NO: 155647 - protein, 77 aa, Heterodera glycines
  Coding regions on vcDNA: vcDNA=SeqID_82070; Strand=-; Position=1 -81,358-510
MVAVGIAVHGTTDGANEFVAISEKRRSMNLDKKNFCQSIFCQNWTFSKSENIPDKSNRWPRRGLNSKNIMNRIKKSI

SEQ ID NO: 155648 - protein, 46 aa, Heterodera glycines
  Coding regions on vcDNA: vcDNA=SeqID_82071; Strand=+; Position=1 -100,268-308
MPAPNASPSTLMDVRIRSLFNGTKITIIWQKIGEKITYIAIFFDYY

SEQ ID NO: 155649 - protein, 105 aa, Heterodera glycines
  Coding regions on vcDNA: vcDNA=SeqID_82072; Strand=-; Position=1 -135,886-976,1911-1953,2009-2057
NMFPENIVQATMQQMETTYVYDANKTDVPLKYKTVYKDGLNILGTWYSPIGICCLIMGHILQVEDMSNTARSLAMDGTALYEAVATIFIAQMNDVHLSFGQVITV

SEQ ID NO: 155650 - protein, 51 aa, Heterodera glycines
  Coding regions on vcDNA: vcDNA=SeqID_82073; Strand=+; Position=1 -92,253-316
MYADDVKLYYAYGNDDHSNQLDKAIEALEKCVSEMLNIVVVFDRNEAFYAK

SEQ ID NO: 155651 - protein, 76 aa, Heterodera glycines
  Coding regions on vcDNA: vcDNA=SeqID_82074; Strand=-; Position=1 -114,203-319
MVRATTARTRASAERARTIKINRRNAKKARAAIGRAGHSGNAMGREKCMMCLSKVSDMTRVTMGCVHQFHRRWRSG

SEQ ID NO: 155652 - protein, 65 aa, Heterodera glycines
  Coding regions on vcDNA: vcDNA=SeqID_82075; Strand=-; Position=1-195
MINVWKMWRKNVGQNDQSVKETDQSAGISDHCMLQVDQHDGRSDQTNKCVDLVLLKAVKRSKCAN

SEQ ID NO: 155653 - protein, 50 aa, Heterodera glycines
  Coding regions on vcDNA: vcDNA=SeqID_82076; Strand=+; Position=1-254
IFCWSNHQSPFFNHELTSFAIPPTFYHEIFIYIYIYILLLFMENKKSISC

SEQ ID NO: 155654 - protein, 51 aa, Heterodera glycines
  Coding regions on vcDNA: vcDNA=SeqID_82077; Strand=+; Position=1-153
MSLFSKQMSEQIATSIKDNYATFFPNSKEAKFAQKSNTAWDDLTNELMQLG

SEQ ID NO: 155655 - protein, 89 aa, Heterodera glycines
  Coding regions on vcDNA: vcDNA=SeqID_82078; Strand=+; Position=1-270
MPKTEFGATPSPSFLPKAFRRTVNPVVDLQRDVLELQKDFFKHSAMPLVDKMSAYYDYKIAKMMASNDQQQKSEEKEENKEFDENELDY

SEQ ID NO: 155656 - protein, 136 aa, Heterodera glycines
  Coding regions on vcDNA: vcDNA=SeqID_82079; Strand=-; Position=1 -115,201-232,351-612
MFLKRNSVLQNLPFVPRAVEPSPMAPVKHIFMENARLLKNAGLEEICADCSSPCRTHFDVRLLHCRWCLCVLPIGKAKRNCGPKRGECQQIFWERQNITGLIYWPMLIQTLDIIEREKHEMLDQIWALINDPTVPQ

SEQ ID NO: 155657 - protein, 178 aa, Heterodera glycines
  misc_feature (50)..(50): Xaa can be any naturally occurring amino acid
  misc_feature (56)..(56): Xaa can be any naturally occurring amino acid
  Coding regions on vcDNA: vcDNA=SeqID_82080; Strand=-; Position=1 -24,1144-1656
  Homolog annotation: Hit_ID=AAG50897.1; Match level="QueryCoverage =100%, HitCoverage=57%, E-value=3e-70, Identity=78%"; Hit description= bacterial IS-element [Arabidopsis thaliana] pir||D86488 bacterial IS -element [imported] - Arabidopsis tha
LSLRASGKDYDHCLIDLVSILPSSTTPLIDCDVDFRVPWYISVENLSRNXLGRVRXEVRYADLRAENWKPISNLHDMSSSLSQTLCYKRLTISNPISCQILLYRSRSIGRKYQRSTRTHCHHSSPKIYSASAKEPCSLATNLPVEIRTPKQLVNIYSKRMQIEETFRDLKSPAYELGL

SEQ ID NO: 155658 - protein, 73 aa, Heterodera glycines
  Coding regions on vcDNA: vcDNA=SeqID_82081; Strand=-; Position=1-221
  Homolog annotation: Hit_ID=XP_316759.1; Match level="QueryCoverage =97%, HitCoverage=14%, E-value=2e-09, Identity=48%"; Hit description =ENSANGP00000016092 [Anopheles gambiae]
EMSDRVILAPLNVDVDEINEKVLDLINSEEKIYKSIDTAGNDSSFDCVPEYLNTLYTTSLPRHELRLKNNAIV

SEQ ID NO: 155659 - protein, 90 aa, Heterodera glycines
  Coding regions on vcDNA: vcDNA=SeqID_82082; Strand=+; Position=1 -103,498-608,673-731
MFFLNSIPSENGLILLLFAIRFISTLCVVDSPKADENVEDKNNSQPIVPTMNDQLNEYMQKNEDGQSNKNEDSSIRAEHASVQSSSFGGK

SEQ ID NO: 155660 - protein, 89 aa, Heterodera glycines
  Coding regions on vcDNA: vcDNA=SeqID_82083; Strand=+; Position=1 -69,308-376,430-563
SNISKIDEEYVAESSDQQNVGKTKNEDLTSSNIGDANIENEIHEEATKLDGIEEIGNKSAKNNGRLEMYEQNAKLIEQLNRDQSEQNAN

SEQ ID NO: 155661 - protein, 64 aa, Heterodera glycines
  Coding regions on vcDNA: vcDNA=SeqID_82084; Strand=+; Position=1 -42,290-442
MPRSKSVNENNEKESHQNSPKNIMERQLDNAESSVAKSADHMPPSSPSPIGWAKGRTVRNKMPN

SEQ ID NO: 155662 - protein, 228 aa, Heterodera glycines
  Coding regions on vcDNA: vcDNA=SeqID_82085; Strand=+; Position=1 -23,214-317,386-711,762-992,1620-1622
MNKWIALGVLIAIISALDSAVLRQRRIVKAGNAPKSEQKEKPGEANLRKKRQSGGQGDEAEKMPYKFDLTCRFYSSNPFRMENDEVPPRDTFASEAEYEEARRLAVLRVRADEEKARIKKPSEESSLFQNDVKYFHCLDDETYYTKELDPQKIMALHHAILVIKKDRASAAGVYRMTDVFVGDDPIGVPAWEIPAAMAHFCRWLKVAEEELNRGGELARFVATAHLRL

SEQ ID NO: 155663 - protein, 101 aa, Heterodera glycines
  Coding regions on vcDNA: vcDNA=SeqID_82086; Strand=+; Position=1-306
MSVNPQNIIVLLKKYFSKYNDETPINSVEINISKNFAATIEKCIKFDEEMLLSEDLVIDEEANFDELDDESDEFDYDSAEEFDGNQSPNGSGPFVYCRFVF

SEQ ID NO: 155664 - protein, 86 aa, Heterodera glycines
  Coding regions on vcDNA: vcDNA=SeqID_82087; Strand=-; Position=1 -78,555-737
MQPKIIKNIFTITETLTPNKFWEVGVLEHDEDFESPPHSSDEEAPEDEVDSDFDKDEEEDEPTPAEEDPEQIERRRKVFFWKEINS

SEQ ID NO: 155665 - protein, 31 aa, Heterodera glycines
  Coding regions on vcDNA: vcDNA=SeqID_82088; Strand=-; Position=1-93
VDLVTDRGELAELAHILTEGTVGGQPMKTKP

SEQ ID NO: 155666 - protein, 109 aa, Heterodera glycines
  Coding regions on vcDNA: vcDNA=SeqID_82089; Strand=-; Position=1-330
MDKLFCANFAVKTWEKESGAPIECQFDVKSVNAKIDETEQIGTKWVFCMYASANEKLQGKPNIFEQPNKVEEILKPKYFIFNLEIKPTYGNDFVFYMPCILNSIIINKF

SEQ ID NO: 155667 - protein, 205 aa, Heterodera glycines
  Coding regions on vcDNA: vcDNA=SeqID_82090; Strand=+; Position=1 -184,586-1019
MDQNAKIWKYGHKSRNMEKYGYRNPSFLSSSLQAFLPPIYRFFYGDNFSCEQIERKWRNSVVICNAGYASNSFVILQQNQDLLQFKQHKMVEEAVQEQERRRSIVVMGLAESAETKPSDRVAADHTAVSSVLDELGIKCPISNYRMGSPQWKNMNIRPSLSPAELDVRRQLQKECAEKRKDGGDWVIYAGTVIERSDIPNFRKIN

SEQ ID NO: 155668 - protein, 51 aa, Heterodera glycines; identical to SEQ ID NO: 124998
  Coding regions on vcDNA: vcDNA=SeqID_82091; Strand=+; Position=1-155

SEQ ID NO: 155669 - protein, 29 aa, Heterodera glycines
  Coding regions on vcDNA: vcDNA=SeqID_82092; Strand=-; Position=1-87
MYLTCSTERPGWMRSLPLNSTRPRPQSNT

SEQ ID NO: 155670 - protein, 131 aa, Heterodera glycines
  Coding regions on vcDNA: vcDNA=SeqID_82093; Strand=+; Position=1 -112,173-258,711-870
  Homolog annotation: Hit_ID=AAO51250.1; Match level="QueryCoverage =91%, HitCoverage=30%, E-value=2e-28, Identity=52%"; Hit description =similar to endonuclease [Caenorhabditis elegans] [Dictyostelium discoideum]
NGINSRFLFAGVGPKMSNLALQIAFGKVEGIAVDTHVHRIANRLGWVSTKVHRIANRLGWVSTKSAEETEQRLKELLPKSEWPSINKLLVGFGQTICLPVRPKCDECANRSLCPWSPANGAAPKPKSKKKR

SEQ ID NO: 155671 - protein, 313 aa, Heterodera glycines
  Coding regions on vcDNA: vcDNA=SeqID_82094; Strand=-; Position=1 -260,313-757,826-1059
MDILPSFDRPQLGLKLAILSPRFNALVGKHFDGKSELTIWRTIIIDKDKGPEPKLYVMDEKFYKFVPFPLPERPLPSKIRFKRLRIDYIDHFVIAFLRSNHQIFNKRGTNLELWIYSAHSSDDQPIWDVFVREMWPIFASNIRHLDFIDGDGLDNLRRRTSPTILTDLNQLNSIYSFGLLPDPISDFDVPNATISAGQALSKWLQTPRKDGQPKRLRCKDFNKHVDIDWVNKFKEQFLRANAISSVCYEIHFSVHGPSMQMVPFELANEQTKEKLTLIKAKENDLEDNCWIMKRCKIGESAAVQLQKDENCNN

SEQ ID NO: 155672 - protein, 211 aa, Heterodera glycines
  Coding regions on vcDNA: vcDNA=SeqID_82095; Strand=+; Position=1 -278,351-376,434-765
FSTRANQNGQHGNRSREVRFDNTNGRAYTRRNGSYSSEPSSGRRSSFSRHQDGARTYVPSTAVQRPISPNGCDSGGMFLMVDPFNIPNTLGAQIQVFDLQENANLGIRHIIGYCIPLRCCVGLFKHIQPCRAIKSMESQSMDEQFAHKYKFHPNLPLSVVPLHDTEFHRMMGSPVMPLRDGYQQRNRFFVRPSSPRLAQQQRHEFDDTAMH

SEQ ID NO: 155673 - protein, 99 aa, Heterodera glycines
  Coding regions on vcDNA: vcDNA=SeqID_82096; Strand=+; Position=1 -153,241-384
  Homolog annotation: Hit_ID=NP_491530.1; Match level="QueryCoverage =100%, HitCoverage=25%, E-value=1e-31, Identity=58%"; Hit description= 2-kinase fructose-2 6-bisphosphatase (1F701) [Caenorhabditis elegans] gb|AAK68884.2| Hypothetical protei
MEDMGLYLEKKEGEVAVFDATNTTRQRRKWLVDYCQRERINPKFRIFFVESEVKVNSPDYRGKMTEEEAKADFLRRIENYKLQYEPLDNEKDDHLSYIK

SEQ ID NO: 155674 - protein, 176 aa, Heterodera glycines
  Coding regions on vcDNA: vcDNA=SeqID_82097; Strand=+; Position=1 -202,248-465,960-1070
  Homolog annotation: Hit_ID=NP_491529.1; Match level="QueryCoverage =77%, HitCoverage=26%, E-value=8e-55, Identity=76%"; Hit description =6-bisphosphatase (53.2 kD) (1F701) [Caenorhabditis elegans] gb|AAF60424.1| Hypothetical protein Y110A7A.6
GICEGLTYEDFQTRYPKQFAERDKDKYHYRYPSGESYEDLVVRLEPVIMELERQSDILVVSHQAVLRCILAYFNNNNRADLPYLNVPLHTVIKLTPKAYSEWAVTARSLLIGNTLGCNVELFKFKVDAVDTYREKPNEPMKKLLAEPIPAPIPEERESSISDDAVEPPPSQIVPLN

SEQ ID NO: 155675 - protein, 259 aa, Heterodera glycines
  Coding regions on vcDNA: vcDNA=SeqID_82098; Strand=+; Position=1 -750,811-840
MPTAEWAMAQQRSTKRLAVEATETPAAKIRARMAQQTSIKRFADEYTEMPEEILERAQQTATKRFADEMEMEIPAAEWAMAQQTDTMQMPAAKIQAMSQQTAPTAQIQAMAQQNVSGSEVAELQSDNAAPEITTKRGRPKLEYDGYLYLFERRSADGKLKFWRCEKFKTKYTKCSARLHTDEHNAMRKTLNEHVCDQSAAHVEAQRLRTAIKRYAAEATEMSAEEIRAIALQNVPGSVVAELPNKDAMEKMVRRMRQRN

SEQ ID NO: 155676 - protein, 255 aa, Heterodera glycines
  Coding regions on vcDNA: vcDNA=SeqID_82099; Strand=+; Position=1 -5,385-1147
  Homolog annotation: Hit_ID=EAL44090.1; Match level="QueryCoverage =94%, HitCoverage=97%, E-value=6e-25, Identity=31%"; Hit description =hypothetical protein 298.t00006 [Entamoeba histolytica HM-1:IMSS]
MELCQTTTAAHHRTSAEEEAAHHHQQQHQTMSDKKKEEPKKEEPKKEEPKKEEEKKEEPKKEEKKDEKGGKDKEEKRRSKKSGKSSKKKDKKKKDGKKSRKDRKKEEKPSTGDAAVATTPAAAATTPATAEAAPTKEQPPAAVVEAATPPAAAEPAADAAKEEPKSAETTTDQPPGDAPAADGAAEPKEEQPSAETKTDQPPVDAPAADGAAEPKEEQPSAETTTDPPTGDAAAADGAAEPKEEQPETDKPAADE

SEQ ID NO: 155677 - protein, 56 aa, Heterodera glycines
  Coding regions on vcDNA: vcDNA=SeqID_82100; Strand=-; Position=1-170
GTTLVRRGTTVIKRGTKVNGRGTTLIRRDTTVIRRGTTVIRRGTTVIRRGTTVIRR

SEQ ID NO: 155678 - protein, 63 aa, Heterodera glycines
  Coding regions on vcDNA: vcDNA=SeqID_82101; Strand=-; Position=1-227
IKFIENNVKMHKKNNVTPSGFEPAPPPLKMMPQNPQSHRDSEVLTMSKVKSDHVFVISGPNNP

SEQ ID NO: 155679 - protein, 124 aa, Heterodera glycines
  Coding regions on vcDNA: vcDNA=SeqID_82102; Strand=-; Position=1 -132,422-664
MSAEREAQRALEEERMREREERERVAREEAEREAEERRRMDRIEAQREAELLRRAKLFRHILLDGDGQADMKTAREVLKCEPEEEAVLNDVIRQVDKVTNGGKRNRQLREKLEMDDQVGRKLRI

SEQ ID NO: 155680 - protein, 610 aa, Heterodera glycines
  Coding regions on vcDNA: vcDNA=SeqID_82103; Strand=-; Position=1-1830
  Homolog annotation: Hit_ID=XP_320889.1; Match level="QueryCoverage =93%, HitCoverage=69%, E-value=1e-81, Identity=32%"; Hit description =ENSANGP00000012033 [Anopheles gambiae] ref|XP_313651.1| ENSANGP00000013044 [Anopheles gambiae] ref|XP_314
MAADIGQILQQLVKNQTEAFQALLRNAQTNPNSVNHSTIYSTINSQLGQFTYNPELDLTFQAWLDRFGPFIQVDGKDLPDAMQVRLLLGKLGQEEYARHAERVLPKLPTDFTLAQTIDKLKILFGETKSIFTRRYECFQLAKSFSQSPLDFASQVNAMCERSKMDLTKDEIKALIFLTGLSDEDRELRERCLRILEEAIKKTPPEVITFEKLTEECRAFLSLRNTSQSLATVSGTNAITLKPQKLKEQQLKKRSISQRPSAKAQSNKNRSPSPFQRQPKPPSPCRFCGQMHWVRDCSQAPTCSKCNRRGHYRSECRSASSARPNSQRYNTTMSVFNITDDDLSEWIMINCRINNTDASLMADSRSRLSVIQIGLWEKLGKPKLISGIKKAKSYSGHFFEILGFFVCSVTYQGCTLQLKCHVAPDGPMNLFGLPWIKAFEMALQRPIATTLNLAQAHAVTVCDDPNTLAKNLKQKFSKVFSSSLGLCTKMRAHLQLKPDAQPIFCRPRPVPHAAKAAVDDELDRLLACGAIKSVDFSKWAAPIVVVKKKCGNVRVCIDFATGLNNSLELNRHPLPRIDDIFASLEGCTVFSQIDFRDAYFQVELDEESKEL

SEQ ID NO: 155681 - protein, 21 aa, Heterodera glycines
  Coding regions on vcDNA: vcDNA=SeqID_82104; Strand=+; Position=1-65
NAQFNRTRTKEQQRKNSWLRF

SEQ ID NO: 155682 - protein, 102 aa, Heterodera glycines
  Coding regions on vcDNA: vcDNA=SeqID_82105; Strand=+; Position=1-309
MALTRKWPSRENGHAKTATRKRPRENGPHAKMATRKRPSRENGHAKTATRKWPRENGYAKMATRKRPRENGHAKTATRKRPRENGHAKMATRKRPRENVLAR

SEQ ID NO: 155683 - protein, 40 aa, Heterodera glycines
  Coding regions on vcDNA: vcDNA=SeqID_82106; Strand=-; Position=1-226
AVFAWQFRVVAHKRIFYFFIVWKIFSLPFYFWCLIQYIFK

SEQ ID NO: 155684 - protein, 62 aa, Heterodera glycines
  Coding regions on vcDNA: vcDNA=SeqID_82107; Strand=+; Position=1-189
  Homolog annotation: Hit_ID=CAE68801.1; Match level="QueryCoverage =98%, HitCoverage=11%, E-value=1e-13, Identity=57%"; Hit description =Hypothetical protein CBG14751 [Caenorhabditis briggsae]
KISSETLSQYHVKGHMDHFDQPAICYPRYRGPSTRNRLPTGLKLIRRVGEKLIKENYPSTEE

SEQ ID NO: 155685 - protein, 18 aa, Heterodera glycines
  Coding regions on vcDNA: vcDNA=SeqID_82108; Strand=-; Position=1 -36,114-134
MPKGIESRLTKIPKIEQK

SEQ ID NO: 155686 - protein, 112 aa, Heterodera glycines
  Coding regions on vcDNA: vcDNA=SeqID_82109; Strand=+; Position=1 -217,563-683
  Homolog annotation: Hit_ID=EAL31098.1; Match level="QueryCoverage =92%, HitCoverage=39%, E-value=5e-41, Identity=74%"; Hit description =GA10883-PA [Drosophila pseudoobscura]
IPHNTQADDTVVIDIGTGKVTDYVKFDAGNICMITGGHNIGRVGIVGHRERHPGSFDIVHIKDAAGHSFATRMTNVFIIGKGATPLISLPASKGIRLSIAEERDRRLAQKQK

SEQ ID NO: 155687 - protein, 34 aa, Heterodera glycines
  Coding regions on vcDNA: vcDNA=SeqID_82110; Strand=+; Position=1-106
YSRTRQQFCRERFLDENGKLKRVNELIPFSVGKW

SEQ ID NO: 155688 - protein, 369 aa, Heterodera glycines
  Coding regions on vcDNA: vcDNA=SeqID_82111; Strand=+; Position=1 -128,641-874,925-1351,1406-1680,1722-1767
MPQSQPSVVVTDYLIKWHGNVFINWGKFVPIVNGGKLTKYVHTMIGTVDYKKMAMLCSFFQGIVNSYFAKRKWIVDFIEIRCNEKEGKKEFELAETRSNKTIELPKHLPDKIRGFVCISITFLDQKAIEFLRHFHRLFGTCQIKLSIGTSSILAIGFFYCFLWPRIKNQISFIEFRDDQAFSRMRDIAPSIFSELPSLRIFESLEDPFPAFPAIDSTNAVNGQLLAHWLIKALPNEIPKIVRCSIEEPDTAGDLPAKIGAIKSAFSKSSFSANFIIQMTIPDETIIAPFDVFNKKTGRRLLLDDSHDQNLLLISCPIKRDKKAWTKWREEALQGSEIYTWNLIDLTAGDADIGEWNSAQFPDLMANMQK

SEQ ID NO: 155689 - protein, 95 aa, Heterodera glycines
  Coding regions on vcDNA: vcDNA=SeqID_82112; Strand=+; Position=1 -171,279-395
MFDMFDAILFQCKTFPRLSIDHFKWHNITNISPWRKPNSNDEIHGRRSIGKSLNGKKSMTINLYAKIDMFRSTLFSVTITDLMLIIFGLHWCSRI

SEQ ID NO: 155690 - protein, 204 aa, Heterodera glycines
  Coding regions on vcDNA: vcDNA=SeqID_82113; Strand=-; Position=1 -72,161-243,311-509,1201-1370,1422-1512
  Homolog annotation: Hit_ID=XP_319666.1; Match level="QueryCoverage =100%, HitCoverage=64%, E-value=1e-60, Identity=56%"; Hit description= ENSANGP00000021376 [Anopheles gambiae]
MDRKNVKANYYLGKVYVHQGQFDEAIKVLSRAHEGVLNLKQTYGDEITQLLRFRQEEDKRITQEIELQSYLNQLIDDDIAKKVNQLEDKKENDVEEKAEELKTQGDTFKKQLNNLFAQVDDRRRKRDLPDYLCGKISFELLKDPVITPSGITYDRQDILTHLHRVGHFDPVTRVPLTADQLIPNFSMKEVVDHFVQENEWAIDF

SEQ ID NO: 155691 - protein, 254 aa, Heterodera glycines
  misc_feature (3)..(3): Xaa can be any naturally occurring amino acid
  misc_feature (21)..(21): Xaa can be any naturally occurring amino acid
  misc_feature (28)..(28): Xaa can be any naturally occurring amino acid
  misc_feature (193)..(193): Xaa can be any naturally occurring amino acid
  Coding regions on vcDNA: vcDNA=SeqID_82114; Strand=-; Position=1 -100,3026-3687
  Homolog annotation: Hit_ID=XP_320889.1; Match level="QueryCoverage =91%, HitCoverage=28%, E-value=4e-60, Identity=50%"; Hit description =ENSANGP00000012033 [Anopheles gambiae] ref|XP_313651.1| ENSANGP00000013044 [Anopheles gambiae] ref|XP_314
FSXLTYLIFFLTLILPNAFGXESILKIXNTFPTIFSPSLGLCNKMCAHLHLKSGVQPVFCRPRPVPHAAKSAVDAELDRLVACGAIKQVDYSKWAAPIVAVRKKNGDVRVCIDFATGLNDCLELNRHPLPRIDDIFAALEDSTVFSQIDFRDAYLQIALDEESKELVGINTHRGLFQYQRLPFGVKSAPSIFXKLMDELTAGLSGVFCYLDDFIVATPTLEEHHSLLNKFFSRLQDWGLRVHLNKCKFLCSQIK

SEQ ID NO: 155692 - protein, 35 aa, Heterodera glycines
  Coding regions on vcDNA: vcDNA=SeqID_82115; Strand=+; Position=1 -102,1375-1380
MGRCTNALSVAVAMTYTFTNVSFLKTVHSEAFYGV

SEQ ID NO: 155693 - protein, 50 aa, Heterodera glycines
  Coding regions on vcDNA: vcDNA=SeqID_82116; Strand=+; Position=1 -58,128-222
MDLGFHVGPDFLDKKPQVQEQFPNLFGFQSRMPCLDLSFPDKNQGKCILL

SEQ ID NO: 155694 - protein, 56 aa, Heterodera glycines
  Coding regions on vcDNA: vcDNA=SeqID_82117; Strand=-; Position=1 -81,637-726
MLLNEKQKQNPSGEAASYVVTGANAISERNRRRMEEVKKEEEESEMDNNLNDKNEK

SEQ ID NO: 155695 - protein, 52 aa, Heterodera glycines
  Coding regions on vcDNA: vcDNA=SeqID_82118; Strand=+; Position=1-157
MSMAITKCAGQAAVDSTGAVPPAPLCCNKIGWKWFINTVSRIYSNPHDAISY

SEQ ID NO: 155696 - protein, 79 aa, Heterodera glycines
  Coding regions on vcDNA: vcDNA=SeqID_82119; Strand=+; Position=1 -179,217-277
MTFSTNFIIVLGTLVHLRKKIFGNYLKNELFWSRSPHCSIPKLTSVLLYMDVDELDMASKKVAVRTNKNTPNNPKSRRH

SEQ ID NO: 155697 - protein, 165 aa, Heterodera glycines
  Coding regions on vcDNA: vcDNA=SeqID_82120; Strand=+; Position=1 -225,287-559
  Homolog annotation: Hit_ID=AAP30770.1; Match level="QueryCoverage =79%, HitCoverage=49%, E-value=3e-38, Identity=62%"; Hit description =putative gland protein G17G01 [Heterodera glycines]
AFLHDISVGHCKRFTLIGKDSKSGEFDAVFDQDKWHNQLLMSSTNGRPTEEQQHQFMDELAAKLPPAGRLCIPISISPADWFFDVIGMHKNPLKKLTFFYFSDQLFVALCSFYVCYAELIDFLLFSGEEYEVSERNTWPQQIQPDKIASKIAFQSKSDGFVCGSN

SEQ ID NO: 155698 - protein, 171 aa, Heterodera glycines
  Coding regions on vcDNA: vcDNA=SeqID_82121; Strand=-; Position=1 -92,147-570
MEIINANGKALPIPQNPLPNKFIGFRSILINFFDHNVLTFLRRFFTKCETKIHITTENIRISEFFVFTIWPMFKDIIHVMIFNPITFRQNRQFAPSMLNFCPSLRVVAFDDGILPEFPPDDSANASDGQAVAKWLFSPNPDNLPKMLSIENLAVNQWSTLKGQIKAVICQI

SEQ ID NO: 155699 - protein, 64 aa, Heterodera glycines
  Coding regions on vcDNA: vcDNA=SeqID_82122; Strand=+; Position=1 -152,265-307
MTPGGTPFVLAVVAAVGVLRLIAVDHHFVDVVVGRPGDVAVYWLMCLDQQRAIIFIMGKSIKIA

SEQ ID NO: 155700 - protein, 378 aa, Heterodera glycines
  misc_feature (277)..(277): Xaa can be any naturally occurring amino acid
  Coding regions on vcDNA: vcDNA=SeqID_82123; Strand=-; Position=1 -71,121-199,281-454,513-580,631-724,766-847,1111-1256,1622-1696,1758 -1803,1844-1887
  Homolog annotation: Hit_ID=CAE62199.1; Match level="QueryCoverage =99%, HitCoverage=47%, E-value=3e-63, Identity=38%"; Hit description =Hypothetical protein CBG06249 [Caenorhabditis briggsae]
STFADTVFEPGRDNAIVVEFYADWCGHCRAFAPFYRQFASLVKRWSDWCGHCRAFAPFYRQFASLVKRWSDIVQVGAVNCADNVGAVNCADNFNGQICRSNSVAYFPMIKYFPRSANSVSDGILMESAHSGTNLRDQLAAKLLNEYNRFGYSNLLNEYNRFGYSNWPNFRHLEVTVNTRFEDLWHGIFNTRFEDLWHGIFPSANFLLIIFEQFDAVGVQSILDLWQSILDLWQNRKQIGVRRTLSNSPLVPMLGIKKFPYVAMFKRDDQQSIFMEQXENETERELFGQISGSRHSGRSDAETLSSKRAPNRCVHVDVIDCERFPDRCKQLYFVSETDLLKACKQLYFVSETDLLKAVRMALLDEVRMALLDEVTRMDE

SEQ ID NO: 155701 - protein, 99 aa, Heterodera glycines
  Coding regions on vcDNA: vcDNA=SeqID_82124; Strand=+; Position=1 -11,75-363
MNRRWICNDVWMDIFPSFDRPQLGLKLALLSPRFNALVDKHFNGKSELPIWRSIEIHKGKGPEPKLFVQIGDKYNKFMEFPLPDRPLPSKIRFKWLRIK

SEQ ID NO: 155702 - protein, 33 aa, Heterodera glycines; identical to SEQ ID NO: 154596
  Coding regions on vcDNA: vcDNA=SeqID_82125; Strand=-; Position=1-103

SEQ ID NO: 155703 - protein, 28 aa, Heterodera glycines
  Coding regions on vcDNA: vcDNA=SeqID_82126; Strand=+; Position=1 -53,181-214
MSQEELLLSFQDETALDWWKMNQIAEMP

SEQ ID NO: 155704 - protein, 135 aa, Heterodera glycines
  Coding regions on vcDNA: vcDNA=SeqID_82127; Strand=-; Position=1 -84,340-661
MAKDSKNKVAKMKEMISELKEGKDFFLFSADQTDDQPMFLWEDGPSDVSLFRALKICVSEVADEYDQKFVDIKLDALFQLELTQFAKFILCMDKHLKDKRKKDGDEMVAKLHLDKMANLLEGENGDEFGAFLVKN

SEQ ID NO: 155705 - protein, 40 aa, Heterodera glycines
  Coding regions on vcDNA: vcDNA=SeqID_82128; Strand=+; Position=1-121
MIRGKAPQKRQRVRKAAPRQQTQIAHWYRRKFSPDHRSLS

SEQ ID NO: 155706 - protein, 162 aa, Heterodera glycines
  Coding regions on vcDNA: vcDNA=SeqID_82129; Strand=+; Position=1 -54,175-398,620-746,801-884
MPFNGQGKQQQQTIVRDTSVTRPAAGAAPPPPPHVIRTTVRDRLNAGPFLQNGDNGPRIAHVANAAAVLKTTERGEESETGRDLSAEFHKLERRGLLPPAHKSASKAVYGGPKPTPRDFLLNRKNAAAEKWGQRKKWRRILSTANPTKRKRRKKREKGEENE

SEQ ID NO: 155707 - protein, 131 aa, Heterodera glycines
  Coding regions on vcDNA: vcDNA=SeqID_82130; Strand=+; Position=1 -52,163-506
MGLLVFDSGDIDSVGFDKGFEIFQFVMADQNSCGSSKCCGSKSNRGQNEGKMTPNNSQPSSGGCGLVAKTTGPRKGPRAAVQIRPSTPIFRLNNMVTLGGHPRSFGLHTTRHSRNNSWQWGKRTGGAPILA

SEQ ID NO: 155708 - protein, 39 aa, Heterodera glycines
  Coding regions on vcDNA: vcDNA=SeqID_82131; Strand=+; Position=1 -54,247-312
MPLRIGFCIGGLCADKKRPNVQHRVKFAQDELVYYVPAG

SEQ ID NO: 155709 - protein, 72 aa, Heterodera glycines
  Coding regions on vcDNA: vcDNA=SeqID_82132; Strand=+; Position=1 -57,104-265
MELNELSSWYDILQDDEDNILNWFTPVTARDVCQEVLAIAQERCMPFEKIVKWKQILDKICAQIAQKKVIIL

SEQ ID NO: 155710 - protein, 230 aa, Heterodera glycines
  Coding regions on vcDNA: vcDNA=SeqID_82133; Strand=+; Position=1-693
MAINICDKKALVNQILGQADITVTTSGITVSGPRLSTPRFIPFDECGRCRACKATEVEMDTMVTKEGITLWCSRVSKSQFVPFDAVYDLPGHCFFRVKNKARVFNVPYGDLPSDTCTTPTTTTQGTQTNMQQDLKRKAKVALDLVEAGLMADTMQDGVRWKKAKTAFSVLGNLLLAESLDNKVTNSPVEEQNYVQEEPRRDEEENKEDLGDIDKTLDEFFASIKASTSNM

SEQ ID NO: 155711 - protein, 51 aa, Heterodera glycines
  Coding regions on vcDNA: vcDNA=SeqID_82134; Strand=+; Position=1 -11,165-309
MSGKLVRCELSDPANQSEIIGYTVYNILIIEVAEFLCYAMLWLISWWNQCQ

SEQ ID NO: 155712 - protein, 170 aa, Heterodera glycines
  Coding regions on vcDNA: vcDNA=SeqID_82135; Strand=-; Position=1 -184,533-861
MFFALDEDRLPMASTSMAVYPKIAHWSMYYVKERYRGHQLGRALTRRAMEMAGDRHIFGYGEKLHFDKFGFACIPLREPALVAEMWAKYAEEYGMCHFLDWQLWSLLAKSADVRPERLDNDSSVVLKDWQEVPFQTLLNFDVQQTAGIDRSMYLREALRLPESVAKVCHH

SEQ ID NO: 155713 - protein, 108 aa, Heterodera glycines
  Coding regions on vcDNA: vcDNA=SeqID_82136; Strand=+; Position=1 -220,263-369
MWRKAFGPNNFGMFFALDEDRVPMASTSMAVYPKIAHWSMYYVKERYRGHQLGRALTRRAMEMAGDRLIFGYGDSRSRLEKTLGFKIYEFLGPAVPIGASSKKLRFLR

SEQ ID NO: 155714 - protein, 127 aa, Heterodera glycines
  Coding regions on vcDNA: vcDNA=SeqID_82137; Strand=+; Position=1-381
MFNWFSRSPPLFSVPYCSNLPAPTRPPSSTRCSTKHRRPTPSPAHPPPTHPKWARAAAYTHSAVHAPFSAFPRPAHFFDQRRTRVADLSSKQQQRVDEFSAGQNSGMAQNDGNNANELMDNLKLAAN

SEQ ID NO: 155715 - protein, 265 aa, Heterodera glycines
  Coding regions on vcDNA: vcDNA=SeqID_82138; Strand=+; Position=1 -246,305-410,600-1045
MWAKYAEEYGMCHFLDWQLWSLLAKSADVRPERLDNDSSVVLKDWQEVPFQKLLNFDVQQTAGIDRSMYLREALRLPESVAKVVISKETGEVIGMCQARHLMRRRIGISLFYAERSVIGRLLSSPCRTAPICRPRPVRQVRLAALQNTVDQRRVLAHPPPTHPKWARAAAYTHSAVHAPFSAFPRPAHFFDQRRTRVADLSSKQQQQQRVDEFSAGQNSGMAQNDGNNANELMDNLKLAANVFKKVPIIFIRIYFLTVMPLYIYV

SEQ ID NO: 155716 - protein, 129 aa, Heterodera glycines
  Coding regions on vcDNA: vcDNA=SeqID_82139; Strand=-; Position=1 -191,814-1012
MHILKSLTVIIVFVMFGWTLNGLSTFYMPLLKLSPEDSISFAAGLVQMTLVASASNTPVLYVFSAEYRHCFQKAFPWLAKQQNAVSNVVFVGASASNLTRRRGQQGQAAADQQQQQQQQRSLPIVSRTL

SEQ ID NO: 155717 - protein, 112 aa, Heterodera glycines
  Coding regions on vcDNA: vcDNA=SeqID_82140; Strand=-; Position=1-339
MKRTNATNITPPRAKRSMAPAQDLDPNTVALTEQERHRTLVFLGLPESAAALPSERVQEDRKVATKILDHLDVEAEPTAVFRLGRYDPQRTTPRPLKVVMPTPTHGTRRLEA

SEQ ID NO: 155718 - protein, 19 aa, Heterodera glycines
  Coding regions on vcDNA: vcDNA=SeqID_82141; Strand=-; Position=1-58
GLLGSWVRFPPGELPFMFY

SEQ ID NO: 155719 - protein, 104 aa, Heterodera glycines
  Coding regions on vcDNA: vcDNA=SeqID_82142; Strand=-; Position=1-315
MARLFVRPALTKEQLKKKYEERVRKRQLTPTPMAPASSQTNAPTPVVEDGPNQKEASDDISQPPEVFDKTILVCYETLISLPPTDKIVHQIQSLKKQYPHLFNK

SEQ ID NO: 155720 - protein, 153 aa, Heterodera glycines
  Coding regions on vcDNA: vcDNA=SeqID_82143; Strand=-; Position=1 -189,240-294,705-922
MLENQIESLKFSIFFLFISFFIFTMPRGCSANFSSNNKNISNRRVPALQFLETLLKLKDVRVELADFSGDDHNNNLVSFQRADDDDALLIPGRRGGAETHHRHNNFAMAVTKPKAVRTELAATSAAKRMSGAETALMEANLQRALRISNKTIN

SEQ ID NO: 155721 - protein, 33 aa, Heterodera glycines
  Coding regions on vcDNA: vcDNA=SeqID_82144; Strand=+; Position=1 -73,257-285
MPFACSFYVFVTAPLNKQQLMDKCISIIYEIID

SEQ ID NO: 155722 - protein, 31 aa, Heterodera glycines
  Coding regions on vcDNA: vcDNA=SeqID_82145; Strand=+; Position=1 -93,797-799
MMSGQETFDMMMSTSLTFFIIESNFKIRENA

SEQ ID NO: 155723 - protein, 211 aa, Heterodera glycines
  Coding regions on vcDNA: vcDNA=SeqID_82146; Strand=+; Position=1-633
  Homolog annotation: Hit_ID=XP_318550.1; Match level="QueryCoverage =96%, HitCoverage=21%, E-value=3e-38, Identity=38%"; Hit description =ENSANGP00000020240 [Anopheles gambiae]
MDSDADEAAEFVFFANLESLPVSAEEVALCTADEELLQQVIGYVRSGWPSKCPANDLLSFFQKRNTLSVVGGSLLSGNRVVVPASLRKRVLTALHFAHPGIVRMKALARQHVYWPGLDNDIEMLVKHCTDCQSAAKLPKKAPLCPWPTSNQIFGRVHIDFAGPCPDGKTYLILVDSLSKWPEITEMHSTTALHTITALNRIFHRYGFPYVL

SEQ ID NO: 155724 - protein, 66 aa, Heterodera glycines
  Coding regions on vcDNA: vcDNA=SeqID_82147; Strand=+; Position=1 -88,514-626
MSRPLRCQPCQFNQRLVLRDNAAPQYVIRPLIQQNGSLSAAEFEEALPLGSFIKDFYGMALRIVAL

SEQ ID NO: 155725 - protein, 97 aa, Heterodera glycines
  Coding regions on vcDNA: vcDNA=SeqID_82148; Strand=-; Position=1 -45,347-595
MFQNIGSNNLSIRYQRDLCQFVNRIGKMFGFNHLVYNHRIGDATVRFGTNNTAPSLAAVNGIVQRNLISGKALIDNQTKPEDHFAMLKEAWEKGPMK

SEQ ID NO: 155726 - protein, 221 aa, Heterodera glycines
  Coding regions on vcDNA: vcDNA=SeqID_82149; Strand=-; Position=1 -58,471-703,895-1077,1123-1314
MYVIRDKLATQKTAGNMFSAWFLSFCHLSVQIFLWDPIGAESMQFFPSLLKMYFIGIYARNFVPFVVVIELILATLFVRTYEKNRGHLFTVLWAPFALTIPIYIAFSPSPQSEQNQLITNLITTVVHLLIGSIELGIFYQLCRYNSKIYSNNLSIRYQLSENIRIGKQLIPPLSLNLGTIFAGTMILLWDFLDLPFYSQIFNLAAIINSIFGLLIELFIIT

SEQ ID NO: 155727 - protein, 28 aa, Heterodera glycines
  Coding regions on vcDNA: vcDNA=SeqID_82150; Strand=+; Position=1-248
VKCCCCCLVVPLLLLFLLSFFLPHKMSN

SEQ ID NO: 155728 - protein, 149 aa, Heterodera glycines
  Coding regions on vcDNA: vcDNA=SeqID_82151; Strand=+; Position=1 -60,443-831
MAQLVMLLIDTVERFLRFEPIAVFIDYLLTFTLLCPVVVLLSSHQCSAVVVADDQQKHPPLLLTAAASPPVVPSSAGDAEATGKMPPSTAALPCRPVVFMPSSPRSSPLHPTPPPWVHRYARFLHSAQGRLAALCVAALMYAVGTSGVL

SEQ ID NO: 155729 - protein, 34 aa, Heterodera glycines
  Coding regions on vcDNA: vcDNA=SeqID_82152; Strand=+; Position=1 -55,204-253
MTMHTCAFPAFLLLEGSEAMAGALLHQHGDRVFA

SEQ ID NO: 155730 - protein, 287 aa, Heterodera glycines
  Coding regions on vcDNA: vcDNA=SeqID_82153; Strand=-; Position=1 -355,502-596,654-776,820-861,906-1004,1648-1795
  Homolog annotation: Hit_ID=CAE66685.1; Match level="QueryCoverage =58%, HitCoverage=16%, E-value=8e-25, Identity=36%"; Hit description =Hypothetical protein CBG12024 [Caenorhabditis briggsae]
PALPPATKLAFVPSDSGTPMVLPTTKNPAQTDQRTTNGQQSNETMKETTGGHGKDFLDRFNTFVEAQVLLFFGVKMPQANCFVKVARQKAESALQATILSTAVQQHGPSGGELATFSSKLVAERLRYNQRLQRDPNDYEARKALARVDKEMNSWAQDSSLPGEFTGHTGARVLSEKELEPSDPRFHAWAKKFEITMCLDLGYLLMSRASQSVGNLFSGKTPEGPIPVQVYVELSSHNKDQFRTAPEINSGIGLKLLQRMGWQPGQGLGRERAGQLEPLALDVKADRK

SEQ ID NO: 155731 - protein, 48 aa, Heterodera glycines
  Coding regions on vcDNA: vcDNA=SeqID_82154; Strand=+; Position=1 -50,465-561
MREKEKTLSWVKTFFIGVFFGIRVPGPTGSGTGYWIFKKTDPGTGLGY

SEQ ID NO: 155732 - protein, 93 aa, Heterodera glycines
  Coding regions on vcDNA: vcDNA=SeqID_82155; Strand=+; Position=1 -52,113-339
MTHPTFFTLKFRSKIWEAFPSFSDSPSNSRQNWTKEFTRVMALMHAQAMAHFGLTDHQKGQMPIILTVLAMLSDAALVWPLGKLFSPKMDVVY

SEQ ID NO: 155733 - protein, 61 aa, Heterodera glycines
  Coding regions on vcDNA: vcDNA=SeqID_82156; Strand=+; Position=1 -96,216-305
MILLFAQSVPIIEGEMSGKRTHQMYLPFLVISCIQLAFTMIGGIVMFFTLGSKKFIYFILL

SEQ ID NO: 155734 - protein, 112 aa, Heterodera glycines
  Coding regions on vcDNA: vcDNA=SeqID_82157; Strand=+; Position=1-339
MSGRAREITGEMIGRFRRMPEEMTERVKVPEGMTGRGTNPEEVNGRNTEKPEETRGRIIRAKQRWFIRAHIKVRYQEGTDTVTETVSTKDHYSNRNDGMKANFMVLLFGYRN

SEQ ID NO: 155735 - protein, 222 aa, Heterodera glycines
  Coding regions on vcDNA: vcDNA=SeqID_82158; Strand=+; Position=1 -82,142-348,443-634,683-759
  Homolog annotation: Hit_ID=AAP30754.1; Match level="QueryCoverage =88%, HitCoverage=95%, E-value=2e-79, Identity=77%"; Hit description =putative gland protein G11A06 [Heterodera glycines]
SSPSSSVSLLAIVAIFCLLCKCCISAPHPCCPGSQKVVSLMANYVGPCCPGSQKVVSLMANYVGTFAHSFSKSSLCSDAQSVAGALKGQLIGCSKGGDATLLADIEASLATHSADECAHSLGFVRAMFAIAASASSHASNNNEWQALSAQFGQQISEIDSKCAEFGIGIAKVPYDGPKGDHSQRNVHGTDSVIAMPGDHSQRNVHGTDSVIAMPGLAGSHKQ

SEQ ID NO: 155736 - protein, 190 aa, Heterodera glycines
  Coding regions on vcDNA: vcDNA=SeqID_82159; Strand=-; Position=1 -58,107-258,1081-1390,2216-2268
  Homolog annotation: Hit_ID=CAE67772.1; Match level="QueryCoverage =77%, HitCoverage=80%, E-value=2e-09, Identity=28%"; Hit description =Hypothetical protein CBG13347 [Caenorhabditis briggsae]
MVDNNSKTRLDVVKSMENKVQITPRNVVPLADAHELVALANSIQSARDFVKCQAVGKLEMIAEQMEFLRKVYFLYQQCPVGAGADDGEPPQQKCQEQQCRRRFFSLISPDEWGGECALACRQMHFEGAYRLEFDQSWSRVQQNATDEATTKTKMPNSGSQKMQILERVDRLLQASSFSSLMTASMELDGI

SEQ ID NO: 155737 - protein, 21 aa, Heterodera glycines
  Coding regions on vcDNA: vcDNA=SeqID_82160; Strand=-; Position=1-62
QHQLFNLCTATAEGVTRIQHL

SEQ ID NO: 155738 - protein, 433 aa, Heterodera glycines
  Coding regions on vcDNA: vcDNA=SeqID_82161; Strand=+; Position=1 -783,1080-1235,1685-2047
  Homolog annotation: Hit_ID=CAA25702.1; Match level="QueryCoverage =61%, HitCoverage=24%, E-value=2e-45, Identity=39%"; Hit description =unnamed protein product [Drosophila melanogaster] pir||GNFF17 retrovirus-related pol polyprotein - fruit f
MDKVLDDIKNVNVYIDDILIHSNTLEEHLESLDLVFNRLQKYGLKLKGDKCNFLQNKCHYLGHILSEAGYQPSLGNKEVIDKFPEPTNVKEVKRFLGMASFFRKFIPGFASIAHPLNKLTRGNGTEFVWGGAEKAVMDELKQHLLKAPCLRPPNYDLAFYLFTDASAIAYGGALMQTKDNNEMHAVSFWSRTLTPTESKLPPTHGELAAIVHAIQNFRAILYGAELIVLTDHRPLTFLFQKASTNPKLNRWLMALQEFEPKGQFVVPKKLKVAILEQIHKAHFGIVRGKSKARRYVWWPGMSEDIENFLKECEEYRSSPCPILKGNSPAQMFLKREMRTSLDKIRISQVERDKGTPTGDPVRDKGAQNQQRQLPKYEPGDSVWMRDQQDKKWTPAILLEPIGERMWRLEMEGGGERTAHVEQIKARRMVAGRA

SEQ ID NO: 155739 - protein, 167 aa, Heterodera glycines
  Coding regions on vcDNA: vcDNA=SeqID_82162; Strand=+; Position=1-504
MEPVLSDQSRCIAALTDAIDELSLKGTEQSVNPSTDGGPAELAKEAPMNPQGGGPAPELANEAPLNPQGGGPASELAKGRTSPARSTGRAWHGKQHRQPARKAGRLNYLMRQLEREVGGSQMVRSPHPYWENRRGNGYGGPRGGGRGGYNAYRGDRSERVGPSNNGR

SEQ ID NO: 155740 - protein, 68 aa, Heterodera glycines
  Coding regions on vcDNA: vcDNA=SeqID_82163; Strand=-; Position=1 -62,123-267
PHSELGQIVLISNYQKMNRRWICNDVWMDIFPSFDRPQLGLKLALLSPRFNALVDKHFNGKSELTIWR

SEQ ID NO: 155741 - protein, 219 aa, Heterodera glycines
  Coding regions on vcDNA: vcDNA=SeqID_82164; Strand=-; Position=1 -133,182-246,423-884
  Homolog annotation: Hit_ID=NP_504167.1; Match level="QueryCoverage =31%, HitCoverage=26%, E-value=8e-11, Identity=45%"; Hit description =putative nuclear protein, with a coiled coil-4 domain, of eukaryotic origin (5E683) [Caenorhabditis elega
MGLPIIQIYMIVARQLSKPITGYFMGLGKEHPAFRNRVLIPIGKTITNWSTKLRMKNLDLGSPTSVHPFSSGFRSDPSSGHFRLHCRGVLRLFLFHTQRGEGIGKRRGIERAEQKDEPGDNATECAGYGIAGRNANAAEGGQPSTICNKANHHFQDRNWTFPWSGEGKSALRESAVVNPMMPSVVMTDSQPKEQKKDMTKSISRTEALNRLANATETSS

SEQ ID NO: 155742 - protein, 18 aa, Heterodera glycines
  Coding regions on vcDNA: vcDNA=SeqID_82165; Strand=+; Position=1-56
PYRDRDLSFSKPGTGNRD

SEQ ID NO: 155743 - protein, 67 aa, Heterodera glycines
  Coding regions on vcDNA: vcDNA=SeqID_82166; Strand=-; Position=1-204
LDLYRQFRFWANAVANFDCPPNCQFFFSVKMFVHQSIVTVRKQCNFEAKFSTFKRWQNIHPNVATNP

SEQ ID NO: 155744 - protein, 218 aa, Heterodera glycines
  Coding regions on vcDNA: vcDNA=SeqID_82167; Strand=-; Position=1-654
MESNSYYRINIITFIFFVLPNVFFRCCETTEQLQICVKYEKTVAKRETKIALEEFRINNQIKEIKNLPENFQNGECFGILIEPEDEAKVEKFSLTFAISVKPMENEYQPSANENNENQPDDEDIRTMVRRIRFKLYWTNMAKVYTVNLGKIDPPELYFNRTILVDKKNDLANYHALLYAKIHINRQNMSNVLTYNFLGYAHLIKINEEEASSSSSENK

SEQ ID NO: 155745 - protein, 572 aa, Heterodera glycines
  Coding regions on vcDNA: vcDNA=SeqID_82168; Strand=-; Position=1 -553,844-2006
  Homolog annotation: Hit_ID=NP_502797.1; Match level="QueryCoverage =32%, HitCoverage=53%, E-value=6e-32, Identity=38%"; Hit description =HASI (4P602) [Caenorhabditis elegans] emb|CAB16520.1| Hypothetical protein Y57G11C.19 [Caenorhabditis ele
MTVKKIDPKITTDDVNKFLKKQKTYTIHKPIRKRFPRLKTIPSGFHTNWQCDLCIFDQLKKHNDGYKYLLVCIDVLSRMIFSAPAKSKKSEDMIEAFDRVFEKSKIIPMKIYSDSGLEFQAGKMKKYFEEKFIIKNVMYSPDLHAGVVERANRTIKERLYRYFTKKDTLRWVDVIDKIITNINNRISENRWMPYIVLPSNTPGPGNGTSKFTVRLPETLELGTNWSVALSSIIYPYSFTALSINGQEFIKVWENDSSVPTQVYLPDMNFKTAGGLGNKINEAFSHHYKIKKQRGKREAKAEDTKDSKIDVAKRAAERAGRDVERHFNQINNISNSIQTQLNTLRETNPHILEEPDIKIWFDKMVEMGTEIQTSRNELKSFQEEVDKAKNITLEHVEKNDLKKAKKSADVAKGIARQAKTKYTSTLEGYNDKSEKGFSGIVNRLNEALGEHIKRKDIENRQVSEAEKGPQKRERLANEDVQFNYDSIDQKFIVYLSAAVSHIDLSKHLAYVLGFKNTRLFHAEEATYMPDLTGGVRQLYIYAPNLIENTIIGNQMAPLLGIVNVVDDPGSISE

SEQ ID NO: 155746 - protein, 145 aa, Heterodera glycines
  Coding regions on vcDNA: vcDNA=SeqID_82169; Strand=+; Position=1-596
RGHSSLGPIPNANRFFDLPEQPTSSTTSTTTAFLSHSASATQFESEAKTTDERRQRKRVKRSLDELTLDGICNYDNERPLLYCEFAEQKSNEKRRKQKAAEPKRTEDAKRRKSGRRRRRKRRRTGKSERRTKGPNEAAEKQNARR

SEQ ID NO: 155747 - protein, 282 aa, Heterodera glycines
  Coding regions on vcDNA: vcDNA=SeqID_82170; Strand=+; Position=1 -45,90-148,195-249,297-363,405-469,630-744,784-863,952-1075
  Homolog annotation: Hit_ID=P27442; Match level="QueryCoverage=96%, HitCoverage=54%, E-value=3e-57, Identity=48%"; Hit description=GMP reductase (Guanosine 5'-monophosphate oxidoreductase) (Guanosine monophosphate reductase) gb|AAA29373.1| G
MPQILDGIKLDFRDVLLMPKRSQLASRSELLMPKRSQLASRSEVDLNREFVFKNSKATYTGIPIIASFVFKNSKATYTGIPIIASNMDTVNMDTVGTFEMAETLSQSNLFTTVHKHYSVEEHKHYSVEEWKEFANRVRNNSNVLNNIAISSGSRSDDLTKMRDICDAVPEIKFICLDVANGYSETFVDFVRKVREEFRTSTIFDVANGYSETFVDFVRKVREEFRTSTIFAGNVVTKEMVEVTKEMVEQLILSGADVVKVGIGPGSVCTTRKQVQPTAPCPT

SEQ ID NO: 155748 - protein, 21 aa, Heterodera glycines
  Coding regions on vcDNA: vcDNA=SeqID_82171; Strand=+; Position=1 -54,212-223
MIDIEEEEPLLEKMDKDGKNR

SEQ ID NO: 155749 - protein, 188 aa, Heterodera glycines
  Coding regions on vcDNA: vcDNA=SeqID_82172; Strand=+; Position=1-569
  Homolog annotation: Hit_ID=NP_702063.1; Match level="QueryCoverage =95%, HitCoverage=6%, E-value=7e-17, Identity=20%"; Hit description =hypothetical protein PF14_0175 [Plasmodium falciparum 3D7] gb|AAN36787.1| hypothetical protein [Plasmodium
FQSLALNSPTFQSLGLNPPTFHSTGLNPPAFQSLGLNPPTFQSLALNSPTFQSLGLNPPTFQSLGLNPPAFQSLGLNPPTFQSLGLNPPTFHSTGLNPPAFQSLGLNPPTFQSLALNSPTFQSLGLNPPTFQSPGLNPPAFQSLGLNSPEFKSLDSISSILQQHNYRDSVLRHFNHRNSTSATEYRTI

SEQ ID NO: 155750 - protein, 225 aa, Heterodera glycines
  misc_feature (10)..(10): Xaa can be any naturally occurring amino acid
  misc_feature (40)..(40): Xaa can be any naturally occurring amino acid
  misc_feature (60)..(60): Xaa can be any naturally occurring amino acid
  misc_feature (130)..(130): Xaa can be any naturally occurring amino acid
  misc_feature (224)..(224): Xaa can be any naturally occurring amino acid
  Coding regions on vcDNA: vcDNA=SeqID_82173; Strand=-; Position=1-688
  Homolog annotation: Hit_ID=XP_521405.1; Match level="QueryCoverage =92%, HitCoverage=92%, E-value=5e-33, Identity=42%"; Hit description =PREDICTED: similar to putative N-myristoylated protein (4I499) [Pan troglodytes]
SVAEVGSGDXNVGELSPGNCGIDEIESSDLNSGELSPSDXNAGGLSPGDWNVGGLSPSDXNVGELSASDWNVGGLSPSDWNAGGLSPVEWNVGGLSPNDWNVGGLSPSDWNAGGLSPSDWNVGGLSPSDXNVGELSASDWNVGGLSPSDWNAGGLSPVEWNVGGLSPNDWNVGELSASDWNAGGLSPNDWNVGGFSPVDWNVGGLSPGDWNVGGLSPSEILVGXV

SEQ ID NO: 155751 - protein, 712 aa, Heterodera glycines
  Coding regions on vcDNA: vcDNA=SeqID_82174; Strand=-; Position=1 -698,1596-3033
  Homolog annotation: Hit_ID=NP_510671.1; Match level="QueryCoverage =64%, HitCoverage=45%, E-value=4e-66, Identity=35%"; Hit description =predicted CDS, endonuclease/exonuclease/phosphatase family and RNA -directed DNA polymerase (XR69) [Caenor
MFGKRPSSHLSPLSDNASKKSTSDYPYTALSDQLAAISQQMDNNSVDPITKQLLKICVELLQQVQQQQTVISEQDLQLQHFKQQKMMEEAIQDHERRRSVVVMGLPESQKQKPSERVAEDRTAISGVLDELGIESPITVYRMGSPDQAKTGQNRPRLMKVIFGCSKHQKQTLAQWNKGRAQINQKLGMSNIRIRPSLSQEELKARRVLQEECSRKRKEDGGEWVVYADKVMLRISALSNEHFSVNEKYNAFNNTLLETLNECIPMKKITKKDLTPKYPTHLLASIKEKARLYRQCKTDPTKKALYDSISLHIKIQTNKFHSQIEKKAISKGRNSIFKYLQKYDVNPFEIPNLVFENKCYHDGDEKCELLANLFANSFNNSDVDPGYLNLGNTFVNQCFISDIDFNIIETQKLLKKLPNKNGTSPDNISYKILKNCHSSLATVITDLFRISLDSGSLPDIWKESIVFPLFKKGDKFNPENYRPISITCSLCRVMERILSQNIYNFLLKNNKISEYQFGFVRNRSTTSQLITVVEDWYEAIINGKNVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDVKLYICYKARADTEIMHKALHNLFEWANKWQIKVSMQKTFVLYLGSKNPKETYKFDGNTINAVDTIRDLG

SEQ ID NO: 155752 - protein, 188 aa, Heterodera glycines
  Coding regions on vcDNA: vcDNA=SeqID_82175; Strand=+; Position=1 -240,610-746,1364-1553
MREFCAHLQTLGFRMIPGLFGSGSGKCPKKGAQALLVGIFPKKKEKEKEIKRVEASQPMVKWLLCLLLVAWSLWFESHCDINKYLQVQDKQSGEQVVSMPFFVGVVYRVRFPLILIIKLFNFFFDKTKKYERGTESGRGRGRETKRGTEKEIEEEQKVEEKQKVEEEVEDEQKEEDKVEEKQKVEEEV

SEQ ID NO: 155753 - protein, 286 aa, Heterodera glycines
  misc_feature (13)..(13): Xaa can be any naturally occurring amino acid
  Coding regions on vcDNA: vcDNA=SeqID_82176; Strand=-; Position=1 -269,459-573,601-787,892-1087
  Homolog annotation: Hit_ID=NP_505905.2; Match level="QueryCoverage =91%, HitCoverage=44%, E-value=4e-49, Identity=42%"; Hit description =amino acid permease-associated region family member (5L944) [Caenorhabditis elegans] emb|CAA98529.2| Hypo
LRGEIFIRSRKNXNQKVKETHLKTKIQTVAGNGINIWILTPFSLQIGLSLLISLLAAAATTLGAFCYIELGTSIRRSGSDFAYLSYVKWRPLAFMFMVSGSVLICPLYSAIQADTFAEYFVQGLGLDHNSAAAFALRKLIALCSVWLIIFLVQGLGLDHNSAAAFALRKLIALCSVWLIIFLNFFSLRSVVAPFQLVTSVAKFLSALLIIGIGFYWLLFKGYTENLRQPFANSSFDVGNLTNALFAGLFNYDGCDVLNYGIEEISNPARRIIIIIIIIIIIIIIIF

SEQ ID NO: 155754 - protein, 41 aa, Heterodera glycines
  Coding regions on vcDNA: vcDNA=SeqID_82177; Strand=+; Position=1 -81,195-239
MHELVPKLFVGYDRNARPISKDGKPIEIQSLLVVDHIEQLV

SEQ ID NO: 155755 - protein, 53 aa, Heterodera glycines
  Coding regions on vcDNA: vcDNA=SeqID_82178; Strand=+; Position=1-159
MSPPKRAKVSADDDGETISDDGEPSTSAGAKRKQKASKPRQRKAHEAFILLVD

SEQ ID NO: 155756 - protein, 63 aa, Heterodera glycines
  Coding regions on vcDNA: vcDNA=SeqID_82179; Strand=+; Position=1 -126,465-528
MQKDETHVMQNGRNRTNHDEVHSVDEAHDHVSGAVGDAHHDDVSSVTESVLPLYTFFCICIYA

SEQ ID NO: 155757 - protein, 185 aa, Heterodera glycines
  Coding regions on vcDNA: vcDNA=SeqID_82180; Strand=+; Position=1 -375,505-615,673-744
  Homolog annotation: Hit_ID=CAE69470.1; Match level="QueryCoverage =83%, HitCoverage=14%, E-value=2e-26, Identity=44%"; Hit description =Hypothetical protein CBG15666 [Caenorhabditis briggsae]
VAESCFQVADDAKRQSAEHLKVTTDGPGVSQATTAALREKPMPTEKPPSDAEEEESSSAASSDEEEEEDESSVGVAVAKETREDLFARVRAKITVRLCETSSPNDELGIARFRSARNWPIPNAVSIRRSNVQEGEAGGITQQMGATRVPGQAIKERSKMVKNFCADSMQIPGFLIIDTPGHESFA

SEQ ID NO: 155758 - protein, 148 aa, Heterodera glycines
  Coding regions on vcDNA: vcDNA=SeqID_82181; Strand=+; Position=1 -156,299-429,804-876,1006-1092
  Homolog annotation: Hit_ID=NP_497536.1; Match level="QueryCoverage =69%, HitCoverage=8%, E-value=6e-31, Identity=60%"; Hit description =translation initiation factor (133.2 kD) (3D415) [Caenorhabditis elegans] gb|AAK68893.1| Hypothetical prot
VRSLPGLGTTIDVILINGTLRVNDIMVLTGSDGPIATPIRDLLMPQPLKEIRNDYEHYKEIGGAQGVKILAKGLEKAIAGLPLYVATTEEELEVLNSNDAERKRRQFDDEQQQKQQHPLLCHVGEVADVQRVRLVVPTHRSNRNSISM

SEQ ID NO: 155759 - protein, 97 aa, Heterodera glycines
  Coding regions on vcDNA: vcDNA=SeqID_82182; Strand=-; Position=1 -150,296-439
MVKKIPNELLFEIIGAIPFDKKWAQIHVCQVFNHFLFNRMGSWLSQSKNLVAKCMFLFRSIVKMIRSLPDNLLSVNADSRKHFEASKFVNGFNSTKK

SEQ ID NO: 155760 - protein, 77 aa, Heterodera glycines
  Coding regions on vcDNA: vcDNA=SeqID_82183; Strand=+; Position=1 -80,231-384
MKSLLINRNRMDHLQKIWQLCDNLFGRQWHILSSKFLAPDDTLHWAMSPRLLNVVLWADMHVFGGDDWKNIHIGTIR

SEQ ID NO: 155761 - protein, 61 aa, Heterodera glycines
  Coding regions on vcDNA: vcDNA=SeqID_82184; Strand=-; Position=1 -42,312-455
MQPISPIKDLKQSMTKDTESSMRSLKTIILKIGAEKRSAETGAPAKEYEAGRFYEGKKRIK

SEQ ID NO: 155762 - protein, 356 aa, Heterodera glycines
  Coding regions on vcDNA: vcDNA=SeqID_82185; Strand=+; Position=1 -423,468-725,778-1167
  Homolog annotation: Hit_ID=XP_479365.1; Match level="QueryCoverage =78%, HitCoverage=18%, E-value=1e-40, Identity=36%"; Hit description =helicase-like protein [Oryza sativa (japonica cultivar-group)] dbj|BAD32013.1| helicase-like protein [Ory
MRTAAGEQSLRDWLQEIGNGMHRVGTDSQGFTNQLRIPPELLVDDLDHTIHFCFPEALFDDPLANADAIAHNAILCPTNNDVQHINEVALGRMSGCGREFLSIDEPLEPNEEMHNFRTDFNMEAVHNEMPSGMPPHKLTIKVGTPVMLIRNLDVTQGLCNGTRLQVMRTSENNLFCRILTGPRAGAQNIIAIPQIQFEYGRARHHRGLRFRRLQFPVRLCFAMTINKAQGQTLQRMALVLNGRQCFSHGQVYVAMSRVTQMDGIRVYAPLCQSGYGTHIENVVYHELLDLEPQQPRTPIRGLIDVDNDMDVAIPDVGTRVPDVDNDPDVERDNGNAAGANDQEPNDLDSSFDDFFD

SEQ ID NO: 155763 - protein, 94 aa, Heterodera glycines
  Coding regions on vcDNA: vcDNA=SeqID_82186; Strand=+; Position=1 -130,186-340
MAAEWLQKIDFVVPVETTKAVGWHQIVGHPVDLEWHAADPSPKEQNYEEKKQPKESIFKNEKGGTIGRAKGEKICQKKHHLLLMNHFYFGIYKH

SEQ ID NO: 155764 - protein, 290 aa, Heterodera glycines
  Coding regions on vcDNA: vcDNA=SeqID_82187; Strand=+; Position=1 -29,288-1131
MGMSLPLAPKASPNGSDRSAQTAHSRTTRQSQTPPAHLVVNAEHEPHDNQAGLLIAQRQPNAQQRDWFGRFNAVTSAQKLDDLLAHLVVNAEHEPHDNQAGLLIAQRQPNAQQRDWFGRFNAVTSAQKLDDLLDEFTNAVRQQAQATFTQRPAQQQRRPRQLPNQHGRRRNQMNADDGPPFDTVAAKSCTALHARERTGRLLSRRHHCASSRLKCFMGISQTCSAPARLSPSKCPTPCHFTSRPATTARSQPTNNSEVRLKRCSAATPHRDPTTSATRCGKGLARLPYAH

SEQ ID NO: 155765 - protein, 739 aa, Heterodera glycines
  Coding regions on vcDNA: vcDNA=SeqID_82188; Strand=+; Position=1 -346,533-625,680-842,897-1172,1216-1346,1402-1518,1584-1869,1972 -2080,2177-2308,2554-2840,3018-3131
  Homolog annotation: Hit_ID=CAE57746.1; Match level="QueryCoverage =94%, HitCoverage=16%, E-value=1e-94, Identity=31%"; Hit description =Hypothetical protein CBG00759 [Caenorhabditis briggsae]
AKTQSKTFSPSINTTKAPELVQPYPPGAFDYGRKRQTKVTIGLDSLFSVPLELNRREPDLRARSLHSLLQLLQVFDAGTMATQPRAILARMHEQLRELRREGNAQVSVVANACMMSLAVASGQPEFLFASVLALLCESKRCVPFNQLANLANSTSPLPRNFHSLALSVHRRIVGTKSGQISRWISEPLEQRPIVCEFDVIYTGTSDGFVRAKSDGFVRAKCDDKKPPFFCLCEGAYVYLLTVYGFFKLGTGLCETRAGEVMVCNESVRFSDGSALYVSNGSLYLRHRHSARLWVLDTETLREIGEILLPSALISHLLFSDGRQFWREIGEILLPSALISHLLFSDGRQFWVASLDDQWHLAFTPLDDSFGPAKKPRGRRNRLMDCEFCAFAKKPRGRRNRLMDCEFCAFGELEETHDQLLRSIPEKLRGVTADLQLGPGVAFLLSRSGKVFFAISSSDSDFGLCSKTPFCWNRLDVPESIVSMALDSNSKTLVLRSGAGNLWLVGEQRTKALGKSPKAQQNKESSLSVASVGGGSLAFVTEMGRVFLLGRHVLNTAQQSQTVTVPGMDNIPLAQVALGKTHLVGIAKNGAVYATGLNNQNQCGRTSSSNSQSVSSSTSSSCCQFCSPSQHLFVDDLAFLCVRCGQCSVRGIACPFSNYKRTAGTACACAKNGPSCCVRCGLCRECAQADKRSHATRGKHQPRSAGVTATTRIFPLERVLLQPQPNIKVATVSVGNFHTV

SEQ ID NO: 155766 - protein, 22 aa, Heterodera glycines
  Coding regions on vcDNA: vcDNA=SeqID_82189; Strand=+; Position=1-67
MSWMGLWWLAVVVVFHLLVLCL

SEQ ID NO: 155767 - protein, 34 aa, Heterodera glycines
  Coding regions on vcDNA: vcDNA=SeqID_82190; Strand=-; Position=1 -57,405-452
MPNMDKYGNMDINREIWKVANRESEELSNDNKNF

SEQ ID NO: 155768 - protein, 49 aa, Heterodera glycines
  Coding regions on vcDNA: vcDNA=SeqID_82191; Strand=+; Position=1-241
RVYSYSATPKTLKILNYTHFVFINFEKFWTFRGFLLFWTFRGLDTLWGC

SEQ ID NO: 155769 - protein, 99 aa, Heterodera glycines
  Coding regions on vcDNA: vcDNA=SeqID_82192; Strand=+; Position=1-300
MKLFISNAFPLLALSLLVWLLRADQGKLEKRNTAEVTMRNGNAMALNEQWEFKAQPQELDRMAVAIMARKTLAFVTKNIHWHLLFFFDGQYTKMRLWAY

SEQ ID NO: 155770 - protein, 201 aa, Heterodera glycines
  Coding regions on vcDNA: vcDNA=SeqID_82193; Strand=-; Position=1 -142,1449-1912
MKILLTFLLSCIILLHPEVNGNQFNEVVVWDAKCRKHIREVEILAKYENSANLSRALNNLTNEIRQNVRCELSYAIHKNYISDANQKNNKFDASNSHFMYELDKINKISIDQSTNTLPTALIWINQLRTDFATLVPEIGLVDIWQNVDSYTETRKSMEQLYQKIATIQTDVFYSGSNLVNQIISEAKDKLEDFKEKSGGSN

SEQ ID NO: 155771 - protein, 71 aa, Heterodera glycines
  Coding regions on vcDNA: vcDNA=SeqID_82194; Strand=+; Position=1 -11,859-1063
MCGRRAISRLASSLSNCWLSFCLASPFFCCSWPFIGVCAGLRHAKSAVQNNSNKQLKKHKKLINKWPKKNR

SEQ ID NO: 155772 - protein, 124 aa, Heterodera glycines
  Coding regions on vcDNA: vcDNA=SeqID_82195; Strand=-; Position=1 -235,829-968
MDEPKAEKFVSDPNKSNGTVSMEIEKLSEFAREIYGSGSKSETVYIKGVPWKILALITKNESTEKWLSFYLWCDFTEKVFFYPKIFQGHAHCQFFILKSFRLSDEKLKLKIVLIVKPFEGRLPE

SEQ ID NO: 155773 - protein, 33 aa, Heterodera glycines; identical to SEQ ID NO: 126272
  Coding regions on vcDNA: vcDNA=SeqID_82196; Strand=+; Position=1-101

SEQ ID NO: 155774 - protein, 142 aa, Heterodera glycines
  Coding regions on vcDNA: vcDNA=SeqID_82197; Strand=+; Position=1-428
MQNEKNNSDDEHFYPQQQQQQQSLAQLVENRIQLGTAIDEGGEKPPPQQQQQQHSRELAMAIVDPSGGTTTTTPATLTVKEEQQPQQMNMEHQQQTHFVAAPTSSSAAGTAQTMPNAAQPQQQQQQQMNSLESPCGGCRELK

SEQ ID NO: 155775 - protein, 347 aa, Heterodera glycines
  Coding regions on vcDNA: vcDNA=SeqID_82198; Strand=+; Position=110 -183,239-709,779-986,1033-1323
MTSKRNGNTEQAGPSTKKWDFRSIGNNFTEEMENYKLIDERSTICEKFGFTKNITEFRINSDVRRPDEAMRDAIDTMIKAAFKTTEERMKRKVRMFGVAITGAGLASPVWVPYRAYPQNNADVIMQEINKLGQSGDGDENKKTLLLSEPIMMKITCVTLPSGEGPRNVHKFDFGFKEHQRIIISNVDKFCLFYALASSMNYLIMDRFAFNRFMNNIMRQRDAATELLRNCGIDINEYSYGVEHLSRVQNYLDEIYPGKYRVVAFEKSADPRKSIRVLWKGPIGRENVVPIFLENGHWDGLKNYVCFFNRGRKFCKAGALELPLSLYNLIVFSSFNNYSFSLILSSLL

SEQ ID NO: 155776 - protein, 231 aa, Heterodera glycines
  Coding regions on vcDNA: vcDNA=SeqID_82199; Strand=+; Position=1-696
MKRTNASNITPPRAKRAMPPALDLDQNTATLEEQERQRTLVFIGLPESNAIRPSERVQEDREAATKILDHLEVEAEPTAVFRLGRFDPQRTTPRPLKVVMPTPTHQHVALGGWKYERARLRSQQNLTRLFVRPALSKEQLKEEYEARLRKRQQNPAPMAPATQLPQTNAPTPVVEDGPNQKKTSDDIPKQPEVFDETILVCYEALNSFPPTDKIVHQIQSLKKQYPHLFNK

SEQ ID NO: 155777 - protein, 28 aa, Heterodera glycines
  Coding regions on vcDNA: vcDNA=SeqID_82200; Strand=-; Position=1-85
MASVDTEKDRDVCLCPPAPLTLRPIRLG

SEQ ID NO: 155778 - protein, 694 aa, Heterodera glycines
  Coding regions on vcDNA: vcDNA=SeqID_82201; Strand=+; Position=1-2085
  Homolog annotation: Hit_ID=NP_510849.1; Match level="QueryCoverage =89%, HitCoverage=45%, E-value=1e-126, Identity=39%"; Hit description= predicted CDS, zn-finger, CCHC type and RNA-directed DNA polymerase and Integrase, catalytic domain cont
MPPPHDLQTLRSFLGALNYYGRFIKQMRELRAPLDELLKKDVPWHWEEKQQTAFEQAKSIMQSDMLLTHYDPSKPIIVAADASKDGIGCTISHKFPDQSEKVVEHASRSLSPAEQNYSQIEKEALSLIFAVQKFHRMIYGRRFTLLTDHKPLIAIFSSKNGIPIYAASRLQRWALILANYDFEIKYISTNCFGQVDVLSRLVAKQRETVEAEERVIASVDKTSLPISDDSALDESETAAVEYIFMANIDQLPVTADEVAEHTQLDTTLRKVFDFCRNGWPKKSPSDLSAFFTHRHKLSEVNGCLLFGERVVIPAALRQRILAALHFTHPGIVRMRALAQQHVYWPRMDLDIERWVRHCIDCAMAAKTPTKTTLSPWPRTNKVYERIHMDFAGPCSDGNLYLIIVDAFTKWPETFQVKSTSADNVIVQLEWLFSRYGFPREIVTDNGPPFHSKDFSHFCRIKGIKQTFSPPNHPQSNGQAERFVDIFKRQMKKCSHGDKKWITNSLLAYRNTPNAALKGQTPAELFLGRSPRTQLSLLKPDISCSNRNQNDYTNNMPKQFDRKHGARHRTFAIGDDVLIINYRNNKKSWLQGKVVSGSGVIWKIKVPVLGNVIVRRHTNQMRNFFQFPKKVKMEMDPAHSMVLLVLFKSATFVSLMKWIKTVPLLETNNKSPMSPTNKSKSGVPTVNGVQQRNWI

SEQ ID NO: 155779 - protein, 18 aa, Heterodera glycines
  Coding regions on vcDNA: vcDNA=SeqID_82202; Strand=+; Position=1 -18,538-576
MDIGRKVHLENIKQKIFL

SEQ ID NO: 155780 - protein, 91 aa, Heterodera glycines
  Coding regions on vcDNA: vcDNA=SeqID_82203; Strand=-; Position=1 -69,685-891
  Homolog annotation: Hit_ID=NP_495963.2; Match level="QueryCoverage =59%, HitCoverage=9%, E-value=9e-12, Identity=59%"; Hit description =putative protein, with at least 2 transmembrane domains, of bilaterial origin (62.0 kD) (2J501) [Caenorhab
MAPRYSVGQVLELVEKMRNAIPVDLSKHIVDLHKFAAVRMRFSKGFVFACVQAANEFEEQRTRFFAENEMRDDYMEVLTLSIEKSAIDQRC

SEQ ID NO: 155781 - protein, 73 aa, Heterodera glycines
  Coding regions on vcDNA: vcDNA=SeqID_82204; Strand=+; Position=1 -88,743-876
MEELFFSVDGIEYNTVKRISNCEGQPQFRGPQTEEGVPMPMFWLASSKAGKEERQKMKKKCQKKKKKYSLTFY

SEQ ID NO: 155782 - protein, 140 aa, Heterodera glycines
  Coding regions on vcDNA: vcDNA=SeqID_82205; Strand=+; Position=1 -57,126-295,1868-2063
MTIYTVFTFFGQLIFAIFMVFVYVTATNFVDEQNNRYSYAQKWFNISLEMDDLLFIANFNQYPWVNDLATVAIPACFRNDHFKQKRNPTEEEKHGQILAIYFKNWTVMDSIENTRRTKGNCEKCRRNYSNISSVNCFIHY

SEQ ID NO: 155783 - protein, 35 aa, Heterodera glycines
  Coding regions on vcDNA: vcDNA=SeqID_82206; Strand=-; Position=1-106
VVSFNFMMRIIFRNSQLLDSLITLWSTDTDKHLCP

SEQ ID NO: 155784 - protein, 39 aa, Heterodera glycines
  Coding regions on vcDNA: vcDNA=SeqID_82207; Strand=-; Position=1 -34,373-458
MSLRGFSSYICGGIFLGAIDFEFQMINIEFYNYFLSNIV

SEQ ID NO: 155785 - protein, 181 aa, Heterodera glycines
  Coding regions on vcDNA: vcDNA=SeqID_82208; Strand=+; Position=1 -235,276-586
MKKFLFLTIIILLLSNTHSSNKQRHRKQRAVSALARLTVALSRIGTYIKAHPYITASTILMEMGSVSLNIYLLIQEIKACEEKQILKDFFPFVLTLNSYEFSVNVDDYNPGYIFGKINTEIGRPVEEICFAGQPQKINSLKNSFKAPNKVTRKIRNRKDDLGILLLYAIRQQSRLELFECP

SEQ ID NO: 155786 - protein, 84 aa, Heterodera glycines
  Coding regions on vcDNA: vcDNA=SeqID_82209; Strand=-; Position=1-255
MATRLLGICNLGTRLLGIPTFGDPTFGDPTLRDPDIWGSRHLGTRLLGIRHLGIPTFGDPTFGDRTTFEQKTLKKTTDIWQPDI

SEQ ID NO: 155787 - protein, 232 aa, Heterodera glycines
  Coding regions on vcDNA: vcDNA=SeqID_82210; Strand=+; Position=1 -573,821-946
MRETQINLTAIRVNSKNEYRNIKENIKIGECFDISIPQQENNKTKKITFQFTIYVKPLENEYQPPADDHDENPSDEGPYENRILDIKMDDIRTMVRRNNFVIHEPNPSMVYTFNLGKIDPPGFLWKRKIFVLPENDLSNYHAFLYAVAYRNQRIQDNLNSKICTKLLGYAPFVKIDKEIAPTFETDDKRVELNNEYQLTIPIDASNLFKHYIFGFNLVIYSYEKVNHYLYKH

SEQ ID NO: 155788 - protein, 185 aa, Heterodera glycines
  Coding regions on vcDNA: vcDNA=SeqID_82211; Strand=-; Position=1 -465,725-815
LLPPEIAGEQLRFIGLVFGQLLFRENPIFDEAKNEFHFSANIEPEIDAFNPTECQLISNQFDRQLNAQLTQLIGQPLDNPEESKNEENFCAFFEFLVRRIANDQMEPGDKEKWAELEQKSLLIAKYGPEFPLIAPIMRAFIVFGTDAPKLIVLYKALLGGFINEAQLDAFLGEYFDSKTLKLETK

SEQ ID NO: 155789 - protein, 228 aa, Heterodera glycines
  misc_feature (2)..(2): Xaa can be any naturally occurring amino acid
  misc_feature (33)..(33): Xaa can be any naturally occurring amino acid
  misc_feature (40)..(40): Xaa can be any naturally occurring amino acid
  misc_feature (119)..(119): Xaa can be any naturally occurring amino acid
  Coding regions on vcDNA: vcDNA=SeqID_82212; Strand=+; Position=1 -108,376-690,740-857,914-995
  Homolog annotation: Hit_ID=XP_416560.1; Match level="QueryCoverage =83%, HitCoverage=19%, E-value=1e-29, Identity=38%"; Hit description =PREDICTED: similar to chromodomain helicase DNA binding protein 1 -like [Gallus gallus]
FXRKNKTKTFPFFKSFFNAKQKQNATYCDRCGXNEEDITXLIDLGLKLRKHQIEGIKTLLSWHKEGHGGILADEMGLGKTCQAIVVGAILADQIGKRMRMLVICPLSVISHWETEVSRXAYGSSFVSCYILHRPFNFLVRKSLEKMSHWRKSLEKMSHWNVLLTTFEIFLNDHRNLPFKSWDIVVFDEAHRLKNSESLTHQAHRLKNSESLTHQALSNCKFDWLLMMT

SEQ ID NO: 155790 - protein, 117 aa, Heterodera glycines
  Coding regions on vcDNA: vcDNA=SeqID_82213; Strand=+; Position=1-354
MERKCRQSPVPGAAEHGYKFGGMDFVDHIEFNPCSDVGEPFDERQSRRDLHTGPPRRRGDFYGLDYTTMLPDGQWRQPTEWEAEDAQNYHGYQALPPRKNFRLCGRYTADPDAPLNM

SEQ ID NO: 155791 - protein, 181 aa, Heterodera glycines
  Coding regions on vcDNA: vcDNA=SeqID_82214; Strand=-; Position=1 -61,116-598
  Homolog annotation: Hit_ID=NP_492824.1; Match level="QueryCoverage =88%, HitCoverage=66%, E-value=3e-24, Identity=38%"; Hit description =vamp-associated protein like family member (34.3 kD) (1L383) [Caenorhabditis elegans] gb|AAC17524.1| Hypo
MNFPLILLLSLAFCALIIEAYPKNDGPIVRREADNEKAAKAQPGKEEKQAVKAEEKEEEKPKDKKEKRGAEAEEQKEGGEKKGEEKPKGKKEKRAAEKEEKKTENKEAEKKENEEQKPAGKKEKRAAEKEEKKSESKEAEKKENEEQKPAGKKEKRAAEKEEKKSESKEAEKKENEEQKPA

SEQ ID NO: 155792 - protein, 229 aa, Heterodera glycines
  Coding regions on vcDNA: vcDNA=SeqID_82215; Strand=-; Position=1 -93,291-710,1053-1229
MRENRALPGLWNFPYIWMFEQIRQRANEFDIIHFNTIEHLVHMKPYIHKALTTLHAQPGGSTVDNELLSQLTAHQQLFDGANVAVSSDQAAKSLKAKKALRFCQLHIVKSYNGTSNQWQQIANEYVKIYRTISRLNELKNVKASLLPAVGSSSIANGSLAEAKNQEQKLMLCENVYDILNKSKPLRIAIVTPPILDALPPTKGGGTERMVYFLTEQLAQRGNKVNTILV

SEQ ID NO: 155793 - protein, 230 aa, Heterodera glycines
  Coding regions on vcDNA: vcDNA=SeqID_82216; Strand=-; Position=1 -332,421-550,717-947
  Homolog annotation: Hit_ID=ZP_00195516.2; Match level="QueryCoverage =89%, HitCoverage=50%, E-value=1e-39, Identity=46%"; Hit description =COG0438: Glycosyltransferase [Mesorhizobium sp. BNC1]
MENVTHKFLGIFDLNWIGTVHNGIPLDQLTFRPNPGTSECPYLAWMGRMAPEKGVDIAIEFALRSGIKLKIAAQLVDEHKHSYWHKQIEPLINANQHLVEYVGEIGGDERDSFLGNALAFLFTPKWDEPFGLSMIEAMATGTPAIANRRGAVPEIVQIGRNGYTFDYKDRLGVEQVAKFVHLINQAAKLYRATVRQTVEEKWSLDKMAENYEKVYRRMLNKNFIANCHDH

SEQ ID NO: 155794 - protein, 178 aa, Heterodera glycines
  Coding regions on vcDNA: vcDNA=SeqID_82217; Strand=-; Position=1 -93,307-727,843-865
MRENRALPGIWNHPYIWMFEQIRQRANEFDIIHFNTIEHLEHMKPYIHKALTTLHAQPGGSTVDNELLSQLTAHQQLFDGANVAVSSDQAAKSLKAKKALRFCQLHIVKSYNGTSTQWQQIANEYVKIYRTISRLNELKNVKASLLPAVGSSSIANGSLAEAKNQEQKIKVTNVPGEK

SEQ ID NO: 155795 - protein, 104 aa, Heterodera glycines
  Coding regions on vcDNA: vcDNA=SeqID_82218; Strand=+; Position=1 -53,347-608
MNHRKYNSLYNIDCKKDVSAANVGPHMSVALRIKGKLPFIKIVQNRKDKQNNQQKIETIHKFDAIKEKLKQKGKYQWENSSKIETKIGKLLGANCQKYTNGKKN

SEQ ID NO: 155796 - protein, 324 aa, Heterodera glycines
  Coding regions on vcDNA: vcDNA=SeqID_82219; Strand=-; Position=1 -120,866-1151,1561-1742,1809-1913,2007-2216,2268-2339
  Homolog annotation: Hit_ID=CAE61109.1; Match level="QueryCoverage =75%, HitCoverage=50%, E-value=3e-16, Identity=24%"; Hit description =Hypothetical protein CBG04866 [Caenorhabditis briggsae]
MEVYKSLGVDLVVLHIVSALSAVFKLIKAYEAEGRLAVRMGFKLPILKAMNFDPELQIEYSGQLAMAHECFYEFRESAKFISLLDLDDLLVTTQFTSFGDALNAALLQHPRAPFFYINKLESGILLPRHKKESSRNFVNNFRELIFTKKLYNSEKLVLRPPLIDAFWVHLTRHYKGKDKPVQLSTEYMAILHLSKDIRANATNGYNDKLLTNFDGQLGNGSAFLNDTKIMKIIGHMPKRHYYFDAIRHCSRFINNYPNGIFTIPSPCLSYKLCDLPKAKVECTVTKSKYYRSTIMPIQVYRVHVLKRTLFVKRKGGCFARKLRF

SEQ ID NO: 155797 - protein, 63 aa, Heterodera glycines
  Coding regions on vcDNA: vcDNA=SeqID_82220; Strand=-; Position=1 -55,117-217,957-992
MLLRFSLTVQLLLLFFAFEVFGADPPEGTQNEEAQRDNKRLEMARKGLNVHMNVYFFPFIVIM

SEQ ID NO: 155798 - protein, 29 aa, Heterodera glycines
  Coding regions on vcDNA: vcDNA=SeqID_82221; Strand=-; Position=1-89
VYAYTNSTLQLAILSTFTELLYRFQDIAI

SEQ ID NO: 155799 - protein, 356 aa, Heterodera glycines
  misc_feature (15)..(15): Xaa can be any naturally occurring amino acid
  misc_feature (24)..(24): Xaa can be any naturally occurring amino acid
  misc_feature (38)..(38): Xaa can be any naturally occurring amino acid
  misc_feature (100)..(100): Xaa can be any naturally occurring amino acid
  misc_feature (102)..(102): Xaa can be any naturally occurring amino acid
  misc_feature (252)..(252): Xaa can be any naturally occurring amino acid
  Coding regions on vcDNA: vcDNA=SeqID_82222; Strand=-; Position=1 -197,337-700,750-948,1000-1089,1168-1297
  Homolog annotation: Hit_ID=CAE68086.1; Match level="QueryCoverage =91%, HitCoverage=61%, E-value=1e-32, Identity=32%"; Hit description =Hypothetical protein CBG13719 [Caenorhabditis briggsae]
LSGPIPFELNVFTIXGANCRLLWXSFAFSLPICPPPPXELFESRPCVVAIFRLLPAFAQQSVLQLICPAPFSSFSDCAFWKAIRTATFKLVSSFHLNFTXIXKLPQLDFRMNYVSSLLANPLELSNLKMHHLDEEKARKATKDLMGKSVERWESILCYLALPSEAAEKSVSETTKDLFQFIGLVRGRAKEPAKEPEISSIGFQFLLLGRSEQIWAYLIHYMRFIASKGEEVFPVLDFLLRLTLCINGDDGIXLELIQLDPNWPEIVQAFVVTLRELGLIQLDPNWPEIVQAFVVTLRELGLIFIRKRKDGWFLLTWFLLTPLMTQLSVAASAEALEENAGQNGVALQFSTYKFTRQ

SEQ ID NO: 155800 - protein, 56 aa, Heterodera glycines
  Coding regions on vcDNA: vcDNA=SeqID_82223; Strand=-; Position=1 -114,561-617
MIPTMFDLVDKEKSYSPKTALAPKRAAPKRVCPLKIDSLSANSFNLLNCLTMSCIL

SEQ ID NO: 155801 - protein, 98 aa, Heterodera glycines
  Coding regions on vcDNA: vcDNA=SeqID_82224; Strand=+; Position=1 -147,523-611,663-723
MDPKSKKEEKAGSVAGAREDARESLQLRAEQHIELHSYRDATDVNYQRMVPDQGLGAAQRVHDPHWHTLPDDDAQFRGRKIPGRIAQAEAEEQKTCKR

SEQ ID NO: 155802 - protein, 207 aa, Heterodera glycines
  Coding regions on vcDNA: vcDNA=SeqID_82225; Strand=-; Position=1 -78,165-356,457-575,718-952
  Homolog annotation: Hit_ID=NP_497420.1; Match level="QueryCoverage =92%, HitCoverage=25%, E-value=1e-58, Identity=58%"; Hit description =rna helicase (3C636) [Caenorhabditis elegans] gb|AAK27888.1| Hypothetical protein Y67D2.6 [Caenorhabditis
MMCRLGDAVGYSVRFDECISARTHIKFVTDGILLRELMSDPLLQAYSVVIVDEAHERSVNTDLIIGFLRKIVAIRDDLRVIISSATIEAELFRDFFELNDNPQQKPDKNTATIISVEGRMFPVTTFYTKVGVPDYVQTTVETVLRLHDEEPPGDILAFLTGQDEVEKACDLLRHAAKTMSKDKDKLLVVPLYGGAKVSDRSEGQSVK

SEQ ID NO: 155803 - protein, 345 aa, Heterodera glycines
  Coding regions on vcDNA: vcDNA=SeqID_82226; Strand=+; Position=1 -88,1457-2414
  Homolog annotation: Hit_ID=NP_500227.1; Match level="QueryCoverage =99%, HitCoverage=33%, E-value=7e-58, Identity=35%"; Hit description =predicted CDS, reverse transcriptase like family member (4D351) [Caenorhabditis elegans] gb|AAK68554.1| H
PFLYTARDYQQQVLDILDVCEIEAMPTKDPPVIQYNTLFVSDSTSKAEIFAKIFSENFTVNNYSLDFDTSFSSPTINDVVNIISVGKVLKTLPNRNNTSPDGITFRLLKNCSLSFTPFVTEIFRLSLDTGKLPTIWKQSIIIPLHKQGEKSNPMNYRPIALTCSLCKIMEKFIVWAISDFLLKNNLFSEHQFGFIKGRSTTTQLISTLENWYDGIYNNKNIDCVYIDFRKAFDVIPHNLLLYKVHKIGIRGKILNWISDFLSNRTFRVRVDNTLSSEYKMSSGVPRGSVLGPLLFLIYINDLPELIPKQISIKLYADDVKLYSVRKTKNDRIAMHRALNILLDWS

SEQ ID NO: 155804 - protein, 121 aa, Heterodera glycines
  Coding regions on vcDNA: vcDNA=SeqID_82227; Strand=-; Position=1-365
MARRFNKRFGTKLREFPIGNKVFARHRISQNWQQGQVSKRTGVIYDVAFADRRSGRYHANQLRPRKTSDSDDQLSVMFETFDIPRPIAVEDQREIPVEMPLEYPHGEQENFGGQIDHGQQR

SEQ ID NO: 155805 - protein, 817 aa, Heterodera glycines
  misc_feature (293)..(293): Xaa can be any naturally occurring amino acid
  misc_feature (430)..(430): Xaa can be any naturally occurring amino acid
  misc_feature (619)..(619): Xaa can be any naturally occurring amino acid
  Coding regions on vcDNA: vcDNA=SeqID_82228; Strand=-; Position=1 -288,346-1342,1403-2533
  Homolog annotation: Hit_ID=XP_318550.1; Match level="QueryCoverage =98%, HitCoverage=83%, E-value=0.0, Identity=43%"; Hit description =ENSANGP00000020240 [Anopheles gambiae]
FKTDVAVDGKDIKFVLDSGAEIIVIDELSHEVIGSPRLRKCTESGCMFDGTQVKFIGKGVANFKFRDICIKSEYYVAKRGSLNLLSVQMMDAFGLLTRGFTKAQKPSQNLTRGFTKAQKPSQNLTVKAHIDHLKASFPEIFKNELGRCMKFKAHLTLKADAAPVYRKVRPVPYNAQEAIDGELERWEKMGVIGKVEYTEWAAPILAVKKADGSARLCIDYSTGLNNALQDHQHPLPLLEDIFATLNGGKYFSQIDLRDAYLQIELDNESRKICSISTHRGNYEVKRLHFGVKXAPAIFQSVMDQILAEFEFATAYLDDVIIVSKSAKEHADHLKKVLEKFQEWGFRIKLEKCSFFREEIKYLGQIIDRNGRRPDPEKISAISEMPAPTDVPSLRSYLGMVNHYQQFVKNMRFVRKPRRSAEAGQRMEVEXEMQTGIRKIKETDASELGIGAVISHKFPDGTIKAIAHASSALTPAEKNYSQIEKEGLALIFAVQKFHKMIYGRKFTLLTDHKPLLAIFGSKKGVRQCSANRLLRWSLILLAYDFSIEYISTNDFGQADVLSRLIAKGKSDEDRVIASLRSDSEIDDILIGSIEALPIKFKEIVAAAEADKTIQKVKKFXRGWPRNVGDESAEIKLFHRIKEQLCITRNCLMYANRVVIPEKLRQKTLHSFHKGHPGIKRMKQLARNYAYWPNMDADIQQMVENCQPCQMEAKAPVKTNQPWPRPSAPWQRVHIDYAGPFFGKEYLIIVDAFSKYPEVFEMATKSTAATIEKLRYLFSRHGIPEILVVRHGTQFTNNEFAKFMAHHGCHHLFSAPYNP

SEQ ID NO: 155806 - protein, 357 aa, Heterodera glycines
  misc_feature (307)..(307): Xaa can be any naturally occurring amino acid
  misc_feature (323)..(323): Xaa can be any naturally occurring amino acid
  Coding regions on vcDNA: vcDNA=SeqID_82229; Strand=-; Position=1 -87,176-350,710-807,857-1009,1066-1523
  Homolog annotation: Hit_ID=CAE64837.1; Match level="QueryCoverage =80%, HitCoverage=56%, E-value=2e-65, Identity=46%"; Hit description =Hypothetical protein CBG09633 [Caenorhabditis briggsae]
SFFAVFDGHAGNNVAFHSAQNLLQTLLNTGPKITEGPKITEKAKSLIQDGIRMGFLELDSSLGELQGGGERERSGTTAICAILTPDYIFFANLGDSRGLLSRRSNTIFSTEDHKPYLEKERERIIKAGGSVMIQRVNGSLAVSRAAGGSVMIQRVNGSLAVSRALGDFEYKSVPGLCVTEQLVSPEPDIYIVPRDKDDEFLVLACDDEFLVLACDGIYDVLANEDLCALVRSRLSVTDDHKMASNQVLDVCLSKGSRDNMTMIVVIFDAAPKIDHSLVEFEQKWLMKIEKRVRGGTRAFNPALIQIXKFSLSQRMKLTTPTHXRCCSKRKGSTTATPSPAAFTWHDLCSTDFSRKGS

SEQ ID NO: 155807 - protein, 177 aa, Heterodera glycines
  Coding regions on vcDNA: vcDNA=SeqID_82230; Strand=-; Position=1 -96,298-735
MNCSFFLCLFTVQLILLNFAVEGREDDELKRKKRNTDVDVLGLVNIHAPSRKNVNVDVGGEERDRNDKLVNVNVQGHRKNVNVDVGGGHYNEGKVVKYERDGERGREVNVDVRVPKVKVDVDREDGYPKKKRVHLKVLDKLRKYDSEESGERRRHRVVKIERDGGRRHKTVYIEREN

SEQ ID NO: 155808 - protein, 77 aa, Heterodera glycines; identical to SEQ ID NO: 126799
  Coding regions on vcDNA: vcDNA=SeqID_82231; Strand=+; Position=1-234

SEQ ID NO: 155809 - protein, 36 aa, Heterodera glycines
  Coding regions on vcDNA: vcDNA=SeqID_82232; Strand=+; Position=1 -102,217-225
MIDQPTTPRAEKIGEGRRATITTHTDFVELRMRMQK

SEQ ID NO: 155810 - protein, 109 aa, Heterodera glycines
  Coding regions on vcDNA: vcDNA=SeqID_82233; Strand=+; Position=1-629
APKANSNPILAAPAAVPGHTPYFFSPWHTKGAAVGLPPKGTHKKMNQISPKNVKKCKKKFRFLNLELILRFSFKRATVCLYGKENAKMCGTKTPKLAKMDYFSFKSLKI

SEQ ID NO: 155811 - protein, 40 aa, Heterodera glycines
  Coding regions on vcDNA: vcDNA=SeqID_82234; Strand=+; Position=1 -19,278-381
MRQWTIPIKMYRKECQRGRELQIIGQSLIGWQALNGTNLA

SEQ ID NO: 155812 - protein, 174 aa, Heterodera glycines
  Coding regions on vcDNA: vcDNA=SeqID_82235; Strand=-; Position=1 -88,150-400,1103-1288
MVHLLAVLLFTIIQFESGDSIDQKTSDKNAFNAEELCRPIDGTPFHEQCLLSTVVKQKGFIPRHLRPPWLGSSLFEDNELSEENAKNDGCYGCYKGTKASNGMAPREEYCACTRPTCGNKYFDNLKHCAMVIDTKLLLNSNLFVHLKVHFYDNEPEKEPKKPPNKERKKFKMNF

SEQ ID NO: 155813 - protein, 67 aa, Heterodera glycines
  Coding regions on vcDNA: vcDNA=SeqID_82236; Strand=-; Position=1 -82,186-307
MDLVDYEAKLVATGRRYDSRPLSRNLDGYLSAGGDSLGSSGPRGRPRPPAQLAYDSDEHKYAAPFEG

SEQ ID NO: 155814 - protein, 75 aa, Heterodera glycines
  Coding regions on vcDNA: vcDNA=SeqID_82237; Strand=-; Position=1 -123,316-420
MPEQQQQPSTSNIIVPSDSLQQMDTSSSFSVTASPRKRTSLVPEFGLIGLFCSFGFLNFRCRIATDLILLAAKFD

SEQ ID NO: 155815 - protein, 58 aa, Heterodera glycines
  Coding regions on vcDNA: vcDNA=SeqID_82238; Strand=+; Position=1-176
MTKFKKFPPQNLIKQKKQFQICHFLRGNEKIAATDGTKFAVKLKRPANKYLVAPGAAG

SEQ ID NO: 155816 - protein, 51 aa, Heterodera glycines; identical to SEQ ID NO: 124998
  Coding regions on vcDNA: vcDNA=SeqID_82239; Strand=+; Position=1-155

SEQ ID NO: 155817 - protein, 89 aa, Heterodera glycines
  Coding regions on vcDNA: vcDNA=SeqID_82240; Strand=-; Position=1 -110,142-301
MVFIFNLDTFDIRIAIIGKLDQLIDKEKTENNKLLKKSLIFATVLDPRFKLKLFEQMKEQIREWMRADLQKMFSGFLNTTLVRQSSTCE

SEQ ID NO: 155818 - protein, 159 aa, Heterodera glycines
  Coding regions on vcDNA: vcDNA=SeqID_82241; Strand=-; Position=1 -72,382-473,679-828,870-1037
EWDPSAHRAKDMEKTIMEYICVDALTAHFITVEKQPAFVVLGAIPIKEKHKTGTAGLNAIGFDESVTLEKVKTIVRKIRKSSVQRTLFVELQEKLDMPVLILQRDTEVRWNSMFQMLNRFLQCKAAVQVFMTSDEAKRNNKGKGIPIISNIEWDQIEQI

SEQ ID NO: 155819 - protein, 290 aa, Heterodera glycines
  Coding regions on vcDNA: vcDNA=SeqID_82242; Strand=+; Position=1 -179,234-305,360-464,522-704,781-921,984-1057
  Homolog annotation: Hit_ID=NP_741068.1; Match level="QueryCoverage =99%, HitCoverage=23%, E-value=6e-97, Identity=64%"; Hit description =phospholipase C-L2 (3A995) [Caenorhabditis elegans] gb|AAN72422.1| Phospholipase c like protein 1, isofor
LRLVHSHPSSLYRNFLLRVTPNAQRVDSSNLNPQEFWNFGFSLVALNYQTPGLMMDLQEGKFLANGGCGGKFLANGGCGYVLKPAIMCSDQNEGRRRVPAQGRRRVPAQPQILHLKVLSAQQLPRPRASTAKGDTGDPFVVLEVFGVPADDPFVVLEVFGVPADCAEERSKTVRNDSFNPSFDESFQFAISVPELALVRFLVLDDDFIGDDFIGQYTIPFIGQYTIPFDCLQSGYRHIPLLNNEGDPLEGSTLFVHIAITNRRGGGKPKKRGLSVKRKMSRVQTGMKSVA

SEQ ID NO: 155820 - protein, 31 aa, Heterodera glycines
  Coding regions on vcDNA: vcDNA=SeqID_82243; Strand=-; Position=1-93
MEWEDRVENVKMEINGLTVKINEEKEKGKLL

SEQ ID NO: 155821 - protein, 438 aa, Heterodera glycines
  Coding regions on vcDNA: vcDNA=SeqID_82244; Strand=+; Position=1-1315
  Homolog annotation: Hit_ID=CAA82797.1; Match level="QueryCoverage =63%, HitCoverage=43%, E-value=1e-21, Identity=28%"; Hit description =gag protein [Ascaris lumbricoides]
MSSPIQQKLGAALKIINRIRTAAELTILADATASNLENALNFEAQLEKVQKEAKSLEIFIDDVRESLSAWTDLLRKLSAVEREAGETEFSNYSKKEKINEKVDDAALKLRDLRDLIGTLTIKARLFRNKFELEERTAQANHAKAMQQTATMPQQTQPSTMPFYQFQPIQLDKFSGNKRQWPEFYESFKSATGTHALSKAEKFNILRNLLTGEAKQLVAGFRLEDQNYDVALQLLKDTYGAPEEHIRALHFELANLNTCKNLRDTKEFLLHLERLTRELDNAGEDIEGPPTYLMLEKKLTPPFLRTILNKKGEDPEHWNTTKFRGVLSEAVRKESQIQEVMSEYGHHQQRPTKPFNTGPRFRDRAPFNQTRERSFIAATIDDKNKRFGKQPMPLKPATSGQRTTTQPQSQFKPKFNQMDRTAQARPQQKDSKQQSPPSP

SEQ ID NO: 155822 - protein, 34 aa, Heterodera glycines
  Coding regions on vcDNA: vcDNA=SeqID_82245; Strand=-; Position=1-103
MTKAIELEMTMGNDADEAFYGSRKILSVTDMSVI

SEQ ID NO: 155823 - protein, 43 aa, Heterodera glycines
  Coding regions on vcDNA: vcDNA=SeqID_82246; Strand=+; Position=1 -30,178-279
MNSKTAENPKVNGWPNGKSKIINRRKKSAIGTENIEPNGGANR

SEQ ID NO: 155824 - protein, 192 aa, Heterodera glycines
  Coding regions on vcDNA: vcDNA=SeqID_82247; Strand=-; Position=1-579
MAMERQNQSFPESIIAEETEMDEVPANQTNQGTKKRKLNECQPTTSGAQNNLSMESGIEGLVQANPLLVSQLATVAGQLLGTALKEEQRGTGPMFAMQGRGGYYGRRGTRPNFGFASAKWQEGRQQCHAASIPSTSASASASSSAANASDTVHQLATQLRNSNPELAMLLFGIASGLAEIAYYCKTGNWCKR

SEQ ID NO: 155825 - protein, 82 aa, Heterodera glycines
  Coding regions on vcDNA: vcDNA=SeqID_82248; Strand=-; Position=1-247
MAEREIELVVFAAELFNSKPDNVPRMMRDNFRCLKRIRDEVARISERGGRMWSKLCAKNMGNLIKNRWEWEIVMETPMGMAF

SEQ ID NO: 155826 - protein, 105 aa, Heterodera glycines
  Coding regions on vcDNA: vcDNA=SeqID_82249; Strand=+; Position=1 -162,208-363
MRCFACTAFVSVNKEVKNEGIGWIKNQLRSYCRLDPFFSADCYHLLVDTVLYNIKLSLNELKPTAICKQYGLCSEDQGNSTVKLLHASLGPLEAPRSKTHHSVTK

SEQ ID NO: 155827 - protein, 280 aa, Heterodera glycines
  Coding regions on vcDNA: vcDNA=SeqID_82250; Strand=+; Position=1 -154,351-473,540-678,785-1004,1162-1368
  Homolog annotation: Hit_ID=CAE64813.1; Match level="QueryCoverage =61%, HitCoverage=23%, E-value=2e-21, Identity=35%"; Hit description =Hypothetical protein CBG09607 [Caenorhabditis briggsae]
MPLKYEQSNALSAKIAKEIGELSEQRKHFGGGEVGEKNIDEKLKKKLRSLSSFEFSSIILKRILATENTENGNGNILQIYRTFLLMIKFWAREHHIYDNKLGFFNGISLSLLVAKVMLLYPMASLPFFIEKFFFTFSTWPWPTPVKLTDLPSLSILRWNASDESDKRGVIYSRRGLMPGLTMPIVTPGHIEQNATFNVNRSTATIIRGNCKTLLKSFEIGRWICKILPNSSLFGTPSQWSRQIDEKALSLISESTHLPLLRFYRPIQAQLAKFFDNVHFN

SEQ ID NO: 155828 - protein, 70 aa, Heterodera glycines
  Coding regions on vcDNA: vcDNA=SeqID_82251; Strand=+; Position=1-212
ILSQNLSLFNDLLRMAQSNAIKSFDIDQQLETNSRLHVASKVVKVGQSEGFAINANEMGKLRKIFEILIC

SEQ ID NO: 155829 - protein, 126 aa, Heterodera glycines
  Coding regions on vcDNA: vcDNA=SeqID_82252; Strand=-; Position=1 -154,351-473,1329-1432
MPLKYEQSNALSAKIAKEIGELSEQRKHFGGGEVGEKNIDEKLKKKLRSLSSFEVSSIILKRILATENTENGNGNILQIYRTFLLMIKFWARAIKIIRNWPMDLQNLQEEKWENLLKDKKFEEKVI

SEQ ID NO: 155830 - protein, 177 aa, Heterodera glycines
  Coding regions on vcDNA: vcDNA=SeqID_82253; Strand=-; Position=1 -241,489-586,821-1015
MALALLSEREKIGKMVKNLQFRRTSLRQLELLCDKAWLIKLNDEEREKLLMTAFFRNEFELEKFNEFFGHFLLMTKQIEQEFLSKNGFGMVENERKLKIDLAIERIERVVKEWQIMPKTSMPFVWDPLFWNFTFLGVKSVKFTGAEGVARTGHFIAGFVWSALLIMATLIIILRSKN

SEQ ID NO: 155831 - protein, 63 aa, Heterodera glycines
  Coding regions on vcDNA: vcDNA=SeqID_82254; Strand=+; Position=1 -105,393-479
MRSGAPLLLLPSPAVVLFLLLRFFRCRVAVVAVAKLNFPWTRVDERGGALEEMVEEPLENGGN

SEQ ID NO: 155832 - protein, 28 aa, Heterodera glycines
  Coding regions on vcDNA: vcDNA=SeqID_82255; Strand=-; Position=1-96
LKHAKFGHKPLEYQRMVILYSYEHKSEF

SEQ ID NO: 155833 - protein, 46 aa, Heterodera glycines
  Coding regions on vcDNA: vcDNA=SeqID_82256; Strand=-; Position=1 -115,170-193
  Homolog annotation: Hit_ID=AAC72366.2; Match level="QueryCoverage =86%, HitCoverage=3%, E-value=6e-13, Identity=87%"; Hit description =guanylyl cyclase [Heterodera glycines]
NSFPILAGKIHIFSSSNRFLTSVIGGYVTEPRGEVIIKGKGVMETF

SEQ ID NO: 155834 - protein, 77 aa, Heterodera glycines
  Coding regions on vcDNA: vcDNA=SeqID_82257; Strand=+; Position=1 -181,331-383
MESGGTVNDELYYGSAAMPLFTRCYDVIDLGTAERMMARMDHWDNKEHDNTRISTSNQPFANNGKWKNLEENEIDGN

SEQ ID NO: 155835 - protein, 33 aa, Heterodera glycines
  Coding regions on vcDNA: vcDNA=SeqID_82258; Strand=+; Position=1 -48,104-157
MINDSSHQWDFPNVFPPLQMMVIEGLRRSGVKK

SEQ ID NO: 155836 - protein, 26 aa, Heterodera glycines
  Coding regions on vcDNA: vcDNA=SeqID_82259; Strand=+; Position=1 -33,392-439
MIFGLIILEQIKTAQNSTQNQAKFDR

SEQ ID NO: 155837 - protein, 245 aa, Heterodera glycines
  Coding regions on vcDNA: vcDNA=SeqID_82260; Strand=+; Position=1-735
  Homolog annotation: Hit_ID=NP_494302.1; Match level="QueryCoverage =97%, HitCoverage=17%, E-value=1e-36, Identity=37%"; Hit description =predicted CDS, putative protein of ancient origin (2C878) [Caenorhabditis elegans] gb|AAB95006.1| Hypothe
MNIRCEFCDALHFVEEKIHGRGNTFKDCCHYGKVFVREITEQDFPEELRDLFMKFDARHVNFFDNIRHLNSSVSFASMNPLRYRYPNNRGPYCFRIYGQIYHRMNLALNPENGDDPAYGQIFIVDTEHAMRALRHANVGIDPQLLTTAYEVIRNVNPFAEAYMMMKEEEDEEVDRARNENREPAEIKLLFETGRQLDRRLGYNVPRANEVAAVYVPGADGEVPNAKIVVRERGKELKILNCTNSM

SEQ ID NO: 155838 - protein, 53 aa, Heterodera glycines
  Coding regions on vcDNA: vcDNA=SeqID_82261; Strand=-; Position=1 -97,554-618
MPSSSPVALLPLLAPLPPLPLLPLKRCRWALLANCFRSVKMSISIVVNFDSKI

SEQ ID NO: 155839 - protein, 41 aa, Heterodera glycines
  Coding regions on vcDNA: vcDNA=SeqID_82262; Strand=-; Position=1-136
RWKPLFRKCFEILKSQKISYKVFKIALIMNLTVDLNDNALR

SEQ ID NO: 155840 - protein, 33 aa, Heterodera glycines
  Coding regions on vcDNA: vcDNA=SeqID_82263; Strand=-; Position=1-99
YRICSNYSPVSINPAVSNYPPVYEVFPKFEKIN

SEQ ID NO: 155841 - protein, 48 aa, Heterodera glycines
  Coding regions on vcDNA: vcDNA=SeqID_82264; Strand=+; Position=1 -71,395-470
MKSMFALDCMVFVLKVILTEMTKIFRIIQYGLQLESFTLKLFRKTENF

SEQ ID NO: 155842 - protein, 20 aa, Heterodera glycines
  Coding regions on vcDNA: vcDNA=SeqID_82265; Strand=+; Position=1-62
MSTASQKVRTREDVIYGGRH

SEQ ID NO: 155843 - protein, 136 aa, Heterodera glycines
  Coding regions on vcDNA: vcDNA=SeqID_82266; Strand=-; Position=1 -93,736-907,1346-1491
MDNRIASIGTEDAKFSSDSRQKTAHSMANNLVSAGSQRKEGITELEGSAAPPKPLRRAPTNSNSSPTMASSLLLGVQFFERLSFHTLKGTLFPLMVGTLHVDEGSANAFILLCIGVTVFSPIVGAAMADAKNGNYG

SEQ ID NO: 155844 - protein, 40 aa, Heterodera glycines
  Coding regions on vcDNA: vcDNA=SeqID_82267; Strand=-; Position=1-131
PNCCGCFFSPAPRSAAGRSSIIHLSPKVTGEGNSIFSLQI

SEQ ID NO: 155845 - protein, 139 aa, Heterodera glycines
  Coding regions on vcDNA: vcDNA=SeqID_82268; Strand=-; Position=1 -47,972-1041,1146-1311,1369-1504
  Homolog annotation: Hit_ID=CAE74136.1; Match level="QueryCoverage =86%, HitCoverage=20%, E-value=7e-12, Identity=37%"; Hit description =Hypothetical protein CBG21807 [Caenorhabditis briggsae]
MTKIIFHCTPSCLNVLSVLILIFLSSVAAFVFFFNSEILAVKTNEEIQRHPKRLSFSDDELPGARDSNTVLREGQIGNFEQIPAVLPPEDPNGEGEDGRAIVTDLNSPEVRRAMSEYAFNTLASDRASLNRSIPDVRME

SEQ ID NO: 155846 - protein, 130 aa, Heterodera glycines
  Coding regions on vcDNA: vcDNA=SeqID_82269; Strand=+; Position=1 -131,190-451
MSSFWNVSAVLMLITLISLLVNSSEAVPLPSKKSSSLWSKLFSNDRESAKKLGSPSSTSAAGGEFSVQSQMFIPYANNGNGDFFLPYPSEMDTVKRSNTEDHFLDPYDGGSSWLSLSDPSRLEWNFNRLR

SEQ ID NO: 155847 - protein, 446 aa, Heterodera glycines
  Coding regions on vcDNA: vcDNA=SeqID_82270; Strand=-; Position=1 -544,829-1148,1246-1392,1439-1615,1669-1821
MTMNITGASTFLAEQLEGETGHVIGFTYNVSSSEEKLLVLKNVLDSAILLWVIIHPDMLGTKYATENAALTKIMASILRELDKFSVVFFVVSPLTFFKETLLMDSALTIASNLPKDKIGRMFGRIRAKLETEPTDNVYFAHFVEALAAWDMSKLINIIELALQRLRNAVVAVCDPNCSTPRPLPSSFLSTSSIDSPRAKRARFGEGLVDFFRPLELIQILLACPQSCTCLKNNFGIHLEGFFESLCVIRCKFGELLMNNGWETKFDPRTLICAYETFNIVALITKRIEQPRRNSQGEEIGVNEAERGLSLTDRILYNEMKWFATVLNERTPSFSIIQMFLRCLSLHLCASQLSAVVLNETASLLNELRYRLENVYDARPVMSALKKCVNHLNEALEGCEERDQAERIIEHKVRLMEEYFEAEERGDTTQMAAEGNDAYHEIDDGEL

SEQ ID NO: 155848 - protein, 103 aa, Heterodera glycines
  Coding regions on vcDNA: vcDNA=SeqID_82271; Strand=-; Position=1 -52,95-251,894-996
  Homolog annotation: Hit_ID=NP_495582.1; Match level="QueryCoverage =67%, HitCoverage=21%, E-value=7e-14, Identity=52%"; Hit description =ROLler: helically twisted, animals roll when moving ROL-8, COLlagen structural gene (32.5 kD) (rol-8) [Ca
MEGSPGPIGNIGPVGPQGPPGIPGRQFITEGPRGSPGKPGPKGPKGLPGCQGVPGITVQGVKGPPGDAGSRLSFINSLEIKFIYYQKSNRCVSKKDFTNKKQA

SEQ ID NO: 155849 - protein, 364 aa, Heterodera glycines
  Coding regions on vcDNA: vcDNA=SeqID_82272; Strand=+; Position=1 -39,87-159,200-266,488-662,704-730,777-820,863-914,971-1045,1125 -1327,2136-2201
  Homolog annotation: Hit_ID=CAE59558.1; Match level="QueryCoverage =100%, HitCoverage=60%, E-value=3e-61, Identity=39%"; Hit description= Hypothetical protein CBG02955 [Caenorhabditis briggsae]
MDCIDGFDIRLEKDVFYPSETINGVVILDVFYPSETINGVVILETNAPLRLRGIRVFLRGRARVQWKVLKIRVFLRGRARVQWKVLKSGESKTLKDDQYLLDEKLLLWGRDRRDGGDDEETAQILPRGTHEFSFGFRLPATQMPSSLETKAGTVRYYVKAGTVRYYVKVIVDVVIVDVPYASSPQGIKYFTLIGPHIDCMEEKYYFTLIGPHIDCMEEKYLTHLCAQDHQIRCFGCCKRGVTHLCAQDHQIRCFGCCKRGVIALRAVLERSAYCCVLERSAYCCGEVLRLRLQMENRQHFPAIVCVRLIQENHLLIETGFLCFYIFFLRLSYGERSPKIALSSQFRLDAGQELSLKIPVLPPTM

SEQ ID NO: 155850 - protein, 165 aa, Heterodera glycines
  Coding regions on vcDNA: vcDNA=SeqID_82273; Strand=+; Position=1 -206,257-319,372-437,500-595
  Homolog annotation: Hit_ID=NP_493369.1; Match level="QueryCoverage =96%, HitCoverage=41%, E-value=4e-34, Identity=47%"; Hit description =misexpression suppressor of KSR (38.5 kD) (1O64) [Caenorhabditis elegans] emb|CAB63372.1| Hypothetical pr
SAFGSVKVNIFGNSERYPIVTFHDIGLNAIANFENFFQFQTFSKLTEQFCVYNINAPGQELDARKLPENFHYPTMDFHYPTMDGLANIVGDVVSHFGFKSFIGIGVFKSFIGIGVGAGANVLLRFCCAHQNLLDHQNLLDALLLINATSKGGGIEWAYRKSAFRL

SEQ ID NO: 155851 - protein, 187 aa, Heterodera glycines
  Coding regions on vcDNA: vcDNA=SeqID_82274; Strand=+; Position=1 -241,1125-1447
MDKSLQKLQNELCDSSKNENFQNTMEIFQTTKIEKKTFDKSQMDTALAKDQTLNYNNKGMFSELVNFSSKLLKINEKLIEAKKLAVFHQKPKDLLGRRTKRADDNAIKGCISSVLLTLISAPYFGYYSFQYAHEGNVQIEYTECYKHLFSYRCYPAHSSVVTEIVEWTIIFAIGLILALLFCSCARG

SEQ ID NO: 155852 - protein, 24 aa, Heterodera glycines
  Coding regions on vcDNA: vcDNA=SeqID_82275; Strand=-; Position=1 -50,175-199
MGGPVGMTRGKYKRNRSEVEPRIY

SEQ ID NO: 155853 - protein, 20 aa, Heterodera glycines
  Coding regions on vcDNA: vcDNA=SeqID_82276; Strand=+; Position=1-65
QVSKLEEALRKLDKEKAKAK

SEQ ID NO: 155854 - protein, 488 aa, Heterodera glycines
  Coding regions on vcDNA: vcDNA=SeqID_82277; Strand=+; Position=1 -78,205-273,321-413,545-800,954-1046,1123-1193,1301-1434,1482 -1617,1648-1713,1762-1860,1926-2044
  Homolog annotation: Hit_ID=CAE61242.1; Match level="QueryCoverage =97%, HitCoverage=79%, E-value=8e-69, Identity=37%"; Hit description =Hypothetical protein CBG05042 [Caenorhabditis briggsae]
KMLPTPKMLVIVALVSFCSNWQFGYQITYINTAHWSFYALADEVYQNESLPFSAHLPQSEWNLLWSFILASFSLPFSAHLPQSEWNLLWSFILASFYGGTLLGFLLLSSLPAIFGCAVQLAVRLSASKFCQNSNWLPVPNLSFATLCFLLSVGRLLVGVQAGCSLCLLPLFIIETAPFNHRPFLSSLQVVFQSLATLIGLSVGSDHLLSLGEHKIEWLQIIGLAPTMFFAIFLIIGLAPTMFFAIFLLWLPDTPFRLFVLSSLFYFGQSSSSAPFVPKHLSGGPSRRKGAKDGKWADNWKGLLVGIFAAVSFLLVGIFAAVSFAFTADDLIDSYSADFLRNSKIKSKKVFILIFEFAEFLTAGLGLLLFFTSAEFLTAGLGLLLFFTSILGAFLADRFGRRRLLISGLLGTAADRFGRRRLLISGLLGTAVSNAIAAFGASTNSTVAIGVAIGFALTKTFIGFGAGAPAWFLTSELVSPLFVAQGQAI

SEQ ID NO: 155855 - protein, 78 aa, Heterodera glycines
  Coding regions on vcDNA: vcDNA=SeqID_82278; Strand=-; Position=1 -63,183-356
MSQIHSKIIHTGCHFAAFVPMNPDNAAIPYLTAVGDLLGTTFLFAAFSVLALLKPEELVSIVSSSTASPPTGMPPSPG

SEQ ID NO: 155856 - protein, 68 aa, Heterodera glycines
  Coding regions on vcDNA: vcDNA=SeqID_82279; Strand=-; Position=1 -3,198-401
MALVAIWPQWPPPNCPHFITALHSLAYCQMSGPWAVSAPFRGHFFRPIRYLKERKGEQILPPRNFRKF

SEQ ID NO: 155857 - protein, 55 aa, Heterodera glycines
  Coding regions on vcDNA: vcDNA=SeqID_82280; Strand=-; Position=1 -63,437-541
MPWVWENAAQDRRRQQQHYAMEQFEVGSLGATMTPCHHFFSFWMCQGKWAEPKNQ

SEQ ID NO: 155858 - protein, 26 aa, Heterodera glycines
  Coding regions on vcDNA: vcDNA=SeqID_82281; Strand=+; Position=1 -77,471-474
MDEEGDERDDFWANIGSDDVKNVGYC

SEQ ID NO: 155859 - protein, 146 aa, Heterodera glycines
  Coding regions on vcDNA: vcDNA=SeqID_82282; Strand=+; Position=1 -210,409-501,880-1017
MTSSQPIIYEKIVQQNGSKNSAEWCLASERRLLQKLIHHKPVGINRHFNLNLLVIYMNNIFDFEEDINFDQPGFFLDIVQEAHVSMSMHEKAGFPGLCYLYVEEKLNEYFDMELIGENESPSEELEKKAVFELPQEYQFKEEMVPR

SEQ ID NO: 155860 - protein, 105 aa, Heterodera glycines
  Coding regions on vcDNA: vcDNA=SeqID_82283; Strand=+; Position=1 -193,335-457
MTIVGKGGSAVNAISRSPFGDDKDSRRSVSPPGTKRVRNGGGGGDDDSARRNDRDSKRSGGRRERTARHDEEERDRSDRDRERDHQERERRRIGLPGKPKSDHVL

SEQ ID NO: 155861 - protein, 183 aa, Heterodera glycines
  misc_feature (18)..(18): Xaa can be any naturally occurring amino acid
  misc_feature (73)..(73): Xaa can be any naturally occurring amino acid
  misc_feature (117)..(117): Xaa can be any naturally occurring amino acid
  misc_feature (146)..(146): Xaa can be any naturally occurring amino acid
  misc_feature (171)..(171): Xaa can be any naturally occurring amino acid
  Coding regions on vcDNA: vcDNA=SeqID_82284; Strand=-; Position=1 -274,363-492,1783-1928
  Homolog annotation: Hit_ID=CAD22154.1; Match level="QueryCoverage =97%, HitCoverage=53%, E-value=4e-36, Identity=51%"; Hit description =pherophorin-dz1 protein [Volvox carteri f. nagariensis]
QRFLAPPPSPNGIRPPAXKAPPPPRPPPPPRPPPRPPLPPIGLPPPPPLSQPRPRPPPRKPPPRPRSPPVNGXKPPPAPGRKAPPPLPPPPPPPPPRGPPRLRQLPLLGSPNPPVGXPPPAATALEKPTLAKPPRPPMASPPAATXRLLALALLCPARLVVAGVVVALNEXRQPKWKATNCAD

SEQ ID NO: 155862 - protein, 154 aa, Heterodera glycines
  Coding regions on vcDNA: vcDNA=SeqID_82285; Strand=+; Position=1 -303,1018-1179
MFTQAAAAAAAAQMAFAGNLLPFSFPPPNIPPPSVTRQSQQQQQQQQHQTDTAIAQQHQQQQLTTPVSSAIAALMSTPASAPPTSRMNAGRANDGDRDGLALAVLPMSASPMRWQQAAATQLADLATPAEAIGEVVAVHVVVAAASSNDSVGVS

SEQ ID NO: 155863 - protein, 78 aa, Heterodera glycines
  Coding regions on vcDNA: vcDNA=SeqID_82286; Strand=+; Position=1 -33,248-418,646-678
MMKIQWITLFVLSTTISAIFCASSVKLPRAIAGPPNSYVKKPNYAQQQAVQKQQQNGMPSSAGRVQTSVEASVQTSER

SEQ ID NO: 155864 - protein, 37 aa, Heterodera glycines
  Coding regions on vcDNA: vcDNA=SeqID_82287; Strand=+; Position=1 -49,255-319
MFNASFRKDFNPKLNGDYQVKRAKLPDIDQCIPKAIF

SEQ ID NO: 155865 - protein, 89 aa, Heterodera glycines
  Coding regions on vcDNA: vcDNA=SeqID_82288; Strand=+; Position=1 -34,516-595,1011-1166
MSSPLVKKEIKCSSRFGRIDTSIQYGGLLGDIANQQLKLCKRVPQMVDEQVNPQIAGVVPKKIAFKSISSVALNSSCLAALTGDGGAVI

SEQ ID NO: 155866 - protein, 176 aa, Heterodera glycines
  Coding regions on vcDNA: vcDNA=SeqID_82289; Strand=-; Position=1 -274,646-902
MLDQLKTLLKQPQEGQRLIRPKLLTNVNILPNEWSIYPAPRNIGAKSGSDRDQKLDQGQQQHQETADEDRSTDQKVSVQTIEIGADNQRGEAKEEKKETKKETEQHHQQNKEEEEEEKRAVKMEANWQTEEQKLMAEMRMAVQKADSAMEKLESQRRKESAQANNKAIWKMIIDTN

SEQ ID NO: 155867 - protein, 34 aa, Heterodera glycines
  Coding regions on vcDNA: vcDNA=SeqID_82290; Strand=+; Position=1 -31,97-170
MQRMEQMKMANRKQAKEIAKAFGMYLKQMVPNRK

SEQ ID NO: 155868 - protein, 334 aa, Heterodera glycines
  misc_feature (125)..(125): Xaa can be any naturally occurring amino acid
  Coding regions on vcDNA: vcDNA=SeqID_82291; Strand=+; Position=1 -858,1192-1338
  Homolog annotation: Hit_ID=NP_502797.1; Match level="QueryCoverage =93%, HitCoverage=86%, E-value=2e-52, Identity=37%"; Hit description =HASI (4P602) [Caenorhabditis elegans] emb|CAB16520.1| Hypothetical protein Y57G11C.19 [Caenorhabditis ele
FKEAKKIDREITTDDVNKFLEKQRPYTIHKPIRKRFPRLKTIPSGFHTDWQCDLCIFDQLKKHNDGYKYLLVCIDVLSRMIFSSPAKSKKSEDMIEAFYRVFEKSKIIPMKIYSDSGLEFQAGKXKNILRKNFIKNVMYSPDLHAGVVERANRTIKERLYRYFTKKDTLRWVDVIDKIVSNIKNSVNRTLGIKPSSINFENARALWEKLYKAREFKISKKNKFKIGDIVRITKEKGKFAKGYLPNFTEELFKIVIVNSTTPDSYRIKDLEGNLIKGIFYNQELVKAEETNDSKIDVAKRAAERAGRDVERQLNHINNVSSSIQTKLSTLREVNP

SEQ ID NO: 155869 - protein, 36 aa, Heterodera glycines
  Coding regions on vcDNA: vcDNA=SeqID_82292; Strand=-; Position=1-108
GSMKLLLNISLNFFVLFKRELKIFKNFIHLPLLIEK

SEQ ID NO: 155870 - protein, 32 aa, Heterodera glycines
  Coding regions on vcDNA: vcDNA=SeqID_82293; Strand=-; Position=1-154
KPKLFGLFKKELKFLKILFISLLIEKASESLI

SEQ ID NO: 155871 - protein, 45 aa, Heterodera glycines; identical to SEQ ID NO: 124814
  Coding regions on vcDNA: vcDNA=SeqID_82294; Strand=-; Position=1-436

SEQ ID NO: 155872 - protein, 66 aa, Heterodera glycines
  Coding regions on vcDNA: vcDNA=SeqID_82295; Strand=-; Position=1 -140,370-430
MSHLKNEHKNETKCQNDPPFVLEFVIVVADSLKRIAPHLATDRLTDQVPWVETPKNRVWRSQKYQK

SEQ ID NO: 155873 - protein, 174 aa, Heterodera glycines
  Coding regions on vcDNA: vcDNA=SeqID_82296; Strand=+; Position=1 -247,424-459,514-537,611-632,692-797,1363-1450
  Homolog annotation: Hit_ID=XP_230381.2; Match level="QueryCoverage =68%, HitCoverage=11%, E-value=2e-13, Identity=35%"; Hit description =similar to chromosome 11 open reading frame 25 [Rattus norvegicus]
YADDTFAYFDSSTLTVANTEFPNTTYCRYQDYRRPPCSLISQPISRQVWGDAFETVCDDNYEFQDKWWIILAFRLVFVLIFELVVLSIKALFAYLIPDMPTKIVIQLQRERFLMRQAILQRRDSPEELKAADLEEKELSQLTTDRRDAPALSPRASFVNELPLSMEEADTNEKM

SEQ ID NO: 155874 - protein, 28 aa, Heterodera glycines
  Coding regions on vcDNA: vcDNA=SeqID_82297; Strand=+; Position=1 -70,612-628
MSHPIWQIGLFKRIKEDSVDCLECTLSI

SEQ ID NO: 155875 - protein, 28 aa, Heterodera glycines
  Coding regions on vcDNA: vcDNA=SeqID_82298; Strand=+; Position=1 -73,187-200
MDPTLVEIEQTPELKSFIKWLYQRRISN

SEQ ID NO: 155876 - protein, 143 aa, Heterodera glycines
  Coding regions on vcDNA: vcDNA=SeqID_82299; Strand=+; Position=1 -159,798-1070
MSDFEIGMLKAMRHVFPSCERSGCSFHMAQAVFRKARSMGIFNLLNEDDNEAPRELNHHPSLSDFIAAFTKDINKQLDIGRAEQLQKSTKRRQRYVIKEQNVVRILDEADFESEEGLTNALHLLGIVMQGFAEGLHVRGNSEW

SEQ ID NO: 155877 - protein, 64 aa, Heterodera glycines
  Coding regions on vcDNA: vcDNA=SeqID_82300; Strand=+; Position=1-266
ICKIDIKNMSFYVMLSDLKFLSPFILCLLRINKRQWQLSQGQCAPREVGPSAVGLHECFHQYLL

SEQ ID NO: 155878 - protein, 76 aa, Heterodera glycines
  Coding regions on vcDNA: vcDNA=SeqID_82301; Strand=+; Position=1 -16,288-502
MSPQYDLVRTVYSSCATLCFSLGMLFNAFLVWLILTKTPAPMLVYSKLLLTPCMMVKTKFSNFSALWCFEHGVYYE

SEQ ID NO: 155879 - protein, 1293 aa, Heterodera glycines
  Coding regions on vcDNA: vcDNA=SeqID_82302; Strand=+; Position=1 -271,392-658,1057-3984,4082-4497
  Homolog annotation: Hit_ID=CAE64509.1; Match level="QueryCoverage =61%, HitCoverage=33%, E-value=7e-23, Identity=20%"; Hit description =Hypothetical protein CBG09244 [Caenorhabditis briggsae]
MDSLKEHNDGYRYILVCIDVLSRQIYVAEAESKKSEHMIEAFEKVFKKAQVLPNKMYSDSGLEFQAKRMNEYWLSKDIIKHVMYSPHLHAVNRTTGMRPVDVNFRNATELRNRLYKDMEQQKRIQKFKIGDIVRITKEKGDFSKGYFPNFTDELFKIVRVNPTNPPSYRISDLEGENIKGPTTVTLKVKIPSIQFHSVEHMQKSLNSIIQSAYDVKFPKEKRVKRAAAASADKELEPETRPEPDKELTREVPSSKTLDKELIREAPLPATHDIELQRGDEPKPSEKELGRETEPAQLSDKQLGELEGEKLQKEQLPPTPIVDHGEISTIDQERMDLAKRVTEQSWKETVKLAANAADIAEKAKTALNRAEQARKRAPNAPHVKKWFDRLSNMENNLRELVEKISQESKKAAEAKRKLDVHYDSKNLNECRKHADMSKQALKNSKNYIAQLTPMYFSTVPEDQLGVNELANRVVTAVNNFLNAELTVPRPVKDPQLSAGQPKQQQEKQMEKLKPTVEKEVGSIIKPPVPKLSDEKETKREPTKPTVEKEMEREPVKPPEKELERESPKKADKELEHMVKQQSTQEDNLLEKAKKEIDQTAQNAALKAEYIRTLVANSKHNRGVAEGRLNTYSGVPQFNEWLDQIVELDKKIDELAKKVGNEPSKVINAKQQFDKPYRMKNLTEARKLIEAAKNAFEVILNYSLEIKQLNNKMHELNDKFTVAVKEKEEEEAKEGAAINIQQEKKLEKEIPQVLKELEREKSQHDINTTAENTETEFPSSEYEIDDSSEKQPERAEQQAEVSYVLKKKEGKLEEEKIETKDDTAINEFPSTEYGIEESETEETEKWSPDQAKQKILKGKEEPFEQPDGQKDEETILVIGTDKKGEEFPSNQYEIEDNYSSSSSSFIAQNEPSVTTKDEEGLLTVQIKKLPMTGDNEQKTIQMVPSDFPSYNDDDSRDTTVNELSEEQHASTVPEDSKSEPYDVDELPDLPDPQALSAKGRGGDKKGVTSVSDRVKMLMGHQKQQRKAVEFLFNEITQRFYINIGSGVQHVDASSHLAYVLGFENTRLYYNHPAKYLPDLSGGVRQLYVYAPKLVEDTIIGDRMAPLLRVVNVSGTVPLDVPEVIYTNEFFKPIQNKRISEIKIEIQTAFGRYIKFNWASQQEGRGEQQYFVGTRYQRGGGLLQNVARFLMPVASNLLSSASKEGIAAGTRVLGDLSQGKALKESLETHAKQGFENLAGKLQQCGKGGNYGADGRRGQRVSKVKKASGISSSDSIIGRIGTVKRRRNKIMDQLSFP

SEQ ID NO: 155880 - protein, 139 aa, Heterodera glycines
  Coding regions on vcDNA: vcDNA=SeqID_82303; Strand=+; Position=1 -254,299-464
MQRAIKYFIDYYAINDITQLYALLKLEIDSHPSNYFPNPLLSVSCVHIVNTEFENQPVIVEGTLDLIDELLFSTCYPKTRQGVGWSEPLYVELTDLMVCPGDLPICLSHFGQRKERRPSLMVDELDWHDSDDDAADEAW

SEQ ID NO: 155881 - protein, 894 aa, Heterodera glycines
  Coding regions on vcDNA: vcDNA=SeqID_82304; Strand=-; Position=1 -165,217-478,523-731,785-1041,1089-1179,1222-1733,1779-2790,2838-3014
  Homolog annotation: Hit_ID=NP_001004509.1; Match level="QueryCoverage= 90%, HitCoverage=53%, E-value=5e-99, Identity=31%"; Hit description =si:busm1-180o5.3 [Danio rerio] emb|CAD60788.1| novel protein similar to DNA polymerases [Danio rerio]
MNRHDFCKDYEAFNRLVSNIGRMQTAVEELMNASGIQKDQTSYGIEHIQQVQQYWNRVFPGTYRLVLFEDRPEELPRPIWKGPGGHRFNVTLFLSSDHYDVIKKIHCFFKLGRKYCIECECTYTVDAKHTMHCKSRCPQCAKVGPQHPCPKQDGVQILCTECNRYFFSRFCYDGHRGTTCRLYKRCSSCNRVYRSDTGQKHKCNTRYCKRCKVYHAEKRSCFIKKIRVSPEEQRYRIIVWDTETRLEQLEDEGQRIHRVNFLSARVTCTDCCESTETDDDNCEICCQNDGALERAKEWSEADGEDQPVAAFVEWVLRAWNNEYTTYIWAHNASRFDGHFALNHLCKTARRPDVVMNGLKIFEFRVQHSRKHSMLIWRDSCLIMPIALAELKKTFNLDCDDKPFFPYAFNRKENYSLRMENLPDESEYEPGTMKADKYEKFKKWYNDNKRTPFFLPDELRAYCLNDTEILLKALVKFRQILMNEITDGFDVVPISCTIASACMNIFKAQFMEPEQLAMVPELGYERNDRASVLAIKYLDWRAKSEGIEIQHAGNGREKRWKQFKLDGWIESQQRCIEVLGCYWHGCERCFKPDEQLIDGKTCRELNDTTQDRLRQLREYDDHGRCLQVEEIWECEINDQLKKNERMKAFFDDISNERGPLDPRLAYCGGRTGPLRLFAEPAEDEKISVFDIVSLYPWVNYDTDYPIGIPTIIHPNADEMNVNWTKPEHLQYRGLYRVRVIPPRGLRVPVLPMKIDERLLFSCCHRCAALFRKCVTRCSHKCTHSDQQRAFTGNFTHIELEKALELGYVVDRFWRAWHYAEWSDQIFKGYVRQFIRLKVESSGFPEGVETSEQKQQYIDEYRRIYGVDLDFGRIKKNPGLRFIAKLMLNSLWFAPK

SEQ ID NO: 155882 - protein, 71 aa, Heterodera glycines
  Coding regions on vcDNA: vcDNA=SeqID_82305; Strand=-; Position=1-216
MAEVPPTVPSTRPTEADGQSVEEEEELSMAASSLAELTEDDGAETVLKKQGIELLIEAMHLHFRNIFNGRP

SEQ ID NO: 155883 - protein, 178 aa, Heterodera glycines
  Coding regions on vcDNA: vcDNA=SeqID_82306; Strand=+; Position=1 -381,669-822
  Homolog annotation: Hit_ID=CAE71851.1; Match level="QueryCoverage =37%, HitCoverage=15%, E-value=5e-16, Identity=67%"; Hit description =Hypothetical protein CBG18895 [Caenorhabditis briggsae]
CKNVMSLRANAIIRRYRTRTNECGLVLKPVHFKNGNTRLRVFPKFISGSFGTFKRSEAQQNANSEEECLPIPPAQMGELRTKNCSGGDGETEQRTVGELGGIPLGQKTLSLRNLTSAGGSKRFSAIEDDEMRPVSSPKRATSHDGNFVELFTSATSAGGDEPSLVPAGLHLLPFALPT

SEQ ID NO: 155884 - protein, 235 aa, Heterodera glycines
  Coding regions on vcDNA: vcDNA=SeqID_82307; Strand=+; Position=1-708
MRPVSSPKRATSHDGNFVELFTSATSAGGDEPSLVPAGLHLLPFALPTSSTSSDALAQCQTQSACLFAKTPNRSENAANLEFHQQNILSLNSARTATEGGQTMQFYGNNSTANVPINFAIGATNNGQPQQHQQQNIVSLLGPFSGASTANDGQLGQNATMGNVLTMTTNSMGGLFMCDQQKQQNLWVQQQQQQQQKQQHIQVINSREDMLITDQWGRTERNPRDYPGNFHANSFL

SEQ ID NO: 155885 - protein, 50 aa, Heterodera glycines
  Coding regions on vcDNA: vcDNA=SeqID_82308; Strand=+; Position=1 -136,800-816
MANPIATKKQKVKLSYKDHLCTFAKMSSDGMTKFWRCEFKKSISHMILHF

SEQ ID NO: 155886 - protein, 110 aa, Heterodera glycines
  Coding regions on vcDNA: vcDNA=SeqID_82309; Strand=-; Position=1 -196,576-713
ILINEPLGTDRPEIVHCCDELLARQPPCNSSHLFQFLIDKIADKMRENAVANEQQLTEMAQKSGEYLDVLERIDPIRHNFWKYRRAQLQTLADSVKFNSSNSASAAAASA

SEQ ID NO: 155887 - protein, 75 aa, Heterodera glycines
  Coding regions on vcDNA: vcDNA=SeqID_82310; Strand=-; Position=1 -79,138-287
  Homolog annotation: Hit_ID=NP_509674.1; Match level="QueryCoverage =100%, HitCoverage=7%, E-value=1e-24, Identity=72%"; Hit description =metabotropic GLutamate receptor subunit (mgl-1) [Caenorhabditis elegans] emb|CAA87374.1| Hypothetical pro
TVPSDNYQARAMIDIAVHFSWTYLSLVYSADEYGELGADAFKKEARRANICIAIEERVSMKPESLRDSIANLVKK

SEQ ID NO: 155888 - protein, 332 aa, Heterodera glycines
  misc_feature (25)..(25): Xaa can be any naturally occurring amino acid
  misc_feature (42)..(42): Xaa can be any naturally occurring amino acid
  Coding regions on vcDNA: vcDNA=SeqID_82311; Strand=-; Position=1 -353,441-522,575-775,828-873,942-993,1137-1215,1274-1482
  Homolog annotation: Hit_ID=NP_509674.1; Match level="QueryCoverage =72%, HitCoverage=21%, E-value=2e-60, Identity=53%"; Hit description =metabotropic GLutamate receptor subunit (mgl-1) [Caenorhabditis elegans] emb|CAA87374.1| Hypothetical pro
SKYNQLALGQLFHLFVFGFINCFNXIFYSKKCFDFCRPPHHXLLKMFSLITMTLRTLTHVHMLAKAVDGVGGQPTENMRQLRIPGDLIIGGVFPVHAKGGGTSPCGEIFETRGVHRVGVHRVEAFLYALDMINAQTDFLRGYKLGALILDSCSNPAYALNQSLDFKLGALILDSCSNPAYALNQSLDFVREMIGSSELTDYSCADGRQPTLRHPSPKKSVVAVVGASYSSVTVQIANLLRLFRIVQVSPAIANLLRLFRIVQVSPAALRFFAVPPRAAVPFWSLSLVSAFGVSAFGLGAAFAALCALVSPSLRAKLVAAASKNGTKQSNSKL

SEQ ID NO: 155889 - protein, 287 aa, Heterodera glycines
  Coding regions on vcDNA: vcDNA=SeqID_82312; Strand=+; Position=1-864
  Homolog annotation: Hit_ID=NP_473004.1; Match level="QueryCoverage =40%, HitCoverage=6%, E-value=1e-09, Identity=30%"; Hit description =hypothetical protein PFB0380c [Plasmodium falciparum 3D7] gb|AAC71865.1| hypothetical protein PFB0380c [Pl
MPIAHSSAADQAHPPLSEGTTNTNLTSDKSDQTGPETPNSQRKRSRQRKQSSSNIQRTEFLGFASTETEIAVIKQKDQRNDQPRNQRNDQPSDQRNDQPSDQRNDQSSDQRNDQSSDQRNYEFNEQQSYQMLGLYDHDDQNIEPMFVDTNAPQMIDTSDFDQIAQLAGDDLMFPHPMEVYDEPNNAEEQFVMIPVGNSTQQIAAESVGKTKSNSKSGHGKSRQSADQSMRDYASPSIQQKQKAGRPKKPKIDEKMEKAKSKMGVEEALIKPAKHKSKMTMGKTTDEK

SEQ ID NO: 155890 - protein, 72 aa, Heterodera glycines
  Coding regions on vcDNA: vcDNA=SeqID_82313; Strand=+; Position=1 -70,159-307
MLYWSSSFIKILVLYFHPLLPFFAITFKSRNRHFEKCLDLDLDFLDKNPGKSRSRKNPGSSRPGSRPGPGFF

SEQ ID NO: 155891 - protein, 92 aa, Heterodera glycines
  Coding regions on vcDNA: vcDNA=SeqID_82314; Strand=-; Position=1 -155,208-332
  Homolog annotation: Hit_ID=AAR85527.1; Match level="QueryCoverage =97%, HitCoverage=35%, E-value=9e-20, Identity=47%"; Hit description =14-3-3b protein [Meloidogyne incognita]
KAKQAYQEAFDLAKNKLRPMHPIRLTVALNFAILQFEVQKSPADACQTAQLAYDDATSDAQTTGESICAESVTIMGLLQDNISYWSGNTSKT

SEQ ID NO: 155892 - protein, 336 aa, Heterodera glycines
  Coding regions on vcDNA: vcDNA=SeqID_82315; Strand=-; Position=1 -279,332-782,844-1124
  Homolog annotation: Hit_ID=AAL78214.1; Match level="QueryCoverage =44%, HitCoverage=75%, E-value=4e-10, Identity=30%"; Hit description =putative esophageal gland cell protein Hgg-20 [Heterodera glycines]
WICNDVWMDILPSFDRPQLGLKLAILSPRFNALVDKHFDAKSELTIWRTIIIDKDKGHEPKLSVQMDDKSLSFPLPDDRPLPSKIRFKRLQIEYMDHSVIAFLRSNHQIFDKRGTNLYLWIPSPDTTDGQRIWDILIREIWPIFSTNIRHLRFTGGDDLDYLLRRTSPTIFTDLNQLVSINSYDLLPDSIGDDFDGPNATISAGQALSKWLHSPRKDGQPKRLRCANYNEQRNTTDWVNNFNEHFLRANAISSVSYQIHFSVRVQSMQIVPFEFLNEWTKEKLTLTKEKENEWDNSWIMKRCKIIGESAAVHWKDGNWDNNCNNVYFWLFAGTNCI

SEQ ID NO: 155893 - protein, 102 aa, Heterodera glycines
  Coding regions on vcDNA: vcDNA=SeqID_82316; Strand=-; Position=1-308
MEVEDAVPPLADCWPIKLFSNIFWPENRWPNVPSLLVPAAAAAAAAMRPAGDGWRNGDGCCCCCCAADGEEKPLEVGVEEEAAVANWPKEWNGKAGTGNAFD

SEQ ID NO: 155894 - protein, 217 aa, Heterodera glycines
  Coding regions on vcDNA: vcDNA=SeqID_82317; Strand=+; Position=1 -207,594-1037
MHANLAAGGGIAGPTDLPADDQQQLQQHGGTNFNPFNNANNNSSVQQQQQQQRFVRTPSANFQCVRCKLHQQRVCFAGDEHQQQQNDNSTNGYSNNEPLVSSSALLVDEQKQQQYNSNNNMTTTSSSNSNYNCNTTTTTTTSAATTDATSSAATAATMYAMEQSTQELLRQLVAAHCHQNLGPTPGHGHGHGDDDEHEHGAGDEYHHGDEDDQHHEE

SEQ ID NO: 155895 - protein, 60 aa, Heterodera glycines
  Coding regions on vcDNA: vcDNA=SeqID_82318; Strand=-; Position=1 -58,157-279
MTSFFYLLLVLLSFTQKVNALQCWSGIVFNIFDTINVNATRKDECPRGRNFCSKTDCTAT

SEQ ID NO: 155896 - protein, 90 aa, Heterodera glycines
  Coding regions on vcDNA: vcDNA=SeqID_82319; Strand=-; Position=1 -96,145-321
MTTPANAARARSAKAKLRDAKLRRAAAGRAGNLLKNMRGERCAHEKRERHHADDARLHPSVPSSLLVPLAPRPHQLPRVPLQLRAHHTAQ

SEQ ID NO: 155897 - protein, 66 aa, Heterodera glycines
  Coding regions on vcDNA: vcDNA=SeqID_82320; Strand=-; Position=1 -190,544-554
MVIEKIEPVFGAVSFFTLIIISFVLCGGFFFRFFHYFGPFSRLISLLPFSASSSDTSRPTRASYFL

SEQ ID NO: 155898 - protein, 28 aa, Heterodera glycines
  Coding regions on vcDNA: vcDNA=SeqID_82321; Strand=-; Position=1-86
MRLERSEKGRGPEYLVCETWEPEGKRGD

SEQ ID NO: 155899 - protein, 403 aa, Heterodera glycines
  Coding regions on vcDNA: vcDNA=SeqID_82322; Strand=+; Position=1 -182,227-650,2056-2237,2282-2702
IAPPDLPRLNAVELNQQSSGNKNGKTTNGKGQAGDLSHRELSKVVVPSCYNVIGDGDCFYRSVCYSMFRVDKTSNSDELRIAVGNTLQAIVNNKEYFPKNRLKNHEEFVRELEYALLEKPSTEWFNKNLEAYAKFVAIPARNGKGRWAQLEDARLISLFLMRPVVILHPIAEKKVLVELQPKYDDSSIMRRIEVYFPDGETMIAPPDLPRLNAVELNQQSSGNKNGKTTNGKGQAGDLSHRELSKVVVPSCYNVIGDGDCFYRSVCYSMFRVDKTSNSDELRIAVGNTLQAIVNNKDFPKNRLKNHEEFVRELEHALLEKPSTEWFNKNLEAYAKFVAIPARNGKGRWAQLEDARLISLFLKRPVVILHPIAEQKVLVELQPQYDDSSIMRRIEVHFPDGETM

SEQ ID NO: 155900 - protein, 68 aa, Heterodera glycines
  Coding regions on vcDNA: vcDNA=SeqID_82323; Strand=-; Position=1 -43,105-268
MKAMAAHAFIESLELMFGFYCKSTNAYIDGMMKKMENGDELKQLLVQNPCEEAKMKVKKTKMSYQRVF

SEQ ID NO: 155901 - protein, 34 aa, Heterodera glycines
  Coding regions on vcDNA: vcDNA=SeqID_82324; Strand=+; Position=1 -91,298-311
MACQKVTLDEWECAPPMMIYALMQFQVRLKRKKF

SEQ ID NO: 155902 - protein, 132 aa, Heterodera glycines
  Coding regions on vcDNA: vcDNA=SeqID_82325; Strand=+; Position=1 -198,264-464
MARRRRKKETRKVSYKVRFTTKAKCQGNCVNDSPFFPLISVVRSTGAEGSSSGQGNLNACVEHHELLRHRRLGSHCNGGDAHGPLRPAQDRHASRHGVFVPTVPARHHGQTCEPKGFGGDKFMISPICKAHS

SEQ ID NO: 155903 - protein, 555 aa, Heterodera glycines
  Coding regions on vcDNA: vcDNA=SeqID_82326; Strand=+; Position=1-1668
  Homolog annotation: Hit_ID=XP_318550.1; Match level="QueryCoverage =86%, HitCoverage=48%, E-value=1e-104, Identity=41%"; Hit description= ENSANGP00000020240 [Anopheles gambiae]
MLFGRKFTLFTDHKPLLAIFGSKKGIPIYSASRLQRWALIMANYDFDIKYTNTASFGQADVLSRLIANYPKPEEDVLIANICVETDCYINTILQSQTDHLPVTAQEIAESTTKDETLQKIVNFVISGWPTKCREPEIAPFHPKRNEILEIGGCLLYKSRVIVPSQLRGRILKALHFAHPGIVRMKPLARQYVYWPGIDSEIERVVRQCDECQGAQKCPIKAPLAPWTVTDKAFQRVHIDFAGPCQDGYVYFILVDAFSKWPEVYQMSSITAKSTVFTLRSIIHRLGIPEEIVSDNGTQFKSAEFAAFCKEFGIKHTFSPPFHPQSNGQVERFVDTFKRAMKKCSKDDKNWTEKVLLAYRTTPNNAIDGYSPDQLFFGRKLRTKLALVLPQEHKNNSENIDKIQLNKRRKDYSNNMAKQFDGRHGVKEKVFVPADSVLLLNYRNQKTYWLHGTIVERVRNSPTYRVHVPVLGRIVHRHSNQLRRNCVFEENSKHNPGAGQQPIPPANGQTQNLAHQIADPVDQRTDQQAANDPPTLALRRSQRKPKPVIRFSPSGR

SEQ ID NO: 155904 - protein, 155 aa, Heterodera glycines
  Coding regions on vcDNA: vcDNA=SeqID_82327; Strand=-; Position=1 -52,117-241,280-570
  Homolog annotation: Hit_ID=NP_659073.1; Match level="QueryCoverage =88%, HitCoverage=24%, E-value=1e-18, Identity=39%"; Hit description =cDNA sequence BC021790 [Mus musculus] gb|AAH21790.1| CDNA sequence BC021790 [Mus musculus] gb|AAH69868.1|
MCPTFGGVFAVASSNGSVGLYSTLTNSCDCLLNGSSDGSAVTHLQYSSDGNLLFAGLRKKPSIQCFDLRMPGHLLANYQRTVETNQRFFFQLDPFDRYLYSGSSTGELLIFNCKINVQLAEDGKEVEPTFTAKCSKSAVAGLRLDLSGNRREKLD

SEQ ID NO: 155905 - protein, 432 aa, Heterodera glycines
  Coding regions on vcDNA: vcDNA=SeqID_82328; Strand=-; Position=1 -123,497-589,645-731,783-905,982-1192,1241-1288,1368-1591,1714-1934
  Homolog annotation: Hit_ID=CAE59594.1; Match level="QueryCoverage =85%, HitCoverage=41%, E-value=1e-66, Identity=43%"; Hit description =Hypothetical protein CBG03001 [Caenorhabditis briggsae]
ASMSVKIQILPQKFKKITKKVAKTRKSHKNPKKCKKVTKKHLNKSSNEPKECGKEFTTERVAILDFGAQYGKLIDRRVRLIDRRVRECNVCSDLLPFSTTMNELVHNGKFSAVILSGGPNSVYVDNAPVNGKFSAVILSGGPNSVYVDNAPVYDPELLGGRLPLLGICYGFQLINKHFGGSVSLQPLINKHFGGSVSLQPRREDGRTQIQVSPKSDLFHSLKPDQFVLLTHGDGVTPETSAKNGFQPIGFSGEFVAAIENTERRIENTERRIYGLQFHPEADLTDADLTDQGIQIIDNFLRRICSLKCHYTLRNREQMCEERIRSAVGEKGEVLVLVSGGVDSTVCAALCTKALGAERVHAIHIDNGFMRLNESDRVMNSLHDIGLVSKFQKNLSNSLPYYRLLQSEVHRFNCVSDFLSGSIVQNGMTLEVP

SEQ ID NO: 155906 - protein, 90 aa, Heterodera glycines
  Coding regions on vcDNA: vcDNA=SeqID_82329; Strand=+; Position=1-318
DKRRTERKGGADELTERVRLIGRNVIPDGDLSRRIETKKATCICVVLFCCYSNHIVHLCRCFTVLFSFFSLSLSLSFFSFRFWLINSFFS

SEQ ID NO: 155907 - protein, 99 aa, Heterodera glycines
  Coding regions on vcDNA: vcDNA=SeqID_82330; Strand=-; Position=1 -24,265-331,386-442,495-613
  Homolog annotation: Hit_ID=NP_495300.1; Match level="QueryCoverage =94%, HitCoverage=22%, E-value=2e-25, Identity=70%"; Hit description =transcription factor ap-2 (2G747) [Caenorhabditis elegans] pir||T34333 hypothetical protein K06A1.1 - Cae
ENKFYNTVSGRLSLLSSTPKYRVTVGEIHRRINRINPPECLNASVLGGILRRAKSKDGGAKSKDGGKSLRDQLKTYGLVLPAGRRKTANVSTLTALVEF

SEQ ID NO: 155908 - protein, 185 aa, Heterodera glycines
  Coding regions on vcDNA: vcDNA=SeqID_82331; Strand=-; Position=1 -360,821-975,1192-1234
MPESDFLYIPGMYIVHSCIHHQQQSPLDYMVALNPVHTLQQQQQQQNATSSQQQQHANNNGTTVFIHQQQQQGTSASGGDVVGAGNGGGAVGGTLLRVLPPFLHHSPREAVEMKMDNSDGEQSSDSDSPSMNGGRGRGVKRHNARRRGGGAGTMTGAEGVIRKGKKHWQQQHKNICLNGLRSKSD

SEQ ID NO: 155909 - protein, 334 aa, Heterodera glycines
  Coding regions on vcDNA: vcDNA=SeqID_82332; Strand=-; Position=1 -47,107-382,440-863,1002-1259
  Homolog annotation: Hit_ID=AAL78214.1; Match level="QueryCoverage =52%, HitCoverage=93%, E-value=8e-11, Identity=27%"; Hit description =putative esophageal gland cell protein Hgg-20 [Heterodera glycines]
MSDNRNEAEEKMAKAIFISGDGWLCVFELLPASQLGLGIAMISHRFDFYVDEHFKTRYWTLRSMKIKMKFEADGTKEMDVVNANWESFGITQKPLPKRVVGFKAISLKYFNNNVITFLHRFRPILAARPIHLTIDTYFDQRTLESILLNIWPMIATNIRGIQLSKESFCRLRQFVPSILDDCPSLRVVNAYSSGFFTKFPCDDSAEASEGQAVAKWLFTPRPDNVPKVFKCWLECGGWHLAPRIEAFKEEFYAASSPVNFIAVIRFRSSFDHLVVPFVLTNELTREQLTLKKMNDIDRVLLIRCPIVRDESKWAKWEKEAIGWNFMDQWNRIDI

SEQ ID NO: 155910 - protein, 40 aa, Heterodera glycines
  Coding regions on vcDNA: vcDNA=SeqID_82333; Strand=-; Position=1 -60,323-385
MENGRNAMYGRNVWLEMMDGTRPGDRDLPGPEKPGPGPGP

SEQ ID NO: 155911 - protein, 40 aa, Heterodera glycines; identical to SEQ ID NO: 155910
  Coding regions on vcDNA: vcDNA=SeqID_82334; Strand=+; Position=1 -60,322-384

SEQ ID NO: 155912 - protein, 68 aa, Heterodera glycines
  Coding regions on vcDNA: vcDNA=SeqID_82335; Strand=-; Position=1-260
NQDFHYIILKLILSDEMIGTVFIGILSNVKLTNEMNCPPSIRFVRFFSFRFAFFFFHYVFVSSGAGYC

SEQ ID NO: 155913 - protein, 367 aa, Heterodera glycines
  misc_feature (3)..(3): Xaa can be any naturally occurring amino acid
  Coding regions on vcDNA: vcDNA=SeqID_82336; Strand=-; Position=1 -106,144-337,405-572,603-689,863-1010,1052-1178
  Homolog annotation: Hit_ID=NP_510795.1; Match level="QueryCoverage =80%, HitCoverage=45%, E-value=2e-38, Identity=35%"; Hit description =predicted CDS, i-93 protein like family member (XR861) [Caenorhabditis elegans] gb|AAC69018.1| Hypothetic
LFXIHINFGFLLSIVCLFYPFAYEFRLSFLRRLSAAFSQNVFPLLPYAFAPFCAFAAYKRLSAAFSQNVFPLLPYAFAPFCAFAAYKLIKYLFGGQSQKKLELKNKTVLIVGASSGLGRSLAFEFYAKGSKLILVARSIDRLKAGSKLILVARSIDRLKALCAELIKWGDENGVENANLPVFRYLDISELNGDGMEQIREIDVLVNNAGLSSRGSCDETSMEVYRRLMEIDVLVNNAGLSSRGSCDETSMEVYRRLMEVNFFGFVAITKSLGCIPDDGAILNINSIQGRVALPYRSPYSCSKHAIQAFFDSLRGEERPQLQILTVNAFFDSLRGEERPQLQILTVNGRYINVEFLPFVNDIPSILLS

SEQ ID NO: 155914 - protein, 569 aa, Heterodera glycines
  Coding regions on vcDNA: vcDNA=SeqID_82337; Strand=-; Position=1-1707
  Homolog annotation: Hit_ID=AAV44035.1; Match level="QueryCoverage =99%, HitCoverage=37%, E-value=2e-83, Identity=33%"; Hit description =putative helicase [Oryza sativa (japonica cultivar-group)]
MPKFCTWNSKQGKWLLRKNPEISKTIGRMYPVNPTEGEKYYLRYLLLHVHGKNFDELKVVNGERYNTFAKACLARGLTKNDDEWKYCLKEACQFRFPAALRSLFTSILLFGDPKYPELLWEQFKNNLSEDFLKKNSESVAYKLSLTIINKKLLQESKSLADFKNLPQETTTKEEQENINYEEERKIAEDLYKFMNNDQKKIYDIIKKVLTGEIKQKLIYIDGPGGTGKSFTLNTLYHLIRGYKKQITNMAFSGIAATLLKNGRTIHNRFKFPLNLNAYTVSGVVNGTKASEEILRSDFFVIDEAPMAPRFALDAIEKKLRELTKSNQLFGGKTIILAGDFRQTLPVKKFAVKSEIIDLTIKRSIFWNKFEHMKLIINNRAKDESFSKQVLEIGNGFNQNGFIQLPNECILSENSNLVHEIYGDIFLNNNFNELKNRIILSPYNDLTDYHNAVALEHFPGQLVSYLSIDEVETTNNFPVTTEIMNSFNAPGFPLHELKLKQNCKVMLLRNINIEEGLCNGTMLQVLELKENVLRCVILGGDKNGSEVYIHRISLITESEFPVPLKRHQFP

SEQ ID NO: 155915 - protein, 74 aa, Heterodera glycines; identical to SEQ ID NO: 145501
  Coding regions on vcDNA: vcDNA=SeqID_82338; Strand=-; Position=1-225

SEQ ID NO: 155916 - protein, 64 aa, Heterodera glycines
  Coding regions on vcDNA: vcDNA=SeqID_82339; Strand=+; Position=1 -67,649-776
MVQKELIGKFASGDYAKKPISFPTTNVFSFQNMPIFGDPSSPYDEAVEKATAETMTNENWTLML

SEQ ID NO: 155917 - protein, 82 aa, Heterodera glycines
  Coding regions on vcDNA: vcDNA=SeqID_82340; Strand=+; Position=1 -103,146-291
LDSTTNNHCQKKKAIVSNDPNVVSSEQEEADIAKAIALSLQEGGKQQQSSQNFYPSAVVGTAPTRFWHISEPSIEMGQLFKC

SEQ ID NO: 155918 - protein, 50 aa, Heterodera glycines
  Coding regions on vcDNA: vcDNA=SeqID_82341; Strand=+; Position=1-152
MKCIELLEKCDPGADPSSDPAELPFLEQMAKAQAPLIDQKLVKIDKVSKD

SEQ ID NO: 155919 - protein, 376 aa, Heterodera glycines
  Coding regions on vcDNA: vcDNA=SeqID_82342; Strand=+; Position=1 -138,301-573,644-1360
  Homolog annotation: Hit_ID=AAM19760.1; Match level="QueryCoverage =95%, HitCoverage=88%, E-value=5e-18, Identity=20%"; Hit description =glutamic acid-rich protein cNBL1700 [Trichinella spiralis]
MIYHIKKLPLCHRLWCREWKGRQQQQKAQQQKQQSKQRKMPPKLGQSADGIGRGCERRNGRERNGKGKGKAENGKQISKQMKVIETTGEAKIETITQKGKTAEEEEEKEEKKEHKETKEEPEFSMDEENQTEKEKETTEESTTVTDRVPTLPILIMNEHQGSEGRPKSVGIAVPSETNPTATTATTEGSEEGEEEEEAQKTRENGTTKAADQPISERKVMLKSEEKVQQQEDDVNATTASSSTEETAVTVKVEQQEDDVNATTASSSTEETAVTVKVEQQEDDVNATTASSSTEETAVTAKVELQEDDANATTASSSTEETAVTAKVELQEDDANATKASSSTEETAVTAKVELQEDDANATTGSSSTEETAVTAK

SEQ ID NO: 155920 - protein, 26 aa, Heterodera glycines
  Coding regions on vcDNA: vcDNA=SeqID_82343; Strand=-; Position=1 -30,495-545
MYFSASIFYKRISKRNGYVWGKNERK

SEQ ID NO: 155921 - protein, 131 aa, Heterodera glycines
  Coding regions on vcDNA: vcDNA=SeqID_82344; Strand=+; Position=1 -149,628-663,957-1059,1441-1548
  Homolog annotation: Hit_ID=NP_502437.1; Match level="QueryCoverage =96%, HitCoverage=10%, E-value=7e-41, Identity=71%"; Hit description =UNCoordinated locomotion UNC-31, EGg Laying defective EGL-22, Ca2+ -dependent activator protein for secret
MPRFVVKDMETLFIDEVRQSINLLISNLESVPVAPRQTMGRKKEKSRGNRSRSIEDLSLFNSLKRRTSSMSLNKTENGDDEVSLTKNDVVLNFNMEVVVMEVQGLKSVQPNRVVYCTMEVDGCSKLQTYAF

SEQ ID NO: 155922 - protein, 96 aa, Heterodera glycines
  Coding regions on vcDNA: vcDNA=SeqID_82345; Strand=+; Position=1 -100,327-366,524-546,646-771
  Homolog annotation: Hit_ID=NP_502437.1; Match level="QueryCoverage =100%, HitCoverage=7%, E-value=7e-41, Identity=77%"; Hit description =UNCoordinated locomotion UNC-31, EGg Laying defective EGL-22, Ca2+ -dependent activator protein for secret
LGKVVIQPTPNCSRQPEWYKMTVPKSSADKNLRIRLAIRMEKPLNLKICGYLYGIGRIAWKKWKRRFFCLVQVSQYAFAMCTYREKKSDPTEFSQL

SEQ ID NO: 155923 - protein, 223 aa, Heterodera glycines
  Coding regions on vcDNA: vcDNA=SeqID_82346; Strand=-; Position=1 -222,269-316,370-442,493-675
  Homolog annotation: Hit_ID=AAO12507.1; Match level="QueryCoverage =96%, HitCoverage=25%, E-value=8e-52, Identity=51%"; Hit description =blisterase precursor [Onchocerca volvulus]
CRSVLSLQPRPIQGRFALNFTLEVSGCQQGTPVLYLEHVQVITTIRFGKRGDLKLTLFSPMGTRSVLLPPRPQDFNQNGFHKWPFLDFNQNGFHKWPFLTVQMWGEDPRGVWTLLVESISNMWGEDPRGVWTLLVESISNNPNIGGIFSDWALLLYGTEEPAQPIFSDWALLLYGTEEPAQPSDQRYSPYAPSAYRRPGIGQALTSQVGGPSACWWPLCLFKS

SEQ ID NO: 155924 - protein, 201 aa, Heterodera glycines
  Coding regions on vcDNA: vcDNA=SeqID_82347; Strand=+; Position=1 -66,456-600,1023-1158,1242-1343,1390-1418,1798-1925
  Homolog annotation: Hit_ID=CAE74552.1; Match level="QueryCoverage =94%, HitCoverage=16%, E-value=6e-85, Identity=78%"; Hit description =Hypothetical protein CBG22310 [Caenorhabditis briggsae]
MCTKVQGFADKASKHGMDELIQADPVQIGHDHLFAKLQSLTLDFRLNEHICSLGWFSPGQVFVLDEYCARYMVRGCHRHVSLLNDLLNKADDGHLVDPTLIHYSFAFCASHVHGNRPDGVGTVTLEEKEKFQDVKERLRGLLEKQITNFRYCFPFGRPEGALKGTLSLLERVLMKDVVSPVPPEEVGDLPKKEKCECRNGG

SEQ ID NO: 155925 - protein, 117 aa, Heterodera glycines
  Coding regions on vcDNA: vcDNA=SeqID_82348; Strand=+; Position=1 -55,481-779
MKRIMADQNKKYKKGIYQLSFCFVCPNVCKSFASSLHESVRSVDDIIWGVLVSCFAGSSFNVSELSRPFPGRLVQNDGRRLLGGQRLEHLLEQRRVLLDQNLPPVRLHHLREVEIEL

SEQ ID NO: 155926 - protein, 86 aa, Heterodera glycines
  Coding regions on vcDNA: vcDNA=SeqID_82349; Strand=-; Position=1 -127,169-302
MAGQMVSDLTATNRELTASNRSYQRQLLIHRIILGVLVALNIVLIILVVFLVGGSGPTHNECVKCSERCGGLLRMEVPVRRVNCKR

SEQ ID NO: 155927 - protein, 82 aa, Heterodera glycines
  Coding regions on vcDNA: vcDNA=SeqID_82350; Strand=+; Position=1-249
MDKCLDRKDVLMCRELADEAKGAFEIVKQYRLDAGTAYRNAYTQSDLGIGELADKVKETMKEYLSRPGPSPRPTFKDQFISD

SEQ ID NO: 155928 - protein, 104 aa, Heterodera glycines
  Coding regions on vcDNA: vcDNA=SeqID_82351; Strand=+; Position=1 -102,158-244,503-628
MWSDDRYSSPEQMKLCSKKKKKVEEGEEEEHIYPVSSKSDIWAIGMMLIEFLLMTPLFDIDPVACLQIDPYRRPTARGIENFMKGECDFKWLTLKPCDEGAAVN

SEQ ID NO: 155929 - protein, 59 aa, Heterodera glycines
  Coding regions on vcDNA: vcDNA=SeqID_82352; Strand=-; Position=1-181
FFNGRPIEPSRKFEFKKEHTELVIYPFLEHDVGSYACEATNLNGRVKSEAAQIGLVGNY

SEQ ID NO: 155930 - protein, 140 aa, Heterodera glycines
  Coding regions on vcDNA: vcDNA=SeqID_82353; Strand=-; Position=1 -73,522-871
MLSFIYTEELSELNGDNAMAVLYAVPSKVLTAEEKIGIYQFYCQQNFRGMYSQLFHPLKFPSHWRIWTFGTISMKIEKVSEFARHPMESYRFSDDTVYIKGLFWKILAQLKAKTKRNDNEPFELSCKRKWRRIPLENSMT

SEQ ID NO: 155931 - protein, 270 aa, Heterodera glycines
  Coding regions on vcDNA: vcDNA=SeqID_82354; Strand=-; Position=1 -667,727-869
  Homolog annotation: Hit_ID=NP_342705.1; Match level="QueryCoverage =92%, HitCoverage=78%, E-value=1e-21, Identity=29%"; Hit description =Microtubule binding protein, putative [Sulfolobus solfataricus P2] emb|CAB56115.1| coiled-coil protein [S
MEENKGKFKENNEKWEQIIEKLKEKTKQMEENTEKIKENTEKMEENTEKLEEITKKLLENIEKMKENTREMKENAKKLKLEEKGERLEENAKKLEEDGERLMENANKIEENGERLVENANKIEEDGKRLIEIKKKEKFKETAERLIENNKKLLEIREKLEENGKKLKENNEKISKERSEKLKESIETNKKRQEKWEELKKWKEIAGAEKWLGFFLLYDAPKDDSNLGCVCSATLRIVSQKNEVRDFQHKFNDVTMKASNCWGFSNFISFA

SEQ ID NO: 155932 - protein, 27 aa, Heterodera glycines
  Coding regions on vcDNA: vcDNA=SeqID_82355; Strand=-; Position=1 -39,600-644
MQLLLLRKIALLRIGPRLIGKMAIIKV

SEQ ID NO: 155933 - protein, 105 aa, Heterodera glycines
  Coding regions on vcDNA: vcDNA=SeqID_82356; Strand=+; Position=1 -80,1271-1330,1393-1520
  Homolog annotation: Hit_ID=CAE75494.1; Match level="QueryCoverage =93%, HitCoverage=16%, E-value=2e-29, Identity=60%"; Hit description =Hypothetical protein CBG23499 [Caenorhabditis briggsae]
PQQGNFAEEKQLHPNHNVYRKMERLISLMLNVDDGVPIKTVKSFLSKIPSVFTGIPSVFTGQDLVGWLLQNVDIADLGDALHLAHLLASHGYVFQVEKFLIFIDN

SEQ ID NO: 155934 - protein, 217 aa, Heterodera glycines
  Coding regions on vcDNA: vcDNA=SeqID_82357; Strand=+; Position=1 -174,677-1065,1426-1516
LMTPEELTNPNVDEKSVMTYLSQFPRARPLYSASTRAPLEQQDSEGTTLDDSNQSDIPFPNEPSLPTDMENIPQQNHQLYNLMVCESDLNDGIAETAAEPTTDFDAVRMTYRHEELQYEPLVVVSDEETVALGTTAVRPQPGFRSLCRERSTDHIEAAAMVAVEGHGLQSFVPGHAAKFAVDASNTGGVRPMRFRNNHNDDAFLAEMRTDDVNYYRM

SEQ ID NO: 155935 - protein, 130 aa, Heterodera glycines
  Coding regions on vcDNA: vcDNA=SeqID_82358; Strand=-; Position=1 -84,129-209,734-793,837-1004
MRQCSNAGGISLQKKTPRESENSEEKQKQISSNFYGNSFFPQNVQNKAKGSEWRKQSSPTLFAPQNENSESEERKELERMGRQVAEIRSKVETIKSKMNKMANDFKKTMLELKAFMERIFDDENEKSEKK

SEQ ID NO: 155936 - protein, 174 aa, Heterodera glycines
  Coding regions on vcDNA: vcDNA=SeqID_82359; Strand=+; Position=1 -298,570-695,902-1002
MLVNRVYAFKHRQQRDDDGEGGQNDQGEEEKWAVEEAEEERYEDVDEDGLVGGDDDAAVPPPNQQKQHNGNRWRWHQPTGWLHRRPVRRSGAAASATTVGYDPTVRNPLFAGAEWAVDDELRTLCHHFHPTVSAFTRALVKEEKQKTGFISLDFLNKNLRNDVLSCSHLSTPPP

SEQ ID NO: 155937 - protein, 245 aa, Heterodera glycines
  Coding regions on vcDNA: vcDNA=SeqID_82360; Strand=+; Position=1 -218,389-585,777-916,969-1106
  Homolog annotation: Hit_ID=CAE67735.1; Match level="QueryCoverage =99%, HitCoverage=36%, E-value=2e-58, Identity=48%"; Hit description =Hypothetical protein CBG13310 [Caenorhabditis briggsae]
ELQSGTLSATQVLYAYAHFALLVNDRLNCVAEMLPEAFDEAAQLDAKYAAGGTGKNKPPLFGLPFSVKANFFLKGYDCCIGIARWLGHPRSVDCSLVTLLRQLGAVPFCYANVPQTLFSFVCSNPVYGTTGNPHDPKRSPGGSSGGDAALLAAGGTAFATGGDIGGSLRIPAQFCGLATLKPGQNRFEISNAHLGMPGHARFEISNAHLGMPGHARLGLGTGVFAKSVEEVLRTAAGCLTDIDCC

SEQ ID NO: 155938 - protein, 78 aa, Heterodera glycines
  Coding regions on vcDNA: vcDNA=SeqID_82361; Strand=+; Position=1 -82,367-437,490-573
  Homolog annotation: Hit_ID=CAE67734.1; Match level="QueryCoverage =94%, HitCoverage=11%, E-value=7e-09, Identity=44%"; Hit description =Hypothetical protein CBG13309 [Caenorhabditis briggsae]
MPAGVVPTGTVRREDDEALMDDTQWATDGNILLKWMRSAAANSVGLPVGVQVVAMRWEEEKCLGLMNAIEAMAKAQKK

SEQ ID NO: 155939 - protein, 116 aa, Heterodera glycines
  Coding regions on vcDNA: vcDNA=SeqID_82362; Strand=-; Position=1 -138,654-866
MPFYLYIAGSPMLHFAIMIERVRATLFVHNYERASTKFAVGILALVDYSLSRNYQTNENILTMRIIFPLDFSYTIFFSIFNILSGYIRIKREQFGILVYIRTYETITLVRFSELIN

SEQ ID NO: 155940 - protein, 39 aa, Heterodera glycines
  Coding regions on vcDNA: vcDNA=SeqID_82363; Strand=+; Position=1 -68,498-549
MTTLEARPLCQQPLLRPWARLSGETFWKIWVPEVWMGTK

SEQ ID NO: 155941 - protein, 507 aa, Heterodera glycines
  Coding regions on vcDNA: vcDNA=SeqID_82364; Strand=-; Position=1 -139,460-511,559-658,708-848,896-967,1017-1112,1168-1287,1335 -1643,1748-1996,2048-2081
  Homolog annotation: Hit_ID=NP_505094.1; Match level="QueryCoverage =97%, HitCoverage=22%, E-value=1e-161, Identity=60%"; Hit description= myosin heavy chain family member (5I597) [Caenorhabditis elegans] gb|AAG24132.1| Hypothetical protein F5
ALYARMFAWLIRRCNASLSEGLQREMFVGVDIAGFEIFDLNSFEQLWINFVNEKLQQFFNQHMFVLEQEFVLEQEEYRREAIRWEFIDFGLDLQSCIELIEKPLGIISMLDEECIVPKAPLGIISMLDEECIVPKATDGTFVQKLYDQHLGKHPNFKKAKPPKGKQAEADFSVQHYAGTVAEADFSVQHYAGTVRYNAKSWLEKNKDPLNDSVVAVLKNKDPLNDSVVAVLKTKQKMALLNAIWADYQTQEDVEDVQEQQMRGKVPKGKKKGKASTFQTVSMMYRDSLNKLVKVLSQTHPHVLSQTHPHFIRCIIPNEQKKSTRIEANLVLNQLTCNGVLEGIRICRKGFPNRVAYADFKQRYAILATKEAMETDPKRAGEAMCLRMERDGTLSRDGFQCGTNKVFFCSGVLASLEELRDEALSAVIVQFQRVCRFHLAQKELKRRLTEKIGVKIVQRNVRRWCSLRSWPWFRLFSRIKPLIKDLKMNEEYGSLQDNEEYGSLQDSR

SEQ ID NO: 155942 - protein, 238 aa, Heterodera glycines
  Coding regions on vcDNA: vcDNA=SeqID_82365; Strand=-; Position=1 -136,204-308,350-448,503-726,801-833
  Homolog annotation: Hit_ID=CAE66133.1; Match level="QueryCoverage =99%, HitCoverage=10%, E-value=3e-65, Identity=57%"; Hit description =Hypothetical protein CBG11357 [Caenorhabditis briggsae]
VISFFAVVGGTNTKKRTKSSTEKESSSLEDQIVRTNPVLEAFGNAKTVRNNNSSRFGKFINAKTVRNNNSSRFGKFIRIYFNNGGKLAGGDIEHYLLEKSRVILLEKSRVIKQQPTERSYHIFYQLMSGAIPGLKTKLFLDRPVHSYNFIAQAKLFLDRPVHSYNFIAQAEVAIEGMDDGEEMLTTDESFDIMMFSELEKMDLYALIAAIMHMGEMRFKQRPREEQADISDGGGGEKR

SEQ ID NO: 155943 - protein, 149 aa, Heterodera glycines
  Coding regions on vcDNA: vcDNA=SeqID_82366; Strand=-; Position=1 -81,330-529,659-826
MITKFNQKLFDLHHGNGKNLQLSVRYQLNENIRTGRQLAPNFSCHFITVFITFVMTMNFQFGIITKDEYMLLFYGFLFLAHAFNDLALPVVMLCYHPLLNRKAKASLAIIKKLLRNSSAVSPLEETAQPLDTDGRPFGERIQQENQDKD

SEQ ID NO: 155944 - protein, 44 aa, Heterodera glycines
  Coding regions on vcDNA: vcDNA=SeqID_82367; Strand=+; Position=1-132
MTEHNFEQNRRTNSSIVHEGNVQFDNENNGTERDENEIRRLLLQ

SEQ ID NO: 155945 - protein, 40 aa, Heterodera glycines
  Coding regions on vcDNA: vcDNA=SeqID_82368; Strand=+; Position=1-120
MSSLFVQQPSFSGSTPNLRSLSAAEEAGQQSAKKGHKREK

SEQ ID NO: 155946 - protein, 226 aa, Heterodera glycines
  Coding regions on vcDNA: vcDNA=SeqID_82369; Strand=+; Position=1 -136,723-865,922-964,1026-1091,1244-1380,1601-1709
  Homolog annotation: Hit_ID=XP_315683.1; Match level="QueryCoverage =88%, HitCoverage=43%, E-value=4e-43, Identity=47%"; Hit description =ENSANGP00000021837 [Anopheles gambiae]
EGSPSLPFKKIIYVFFSLTGHVQRLHFVQNEVIPSSSHFDSTGEFPWPWVRRAHALGLMNTGIPPEHGGIGLPLTVKVGIFETIAYGDIGLGTTLMVSELSQQPLLTTLMVSELSQQPLLYAYAGTLEQKQKFLLPMLGNPFLASFAVTEPEAGSDVSNVSTSAEPSEDGTFYVLNGAKKWITNCGVAQWFFVLARTAADPATPAKDAFTGFIVERDTPGLTVGEK

SEQ ID NO: 155947 - protein, 356 aa, Heterodera glycines
  Coding regions on vcDNA: vcDNA=SeqID_82370; Strand=-; Position=1 -171,473-677,727-797,852-1028,1330-1407,1466-1833
MQNDFVANLHQNGIAFLADYAALWLLGLDMLPMYNKQQQQEMKLFISQSCSCTMEAWFVQSSDSVGPFFPKMPSAGSASSPPKLTDKIFPINLTNNGEQKQIIKIKGLTDANIRSILVELLSAKKGSETKTEARFIIGTDSDLEVTLPRLSKSIRSKGVRLATGIYVLNLDIVLTKRCYLLRMNGTQLGRPICPLEGNLPLEEISGIKVQGQMLLLGDPQVNENDDKIKFTQEEAPEIRFDWWALPKGSAPLDCARLFANDAKYISQMVRRRICREEDPTENDLDMSCTAIQSRNRFWHGAKDDQQGEQNEKEHANYPMAQIRTVYKARNGITVGFKYSNGLNPFGHWFEKDSIFY

SEQ ID NO: 155948 - protein, 96 aa, Heterodera glycines
  Coding regions on vcDNA: vcDNA=SeqID_82371; Strand=-; Position=1 -37,416-541,717-844
MTLFLRHTGHPYGLELFGGPATIRTWGYAEGDVVGVGLNRSNFQTFFTLNGTLIEDCACKVTPDMTVPVVSLRGAQTTAKIFRGAPYIFEFENLYI

SEQ ID NO: 155949 - protein, 266 aa, Heterodera glycines
  Coding regions on vcDNA: vcDNA=SeqID_82372; Strand=-; Position=1 -387,1720-2133
  Homolog annotation: Hit_ID=EAL44122.1; Match level="QueryCoverage =91%, HitCoverage=34%, E-value=3e-10, Identity=25%"; Hit description =conserved hypothetical protein [Entamoeba histolytica HM-1:IMSS]
MNSEKSEKANTILVEAAKKETERAWRDVAALAEEVGDFAKSSRETLNRAIKSREKAPYANGVRELYLKMSDSIWEIFKIMDQINLESVKAESAWREFERLKTFDQATKFEELSQNSLVEARRLHFESRRMYAQQNDMQISAQGEDVLQLTAEDFAAMDEAERQWQAEQRRRREQQRRDAEERRQVRGDWHSDMLRRQHVWEQQKEEREIDRERWEQRMEDEGRKCEERSEATRKKEKEEKDKNDVTDHYSFKWGEWRKKEKLFFGK

SEQ ID NO: 155950 - protein, 120 aa, Heterodera glycines
  Coding regions on vcDNA: vcDNA=SeqID_82373; Strand=-; Position=1 -102,142-285,327-443
MQTIAEIKNFEIIEGGRVFIVRARIENVVHAEYRACVLCRKGACSCGVEKALTPYFKVSVTDDTGVLENVAFFGVRGKKNGMEELKGLSGAVCTMKIGARVKEFGGKKGIYYSLIDIVSL

SEQ ID NO: 155951 - protein, 229 aa, Heterodera glycines
  Coding regions on vcDNA: vcDNA=SeqID_82374; Strand=-; Position=1 -165,345-801,851-917
MSREAEPGWKIEKISVDLYCSALSDPVIIPARPFQHSNPDIVFNEFMHRQQSFGEEALEKEDFFWQKNRAEVEALLIEASNYKIIIHRDYESRYSDYIATYHRTPLFCFCMIERNLRFFYDTGTGTAIGRVTTVLHVTVEASYTGEGFISPMFSFWFYWEGRSQTTNESFTSRLYLYTVSMLRAMGKAWGRELLLNPVEVLIDMFYQQIWSDRGHCSIDSHPHFLTLHA

SEQ ID NO: 155952 - protein, 367 aa, Heterodera glycines
  Coding regions on vcDNA: vcDNA=SeqID_82375; Strand=-; Position=1 -202,282-799,843-1149,1727-1803
  Homolog annotation: Hit_ID=NP_001004509.1; Match level="QueryCoverage= 98%, HitCoverage=25%, E-value=8e-50, Identity=33%"; Hit description =si:busm1-180o5.3 [Danio rerio] emb|CAD60788.1| novel protein similar to DNA polymerases [Danio rerio]
ECDVKEELKKNKEMKKFFESVPDKGPINPRDAYAGGRTMPFCLYAKATEEVEISMFDIISLYPFVNYVSRNFNVNWTTPDDVPYDGLLKVKVIPPKNLLYPLLPVHIDEMLLFPNCWSCARRAKNEFVMTKDVKKCNHRPTQRAFLGTFTSIELRKALELGYRIVGFYRAYHFEQFDSQLFKGYVRMFLKIKVEASGWPAEVKSEDEKRAFIEMYKAKYDIGLDYDKIGFNPGLRMIAKLGLNSLWGKFSMRNTLSSTEIVGSMERWMELGRDNTIEFGRPVKISEEISRVVYRKKEEFIREHKVSNIVLSLWTTSAARLKLYEYMEQVYKKEGCKLLYCDTDVKEKLPRNFKRSPPLEKYQKLFQE

SEQ ID NO: 155953 - protein, 198 aa, Heterodera glycines
  Coding regions on vcDNA: vcDNA=SeqID_82376; Strand=-; Position=1 -55,176-397,445-548,655-870
MVLTRKKSENLKNMSNSGWLKQTDAAPTADGEGTSTQAAESACPSKNYQLDKQLKEQEQAISFLRLQVRNRDAMIAELRRQLEQQAPKDQPTTSTRRKKNAATLERTSRRNLAEKIADVIDRDRSRSAQPLSPRDLDELETSIDQFRTFLDDQPRMRTLLALKPKVHLVLNHFVPFARQHKFLALLDEQGQGHKAFEI

SEQ ID NO: 155954 - protein, 499 aa, Heterodera glycines
  Coding regions on vcDNA: vcDNA=SeqID_82377; Strand=+; Position=1 -78,129-179,234-388,436-838,1160-1309,1374-1445,1492-1617,1677 -1790,1846-2037,2083-2238
MKCIGEKALGCFISPELAKDANKMAKIAENRDKALTDSPNGPNDRVELFANANLSSRPVADSAKKRDASTSRLNQTINSTVDDPNATKRARSASGRRRSVAVLPNNSMLNDNTDEGNPRAPRRSHFVGSGGLSSAVSYSSNLNTTMTLQSQNVAGKFQLDPKFFQNDFDDNTLLAGNNRGERELTNTTQTLLLDKTFKVSTPKVGDKHNNNTNAAQSMDQASSVDLQPIKPVVRPTSTFSRRSESVSSISSLESAEHIDRTVHNISCLQLNIAEEALAQLLHLMNDQTTRQYIIDRTELILKTMVTQIFHIRSQHLEQLDGVKEGDQKEQELSEFMRSICNFLSTLTNEMTIMQRISTDTLRSFIDSLLSLVSDQRLKILNKQVFRSLNIIVIRLCEFTNPNVCFVALMKLVMKYQASDPGGQLSSLVRKCLTKFTDAIVEPTRIEKVDILTVLHPIHEYYSRFYVADGQTNQISDTVKDTSKLLCIFLQRLVINQKYA

SEQ ID NO: 155955 - protein, 120 aa, Heterodera glycines
  Coding regions on vcDNA: vcDNA=SeqID_82378; Strand=-; Position=1 -29,118-451
MEDIRFEKLNGTLSNWVLERDFDKCIRPGVLSKGGAVSDVVHIAKHLGVRHFSPFGTDCVAPPAVNTSTIKSELTTSLSPAGGGSSPSIKEEGNNGKQQQMTRFECAYLVMNSQPSTLFA

SEQ ID NO: 155956 - protein, 50 aa, Heterodera glycines
  Coding regions on vcDNA: vcDNA=SeqID_82379; Strand=+; Position=1 -58,675-769
MARRFYGVRVQFALERRSRVIPVYKSTLRFQKFNAALVGTAGSFLGHALK

SEQ ID NO: 155957 - protein, 239 aa, Heterodera glycines
  Coding regions on vcDNA: vcDNA=SeqID_82380; Strand=-; Position=1 -295,346-440,1255-1581
  Homolog annotation: Hit_ID=NP_496508.1; Match level="QueryCoverage =51%, HitCoverage=31%, E-value=2e-45, Identity=71%"; Hit description =G Protein, Beta subunit (37.4 kD) (gpb-1) [Caenorhabditis elegans] emb|CAA88948.1| Hypothetical protein F
MALFLPFVQFFPNGHAFATGSDDATCRLFDIRADQELAMYSHDNIICGGPFLVILFQLISDRSLGVTSVAFSKSGRLLFVGCDDFNCNLWDSMRVERTGIISGHDNRISCLGVPNDGTALCTGSWDSLLKRNVRHQPTQFRAQQVPHRTHFGFAERRPARVNVGAWASGGAGLCKSGKCQSQKYGAENCVRWRGDPTCPAVAPVAIGVRTDAPFVQRVVAGARLAPQAVPAHGEGVPVR

SEQ ID NO: 155958 - protein, 260 aa, Heterodera glycines
  Coding regions on vcDNA: vcDNA=SeqID_82381; Strand=+; Position=1 -211,284-486,547-666,714-761,1717-1839
  Homolog annotation: Hit_ID=NP_494213.2; Match level="QueryCoverage =76%, HitCoverage=40%, E-value=1e-61, Identity=53%"; Hit description =carboxypeptidase A4 (51.9 kD) (2C501) [Caenorhabditis elegans] gb|AAC68743.2| Hypothetical protein Y59C2A
PPSHANASPSVNASVLRQFDFVVIPCANPDGYAFSMSRDRLWRKTRSRNDSLHKWCVGADANRNWGYRWAETGASRSPCSNIYPGRAPFSEPEVRAVRDLLSPELSRLVAYISLHSYGQLVLSPWGFSNVKPSNHWEQQKLASLVIDSIQKLASLVIDSIREATGTEYTFGTIADLLYPASGTSIDYWQYRGVPYIYGVELRPEDYRGVPYIYGVELRPEDNGISPELNLPFSFPSTAFSLLIVRTRGVYVRLVPGECLL

SEQ ID NO: 155959 - protein, 29 aa, Heterodera glycines
  Coding regions on vcDNA: vcDNA=SeqID_82382; Strand=-; Position=1 -85,558-562
MVRSMLRPSIFALLLLVCLLSVLPKPGHG

SEQ ID NO: 155960 - protein, 149 aa, Heterodera glycines
  Coding regions on vcDNA: vcDNA=SeqID_82383; Strand=-; Position=1 -439,718-729
  Homolog annotation: Hit_ID=EAA20984.1; Match level="QueryCoverage =93%, HitCoverage=14%, E-value=1e-11, Identity=30%"; Hit description =MIF4G domain, putative [Plasmodium yoelii yoelii]
GNEELDDSWGWDEQGGGEDQRSDQKEREEHIDRKGYEKQTDHCGNEELDDSWGWDEQGGGEDQRSDQKVREKQTDRKRHEEQTDHFGNEELDDSWGCNEQEGGEDQRSDQKEREEQTEIEQKQEKRFDQYEEAAASEPKKTIFDNLYVR

SEQ ID NO: 155961 - protein, 397 aa, Heterodera glycines
  Coding regions on vcDNA: vcDNA=SeqID_82384; Strand=+; Position=1 -930,1315-1578
  Homolog annotation: Hit_ID=NP_502797.1; Match level="QueryCoverage =78%, HitCoverage=87%, E-value=3e-51, Identity=35%"; Hit description =HASI (4P602) [Caenorhabditis elegans] emb|CAB16520.1| Hypothetical protein Y57G11C.19 [Caenorhabditis ele
MGKTVEKILSKIYYNLKSPASFAGIQKILIEAKKIDPKITTDDVNKFLEKQRTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQAGKMKNYFEGKFIIKNVMYSPDLHAGVVERANRTIKERLYRYFTKMDTLRWVDVIDKIITNINNSVNRTLGVKPSSITFENAGNIWDKLFGNLETEKKNKFKIGDLVRITKEKGIFAKGYLPNFTEEIFKIYKIIKSDPIAYRIEDLNGDNIKGIFYDAELKIGHKMDKCLDRKDVLMCRELADEAKGTFEIVKQYRKDVGTAYRNAYTQSDLGIGELADKVKETMKEYLSRPGPSPRPTFKDQFISD

SEQ ID NO: 155962 - protein, 24 aa, Heterodera glycines
  Coding regions on vcDNA: vcDNA=SeqID_82385; Strand=-; Position=1-79
LTHRPLRRKNQLNCTWSPKLNRRV

SEQ ID NO: 155963 - protein, 221 aa, Heterodera glycines
  Coding regions on vcDNA: vcDNA=SeqID_82386; Strand=-; Position=1 -142,286-431,477-682,1886-2008,2053-2102
RGKWIIPVCHFLLTSKSQASYIRMFELLHQAWPTFAPTSFTIDFELARYCTDSVFAENARMITSVAFVPLCDIRMAVAALDTEFGNLAVFQPLIDWLLINYVGQPRPNGTWSQPTFRPEQWNVYTRTLNADARTNNHSEAEHHRLQGAFNCRHPSIFHFIDVLRPKGTKRRRGIHADQLERLYSAEWPQIICKTMGHLAKINFYKSPATVATGFGRIGNVD

SEQ ID NO: 155964 - protein, 31 aa, Heterodera glycines
  Coding regions on vcDNA: vcDNA=SeqID_82387; Strand=+; Position=1 -29,73-138
VKINRNSRVHSIVARNSPEKLQNNVKLIGIL

SEQ ID NO: 155965 - protein, 123 aa, Heterodera glycines
  Coding regions on vcDNA: vcDNA=SeqID_82388; Strand=+; Position=1 -100,1144-1352,1659-1721
  Homolog annotation: Hit_ID=NP_499392.1; Match level="QueryCoverage =56%, HitCoverage=6%, E-value=1e-14, Identity=60%"; Hit description =OXidative stress Induced OXI-1, ubiquitin protein ligase (120.9 kD) (oxi-1) [Caenorhabditis elegans] emb|C
MYECERPFGRDQLRQIAKFVNLFCFHALWNELIAVYEGICVDVQLAPVLLAAVLGKQLHPFDELATFDPVLYKNLTFLKHYSDSDDVADLELTFCAQDEFLGRGFLHPSDGPPSCRQTDQGPD

SEQ ID NO: 155966 - protein, 57 aa, Heterodera glycines
  Coding regions on vcDNA: vcDNA=SeqID_82389; Strand=+; Position=1 -145,515-540
  Homolog annotation: Hit_ID=CAE67965.1; Match level="QueryCoverage =98%, HitCoverage=23%, E-value=5e-14, Identity=62%"; Hit description =Hypothetical protein CBG13569 [Caenorhabditis briggsae]
STFIDARHKGNISRFINHSCEPNLSLQIVRLGRQCPSLAMFASRDIQSGEELSYSYG

SEQ ID NO: 155967 - protein, 115 aa, Heterodera glycines
  Coding regions on vcDNA: vcDNA=SeqID_82390; Strand=+; Position=1 -28,1315-1632
  Homolog annotation: Hit_ID=AAP51089.1; Match level="QueryCoverage =99%, HitCoverage=33%, E-value=1e-33, Identity=55%"; Hit description =transposase [Forficula auricularia]
SEKTVILRNRGGVLLLHDNARPHVAFSTQQKIEKLRWAVLPHPPYSPDISPCDYYLFRSMEHFLRGKEFADQNEVENALDDFFGSKNDQFYKKGIEMLPERWGRIIDQKGEYIID

SEQ ID NO: 155968 - protein, 31 aa, Heterodera glycines
  Coding regions on vcDNA: vcDNA=SeqID_82391; Strand=+; Position=1-98
PAVALATPLLPEAKIAKAKPTNRPSNYLLDR

SEQ ID NO: 155969 - protein, 69 aa, Heterodera glycines
  Coding regions on vcDNA: vcDNA=SeqID_82392; Strand=+; Position=1-446
KKFSIRHLLMLSFHTQYFIFYIYKPIFFFAFFFVCLSETINFCFDIPSSYIKIYQILSTLGPYKLWPTC

SEQ ID NO: 155970 - protein, 116 aa, Heterodera glycines
  Coding regions on vcDNA: vcDNA=SeqID_82393; Strand=+; Position=1-351
MHYNSQVTAGLFLSICRQKPILAAFSLRSLAKSSQPAFFSILQTPVAMFRLAILLLPCPLILCMEWQDFIIDKFGYRRAQPWHCCGICPDNNIYDKGRCVNESSYETETDRYIRIN

SEQ ID NO: 155971 - protein, 109 aa, Heterodera glycines
  Coding regions on vcDNA: vcDNA=SeqID_82394; Strand=-; Position=1 -34,435-526,590-793
MGWAITIYILKRPVCRSVEMLVQMIENGMDVARINFSQEDQEYHRVTIKHVREAAVKCDGGREQSYRVRHQRGQGARVHPQRRLCGAYHRMEIGSVSLEFKHSVIIALN

SEQ ID NO: 155972 - protein, 100 aa, Heterodera glycines
  Coding regions on vcDNA: vcDNA=SeqID_82395; Strand=+; Position=1 -155,291-393,460-504
MHKNGAFSSTFHRLYHAFCEIDSECERKRSVLSSLPLMGVVAWLEEHTITFKSKNEFEFPFLDVLGRNLRIERRTMPGERADKCVTNSSSSSSTVAIEPV

SEQ ID NO: 155973 - protein, 188 aa, Heterodera glycines
  Coding regions on vcDNA: vcDNA=SeqID_82396; Strand=-; Position=1 -142,195-341,405-487,532-631,685-778
  Homolog annotation: Hit_ID=NP_497572.1; Match level="QueryCoverage =79%, HitCoverage=53%, E-value=2e-48, Identity=57%"; Hit description =predicted CDS, WD repeat domain 7 (3D600) [Caenorhabditis elegans]
PQALITTLSTEVSYLFGGVSQGWHGIPIPGNFWVSECLPSLVLVIRMVARYNAVAQHQTIQHTIQSPLMRARNEVLRLLEQLSDKQYNFVVDLIIPVGEVLVHCLDLSLLKQRSLFELFPAIAKFYMVAYCPNTRRLAFGGKNGAIIVHELRASKAQTVQAHRAPITALAFSLDGKYLAAYAAQDAKI

SEQ ID NO: 155974 - protein, 774 aa, Heterodera glycines
  Coding regions on vcDNA: vcDNA=SeqID_82397; Strand=-; Position=1 -330,714-852,1257-1336,1384-2180,2407-2741,2971-3048,3105-3246,3299 -3445,3506-3588,3633-3732,3786-3879
  Homolog annotation: Hit_ID=AAK29933.2; Match level="QueryCoverage =83%, HitCoverage=35%, E-value=1e-83, Identity=47%"; Hit description =Rab connectin related protein 2 [Caenorhabditis elegans]
GLLLLDYELCATESEDGGANFAATVPPPPNIECLSGAGTDSGRALLNTLISRRIAAASSPLHHHPHHQDNGIAADHCHPHFDGGGAFPSGLVFAARNAAACANPRATIGAIVRHGLPLTFCCSLKAHLLSVVALSNTLMTLKSKSNQLAIKKPPLKWQDNCIEIRDAAQALLIRELTRMGGDGRRRLIERWSNFLPTVLDPSISIFGTHFGGAGTTSQLSTITSGAGAAHHSHGNNTNNIGTLQDNHHQHHVAFVEEKPLPVILKTTTGHQHHHLHHHLSATGSFFQMDSSAANSSNSVASSTASSTTTATAVTKLAPPPRPAVPPIPPRTVSSGALPSLLPPSSMVGAECGGGGATTETVVDTSGVGNDMPNNCRSSPRSSLTSNNKHNQHHQHKHFSVSQQQQQQQQLAASSSLASSSVAQCNSSSLSSLDDPYQQCASSTAIANKLQEDQMLLCGGVHQVHRNQATAIVLLGAMGAEFPSDLQRNTDLCRATALSLLELLLVPESPLLPANSPLRRAAIDLLGRGFVLWQPHLDLSKTILGLLNLASAAAGVDEEKSDFCCFTTEADACKTARHALSLIALSRPQALITTLSTEVSYLFGGVSQGWHGIPIPGNFWVSECLPSLVLVIRMVARYNAVAQHQTIQHTIQSPLMRARNEVLRLLEQLSDKQYNFVVDLIIPVGEVLVHCLDLSLLKQRSLFELFPAIAKFYMVAYCPNTRRLAFGGKNGAIIVHELRASKAQTVQAHRAPITALAFSLDGKYLAAYAAQDAKI

SEQ ID NO: 155975 - protein, 74 aa, Heterodera glycines
  Coding regions on vcDNA: vcDNA=SeqID_82398; Strand=+; Position=1 -31,165-358
MGASLDLCVCGIDRKRGDRKCPSANVRPTMSRPQMSVRKCPSANVRKAFEYAFHRMLSQLFHNPMDDLDDHGAH

SEQ ID NO: 155976 - protein, 267 aa, Heterodera glycines
  Coding regions on vcDNA: vcDNA=SeqID_82399; Strand=+; Position=1 -136,187-273,654-710,756-1255,1361-1384
  Homolog annotation: Hit_ID=AAM09317.2; Match level="QueryCoverage =45%, HitCoverage=14%, E-value=8e-13, Identity=31%"; Hit description =similar to Vibrio vulnificus CMCP6. TPR repeat containing protein [Dictyostelium discoideum]
MFDNENGGSGEPQQINENIPAKTSYNVQPWKLFRPKYMLTYRMCELCLSSLWNNTNKYIANERRSLISFELCEKYNVPADQNAQGGNASGDGNVPSFGATIETHMERSRRRLLHDEMVQRSVQQHFQHQQQQIMFQAQQQEQRRVEMQRQFDEAEHLQEEIQAADERQNAQQNDQEQEQEEENVQHAVQQQQFERTVRLQLRESQRFYGGSPSSVLVPPVQLFWETECVICTTSRPHFYSKECGHIYLCSECAVTAVINKLKFVLLP

SEQ ID NO: 155977 - protein, 83 aa, Heterodera glycines
  Coding regions on vcDNA: vcDNA=SeqID_82400; Strand=-; Position=1-252
MLLRLALLLWLGIRGALHMGNRLTLKMQCDEMQKAIEAGRGRAKHFRIWEDLDHSPPPHSVPEMRLTGKPGYARFSSTHRPKC

SEQ ID NO: 155978 - protein, 43 aa, Heterodera glycines
  Coding regions on vcDNA: vcDNA=SeqID_82401; Strand=+; Position=1-131
SISKQSVGVLKAQRHFLGVQVTARGATTTERQRDEEEQNKAER

SEQ ID NO: 155979 - protein, 121 aa, Heterodera glycines
  Coding regions on vcDNA: vcDNA=SeqID_82402; Strand=+; Position=1 -226,1091-1230
MSNNKEEAVINNASNNKLIVYLISTINFSKDLTNHWCKGGFLWERSNGGKTEDTVAICKPNEHYCYVANCSVAMAAIIFCFFVGNASRTLTQNRKSEHPSENQTISPSRKQSTKFQKKNLL

SEQ ID NO: 155980 - protein, 70 aa, Heterodera glycines
  Coding regions on vcDNA: vcDNA=SeqID_82403; Strand=-; Position=1-212
NIHWKENKRIFFLHLMRFRFGNLLPYITIIFRYRIKIQIATDRPFVLLVVQLLVFLCQPMVRTLQTVQHS

SEQ ID NO: 155981 - protein, 24 aa, Heterodera glycines
  Coding regions on vcDNA: vcDNA=SeqID_82404; Strand=-; Position=1-80
RTLSTAVRQRSSKIYSMPQILWAG

SEQ ID NO: 155982 - protein, 76 aa, Heterodera glycines
  Coding regions on vcDNA: vcDNA=SeqID_82405; Strand=-; Position=1-231
  Homolog annotation: Hit_ID=NP_608540.1; Match level="QueryCoverage =97%, HitCoverage=54%, E-value=8e-10, Identity=45%"; Hit description =CG2839-PA [Drosophila melanogaster] gb|AAF51469.2| CG2839-PA [Drosophila melanogaster]
MRERGKNERKRKKEEEEKMREEERAKDERKRKKEEEGKMREEWEEEKGIRVERGKSKRWGKRKEEERKMKKGKSKR

SEQ ID NO: 155983 - protein, 75 aa, Heterodera glycines
  Coding regions on vcDNA: vcDNA=SeqID_82406; Strand=-; Position=1 -126,177-278
LTECAVPTDCVHRVERALLQRIQVPRCNSTDYFDLLKCLDFIILTRTNLTELNSRAGRVCCEMDKVSLSCQLACR

SEQ ID NO: 155984 - protein, 16 aa, Heterodera glycines
  Coding regions on vcDNA: vcDNA=SeqID_82407; Strand=-; Position=1 -34,1533-1549
MSLSRASKGIIVKNCL

SEQ ID NO: 155985 - protein, 25 aa, Heterodera glycines
  Coding regions on vcDNA: vcDNA=SeqID_82408; Strand=+; Position=1-77
MTSLYKFLPPLINCSIILPSYAEQC

SEQ ID NO: 155986 - protein, 62 aa, Heterodera glycines
  Coding regions on vcDNA: vcDNA=SeqID_82409; Strand=+; Position=1 -92,783-879
MSLLLTFIRPLLPLPPLLSLSLSLPPTLYPRDGYGNEQNGYCNEHNGKLTRWGDYIIVIIKW

SEQ ID NO: 155987 - protein, 266 aa, Heterodera glycines
  Coding regions on vcDNA: vcDNA=SeqID_82410; Strand=-; Position=1-799
  Homolog annotation: Hit_ID=XP_392311.1; Match level="QueryCoverage =90%, HitCoverage=31%, E-value=1e-33, Identity=26%"; Hit description =similar to Short stop/Kakapo long isoform [Apis mellifera]
MQGVQDWLYGAEEHLAMVPQQSKLVEPLSAQLQHHQAFHAELGERVEQMKELSNKGIRIQLSCEKKDAIPMKNRLVSMKHRMDKLGQRSGERLKSLTMALDESRLFFDSRRDLLHWTEDQQRWLRDREAAEPSSTGTGERIREALTEHRTLADALQRKTGVYDEVRRRGSALAEHAPPSEKLQLDEANEEMTRCWEALSRAALRRQRSLEEALIQSGKFDEVLAELLNWLGTVLPPLEAELNIGNFLGNVGRIIKFGVNDSSNNFF

SEQ ID NO: 155988 - protein, 51 aa, Heterodera glycines
  Coding regions on vcDNA: vcDNA=SeqID_82411; Strand=+; Position=1 -90,213-278
MAHDFCFKNFYEIFIYANFIGLNFKKALSKNISFEHINNMPIKFGAFQSPF

SEQ ID NO: 155989 - protein, 87 aa, Heterodera glycines
  Coding regions on vcDNA: vcDNA=SeqID_82412; Strand=+; Position=1 -137,630-757
VILTQSWLRRSWPDGVGPFRGAGSARGTGAPTARLASSAATCCHCETDHPLITDLPLFSHGWPTNGTNTNGLGMKHYWPRMDLDSIF

SEQ ID NO: 155990 - protein, 54 aa, Heterodera glycines
  Coding regions on vcDNA: vcDNA=SeqID_82413; Strand=-; Position=1-278
VSLFAFRLSHFLAFRISLFAFRFLARNATFTPLRIGLNSHKIFQNFTYKLANFQ

SEQ ID NO: 155991 - protein, 50 aa, Heterodera glycines
  Coding regions on vcDNA: vcDNA=SeqID_82414; Strand=-; Position=1 -106,868-914
MRWQGGKFVHLGHGFFLSPGPVHFRQPWIFVQEISGLFDALSTNSSFQGR

SEQ ID NO: 155992 - protein, 171 aa, Heterodera glycines
  Coding regions on vcDNA: vcDNA=SeqID_82415; Strand=+; Position=1 -186,1524-1649,2474-2677
  Homolog annotation: Hit_ID=NP_491489.1; Match level="QueryCoverage =24%, HitCoverage=6%, E-value=1e-11, Identity=76%"; Hit description =aminopeptidase -pro (69.3 kD) (1F534) [Caenorhabditis elegans] gb|AAB96739.1| Aminopeptidase p protein 1 [
MANSELNTMPSNGDLKHNNAAEKVQQPNDLKKVNEGGGGGAEAGQDGTAPTAAEQAQKKPSPSEYLCDRDLRVQFLSGFTGSNAFVVVTQQDALLWTDGRYFVQIWTDRPPEMPKKLIHLGETECGEKPASKLRRLALLIRKANCDSIVLSQLDEIACNEFVKHLMEKTEN

SEQ ID NO: 155993 - protein, 68 aa, Heterodera glycines
  Coding regions on vcDNA: vcDNA=SeqID_82416; Strand=-; Position=1-207
MANFLLSLLLTASPLPLALLPPALPSAGDDGTVEGVVVLVVVVFVGVVGAAFGFTDAVVPLALASTTS

SEQ ID NO: 155994 - protein, 172 aa, Heterodera glycines
  misc_feature (6)..(6): Xaa can be any naturally occurring amino acid
  Coding regions on vcDNA: vcDNA=SeqID_82417; Strand=+; Position=1 -169,493-631,788-884,1161-1274
  Homolog annotation: Hit_ID=NP_491489.1; Match level="QueryCoverage =94%, HitCoverage=26%, E-value=6e-38, Identity=47%"; Hit description =aminopeptidase -pro (69.3 kD) (1F534) [Caenorhabditis elegans] gb|AAB96739.1| Aminopeptidase p protein 1
YANFAXKKKRKFPFSFVLAVNLDGICRAPLWAHGCNFDHGVGHGVGHFLNVHEYPPYIGYRVQSKYNYLHKGVVVTIEPGYYAQGSFGIRFENCYEVVDANASSDSRKFAMFAPLTFVPVQKSLLVRELLDQREIDWLNRYHNQCLEAVGRYLQEKSMQEEYNFLAEACTPF

SEQ ID NO: 155995 - protein, 443 aa, Heterodera glycines
  Coding regions on vcDNA: vcDNA=SeqID_82418; Strand=-; Position=1 -39,98-668,714-1008,1328-1754
  Homolog annotation: Hit_ID=NP_702308.1; Match level="QueryCoverage =79%, HitCoverage=4%, E-value=4e-13, Identity=27%"; Hit description =hypothetical protein PF14_0419 [Plasmodium falciparum 3D7] gb|AAN37032.1| hypothetical protein [Plasmodium
MGKQRKEKNEKAFHEFVTASDESLNPSESENSAEIFFDTNEDQIEELIEKESQNYKMNEIKSDEKEAEKSEEKEKIPKKEVKEEEEEKEIEGHFEFNEEMEEMNRENEHWIQKSQNKKSKGKEKNGKRKKNYSSEKQKNNSENSIKNENNSENGKKSLETNDTLRKGEKLRENVKNSPKNLMERTRDITCIVSLKKMGISKLIDLMDDHFLTILYKNYFEDKFGAECVPFLHISLLGKAIEAKRKFIEKSAKNEIAEKNNWKKFNGKWKEFVGIKLDKFETMQFLMEKLYFVHNELDIYVLDEQNERSLIKTIEYLEAIELMKIEKESAEFKTHSSKQTVSIPQNDKKANGLITTQFGSFKSTEFNQMLDILHTHIFSVLVAKNVQKITASNESDETKCAPNWQRYYSHIINMERLNSLFKSVENLVKSVENIEKMEKQQKIG

SEQ ID NO: 155996 - protein, 270 aa, Heterodera glycines
  Coding regions on vcDNA: vcDNA=SeqID_82419; Strand=-; Position=1 -167,293-651,727-1013
MLQFYYFFTIFLLFLPLFSSGDECYFHYLRDTKLENLKSRPHYSVVMPQCFADLFSIYIFFIPLPIISFRKLDVKSNAKTNKNLEWVEAKDARAFKGQLYGVETFLDLILARGQGLFDWRTSPSKELIERQQWHIKRLKKLAEKQEEAGKQKQNQHQRQQTQHQQQQPEFGHDTYSYQPFLQAILSQNSYNDRFFNHIDHPIWQIGLFKRINKESVECNECKDTLPLSDGSLNQLKQHLSDKHSETEYESTYNQIYKELNEGTRENLKFY

SEQ ID NO: 155997 - protein, 51 aa, Heterodera glycines
  Coding regions on vcDNA: vcDNA=SeqID_82420; Strand=-; Position=1 -39,864-980
MSAMFKQNKRMERDSKIHLIPHPSDCLLVHPPIPTSHGAEQPLRNSAEVIV

SEQ ID NO: 155998 - protein, 176 aa, Heterodera glycines
  Coding regions on vcDNA: vcDNA=SeqID_82421; Strand=+; Position=1 -190,233-374,1164-1361
  Homolog annotation: Hit_ID=NP_608751.2; Match level="QueryCoverage =98%, HitCoverage=54%, E-value=4e-24, Identity=30%"; Hit description =CG3488-PA [Drosophila melanogaster] gb|AAF51139.1| CG3488-PA [Drosophila melanogaster] gb|AAQ22551.1| LD0
GNGEMEAMFRVLAKVYPRTYFIGIGFSMGANVLTNCLASGLDPSISSRILLGISVCQGYCASDASSLLFDWQGGRRFYNYIITESVKRLLRRNYAMVVQPHVKSGLVDERIFINTLDDPLVPEALWEPVRQLCETHPLHAFVLLKHGGHLGFLEGNSLRPRSITWLDRFILQVAAA

SEQ ID NO: 155999 - protein, 140 aa, Heterodera glycines
  Coding regions on vcDNA: vcDNA=SeqID_82422; Strand=+; Position=1 -188,501-735
TMEKIKNNIGDSYVWISVDETTDKMGRAMANLLIGKLDGQKWHNPHLISVKCLEKVDSAAIARFNFLSMAPYHPIWKIGLFERSKENDKIAECVECKAQKQRKFQFKLSDGSVSSLIGHLKSDKHKNSEYKNKFDEIIKT

SEQ ID NO: 156000 - protein, 312 aa, Heterodera glycines
  Coding regions on vcDNA: vcDNA=SeqID_82423; Strand=+; Position=1 -254,295-482,696-802,849-1109,1159-1222,1266-1330
  Homolog annotation: Hit_ID=AAL93203.1; Match level="QueryCoverage =98%, HitCoverage=54%, E-value=6e-20, Identity=25%"; Hit description =transposase [Bactrocera dorsalis]
MTRLDKAIINLICCNNLSFNLVNSPQFRVLCKPWSEQLKDESHYRKLLPVASELVKGKIKEELRKCDSFSCTSDIWSGPNQGFISLTIEGVTNKWERVRHTLAIKPFPGTHTGRRVAEILSEIIDQWECRDKIHTFATDGGTNMKKVANCRRIVGRVKHSIKAFTELNEAQIEEGLPQHKLLQEMAVRWNSSLIMIRRLSEQRAAIDRIAFEQRKFELTLQDGEWRLLNSLEMLLAPLEEASLYFCKSPLSTQIPFSRALLSQLKNLDLRKMRSKLLAGLEERFGPFGEMRNYDALSTFLDPRYKYLFANDE

SEQ ID NO: 156001 - protein, 258 aa, Heterodera glycines
  Coding regions on vcDNA: vcDNA=SeqID_82424; Strand=-; Position=1 -194,256-461,523-646,740-820,878-982,1947-2011
  Homolog annotation: Hit_ID=CAE67302.1; Match level="QueryCoverage =89%, HitCoverage=26%, E-value=3e-58, Identity=47%"; Hit description =Hypothetical protein CBG12755 [Caenorhabditis briggsae]
MPYLFRPSSDIVKPIFFEYKSANSGKTHHGLLLLPANRNGTAKFPVIHAVYAGPSVQLVRNSWYSVCHNLKYVAFGYAVLMVDGRGSANRGLQFESAIKHRMGSAEIEDQQEGMRMAGERFGDLLDMERVAVIGWSYGGYASLLLLACFPGTYRCACVGGAVSDWHLYDTAYTERYMGMPDENAEAYEKSALSSFVPRLPNEEGRLMIVHGMIDENVHFSHCAKLMSALIAAQKPYRVRFSAAAPPARASPCPPAEAP

SEQ ID NO: 156002 - protein, 79 aa, Heterodera glycines
  Coding regions on vcDNA: vcDNA=SeqID_82425; Strand=+; Position=1 -150,480-569
MFRQHFLLTTMLLCALLYPIIIGVGPPAYLAICQWKDCVGEKPAPGGSHTMICLPATRPAQCPEEAWNQLTELNELEPC

SEQ ID NO: 156003 - protein, 58 aa, Heterodera glycines
  Coding regions on vcDNA: vcDNA=SeqID_82426; Strand=+; Position=1 -59,270-387
MMQVVIRQMIAIKSNAASPISLISLKEVPSGFFESLITNQPILDYGRGVICPDLSDLS

SEQ ID NO: 156004 - protein, 191 aa, Heterodera glycines
  Coding regions on vcDNA: vcDNA=SeqID_82427; Strand=+; Position=1 -150,193-360,474-731
MILPELLDIMSHFKVKIKDRMDKQFFGIITGQLLHRLTEKEEQTLKNAFTSFYKTTLDYVAKWFRTERYPDHIQWLSLTDRQLVHENVIELASTFSPDLSDTLFDEARKQINVNSRLKCICGESVFALFGAMDRCAKFVEGRRHSEVAGPNQSQLQFYMLGISQNAYFEQKIAQIDHGRSKIPHLNILNVF

SEQ ID NO: 156005 - protein, 34 aa, Heterodera glycines
  Coding regions on vcDNA: vcDNA=SeqID_82428; Strand=-; Position=1-106
LNAQDEVRNTVKANADCEMDPEEISPVPDDYLTK

SEQ ID NO: 156006 - protein, 157 aa, Heterodera glycines
  Coding regions on vcDNA: vcDNA=SeqID_82429; Strand=-; Position=1 -39,365-483,528-745,1068-1165
MAIKDQELVQFLKLPQLQVKPFKLTANAVVLAGLSGATSVAFYTIDKISAYWTVPFTLWAIFCAGLTVKANFDAPPAQPLDAPLAQPLDAPPAQPLEAPPANDELILQQMTMLSDTVQNMNDNFEDRMDRMEVRNTISMCASILAIVISGAVFFCKK

SEQ ID NO: 156007 - protein, 90 aa, Heterodera glycines
  Coding regions on vcDNA: vcDNA=SeqID_82430; Strand=+; Position=1 -72,132-213,253-369
  Homolog annotation: Hit_ID=AAK52748.1; Match level="QueryCoverage =97%, HitCoverage=34%, E-value=2e-09, Identity=35%"; Hit description =FOG-3 [Caenorhabditis remanei]
MYTEILELVNFFARFFHLRVPRLKIGMFCEHFANNCFLRFHLYWNLNQPKQYEELRIIRVSNEYTDELFTNAANAVGLQLDELLACIPGT

SEQ ID NO: 156008 - protein, 156 aa, Heterodera glycines
  Coding regions on vcDNA: vcDNA=SeqID_82431; Strand=+; Position=1 -285,328-409,452-555
MYVTPGEVFYCLGDYSPPVPVWVGSVCADLKYNETSNVTFPPPPIPSSILPTHTIQPLIPRAIGGVSATVDFSVVNYRIQLSLVHPRELGYATNPSSDFVMFRYVVPGTPNYTVESFASTRFGSYRKRPDYEFVTHLQRSLLLMNMNIHSCSDEST

SEQ ID NO: 156009 - protein, 177 aa, Heterodera glycines
  misc_feature (150)..(150): Xaa can be any naturally occurring amino acid
  Coding regions on vcDNA: vcDNA=SeqID_82432; Strand=-; Position=1 -96,284-367,429-459,504-634,2271-2393
  Homolog annotation: Hit_ID=CAE56060.1; Match level="QueryCoverage =86%, HitCoverage=28%, E-value=8e-38, Identity=53%"; Hit description =Hypothetical protein CBG23634 [Caenorhabditis briggsae]
SIRQANYSAGFWDELTVQFHFQRRYGWYLLQGLIPLLIVSWIPFYLGPKAIPARTMIGVNALLAMIFQFGNALLAMIFQFGAIIRNLPRVNYVAIIRNLPRVNYVKAIDWWILCGMTFIFASLVELAAIGFKVGNKFLKKVIEKNRNKNXQNDITSCKSFSKVSGVADHESIIYLNL

SEQ ID NO: 156010 - protein, 50 aa, Heterodera glycines
  Coding regions on vcDNA: vcDNA=SeqID_82433; Strand=+; Position=1-151
MAYGMKTINHIWVDDNSQMSRDLNLIIFPLFPFSASAVPSLFGTSVSSAG

SEQ ID NO: 156011 - protein, 320 aa, Heterodera glycines
  Coding regions on vcDNA: vcDNA=SeqID_82434; Strand=+; Position=1 -136,201-1025
  Homolog annotation: Hit_ID=EAK82978.1; Match level="QueryCoverage =99%, HitCoverage=89%, E-value=5e-41, Identity=32%"; Hit description =hypothetical protein UM05104.1 [Ustilago maydis 521] ref|XP _402719.1| hypothetical protein UM05104.1 [Usti
MYGYNGMGGGAAQYNGYGGGMGGGMPQQWGTMGGAQQQQMPNGRGGRFTEGIKNVANSAMNAIGGGGGAANGQQGGGTWGKLAKTAMNAAGMGGGRTSNGQWNGNGQQNGGRGGGNGRGNGGGRRENGGSGGRGRGNGGGNGEGRAGNGGGGNGGGRRENGGSGGRGRGNGGGNGEGRAGNGGGGNGGGRGRNGGGSMDEQYDDYGSDYGDEGTEDNYYDDADEDGREGRQGSNSGRGRSRGNGRENGNNNGKRKQREREETVYDDDDNEEDEEEEGDYNNDDDEDDEEGGEQRKNGRRSSGTRAKRRKNDQRSSKGEKE

SEQ ID NO: 156012 - protein, 114 aa, Heterodera glycines
  Coding regions on vcDNA: vcDNA=SeqID_82435; Strand=-; Position=1 -157,427-613
  Homolog annotation: Hit_ID=NP_491262.1; Match level="QueryCoverage =92%, HitCoverage=28%, E-value=3e-17, Identity=41%"; Hit description =ribosome factor like (1E478) [Caenorhabditis elegans] gb|AAB37664.1| Hypothetical protein T20F5.3 [Caenor
DPSKSPQKIVAEAVKEMELYFNALNNALIKHLSLNINLKAYEDLSVTLDNGETHRLVKFARISLKTPKGPIVLNFADNPAAIKPARIAIQNMAENVTPQVDGIVINVQIPKITR

SEQ ID NO: 156013 - protein, 141 aa, Heterodera glycines
  Coding regions on vcDNA: vcDNA=SeqID_82436; Strand=+; Position=1 -84,134-269,558-763
MLLLVLLLILLFPSESLQAASFITLHCQGNGLYVSGRWNENGQTADLPLPSELTMQRLARLIKCLFICYICFEGSFHWQILELPQLRLSAVRQPGKGGGALRKVLLGHCDDIGGICHRKSSAEIATLQGTKKTWIKEQKER

SEQ ID NO: 156014 - protein, 275 aa, Heterodera glycines
  misc_feature (109)..(109): Xaa can be any naturally occurring amino acid
  misc_feature (119)..(119): Xaa can be any naturally occurring amino acid
  Coding regions on vcDNA: vcDNA=SeqID_82437; Strand=-; Position=1 -89,220-512,668-793,889-1066,1122-1241
  Homolog annotation: Hit_ID=NP_741101.1; Match level="QueryCoverage =100%, HitCoverage=100%, E-value=2e-53, Identity=41%"; Hit description=putative protein family member (27.5 kD) (3E152) [Caenorhabditis elegans]
MQNEQYKVIFLFLLLCSVEIVGKRGGGGGAGGSAARASSASRGGGLFGGSGNSRSGGGSGGSWTAPKPNYGQTGGGGFSNTFSKGTHGGSHTERPGKTGQGWHDISAIXSPFGSKILFXFLKSNCWSGSGVGSQSRGNTFKNMIIGAAAGVIAYEAGKAIIRSVASPMHWGGRWGGRNYYWGSQYYRGMSSGRTMCRMPVDPSDPQFGNVFLRGQSRPKEIVWSCNYNEQCCGYECQCCGYECCPSGGTAVGTRVRGSEWGMPLTLPPLLLLLLF

SEQ ID NO: 156015 - protein, 201 aa, Heterodera glycines
  Coding regions on vcDNA: vcDNA=SeqID_82438; Strand=+; Position=1 -108,307-384,646-816,874-958,1088-1251
  Homolog annotation: Hit_ID=NP_057213.2; Match level="QueryCoverage =92%, HitCoverage=52%, E-value=5e-38, Identity=42%"; Hit description =COP9 signalosome subunit 4 [Homo sapiens] gb|AAH09292.1| COP9 signalosome subunit 4 [Homo sapiens] gb|AAH
ALYARVLDRQGNFTEAAQRYHELSLKPGLIPSEKRQDERCQQLVGHSLLKNMYLERLVKGPELTEFELSLCPHQRLLDAEGVSILQRSVLEHNILAASRLYANISFDGLGQLLGIPAAKAEKVATQMISGEKVQGAIDQLERTVSFEVPDSSNGGADSQIASICELVASINEKLATRFSEWHTERFNAYKRAHQQPNDPMQ

SEQ ID NO: 156016 - protein, 35 aa, Heterodera glycines
  Coding regions on vcDNA: vcDNA=SeqID_82439; Strand=-; Position=1-105
MRTNCLALSSLAIFYSAVFSAIGAPVEPSTKERAK

SEQ ID NO: 156017 - protein, 234 aa, Heterodera glycines
  Coding regions on vcDNA: vcDNA=SeqID_82440; Strand=-; Position=1 -185,455-714,1258-1517
  Homolog annotation: Hit_ID=S55244; Match level="QueryCoverage=91%, HitCoverage=93%, E-value=2e-24, Identity=34%"; Hit description =polyubiquitin 4 - Arabidopsis thaliana
MHRSDTVKNIMEKVHEQQGIPIAEQRLFFRGVLLRAEMPIFKYNSRENDFVLFLVPWISLSRKEYKIKVKNTNGKTIGLKIDASDTVQNVQWIIEAKTGIPNRYQRLFYGGRLLDKRKTLSDYGIINIFYKWQEVRLEVEEPKEARSFEITIILLGQKRIKMRVKEWNTTHYIMKKMQEIEDIPMIEQTLLFKEKRLRDDETLAQHQILKGAVVVLLLSQPPITYGPNLMLMTE

SEQ ID NO: 156018 - protein, 267 aa, Heterodera glycines
  Coding regions on vcDNA: vcDNA=SeqID_82441; Strand=+; Position=1 -237,320-838,956-1003
MPLIGASSTGSFSSSFSSYFSPRVRSPFVPLRPRARRLPNELLTELATFAHYDFLELSRAANSRLRGLYRPILQRKDAKLCALFFDDVRSLSLWFKNWAVRSDALRKFVNLRATVDSKWCEEAMQTKPDLWAVNRARVTSRGLIADLRELRKLTDELIATTHKVGIQAQMNSLENSIRFSFSDLCRGSSDAKCRRRFRAARLAPRVRPRLLFLRPFPFSEVTSHRQIVGGAQNGGGPVAEQRLAESEGFGARSTPAVSTFSKRATLV

SEQ ID NO: 156019 - protein, 43 aa, Heterodera glycines
  Coding regions on vcDNA: vcDNA=SeqID_82442; Strand=+; Position=1 -81,126-176
MSCHGPKAKVTIVSFAKYALQLLDEGTIVACAVPNFVLHAPNF

SEQ ID NO: 156020 - protein, 149 aa, Heterodera glycines
  Coding regions on vcDNA: vcDNA=SeqID_82443; Strand=-; Position=1 -108,587-928
MIWNYFAFFTISLNSVFGFLSIGDQNHGALDNFQQNANHLIKKSAQKIALSFDMGIMPTVRHSTKIFYKSLPPRVVFPMLQVLVLLAIFSGIIASFLFLALFRALNKGTQFNFRLSFLGRRRSPSSSNGTNSRVPIYSSQSVVEYETLV

SEQ ID NO: 156021 - protein, 122 aa, Heterodera glycines
  Coding regions on vcDNA: vcDNA=SeqID_82444; Strand=-; Position=1 -70,518-648,697-852,1336-1347
MIHENVRQNGYEDHEPPPSKQKKFVGGKNLTAISSALFSNCRFLQMTGDHLQLLQSSACERIDELHLELNFTILDITSIESKALTKWLTGKKAKKSSKKLLIRPRSREFATSWIRKLQSCCF

SEQ ID NO: 156022 - protein, 19 aa, Heterodera glycines
  Coding regions on vcDNA: vcDNA=SeqID_82445; Strand=+; Position=1-61
FGREILFFETKLKTYITYI

SEQ ID NO: 156023 - protein, 93 aa, Heterodera glycines
  Coding regions on vcDNA: vcDNA=SeqID_82446; Strand=+; Position=1-282
MASNSIAASIGVKLKRLNSMAFELIWAYFSAEYSETGKRVSLSFADFLATPMRTDSSWMAFVVVANWANLAAENELVPGVAPAIPSPLACCLV

SEQ ID NO: 156024 - protein, 51 aa, Heterodera glycines
  Coding regions on vcDNA: vcDNA=SeqID_82447; Strand=+; Position=1 -73,125-207
MAKNAKKGTKTVADFIRFKFQECLGNGLVISEDDDDDNDDDGNVAMLASLN

SEQ ID NO: 156025 - protein, 75 aa, Heterodera glycines
  Coding regions on vcDNA: vcDNA=SeqID_82448; Strand=-; Position=1-225
MVASVYSSQTTATRPTTISTLAAASATFAAHAVNSAWTCAASRNRARMAAHACHCSRQKATAATTFAAHAFPASQ

SEQ ID NO: 156026 - protein, 25 aa, Heterodera glycines
  Coding regions on vcDNA: vcDNA=SeqID_82449; Strand=+; Position=1 -51,134-160
MTRPTAVKRVALLLACSKKAFLIFE

SEQ ID NO: 156027 - protein, 85 aa, Heterodera glycines
  Coding regions on vcDNA: vcDNA=SeqID_82450; Strand=+; Position=1 -102,566-659,808-869
MLFIHRVTVQQDCRNPRRIVWRKDPAGRTNVRKTVVTLLERSRSAVQDCIYSHDATLEDLKTLGLFLRTENSRITRGYKIGIGMA

SEQ ID NO: 156028 - protein, 95 aa, Heterodera glycines; identical to SEQ ID NO: 124528
  Coding regions on vcDNA: vcDNA=SeqID_82451; Strand=+; Position=1-1137

SEQ ID NO: 156029 - protein, 265 aa, Heterodera glycines
  Coding regions on vcDNA: vcDNA=SeqID_82452; Strand=-; Position=1-798
  Homolog annotation: Hit_ID=NP_502721.1; Match level="QueryCoverage =55%, HitCoverage=11%, E-value=2e-12, Identity=31%"; Hit description =endonuclease/exonuclease/phosphatase family and RNA-directed DNA polymerase (4O953) [Caenorhabditis elega
MPKSKRRHDDDLANTSASSSEQQFAAFSHRIDNLEKLLQQLLQAHGKEKVAANSLDQLNLRLEKLEGLVATLVAQTATNPQINGYNNSTPTVTPKIPWGCPPQFGPSQIARMLNSAIVDSELIKEKSKRAVVERLPEHLNEKDVVKQIAEECGLLGEIDLDNVHRHPRTAREENAKPRIVKIPFSSQKSRNLFLYKFRSTLLKMPVIPHNLTARRDMTINELQILYDLRKKAFEANQAAGVYKYIVIDLELKTLSNPKPLRTRVS

SEQ ID NO: 156030 - protein, 39 aa, Heterodera glycines
  Coding regions on vcDNA: vcDNA=SeqID_82453; Strand=+; Position=1 -72,106-150
ASTTGPTASTFPRSASTSAESVSRSASTSEESVPKNAST

SEQ ID NO: 156031 - protein, 112 aa, Heterodera glycines
  Coding regions on vcDNA: vcDNA=SeqID_82454; Strand=+; Position=1 -93,292-366,587-628,687-815
MIKGFLRAQQLEREIASLHEQNSILMAERVERNRDIEEIRQTVGEMRGFLLELVQQRENELGQLRQAVQQRERELQQREEELGLLRRFFVQVYLVQNSFFTSMRIVFCGKNP

SEQ ID NO: 156032 - protein, 108 aa, Heterodera glycines
  Coding regions on vcDNA: vcDNA=SeqID_82455; Strand=-; Position=1-327
  Homolog annotation: Hit_ID=CAB62280.1; Match level="QueryCoverage =100%, HitCoverage=88%, E-value=1e-19, Identity=46%"; Hit description= hydroxyproline-rich glycoprotein DZ-HRGP [Volvox carteri f. nagariensis]
MPPLPPSLFPSVPPVPLPPLSPEVPPLRRSPSPKVPPLPPSLFPSVPPVPPVPLPPLSPEVPPLRPSTSPEVPPLRRSPSPKMPPLPPSLFPSVPPVPPVTMPPTFPT

SEQ ID NO: 156033 - protein, 49 aa, Heterodera glycines
  Coding regions on vcDNA: vcDNA=SeqID_82456; Strand=+; Position=1-147
EWERIERERRQYEETELEKRRELELERAEALRREQQWLEQGRAERERLE

SEQ ID NO: 156034 - protein, 196 aa, Heterodera glycines
  Coding regions on vcDNA: vcDNA=SeqID_82457; Strand=+; Position=1 -96,149-643
MSKSNKKTKSVKLNFSQCEENQINASADWQQIPTSSGKNCSIQNTKDDGITPFNSDCEKDDANFEMNEEEQLMSMLDLAYNLDGNIINEVMSTIDKTLNGKCAVDELSSTSDPTSINGECAENGNSGMICTSDPTLKGDSFILEVPFSPIRRDKCVDEMDDGEIVGDNQNDSGGDNECDRRAIVSQQQVKEEAYVQ

SEQ ID NO: 156035 - protein, 308 aa, Heterodera glycines
  Coding regions on vcDNA: vcDNA=SeqID_82458; Strand=-; Position=1 -190,250-619,1004-1208,1325-1486
  Homolog annotation: Hit_ID=NP_741123.1; Match level="QueryCoverage =99%, HitCoverage=69%, E-value=5e-35, Identity=34%"; Hit description =actin-binding WH2 (3G109) [Caenorhabditis elegans]
MPAPPPPPPPPPPPSFSTNSQPLTTQKATGERAMLLNEIHKGTRLKKAVTNDRSAPAVEGKVVGEETKPCAGRTATAPSTVSQKSAAPKPGGAMNLGDLFRDGVPRKPSDLKNQKSSSAGQIVASNTLGRNNGQQKPRSSPVKKAPPVAIASENVKTVENNHSPTPPPHDATANKSTRAAAIANLQNFRSVSTTAVPGAPPPLPAKLPKQKTTIALQPSKLPLSQHNQFQTLRPTKTQPNSDEKRTTLRRTGSTEEIQKRPSAPPPPPIMRRPGAPPPPPPPLARPPPPQMAPAVKKVEQPMNNVSIC

SEQ ID NO: 156036 - protein, 72 aa, Heterodera glycines
  Coding regions on vcDNA: vcDNA=SeqID_82459; Strand=+; Position=1 -81,177-312
MDGADELAKCFMRQRGMDASMINDPIQKERFARLLKTDIEEAMHRRNENPEKHTDPMGIREERTNDWLGAVK

SEQ ID NO: 156037 - protein, 2449 aa, Heterodera glycines
  Coding regions on vcDNA: vcDNA=SeqID_82460; Strand=+; Position=1 -3409,3935-7875
  Homolog annotation: Hit_ID=CAE56152.1; Match level="QueryCoverage=9%, HitCoverage=29%, E-value=8e-26, Identity=28%"; Hit description =Hypothetical protein CBG23765 [Caenorhabditis briggsae]
MDDNALTSDARSSSVESPAGTIYESFEALSIDSSKVAASPEGSANVGAEIVIEGTESNENPAGSGYDEVRNEGSSVTFKAMEVPLDQVDAEGFANNGFDDEEPEACPPAKDVSKSSLLYLVSQAGDGYVIACKKSPKSKPNWPFFMNIEDKLIESAPGFQRKLEVGDFVAVSSFEWNQKLRYLAEHRQDATQSCKFWFNENSQLLPKQADATGVAQLMYMNIGRKQITGVVYWIKRKVQSIPSSFVHANIACCGLAVSARINRRHLDGINPEDLKLGSLVTVVVANIPQDSLVSMGYILPNSSPYKLGTERRAETPEFFGAVACIRPHLLEWPNLNANMTPKVYPCSAELTKHHVVAMEHVVGAALQIEMEREVDMMIEARFEGRARKFDGADCLIVFGSRSKKEVNELAKVWEPESQVKVFKELGEKHFALGVVKDVEVLHAEYEKLELHVVIFLNNIQERKNVDIARKVDEFIQGGSVVIHPVPATAVEDRLFCFRCNVPSIIADEDSPRGRIMAVLLGRPAMEGIRMEKQSVDDSTDSWMEEEGPLHPAILALNSRQRVTARLMLGGGLVQQQAPPGTGKTKVAAAIIKAMMDSNPGFRIVVMACANIPVAKLVQEAEGTCAEKDLDGARAIALFSGFARCKYTDQIKDVQRHTLPNKVNSEEFVKQLSPNVQKQVKEYLAHCEKNPRLAPERAIGKVFNSCMAPKIVFSTAAMAANLLHGEGNITDADVLLFDESTQAQWAVVVHLVARMPKLKALLLTGDRHQLGVHLQELPDIFHSGYGLESVILQAEASVGTNYTFLTKMYRSHPFLAKLISYASYELHNEQLIPARSAEERSLITGSGFLMPVQECPVGLINAFSSFRVDPKSDSLTDDHQTEVASFLVQALLEHFGNDFSSRIIVLCMYTYQTSEIERKLKHCGVRALTVDAYQAQECDVIIIVTTRSKYSEMGSGRTDNMHFFEDDQRATVALSRARHAVFIIGDLVSISTGQVWKRFIEMAITRTSVVRAEYVLALLGRTLVRSSTCLFDSAKRESVEDEGFLESWALKHGLRLDRTNAFGQQQSQQPRAPSFQFQNRHFPALQATGPSDQAGPSGSGGQQRGAPTLAPQYGRGQGRRGPDNQWMHYGGNPKRQKGGGPPNQSAAASSNAQTDPEGLSNDLPELSVVDKLMFAGKILSTPARLSDVDKLHTDLVRTEDGVNRMTRHLNRKINQTNRDLTELKDDTQTLITQVNTLANGYNAVQVLQNPNQSPRANNPPVLNWATPSPLRNPNNSFGNANTSVVEAIIPLGNNEEDSQDEEFELNPSGFHHVNMLFAESSPSFTIFSGTSPLEFDRWARKFTDLLDCNGRKWDDSEKVARLKACLDGEPRRIFDNLLPAHKATSSEAIQKIKENLDTPQNKELIYQALSMCKQREGESVDEFSARLIPLIEATTADLTTNASEEVLCRAFLEKLNPNLKFLTRTLSGPVRRDFQILRMNAREAEMMHREIPKSIPAPLFPISEQQNPRFNNTEPPNHPEGNFRTWAPTGSNREPISPRQRNRNNWDNNAQASRGSFNRSNNHPQNDRRWNNRTSRNDRRWNNQTPQNDRRWNARPVCNYCGKVGHLAFKCFKRRDEFTQPSKNLNFIRAIDEQNRLINDLSTKVNSLTFRNDQSAEAASQNIKTIQKVSESSTDKTHSSMMNDTLKAPSKISNWETSKMVQPKFFPVLMGLTLISSLSSTLVKDFNTIPSGPMICQTRVQPMTWSLPKFPRCPRMSIDTTKPLTKQRRTIYFPNSLEFSTKAWACRRIIKSIRKYTTISGVSVEQHLDSEQTLMSHDECLQMANNKRCSLGYLKNDSGLWHTDRKIDQTPRPWLLGSFSWKKVQSENCFAFETEVYSHIGATSIITPAGTAQACSYDKGNCVLSDKTVLVWVPQKDKMCKYSPIGVMDGHNLGNVWLSTLGDLGLTSSIVRNISDCGRNITVSDQGPAFTINSQSPRHKRGIFGLDSEGVVTSSQLAAQLSYLHTNISRSVNIAFAQAFNSFCDLMLDTQRWVQSSYLNDPTSLTRFIHQNNFLIAKRVGVSLLRTWPCVPLSQSDFEFRPTHTNSSCFEFLPIIVKLNGKEHIAFLNPTYLTVSLHSKTAPCEDQRNILIQMADRTIEVDQVDGTINNVHVHEIREVELDFGKPTRIPKLSPHAFHHLVILNLTDLATHAFASNLVQVSQFTYRADKTHSSEIKTTLSDEWSALEESIVQKAVGNYSLAWQIWITICLLLCMVDLLTRLFFAYIGIRLQDPVETLGRPMITTIANLFGRKKQNLDCDNKNHPNSPTKTIGHITYSHLRSVAATPINEATGQSIFRDTLNGNSCNFIEAYPQSSNSKEFKKIWFTKETNFSAWLNNYLSKPVNHEIPLLLPRNSGELAQFLDVATHFGKEIPNFNSKIVPLAESREMNILNGTSNESLLIRSFWGIYTC

SEQ ID NO: 156038 - protein, 53 aa, Heterodera glycines
  Coding regions on vcDNA: vcDNA=SeqID_82461; Strand=-; Position=1 -84,161-238
MATMVGNANIKFADSKVEFFKFGGGPFESEAYEIVVVECFGFYHESACVYAPK

SEQ ID NO: 156039 - protein, 1529 aa, Heterodera glycines
  Coding regions on vcDNA: vcDNA=SeqID_82462; Strand=+; Position=1 -164,242-4365,4543-4841
  Homolog annotation: Hit_ID=NP_500013.1; Match level="QueryCoverage =37%, HitCoverage=32%, E-value=9e-73, Identity=33%"; Hit description =predicted CDS, polyprotein family member (4B673) [Caenorhabditis elegans] gb|AAC02594.1| Hypothetical pro
MPKPQEALLTHPIIVLKMTEDGTIALPEMIDDGITKPLKMTDAGMLGQFATTVARAIDEQNRLINDLSTKVNSLTIRNGQTAEAASQNINTIQKLSKSSTDKNPSSVMNDTLIAPSKISNWETSKMVQPKFFPVLMILSLISSLSSTLVKDFNTIPSSPMICQTRLQPMTWSLPKFPRCPRMSIDTSKPLTKQRRTIYFPNSLEFSTKAWACRRIIKSIQKYTTISGVSVEQHLDSEQTLMSHDECLQMANNKRCSLGYLKNDSGLWHTDRKIDQTPRPWLLGSFSWKKVQSENCFAFETEVYSHIGATSIITPAGTAQACSYDKGNCVLSDKTVLVWVPQKDKMCKYSPIGVMDGHNLGNVWLSTLGDLGLTSSIVRNISDCGRNITVSDQGPAFTINSQSPRHKRGIFGLDSEGVVTSSQLAAQLSYLHTNISRSVNIAFAQAFNSFCDLMLDTQRWVQSSYLNDPTSLTRFIHQNNFLIAKRVGVSLLRTWPCVPLSQSDFEFRPTHTNSSCFEFLPIIVKLNGKEHIAFLNPTYLTVSLHSKTAPCEDQRNILIQMADRTIEVDQVDGTINNVHVHEIREVELDFGKPTRIPKLSPHAFHHLVILNLTDLATHAFASNLVQVSQLTYRADRTHSSEIKTTLSDEWSALEESIVQKAVGNYSLAWQIGITICLLLCMVDLLTRLFFAYIGIRLQDPIETLGRPMITTIANLLGRKKQNLDCDNKYHPNSPTKTIGHITSSHLRSVAATPINEATGQSFFRDTLNGNSCNFIEAYPQSSNSKEFKKIWFTKETNFSAWLNNYLSKPVNHEIPLLLPRNSGELAQFLDVATHFGKEIPNFNSKIGPISRISGDEHLKWDKQRVAAYQVILGHIHMLIHGRTQNIPQQRFHRPRSVIRELPMFLVLCMILLPATLAAPITSKGPPPNLKNSTFESANFILALPTIVAIIILSALVYSRSRSPISAIIRAKINGLEIRALADTGATISVAPLSLAKKIGCELYESKVEAISVSSHVISICAVGEVIIKLGDISLRSSINFIPDDQAGAMKNYEIIIGCDIFVNLPPITFDFTKKEVMIGKSKLNMESNHSTLSNLKVRALEHHRIPPGTQILVKARIDTIFSIDKDILVENLDPRLSDEHLSTPATVSKPKDNLLNIVICNPTNFPKNIIKNMCIATACELNKSDHPNLEMECTSDEINLLRESQKIIHADPSFKVDFSKSSVSGENLNKLKELCEVFQDIFSKSQYDLGSCTAGEHDIVTTSDTPVSSKPHRTPFKYRDELQKHIDQLLASGVMVESDTPWVSNIVLVQKKDGGLRPCIDFRKLNEVTVPDHYPLPRLETIMERIGNCRYYSSLDLSSGYLQIRLTERASRKCGLITENKIFQMVNLPFGLRNATSAFARCMAHVLTGLDDCVIAYVDDILVYTRDDNFDPKTTRDVKHVVGMASFFRKHVPNFSTIVEPLTRLTKKETNFEWGTEQAAAFNEVKRILSEKPILVFPNYDKPFHIFTDASNVGQGGALMQWNELAEAYE

SEQ ID NO: 156040 - protein, 135 aa, Heterodera glycines
  Coding regions on vcDNA: vcDNA=SeqID_82463; Strand=-; Position=1 -195,274-407,455-530
MVVSIHAIEGEQFCAVVCTNSHIFVLKCAKNGSQSVELAFQVDLTFPNAVNNQQKLGKDNECNPSPTTNSSRWQRPQNTSFSLSCNRWEMQLVALGKKRNAKPFPRHRPQYIFPLAVTLFWSALGPVLCCNSASM

SEQ ID NO: 156041 - protein, 108 aa, Heterodera glycines
  Coding regions on vcDNA: vcDNA=SeqID_82464; Strand=-; Position=1 -20,73-206,820-992
MGRVRRRSFGLAKRTSKFAVGRTVARIRIILRRTVRRSRAEGWAPLAKCCWAGQAYPMQPYYPPASNNYPAQPQAQAVYPPAPTYPAQPQAQAVYPPNPTSYPQAHGY

SEQ ID NO: 156042 - protein, 68 aa, Heterodera glycines
  Coding regions on vcDNA: vcDNA=SeqID_82465; Strand=-; Position=1-204
MVVSIHAIEGDQFCAVVCTNSHIFVLKCAKNGSQSVELAFQVDLFDLTFPNAVNNQQKLGKDNECNPS

SEQ ID NO: 156043 - protein, 182 aa, Heterodera glycines
  Coding regions on vcDNA: vcDNA=SeqID_82466; Strand=-; Position=1 -139,188-353,689-803,1026-1154
  Homolog annotation: Hit_ID=CAE56455.1; Match level="QueryCoverage =76%, HitCoverage=45%, E-value=5e-13, Identity=37%"; Hit description =Hypothetical protein CBG24161 [Caenorhabditis briggsae]
MKFIRKKFIFSFLFCAIQLHCLNAKKFGGGGGFRGGGAARANPAPAGGHFGGGGAPVGGGQPHFVGGGAGGFHGPTGGGFHPPPAGGGFHGPSMSAGSGPGRILFKGKAIIHSFDRPFQHDGRNYYLDEKYAKKQHGEIQCKVPWDKLVNQSPAATTNQTTNGTSPEQTLANVFTGAFTPKI

SEQ ID NO: 156044 - protein, 119 aa, Heterodera glycines
  Coding regions on vcDNA: vcDNA=SeqID_82467; Strand=-; Position=1 -136,1630-1853
MPKFGAKLKFKNFYFLTGQRPAELSSAKGAAHQHPMNAWKMRLAMNVTKKWHQQACEKRKKKSKCTKIRSDKYRCKWENDACVPATDEADYEKPKKGDGLLQKVIAKVLSSAKKPSPSE

SEQ ID NO: 156045 - protein, 25 aa, Heterodera glycines
  Coding regions on vcDNA: vcDNA=SeqID_82468; Strand=-; Position=1 -12,63-128
MNLGIFLIFVIELNRIKPVLSKQNV

SEQ ID NO: 156046 - protein, 90 aa, Heterodera glycines
  Coding regions on vcDNA: vcDNA=SeqID_82469; Strand=+; Position=1 -115,635-792
MNEHLARKTLRVEYHAPDAKRAVPDPMKFGRKRPAMVAAKCHTWTMRIVRNKISCHAYQLGCLCHSLALSQIRLIFYDAVFQLIVLLFRF

SEQ ID NO: 156047 - protein, 91 aa, Heterodera glycines
  Coding regions on vcDNA: vcDNA=SeqID_82470; Strand=-; Position=1 -188,451-537
  Homolog annotation: Hit_ID=NP_491171.1; Match level="QueryCoverage =100%, HitCoverage=21%, E-value=5e-29, Identity=68%"; Hit description= ovarian cancer overexpressed 1 like (46.3 kD) (1E71) [Caenorhabditis elegans] gb|AAF60659.1| Hypothetica
HYRLPLLIVAGHYLTKYWLATTIRSVVEWAQKNRRVRVPLQEQLRWLMPIGFCASLDIGLSNWSLEYVTISLYTMAKSSSILFIVGFSLML

SEQ ID NO: 156048 - protein, 163 aa, Heterodera glycines
  Coding regions on vcDNA: vcDNA=SeqID_82471; Strand=-; Position=1 -219,377-511,868-1004
MPSQSPQLRLSSCSACSSHERLHFGADDEEVFLMETVENGHDDTRQQSYHTERTLLASQGEEDERNGDDTLQQSLIASHCANVIYAGKQTDIDIDHRTIKLRLQEITAHLANWIAKMLEITWPTISRTRAKSAIGDSDIAESENEYQSVAEKIKDEVDQLGAE

SEQ ID NO: 156049 - protein, 228 aa, Heterodera glycines
  Coding regions on vcDNA: vcDNA=SeqID_82472; Strand=-; Position=1 -421,472-737
  Homolog annotation: Hit_ID=S52850; Match level="QueryCoverage=98%, HitCoverage=36%, E-value=6e-97, Identity=79%"; Hit description =intermediate filament protein A - common roundworm emb|CAA60045.1| cytoplasmic intermediate filament protein [
MKVQEIQTMSARQNLEQNYAKEEVKRLRTQLGDMRGKLADLEGRNSLLERQAEELAYQVEDDQRAYESALNDKDAQIRKLRDEAQALMLELQMLLDTKQTLDAEIAIYRKMLEGEEDRSGLYQLVEQVVKTQNIRRQDEAESQRILRGEKSSRQSYQRSAKGNVSILETSPEGKYVVLENTHRSKEEPIGEWKLKRRIDGKREIVYSFPQEFVLRPGKSVKVSANANR

SEQ ID NO: 156050 - protein, 104 aa, Heterodera glycines
  Coding regions on vcDNA: vcDNA=SeqID_82473; Strand=+; Position=1 -151,200-252,1011-1118
  Homolog annotation: Hit_ID=EAL31098.1; Match level="QueryCoverage =50%, HitCoverage=19%, E-value=1e-09, Identity=57%"; Hit description =GA10883-PA [Drosophila pseudoobscura]
MANEILEFPLKYDNDIHYLKVRRTDTVRELKFVIEAKLKIPPEEQRLMIGNCVQPDTRLLSSMKGLDLADDTVVIDIHTGKVTDYVKFDAGNICMITGGPNIGR

SEQ ID NO: 156051 - protein, 191 aa, Heterodera glycines
  Coding regions on vcDNA: vcDNA=SeqID_82474; Strand=+; Position=1 -159,278-464,505-650,698-781
MLDQRARSINRKRGNCKRIFSEHRGQEGSVQKKGHDGELNQKSPDSCGPIGEAAQPLSPRDLDELETSIDQFRTFLNDQPRMRTLLALKPKVHLLLNHFVPFARQHQFLALLDEQGDEALHSVWRRLEQLWKTMPDEEQMRQLLEHHFVSNWLLDTGKIDEMKRDREEQQEEIGGRESDEESDGEEQFDFE

SEQ ID NO: 156052 - protein, 120 aa, Heterodera glycines
  Coding regions on vcDNA: vcDNA=SeqID_82475; Strand=-; Position=1 -76,1332-1532,1618-1701
MEHHANTSIDDALLVDDNEKQKRLFNRTFRAEARQCDGKVASLLPENLKVRTNRWPKKGRNGDKNIFIGQMGQRGGRGGGAKQRKIMMNEAKKHWAEIIHGQRPQGPSVSSVLIRQSDSP

SEQ ID NO: 156053 - protein, 339 aa, Heterodera glycines
  Coding regions on vcDNA: vcDNA=SeqID_82476; Strand=+; Position=1 -293,1514-1792,1925-2371
AFLRATTSTSACYTIKFNVHESTLIVPFELVNGQTQEKLTLKKERKNDFYNNYWWLLKRCPISEKVAADQWENDENSANFNIVQFALNSIDKNHHCIGWICTDVWMDMFPFFDRPQLGLKLALLSPRFDVLVDKYFDGKSELPIWRPIEIRKDSVAKVPKLRVLIDANSVEFPLPDHSLHNKIRFEDLYIGFIDHSVITFLRSNQQIWDKGTNLDLWMPTSYHIYVKRCWKVLVNEIWPIFAPNIHNFSNANWLLYELRRLISPTILTDLSPLNSILSGNLLPDSIADDGPNATADQVLSKWLHTPRTDGQLNRLFCGNYPILMMDINKWIINFKEVKK

SEQ ID NO: 156054 - protein, 132 aa, Heterodera glycines
  Coding regions on vcDNA: vcDNA=SeqID_82477; Strand=-; Position=1 -165,462-575,1415-1486,2245-2292
  Homolog annotation: Hit_ID=CAE58512.1; Match level="QueryCoverage =84%, HitCoverage=54%, E-value=5e-09, Identity=30%"; Hit description =Hypothetical protein CBG01663 [Caenorhabditis briggsae]
MSAFVNGLHKISSVKWSTYGLAWGLITFNGAGICLFMHYIAQKTYMGSPHFKKAMLIFDGHDEAKSLLGEPVKVGKLNMLDKKRNYMRKTEAGLHIPVCGTHSSGFVDVFSEREPDEKSASNGRKQRKVWRK

SEQ ID NO: 156055 - protein, 332 aa, Heterodera glycines
  Coding regions on vcDNA: vcDNA=SeqID_82478; Strand=-; Position=1 -122,302-395,462-559,925-1078,1137-1298,1479-1629,1935-2065,2118-2201
MDGSKTEGMTAQELRMIDYERDIERLEIQCSKQHEQLIILSERAKHVELLEEQKVDLQTQTDILRRQNAQLIRDHEELKCLFGGGSISRNGLEELVRSAGQLREKNKELETKLKLLDSQQQPRDAPTVGESRRIAQLFKRKYDAELGELRNKLQKYEEPTGSDTTRILRFATANPLDEARDELVIREVAAAAASASTGASAPNPLKRRKLDNSVGDELAADETPVGDEFGEETEDSDDGHVHNLRVQIRALKDRLDQTENVNAELLREFRETVALISGYDVRIGEEGFFEAESVHSKNCVFLFQKHGQQPPTVDLLDNECAQRWKDLIANYL

SEQ ID NO: 156056 - protein, 42 aa, Heterodera glycines
  Coding regions on vcDNA: vcDNA=SeqID_82479; Strand=-; Position=1 -57,212-283
MDRSAECPAATWQRIPCCNSGTKQGVKAEHQRERTQHPMCRH

SEQ ID NO: 156057 - protein, 129 aa, Heterodera glycines
  Coding regions on vcDNA: vcDNA=SeqID_82480; Strand=+; Position=1 -27,131-258,322-485,548-618
  Homolog annotation: Hit_ID=NP_505858.1; Match level="QueryCoverage =86%, HitCoverage=9%, E-value=3e-10, Identity=37%"; Hit description =gamma-aminobutyric acid receptor (5L730) [Caenorhabditis elegans] pir||T20544 hypothetical protein T19B10.
MHFFNQFIIFYLAFKDVHPSWSLIGCGLIYGLIATVGIILNSSVILVTLLTKSFRGTVNYLLALCSLFELLHQSGHFLFVYTAFSGQNFIENRLAAKILFISTIGLGAITPTMFFTGIDRLIGIAFSEM

SEQ ID NO: 156058 - protein, 36 aa, Heterodera glycines
  Coding regions on vcDNA: vcDNA=SeqID_82481; Strand=+; Position=1 -34,92-168
MGVWVRKEKGIAYMHIISGIVAKPSYFHYLSVGSIP

SEQ ID NO: 156059 - protein, 47 aa, Heterodera glycines
  Coding regions on vcDNA: vcDNA=SeqID_82482; Strand=-; Position=1 -98,842-887
MGPFDTAPMFIGIAAIKAQKKALTGEAIGISRNAHCYENCQYSKMYP

SEQ ID NO: 156060 - protein, 190 aa, Heterodera glycines
  Coding regions on vcDNA: vcDNA=SeqID_82483; Strand=-; Position=1 -150,456-878
MDKHLITDFEQSNRLLFNSFSSTPLPMIIQRNQRTQSTQSLTTANQKLPLTNCDRKRTIAEKQQQPVITTQAEQHHNVDDAVDEDGAKVTGEDEELELVTQLLRAQQREEEGEEEAQFGGVEGETDENEAVTEAAQKKQQKQNGTEMADEKGKGKANGGKAKGEAGRNRTAQEEEEEAKAISGGANNRKA

SEQ ID NO: 156061 - protein, 80 aa, Heterodera glycines
  Coding regions on vcDNA: vcDNA=SeqID_82484; Strand=+; Position=1 -104,195-333
MNLKFYNKHTHIFGEMVVREKMWKSAFGEKASPGYLGVSDFLRLECVLDFKNKNISFTKNVVTYFVDFEIDDQPDDENAA

SEQ ID NO: 156062 - protein, 147 aa, Heterodera glycines
  Coding regions on vcDNA: vcDNA=SeqID_82485; Strand=+; Position=1 -67,652-821,1082-1288
  Homolog annotation: Hit_ID=AAC37249.1; Match level="QueryCoverage =76%, HitCoverage=13%, E-value=3e-37, Identity=66%"; Hit description =peptidylprolyl isomerase sp|Q27450|CYP1_BRUMA Peptidylprolyl isomerase 1 (Peptidylprolyl cis-trans isomera
MTVEKSVSKAERRRCFFDIHIDGESIYGGVFDDEAFVAKHDQPFMLSMANRGKDTNGSQFFITTKPAPHLDGIHVVFGKLISGQEVVTKIENLKVNAKSRPLADVVIANSGQLVKKRSASAHDTEEEGEEENEDRFFGGGDVNYTFR

SEQ ID NO: 156063 - protein, 20 aa, Heterodera glycines
  Coding regions on vcDNA: vcDNA=SeqID_82486; Strand=-; Position=1-62
YCSSINIYLLIVFLKPSDRT

SEQ ID NO: 156064 - protein, 106 aa, Heterodera glycines
  Coding regions on vcDNA: vcDNA=SeqID_82487; Strand=+; Position=1 -64,246-326,911-1086
MAREAENEMRRQHHKPLAHIYIIESKVWPSVGGQAISTFRKMVDDEWTKSVNVVTALRLKVFLSPINFRSRGITSTFVTTLKDYQQSVTMFCHNFVHFIPNKMPLG

SEQ ID NO: 156065 - protein, 119 aa, Heterodera glycines
  Coding regions on vcDNA: vcDNA=SeqID_82488; Strand=-; Position=1 -123,268-387,434-550
MMSKKKVFGNIKAYLAGRISEIMWNGHSTTACSGDVKEANKIDDELDPGPELKNRIDSAAQKIISSCELEVSILLSKKEINEKWKKLVEELFEREFLDGEYVEKYFNEPLKEGKGVQSC

SEQ ID NO: 156066 - protein, 30 aa, Heterodera glycines
  Coding regions on vcDNA: vcDNA=SeqID_82489; Strand=+; Position=1-94
NDRWGEKRRKWEFSSSVMRMNVPIGEFDRP

SEQ ID NO: 156067 - protein, 160 aa, Heterodera glycines
  Coding regions on vcDNA: vcDNA=SeqID_82490; Strand=-; Position=1 -105,411-560,766-939,1130-1188
  Homolog annotation: Hit_ID=CAE64725.1; Match level="QueryCoverage =96%, HitCoverage=54%, E-value=2e-57, Identity=66%"; Hit description =Hypothetical protein CBG09512 [Caenorhabditis briggsae]
MTRLFILPAIFVAATFSLWLLICNAPEWGDESQMVIELPTQFENFTTMAEQFKAYKTRHTSYITTLFICAYLYKQTFAIPGSFFLNIAAGAVFGLWLGFLLCCVLTTLGSTLCYLFSEFFSREYVLYYFGEKITYLQRKVNDWSQMHLLFLFFVRPLTDC

SEQ ID NO: 156068 - protein, 158 aa, Heterodera glycines
  Coding regions on vcDNA: vcDNA=SeqID_82491; Strand=-; Position=1 -106,752-939,1092-1274
MPVKRLRRFTHFVDDWSPSSVAFLNKKGKEDFECFEFCDHCAYLVVGQRDVFRVELTALADHLWHQCTMKSNANPTKAMGEMSSSNVHQLLMFADSGESPSIGSVVCVQAPIGTDVDEDDDGGTDENRQQRRDLLIAAECLFGTKMGRKSAFLATLAR

SEQ ID NO: 156069 - protein, 43 aa, Heterodera glycines
  Coding regions on vcDNA: vcDNA=SeqID_82492; Strand=-; Position=1-129
MSNSDIKKTIDIWIGEAEKSELQQREIWFFIGAEEKFVFEEIL

SEQ ID NO: 156070 - protein, 358 aa, Heterodera glycines
  Coding regions on vcDNA: vcDNA=SeqID_82493; Strand=-; Position=1 -551,653-861,964-1277
  Homolog annotation: Hit_ID=NP_001004509.1; Match level="QueryCoverage= 62%, HitCoverage=14%, E-value=1e-10, Identity=28%"; Hit description =si:busm1-180o5.3 [Danio rerio] emb|CAD60788.1| novel protein similar to DNA polymerases [Danio rerio]
MAERPERDEVVYTNSARDFHELLMRPEQEVVSFTHLNDQLDRCVVRKREPFARAPEHNNLAVACFVTSHARLYLYDWLEEVRRVGGRSLYCDTDSVLYVKQRGAEGVREGNALGDMKRELPGRRIIDFFAAGPKNYGFQHVDACTGGDLRAERKVRSFELNYAADQQLQYERMRQLVINHFGVGQHHQQQQQRGPAADAADGSDGQEERTISVPCQRFVRNRQADIFTRRSTRVYRPVYTKGRVLRRGAAECVDEVPPQSIRTRPFGWSCCAGDVGSPDSSVMNEEEEEEEPMQMAPDEADQGEEDRWGEHVWPEEIADDNKKPGPERKRARVEQCVAPPPPSPPQTPLREPHAEPEP

SEQ ID NO: 156071 - protein, 751 aa, Heterodera glycines
  Coding regions on vcDNA: vcDNA=SeqID_82494; Strand=-; Position=1 -87,143-322,438-557,673-759,873-938,1039-1173,1246-1415,1482 -1774,1845-1988,2079-2206,2524-3369
MQMAPGQEEEEDAEGPIRAVAVPMETLRQERNNGRKRAREDSTSNGGSSNQSGTATSSVRHPLYGNNGGGGIGAALDLDMLLAPMPQQFRGATSAAGAGVAQVSAANSATASSSAASSGVVPTRFLDSNVGFARPSDGVGGGVGGDGGQLAMAHMQFGPVSCMRGVPAAVATTIWTGSSNAGTFVNSGCAAAAAFGGGGIFGSTTLRSGSASAAEGFGGLSVVGEALPPHIREAIERVHSRQMQRMVTAQPDFTDILPPCADNGMSNTAWLLLDWQPDMLIGRVVGLVVLCGPFTTMGGLNGFDVRLIFDQHNTQQEMAVHCWEDCMPRLANNIQCDQIVEFSRLKVREQGKNAKGFFPFTLLYNNESRHRVLSASGHIGANLASSSTPIIVEAVEQQQPGMNTLSNVVRHNSSSSGANNQHIHGQNSTGVVTADDGQSEGEPDETAAAATNLTNAGARDADVEEGTSETAWLSTTRPPPCTPVGRPCRRRRLRSRCVSPAAVPPSRRSSPPPQRACSITAQRSLHSIVQRMNVVDAQVSRDERNTRVRQRARRQQLQQNHQQQQLSRLRRHVPSSSSSSPTHPLLRRGVPNELRSASAVEAADVITIDDTEPLGVEPQQQLQRGDARYFQDELLTLEDEVGAAHIIMIGNEPLSVADREWLISTGFQMRHLPSSVKGSVEVDNDGNNNISCCICYNWLVSDVDTVVRLACQHFLHRKCFAQEATQRSICPLCRRHFITGEATQQNEGAGN

SEQ ID NO: 156072 - protein, 273 aa, Heterodera glycines
  Coding regions on vcDNA: vcDNA=SeqID_82495; Strand=-; Position=1 -83,133-303,353-413,459-595,639-712,778-973,1017-1118
  Homolog annotation: Hit_ID=NP_491476.1; Match level="QueryCoverage =76%, HitCoverage=86%, E-value=3e-29, Identity=35%"; Hit description =putative protein, with at least 3 transmembrane domains (26.1 kD) (1F480) [Caenorhabditis elegans] gb|AAB
QLSNYQRFIFAESFPTMVKHIRGRPLGQVRIGFGDADPLWDSENEKYKVLCRSIHVSKAALYIGYMRLLVSLVSSLFFAYQYMMAVTGQLSSDHWINQVTARFMSQAMMSICLQVIVVVLMVHGVKAEKKSLLLPFIVYAAIAVLAGSIKVMSDLVYLDTSVYKNNEAESRAAKVQFLTNLLRTVLQAWCLSVVWRCYGYLTEKKVARQIREQLNSTATAFNYPENLMGHPSMPQQPPPYAAVVTAPIAIGPSNDKPQTSATNTSASASHIQQ

SEQ ID NO: 156073 - protein, 41 aa, Heterodera glycines
  Coding regions on vcDNA: vcDNA=SeqID_82496; Strand=-; Position=1-302
TMGTRQCQTKLLITPNSAFGVNFCALFQNLHWKMPFLYFLF

SEQ ID NO: 156074 - protein, 71 aa, Heterodera glycines
  Coding regions on vcDNA: vcDNA=SeqID_82497; Strand=-; Position=1 -151,197-261
MGPVRTRRGFFRFLVLSHFFQSFSMEICGLYVKLSTQYQEKKKNSVTSMPDLNLLNLIVTIRVAFAHFRLR

SEQ ID NO: 156075 - protein, 80 aa, Heterodera glycines
  Coding regions on vcDNA: vcDNA=SeqID_82498; Strand=-; Position=1 -89,428-581
MDEEMGTNPNDQQKREIIKFEAIKEKLKENNEDKFKKLKHYFEIKEENPKISDEKIAKKLEIGITTLKTLKKTAALIMEK

SEQ ID NO: 156076 - protein, 74 aa, Heterodera glycines
  Coding regions on vcDNA: vcDNA=SeqID_82499; Strand=-; Position=1-225
MNVFIIFFFAYKIETAKIRTNFDEIFGNGWDKNESEQKVIKIEQIEQSEFIHSFVRNGAENGTHSNEMIKEKEN

SEQ ID NO: 156077 - protein, 338 aa, Heterodera glycines
  Coding regions on vcDNA: vcDNA=SeqID_82500; Strand=+; Position=1-1014
  Homolog annotation: Hit_ID=NP_001004509.1; Match level="QueryCoverage= 89%, HitCoverage=20%, E-value=2e-42, Identity=33%"; Hit description =si:busm1-180o5.3 [Danio rerio] emb|CAD60788.1| novel protein similar to DNA polymerases [Danio rerio]
MPTGKTLREIREREEKKHEILSRYVDLEVIWEHEINEKLKKDTAMREFFDNWKDHSPIKIRDAFHGGRTGPMKLLHTAKPGQKISYKDFTSLYPFTNFTTDYPLGHPKIVSIPPNEQTVNWRSPSDNPYKGLLKVLLLPPNNNINVTVMPIKFDQRLLFPLCEKCAKYITAKYPNGLKDNDYSCPHYNPNDRAFVSTCTHLELNAALEAGYTVRKVFHVLQYDQWSDNVFKSYVSEMMALKIHATGFPSWCESEEEKSEYIEECWMKFGIHLEKEKMKAEPGKRYIAKLCLNSLWGRFSMRNLLSKAVINNDPCVLRQYTDDKKIDIMDIELMDEDND

SEQ ID NO: 156078 - protein, 146 aa, Heterodera glycines
  Coding regions on vcDNA: vcDNA=SeqID_82501; Strand=+; Position=1 -241,436-635
MALENGRTMNGTQQNNKTAIRPSEFEDDTENRDFENLSMSVSEASSEVGSVSIQDGAMQNQNERPMLENGITKRNVRLKSDLRISPASSGSWERAIRPVVNKHHNANAASVGRRPAANTQRSSVCWYCGVKGHAAAHCQKKRRKGQ

SEQ ID NO: 156079 - protein, 89 aa, Heterodera glycines
  Coding regions on vcDNA: vcDNA=SeqID_82502; Strand=+; Position=1-270
MALPAVEVSQSIPQSSLPLLALPLSRPMGRSLSAGATAQSNNPSVDGGDRSPGLELSRPYPETRHGLTVFYVDCPLKHIFQEDVQRTLI

SEQ ID NO: 156080 - protein, 397 aa, Heterodera glycines
  Coding regions on vcDNA: vcDNA=SeqID_82503; Strand=-; Position=1-1193
  Homolog annotation: Hit_ID=CAA82797.1; Match level="QueryCoverage =82%, HitCoverage=50%, E-value=7e-22, Identity=26%"; Hit description =gag protein [Ascaris lumbricoides]
MSGPIQKGIINALKALDNAKSATSLLLHPDPDLSNWENAINLEAQFDRVVKEIRSMEMQMDSLRDSSNAWIELLGRLIGDDKDNGEKEYVKFDKNEKIADRYDAATTKLRDLRDLEATLSAAAKLHRGRADREAKADQLANPQQQAPMLPAMAAPMTVPTFTAPLYQFQPIQLDKFFGQKQKWPEFYESFKSAIGSQSISKAQKLNLLRNLLGGEARELIAGFRLEDANYETVLQPLKDTYGAPEEHIRSLHFELANLKPCRSLRETKDFLLQLERFTRELNNAGEDIEGPQVFLMLEKKLTPPFLRSILTKKGEDPANWTTTKFRDVLTEAVRKEVQEVMGEYGHHYVQPKAEVVSAAPVQAPRTPNQRSRRPNQPMALRDMTFIASSLDEGHKHQ

SEQ ID NO: 156081 - protein, 99 aa, Heterodera glycines
  Coding regions on vcDNA: vcDNA=SeqID_82504; Strand=+; Position=1 -215,905-989
MPSPGNYHKWNWAPGWDRNFRNGANGKITKINDRDREEQNGGYQGVHKTKTNNRGSKNDHEWGLSQLKANGSVFMHNNYKSESFLINFARTIATSHENK

SEQ ID NO: 156082 - protein, 109 aa, Heterodera glycines
  Coding regions on vcDNA: vcDNA=SeqID_82505; Strand=-; Position=1 -171,244-402
MPPSTSAGTDDLDNNAAAASIALPEFLADLKAERITVNMENCRTELAPINVLWLSSMLLALASVPFCLSVLALLITAKCWSTDGDGAGGISLRAYLPGWVQAKNNSLNS

SEQ ID NO: 156083 - protein, 46 aa, Heterodera glycines; identical to SEQ ID NO: 153110
  Coding regions on vcDNA: vcDNA=SeqID_82506; Strand=-; Position=1-178

SEQ ID NO: 156084 - protein, 371 aa, Heterodera glycines
  Coding regions on vcDNA: vcDNA=SeqID_82507; Strand=+; Position=1 -171,750-937,1390-1524,1894-2054,2480-2619,3284-3605
NGDDEDDDVIFLAEMNLRKECDGGGNAQRREDDNVEQQQQETAACSNNVAQQPANDGTDGDDEIVFLGKQKDERHNGRRRRQSLTRLITEFYRPRQQRMRTMMMMAKPILCATGNNAVDPAVPAPDPARPFVFQLQRGNELCGVAFASLLWQRTKASSTPLTSAPPAHAPVDPARPFVCHLQRGNQRCGANFGTEHALQTHEGIVHTADERGSLFRCPKLSVPGCLFGTNSERNCDRHVRTVHGGYFPPVICLPGEALCMSAVQDGNPKCLRRGHRVLRAREPENSFFDHNKVVMRTRPGEGCKMGSCGFAAFAAFLSLARVVPLPEKAMSGAIDGVSLRVRAVVHIGLPSWPGCCQLAFTKRSCQPSTAG

SEQ ID NO: 156085 - protein, 106 aa, Heterodera glycines
  Coding regions on vcDNA: vcDNA=SeqID_82508; Strand=-; Position=1-617
RSQFLSLFVPKRQPGTLNLLKSCFLIFFITYNISLYIYLIYFFLFDKKINFKKVPIKAYCNHENKNELIFQHNFISFFHMYSIKFDDRKKTLSLKKCVGKSIFFKF

SEQ ID NO: 156086 - protein, 131 aa, Heterodera glycines
  Coding regions on vcDNA: vcDNA=SeqID_82509; Strand=-; Position=1 -74,449-770
  Homolog annotation: Hit_ID=CAE67324.1; Match level="QueryCoverage =100%, HitCoverage=35%, E-value=1e-22, Identity=43%"; Hit description= Hypothetical protein CBG12786 [Caenorhabditis briggsae]
MRREFGKRWRNEDIETGHVVRYYVKYFDVNGDGVVQLDEFLRVFRRDLAAMTSSRKKSADTGLNASRTDRNHSGTGQNTSGTLGRVRDPGLAWILDFDNDGIVTAEELDSADRMIRKVPKVLPKFDKKDEL

SEQ ID NO: 156087 - protein, 102 aa, Heterodera glycines
  Coding regions on vcDNA: vcDNA=SeqID_82510; Strand=-; Position=1 -115,1077-1270
  Homolog annotation: Hit_ID=CAE67324.1; Match level="QueryCoverage =40%, HitCoverage=15%, E-value=7e-09, Identity=66%"; Hit description =Hypothetical protein CBG12786 [Caenorhabditis briggsae]
MAYNQQATSSGAICINNTASTFCCCYGDGCNSALSPAVAFAFANSDPILPLGDGDEMTNRRRPEDAIPVIEVRGEGKPMSAAQIRELEEAANGGPLDIKVGN

SEQ ID NO: 156088 - protein, 82 aa, Heterodera glycines
  Coding regions on vcDNA: vcDNA=SeqID_82511; Strand=+; Position=1-557
NPRASAVKRVKTRQFRFSLTPPTLPKTVPGLLPGFHFTIAKAKKLFQKNNNFANFHALFPILNQNFMLRATHSQPYIGSSLI

SEQ ID NO: 156089 - protein, 281 aa, Heterodera glycines
  Coding regions on vcDNA: vcDNA=SeqID_82512; Strand=+; Position=1-848
IEKFFSKTTNDSEKGGFLEESSAIGKILAAKVSVYGRKLNAMLDGGSQISPISAKFFSQIMDKVSQKNVIARSESRIIDISGTEVKCYGVVCLPIRREALETKINLFVAQSAFGYDLLFGTNALKQLGFKMIDEVSNQIVDFSPASMLENSPMIVFKTFVIDGQNLDKTPGNFGGKRKDASEPKNGTGTKKCNKGRRQEKQSETEKSSVRNAGERRPLLTKTFVPQLKTKEIPIKNSENFGESAANKQRLNSVQMKVGVPNESEEEYLEKEKLWSNSVRDN

SEQ ID NO: 156090 - protein, 70 aa, Heterodera glycines
  Coding regions on vcDNA: vcDNA=SeqID_82513; Strand=+; Position=1 -189,244-267
MGKGKKRERIPSFAHGNLIPGGLEKKESKRTLNKSPFVHSVHVFGMSVFFERQFNYHFQLVDLLCCSKSD

SEQ ID NO: 156091 - protein, 215 aa, Heterodera glycines
  Coding regions on vcDNA: vcDNA=SeqID_82514; Strand=+; Position=1 -526,614-735
MTVPLVGNGAKNGQHFGTKKAPSQRLRSIFSWVSKFNQNGHIMKLYQKLKNTPGGWGQLIRKMYAEMLSAKKLGAGNSKPLRENCHKALQLIGEGRAVQRVDVQKIKPFHDFWTLLKNSALSLVTLFKGTLKTKNGRESDRKMKRENILRALKTFSTEDNSFFLRMVRKNGKTNETHKDQKRRRQKRLAPLIIFGIIIGGLLVIAFLSEWVKAGF

SEQ ID NO: 156092 - protein, 136 aa, Heterodera glycines
  Coding regions on vcDNA: vcDNA=SeqID_82515; Strand=-; Position=1 -57,105-207,258-508
MASPPAILPFGCAPVAQSLPFLAAPPPPPILRSPAGFMPAAAVPAYAPSAAFPGIMPAAAFPGLTAAAAVPAFAPAAAFPGLMPTYSPAVALPAAQLLRMPPAMCGFPRKAAAKARAMARIGTRKGRAEMSAKGRN

SEQ ID NO: 156093 - protein, 54 aa, Heterodera glycines
  Coding regions on vcDNA: vcDNA=SeqID_82516; Strand=+; Position=1 -111,590-643
MGGGGGAAKKGSKRLATIFESKSKNSPKTVRQVHTQTILWQKAGKVAKKLLAKY

SEQ ID NO: 156094 - protein, 30 aa, Heterodera glycines
  Coding regions on vcDNA: vcDNA=SeqID_82517; Strand=+; Position=1-90
MCVYTFAFALSTKFWGLGQLGQFPPSVRRS

SEQ ID NO: 156095 - protein, 104 aa, Heterodera glycines
  Coding regions on vcDNA: vcDNA=SeqID_82518; Strand=-; Position=1 -161,260-413
MLPIANCILLLILLLFPLRFTAAGGHPEYLSALKNISLLTTNDTQEEAEMAKNRTFDIPFDYFPRDIFPPLQNISFGGRTPETAADEQIGSSAATHKMDALENP

SEQ ID NO: 156096 - protein, 89 aa, Heterodera glycines
  Coding regions on vcDNA: vcDNA=SeqID_82519; Strand=-; Position=1 -82,135-321
FAKCPIDISSLRTFINGQQQQHWHTVASGGVANNTTNSDDGTTQQQQSTEKGWHQQSINEISAPSDVVHRIHVGYDGQKFTGLPPSWLE

SEQ ID NO: 156097 - protein, 32 aa, Heterodera glycines; identical to SEQ ID NO: 127531
  Coding regions on vcDNA: vcDNA=SeqID_82520; Strand=-; Position=1-246

SEQ ID NO: 156098 - protein, 23 aa, Heterodera glycines
  Coding regions on vcDNA: vcDNA=SeqID_82521; Strand=+; Position=1-81
FVTEQRWGGGLNGERIHKHVNKL

SEQ ID NO: 156099 - protein, 245 aa, Heterodera glycines
  Coding regions on vcDNA: vcDNA=SeqID_82522; Strand=+; Position=1 -418,459-778
  Homolog annotation: Hit_ID=NP_507780.1; Match level="QueryCoverage =91%, HitCoverage=15%, E-value=9e-28, Identity=32%"; Hit description =predicted CDS, DNA polymerase type B, organellar and viral family member (5T899) [Caenorhabditis elegans]
MSEFVDWILGFKQFETVAFAHYAGRFDSHFVLKELTERGVETELMMADLKIYQMKARGMYFRDFWLLSQNKLADLPKTLGLKTLAKLYFPHKYNKNVNFGKKLTHLPPLEDYCPDNMKEEECAKLVKWHNENYRMEFELGEQLKVYCENDVEILMEAILKFRQLFLEITDGMDVLKDSVTIAGVVMRIFRTKFLRENHLPIIPEGGYERAENQSKIAVKYFEWLAQSKRVRLRHACNGGEVEIGD

SEQ ID NO: 156100 - protein, 75 aa, Heterodera glycines
  Coding regions on vcDNA: vcDNA=SeqID_82523; Strand=+; Position=1 -75,378-530
MFPCKLWNVVDRVAEGLGRTNNSVEAAPADGIRGPYERRKAKYIRQDNNLQALVADFDQRDPLEYLRACAYHLHF

SEQ ID NO: 156101 - protein, 457 aa, Heterodera glycines
  Coding regions on vcDNA: vcDNA=SeqID_82524; Strand=-; Position=1 -523,859-1709
MSSKTKTTKELIDFAAEQLECNKRDLGTVLLSATERRSLKKRITEALNRGSSLWYRLDEGYIENLNGLNLTVTPDRPFLGLRPRVSHRQFAFQILRIKRTQGSALGPMLLAGEFFYPLGGVFFDHYRDEFDDFGDFFAGFMKEKEEKAGNGIESAGERGANDSSGLINRNVSGTEKSFGGTVIGVETVAPKENGTVDQRVGLVKIRGENDSGSAKAVKRSHTDLQPKAKAQTGLPQNGFRFDALKWAQMHQLIPPPTVLYPNPQILRTAVAVPFNQQSCSSSSLNGVQLMPTNGEMIVTPCQQQQPQHQSQPQHQNHQQQPQHQIQQQHHQMHQNQRQRAIEGESRFTPRRFGPNRSHPYGGRTTASLPFIREQQETQLPINWPWNPLPRIQIPVEVRRVLLHRLAQERDHAFGLAGVMRQWNPPMALLLLSMEAFYSTLLAFVVNEGEPGPSLPQL

SEQ ID NO: 156102 - protein, 61 aa, Heterodera glycines
  Coding regions on vcDNA: vcDNA=SeqID_82525; Strand=+; Position=1 -94,295-386
MLCSVRRLFLPLLFLLVLFFQKAIARRRKCPGGHLAEMASAKPLRQIGTDWGINEKHKKGI

SEQ ID NO: 156103 - protein, 62 aa, Heterodera glycines
  Coding regions on vcDNA: vcDNA=SeqID_82526; Strand=-; Position=1 -71,485-602
MKNEFKHQEKNGAKIMTKFVRKLELIEHLKGFRMIPIMFDLDVNENSYSPKTCWGPNVLGPN

SEQ ID NO: 156104 - protein, 31 aa, Heterodera glycines
  Coding regions on vcDNA: vcDNA=SeqID_82527; Strand=-; Position=1 -5,453-543
MNIPQQHVGCSPSWFSEKQRIVKKVIAEFRL

SEQ ID NO: 156105 - protein, 100 aa, Heterodera glycines
  Coding regions on vcDNA: vcDNA=SeqID_82528; Strand=+; Position=1-303
MAFPLGGPATCIAKAKASLGFIPYHGRKADRYGCHGREADRHCVMVAKQTDTDGYGRKADQPSHGRPLRDWPLNHNPQKAVHIYLMNSDFLRYFSPVHWS

SEQ ID NO: 156106 - protein, 64 aa, Heterodera glycines
  Coding regions on vcDNA: vcDNA=SeqID_82529; Strand=-; Position=1 -49,343-488
MAQQQAITKKRKAMQDAHNSEASTSTNFLLGLSLRTKTAPNTTPTRPPWTKRSSRSSRPPNEPI

SEQ ID NO: 156107 - protein, 36 aa, Heterodera glycines
  Coding regions on vcDNA: vcDNA=SeqID_82530; Strand=+; Position=1 -97,892-905
MIRRGTTEIRRGETVIRRGATMIRRGTTEIGREILE

SEQ ID NO: 156108 - protein, 21 aa, Heterodera glycines
  Coding regions on vcDNA: vcDNA=SeqID_82531; Strand=-; Position=1-64
GRFAPVFKFSWAFSAASRPQT

SEQ ID NO: 156109 - protein, 80 aa, Heterodera glycines
  Coding regions on vcDNA: vcDNA=SeqID_82532; Strand=-; Position=1 -63,409-588
MKHYPLGLLGSVQSGVSSIVRIIVRIRRNGSKWTSYSGSTTPKTHRNDFLLISNQFNKEKNFVDTKPESTRNYNRKLKGE

SEQ ID NO: 156110 - protein, 212 aa, Heterodera glycines
  Coding regions on vcDNA: vcDNA=SeqID_82533; Strand=+; Position=1 -81,1006-1236,1278-1349,1800-1928,2133-2258
MVIVTNWSCSMSHHVVLDDKIFVLIELSDRVNENDLVKSLSQCLLAKYELLKRTSFKKEFSVSKRGFVRDADIGEMFSDRRERELRANVLKKSEKLLMDVLGYRLDRDEEGKRFYLSTNLCKGIAMAMQTEQFTNCLLEMALMFIFMSKRHISNKTETEKGVDQMLLKSFLGWLRCDIQRDTVTGSEQVLYHWGPRSETVVSKKVNNDYIYN

SEQ ID NO: 156111 - protein, 158 aa, Heterodera glycines
  misc_feature (6)..(6): Xaa can be any naturally occurring amino acid
  Coding regions on vcDNA: vcDNA=SeqID_82534; Strand=-; Position=1 -108,765-799,843-915,965-1041,1495-1596
  Homolog annotation: Hit_ID=XP_415275.1; Match level="QueryCoverage =96%, HitCoverage=54%, E-value=4e-42, Identity=61%"; Hit description =PREDICTED: similar to RAB35 protein [Gallus gallus]
EKKLEXIKNVCRSGKWIRNRGKGIPCGNPALFVSEPAPVRDYDHLFKLLIIGDSGVGKSSLLLIIGDSGVGKSSLLLRFSDNTFSTSYITTIGVDFKIRSYITTIGVDFKIRTITVMGKKIKLQIWDTAGQERFRTITSTYYRGTHGVIVVFDVTSIE

SEQ ID NO: 156112 - protein, 33 aa, Heterodera glycines
  Coding regions on vcDNA: vcDNA=SeqID_82535; Strand=+; Position=1 -96,243-248
MGSSALKQKTNGSQPLRNSVFWLFLAFCMVLEG

SEQ ID NO: 156113 - protein, 358 aa, Heterodera glycines
  misc_feature (349)..(349): Xaa can be any naturally occurring amino acid
  Coding regions on vcDNA: vcDNA=SeqID_82536; Strand=+; Position=1 -127,178-310,364-580,631-741,792-817,865-1000,1073-1242
  Homolog annotation: Hit_ID=CAE71050.1; Match level="QueryCoverage =96%, HitCoverage=77%, E-value=1e-106, Identity=58%"; Hit description= Hypothetical protein CBG17892 [Caenorhabditis briggsae]
CRSVGEGVRSVHVAFPIPCFTPQCRLCYSCKNPKTNLCQKIRATQGKGATQGKGLMPDGTSRFTCRGQQIAHFMGCSTFSEFTVCAEISLAKVDKSVDKSALLDKVCLLGCGVSTGYGAVLNNCRVEPGSTVAVWGLGTVGLAVVMGAKKAGASKIVGIDLETAKFEKAKHFGATEFVNPKEVKHFGATEFVNPKEVPAEQTLQAFLMDKFDGGFDYTFECCGNVQTMCCGNVQTMRQALEAAHKGWGVSCRQALEAAHKGWGVSCVIGVAGAGEEIKTRPFQLVTGRTWKGSSFGGWKSRDWKSRDQIPSLVKEHLDGKLDLDKFITHKFAFSDINKAFECMTKGERXSEMTKKEKA

SEQ ID NO: 156114 - protein, 79 aa, Heterodera glycines
  Coding regions on vcDNA: vcDNA=SeqID_82537; Strand=-; Position=1 -84,142-297
MSPSMVLRGTEYSFHMRVDLPNQIDRKRGAIVRNSTTDGVWQSEERQLGRFPFTLGATSDLKIAAVAQGFKAFISLPFH

SEQ ID NO: 156115 - protein, 251 aa, Heterodera glycines
  Coding regions on vcDNA: vcDNA=SeqID_82538; Strand=+; Position=1 -507,1181-1429
MVSEYSASTKSDGSGGATAAATENQNGTAQRQQQQQQQQQRRQSVTTLNCSANGGGSANGGNNKMPNGGRQVCQNGTMPKLTDNNHNGIIKNNGNRNSHSSCGTTISALSGLQDTGASKLYSINQQQEMNIGSTVATMKHNGEKQPNGNTIRVGRGPPNAATIETSGGKATTFYFICPFFMYFLNSTNILIFLCGNYCQIWFIFLNLKFFKSLKNCNFLTKKRTIVMTTPLYAEAIEEAKEQQKLTQLPTF

SEQ ID NO: 156116 - protein, 255 aa, Heterodera glycines
  Coding regions on vcDNA: vcDNA=SeqID_82539; Strand=+; Position=1 -72,340-951,1386-1471
  Homolog annotation: Hit_ID=NP_502910.2; Match level="QueryCoverage =78%, HitCoverage=15%, E-value=2e-45, Identity=47%"; Hit description =juxtamembrane domain-Associated Catenin JAC-1, Juxtamembrane domain Associated Catenin (jac-1) [Caenorhab
ESLSSAENAFGYEFRVWTVSLVNEYNGGTSLTLCWLPAKSVLPVQGYEVEFRDIMQDATHWYRMTDQLVRACKTTVGYLLNGHQYQFRIITKNAAGLSEPSDPSPLITIDVEDSGVRSAEQQMSTLDRQIGVPLADEMVRESPPLPDRDGECRKAFPSDLHMDNSRSDSPPPIYRQTESSLQWRDPTLKEVIDYLKSPDQTLVLDASGYLQHLTFNNDLIKEETRNYALWNISSADELKESVLNQAAETVVTHIV

SEQ ID NO: 156117 - protein, 130 aa, Heterodera glycines
  Coding regions on vcDNA: vcDNA=SeqID_82540; Strand=-; Position=1 -132,195-314,367-507
MPIFRSFCSSSAILLTVLDVFLFTAQFANSSAPADDSFVWPMEQYAYDPISDTMLRSLLGYDAKSKQNIRPFRIFLAAQPPKEIRMENEKGGEEGAKERIVMAKRKNAELVNHILKNFASLNRLGDAGKK

SEQ ID NO: 156118 - protein, 98 aa, Heterodera glycines
  Coding regions on vcDNA: vcDNA=SeqID_82541; Strand=+; Position=1 -129,432-599
MRIVGKSVLIPSIVQTRANCNSYKRQFVQKATRRIVNPVQSQKTLCFRMIPKIRVGSNMNKVTVLKPEVLLFDWTHIIFGLIKVDSTHKVQYVEPNVL

SEQ ID NO: 156119 - protein, 19 aa, Heterodera glycines
  Coding regions on vcDNA: vcDNA=SeqID_82542; Strand=+; Position=1-59
AQAACRPVCQCQEPSLNCQ

SEQ ID NO: 156120 - protein, 47 aa, Heterodera glycines
  Coding regions on vcDNA: vcDNA=SeqID_82543; Strand=+; Position=1 -12,93-164,356-415
MITPEQHQKRLEFIKRKKMNSVGCYGFEFKKFPCRRLSAPPELKKFL

SEQ ID NO: 156121 - protein, 27 aa, Heterodera glycines
  Coding regions on vcDNA: vcDNA=SeqID_82544; Strand=+; Position=1 -38,193-238
MTSGLFCTYLLERIGNATNVPRLLKRL

SEQ ID NO: 156122 - protein, 170 aa, Heterodera glycines
  Coding regions on vcDNA: vcDNA=SeqID_82545; Strand=-; Position=1 -27,791-1276
  Homolog annotation: Hit_ID=XP_309989.1; Match level="QueryCoverage =91%, HitCoverage=55%, E-value=2e-23, Identity=37%"; Hit description =ENSANGP00000015194 [Anopheles gambiae] ref|XP_319667.1| ENSANGP00000022407 [Anopheles gambiae]
MDPSKRKYDAVLKASAGQVNNSAALATSIDARLSTFEYDPELGHTYDVWLKRYGQTIAQDGHALSDQSKVQLLIGKLGEAEYKRYIDSIAPKSQNDFNWDETTAKLKHLFGETRSLFLRRFDCFQIRQDAHQDVQSLIALINSSCENADLSLSKEELKCMILIIATNSQI

SEQ ID NO: 156123 - protein, 286 aa, Heterodera glycines
  Coding regions on vcDNA: vcDNA=SeqID_82546; Strand=+; Position=1 -303,399-485,544-1014
MQMPREKERNANAKRERKKCQCQERKKEMPMPREKERNANAKRERKKCQCQERKKEMPREKERNANAKRERKKCPCQGIEKRGRFSKDHFDSIKTLKIATKVHYLFSLLDLERAYVTERGRLVGVVALRDLRMAIQSAQNGISLRHNLYDSADSSSTGTENSLDEFLSIDVEKGMAQKNDEMPQMTLTECDEKRTAQKLANQTDRNFGANAFTVQNSVPLQIIEAENKLHQRNRSQSTRNRWKEGEESEAARAMAYLRRKSVALEDLKALEETPLPTTAAEKEREK

SEQ ID NO: 156124 - protein, 78 aa, Heterodera glycines
  Coding regions on vcDNA: vcDNA=SeqID_82547; Strand=-; Position=1-330
FVGLFICDRFYSSILHFLRSRRFPLRPPQFVNVHVDAMRTQVLIQQFSNLSLFDLVKIEPNTRQMNTAGETSREQTNS

SEQ ID NO: 156125 - protein, 245 aa, Heterodera glycines
  Coding regions on vcDNA: vcDNA=SeqID_82548; Strand=+; Position=1 -90,160-369,519-639,701-861,930-1085
  Homolog annotation: Hit_ID=AAR85527.1; Match level="QueryCoverage =99%, HitCoverage=98%, E-value=6e-61, Identity=48%"; Hit description =14-3-3b protein [Meloidogyne incognita]
MGEQRDELVQRAKLAEQAERYDDMARAMKKLVEMDAKLDEEERNLLSIAYRKAVGARRTSRRIITSTQQRPTLTKKQKQIANELKKKVEHDMEQKGREALDLLDKILIPKVDEPVAKVTYLRMKADLHRYMAEIKEAENDDPQKAKQSYEDAWNIAQQKIRPSHPIRLGVALNFAVFLHEFMKMPEEGRKLAQKAHDDGNADLLADTSGGDSYLESIGILEKLDENMRIWASTQERDGSSERGNF

SEQ ID NO: 156126 - protein, 36 aa, Heterodera glycines
  Coding regions on vcDNA: vcDNA=SeqID_82549; Strand=+; Position=1-118
IDANSYGITKTVGIFVAEPYTLALAQCETKVFCRLF

SEQ ID NO: 156127 - protein, 254 aa, Heterodera glycines
  Coding regions on vcDNA: vcDNA=SeqID_82550; Strand=-; Position=1 -120,151-795
MSSSSANNCDEANNQQNLHNVPIATPSVAQVTEAEQCLIKTIKIINSDNYCLFYAMQATMVRAVGGLNRQRFHDYLRGVGGRLKKETFEMMNALNVSFGQQNYDAEFYVPRIIDWWNGTNFMGIWKFKAFIFGSTGHYKPLFKYGPEDYVVPIILYFDANHFNGVQRSGNLFGKPYCLSCEKTYDRPKQHSKSCKARCIKWFQKRFKIYSQFFISSQMGPTFSCKPIDGFRQKCSGCNKMFYNNDCYQHHLASD

SEQ ID NO: 156128 - protein, 99 aa, Heterodera glycines
  Coding regions on vcDNA: vcDNA=SeqID_82551; Strand=-; Position=1-5,71- 365
MRRHKKKYVIFCDLNGKWVKNYRLEQPDLDALHIADTNENEEPNPEDAELQQEFVLDEEEVDEDPSVPCCSASLQRQNTAVRRNDNKTGSSTTALSSPM

SEQ ID NO: 156129 - protein, 67 aa, Heterodera glycines
  Coding regions on vcDNA: vcDNA=SeqID_82552; Strand=-; Position=1-204
MERLKTNNNGNGQQQPFKLAKGSAEIGKATTTASAQKKKKLKKTKQQEEQKTTAEDEQGKKEEEQVQ

SEQ ID NO: 156130 - protein, 169 aa, Heterodera glycines
  Coding regions on vcDNA: vcDNA=SeqID_82553; Strand=-; Position=1-510
MALKLIVTFPIKATILDNVSGPGQFEVEEEDEVDGNDEEMKQYNKEDEGKSTVAESSEFVEPVPTAAAEKSEVPKSSEKRRARGKSGKGGRRRALHDRRGEKPRETYIQLIGMAIEAQESKRATLTEIVGDFLMSQLMGLESIDDFLWLSGEKLGSRGFKSHWVASIFI

SEQ ID NO: 156131 - protein, 61 aa, Heterodera glycines
  Coding regions on vcDNA: vcDNA=SeqID_82554; Strand=-; Position=1 -123,486-548
  Homolog annotation: Hit_ID=CAE58643.1; Match level="QueryCoverage =96%, HitCoverage=10%, E-value=2e-19, Identity=79%"; Hit description =Hypothetical protein CBG01811 [Caenorhabditis briggsae]
MVDWLGIIAIIFFYVLILIVGIWAGRKTDSTKTGVGDQTEEVMLAGRNIGTLVGIFTMTGG

SEQ ID NO: 156132 - protein, 31 aa, Heterodera glycines
  Coding regions on vcDNA: vcDNA=SeqID_82555; Strand=-; Position=1 -76,241-260
MPRCASYFCFEYSLNGISWSPFINAIKNRFG

SEQ ID NO: 156133 - protein, 60 aa, Heterodera glycines
  Coding regions on vcDNA: vcDNA=SeqID_82556; Strand=-; Position=1 -113,463-532
MVAILRAKNMSQWNIYGHVPPNGNGKSPACQSNGTLPICYNKQIGQKSCDNKFCEMYGVN

SEQ ID NO: 156134 - protein, 16 aa, Heterodera glycines
  Coding regions on vcDNA: vcDNA=SeqID_82557; Strand=+; Position=1 -38,304-316
MATTLQQKYSCARNTK

SEQ ID NO: 156135 - protein, 231 aa, Heterodera glycines
  Coding regions on vcDNA: vcDNA=SeqID_82558; Strand=-; Position=1 -396,981-1280
MDDEGKEICEVLSKIDAYSQQILNMHQKNYEKQIINDQMSKLTQLIEQHFANTKQKIGNDLAPEKRESIEQFVEQLENDGEKMEQQQQNDAVMKKLDEQLKKNLQKIKKLNKKLLKNNGKGPTEKEIPEYYELSYQCLLIYEKMAVHLFPLQTLDTTAGDIPQVGAVSAAQPSAAAVVADGNNRRRRRKRGVHCCGGCCNCCGLEFGAMFRAFFKFMGEMLSVPWKGLYLS

SEQ ID NO: 156136 - protein, 141 aa, Heterodera glycines
  Coding regions on vcDNA: vcDNA=SeqID_82559; Strand=-; Position=1 -45,313-568,1398-1522
MGGRFGEGIPGPGLVDGQSLTAHPFHRIVLDPRSLSMMLAPVRERFRPSVPNPTTCSPAAQFMNRLGLRGLRKSTRVHSVPEWSEETVQKTKCGVGRAVQVIFVNANGSKQNQCAQIETLENFNTKFVHQLYDEICEAEVI

SEQ ID NO: 156137 - protein, 66 aa, Heterodera glycines
  Coding regions on vcDNA: vcDNA=SeqID_82560; Strand=+; Position=1 -119,516-594
MCTGNDKELLTRSPEKIFDFVERSITLSLDVDSLLGIGLRRHPLEAFKEQKSKIEVYLSMNRLFFW

SEQ ID NO: 156138 - protein, 246 aa, Heterodera glycines
  Coding regions on vcDNA: vcDNA=SeqID_82561; Strand=+; Position=1 -403,985-1322
MPTMLLDRHDYIHKWLIWVTEYAEGWLAKLISLAIRIGTLNMDNAREPFAYIICRHFDRVKGNSDFDENYTVEDDGLMMAVHKRNEIDEMATKSEQTQQQYLDKIVAQSLALRNILMILAEEANNDFTFESSLKGTSSSSTSYLTTIISKTLHPLLIKNVHSNHQQLVHHLATLILFFHRIFEMVAVPQIWLLNKFSVGTELKQLKRIYETTIKALHNIENEWDKEQKAISDDDHEDDTAISANNR

SEQ ID NO: 156139 - protein, 35 aa, Heterodera glycines
  Coding regions on vcDNA: vcDNA=SeqID_82562; Strand=+; Position=1 -50,910-967
MAQNYQIPQAAYGQHWRLHKNIIEAQIRYGQKIRN

SEQ ID NO: 156140 - protein, 97 aa, Heterodera glycines
  Coding regions on vcDNA: vcDNA=SeqID_82563; Strand=+; Position=1-390
GGTVPKFCTTFYCGKSKYLIGQLRVNEHSRLWPVVERKNGNIRWGALFSKNSSFRLTIPPFCALFRFKIESFFLSFEINCEKYTKIIFGFNYAVQCF

SEQ ID NO: 156141 - protein, 101 aa, Heterodera glycines
  misc_feature (16)..(16): Xaa can be any naturally occurring amino acid
  Coding regions on vcDNA: vcDNA=SeqID_82564; Strand=+; Position=1-342
APREGGTVPKFCTTFXCGKSKYLIGQLRVNEHSRLWPVVERKNGNIRWGALFSKNSSFRLTIPPFCALFRFKIESFFLSFEINCEKYTKIIFGFNYAVQCF

SEQ ID NO: 156142 - protein, 139 aa, Heterodera glycines
  Coding regions on vcDNA: vcDNA=SeqID_82565; Strand=+; Position=1-420
MTLTFFSFLCPRSQQFLAKQYPGLVLRRRRPRQGGGAGQKRVVVGSTVAPATTAVKLTTPIAAEHRLEGEEEEEEENGDDGGGGIATKLTTADDDNDDEEVEEDIFSEIVIDEFSLLLFRSMDDYNVWGRGKMYYINER

SEQ ID NO: 156143 - protein, 45 aa, Heterodera glycines
  Coding regions on vcDNA: vcDNA=SeqID_82566; Strand=+; Position=1 -73,958-1022
MYEHIIQIVLSFYEAAQVLASGTRTNSYSGRLVTIYNVNKEEEES

SEQ ID NO: 156144 - protein, 34 aa, Heterodera glycines
  Coding regions on vcDNA: vcDNA=SeqID_82567; Strand=-; Position=1 -47,102-159
MSDNPKEAERKMEKAISSLPTVGWRVRFGAPRSA

SEQ ID NO: 156145 - protein, 61 aa, Heterodera glycines
  Coding regions on vcDNA: vcDNA=SeqID_82568; Strand=+; Position=1 -95,596-686
MCCSKNNGVLSKDPQTKNPSLLLLADPSTTAQNSIFLKYFQSWSLPSTSADASSRYCQNQH

SEQ ID NO: 156146 - protein, 33 aa, Heterodera glycines
  Coding regions on vcDNA: vcDNA=SeqID_82569; Strand=-; Position=1 -88,124-137
MKKNEKINYKKRIHKIIILLISFYAFVFNCFLS

SEQ ID NO: 156147 - protein, 36 aa, Heterodera glycines
  Coding regions on vcDNA: vcDNA=SeqID_82570; Strand=+; Position=1 -9,638-739
MSGVYVLQFFIFANLALGHIFITFDGNAESFFCIKL

SEQ ID NO: 156148 - protein, 25 aa, Heterodera glycines
  Coding regions on vcDNA: vcDNA=SeqID_82571; Strand=-; Position=1 -23,286-340
MCMKFEYLNYSWRSTIKNLNIFVSK

SEQ ID NO: 156149 - protein, 393 aa, Heterodera glycines
  Coding regions on vcDNA: vcDNA=SeqID_82572; Strand=+; Position=1 -1162,1302-1321
MPKIKKNKSSKKSISAAPSRQMPLAQNYEDLTSSRESATVDKHSPLTPTTNVVVDRIFSDDPEMADEDGKRVSRSENGQHIKKMSVNSALGPSVMIENKSGGDNEPNYEESEVRIEVLDKTTKTALGSPVMHSRANLAINNITIENIEDINSFFTTFENYFARTYQILGTLTDPLLWAMLQPKSLSESENRKSETISTDDKFIVIQTGINWTLASRLTEVSSWPHFLLMKKKSQSDEYFRLGEIIDIKEFVENESNSPKAFSKFATDLTLLPEDGCGSIARILKCERTGKINAVDICFDELVQRFYSHQFGSDVDVSEIVADAYVEVITLGFRIQGFENSLSTLTGLNTLSDEPIQIVSQPNIGTSIDLVIKIVRQIDPVEEDYRQWSFKNLF

SEQ ID NO: 156150 - protein, 350 aa, Heterodera glycines
  Coding regions on vcDNA: vcDNA=SeqID_82573; Strand=-; Position=1 -385,746-1083,1276-1374,1418-1648
MEFNYSFTYSFIFFLLIYFVVNRCNSEELLKICIKYEQNHSTDDTQRKITVNLSAIYLNMNLMSKDVQQNVQIGDKLDIPMPTNVREFDEFKFVFCIFVKPLDNEYQSGGFDEDPSDDQPFEGGFGILDQYYQLQMDDIRSMVRSVGFVLYEPNFAKRYTFNLGQIDPRGLFWKRRIFLDTKNGGPGNFYGFLYATVNKNQRNLPMLDEKILLGHAPLTAAKNHRNELTTNREQSAKLNLMLNEYNLSIEIDDVQRFFKHKILNLQLKIYYFDEGNKINDDLIIENSINDKKQKSDRNNDDEEDECPICFESLNGEKQTIKFHEDYNENSKAYFYLIKQFIWKAYGIRSN

SEQ ID NO: 156151 - protein, 27 aa, Heterodera glycines
  Coding regions on vcDNA: vcDNA=SeqID_82574; Strand=-; Position=1-142
ARGNIKGIFVFSDPEDPKNPKLDSFVF

SEQ ID NO: 156152 - protein, 265 aa, Heterodera glycines
  Coding regions on vcDNA: vcDNA=SeqID_82575; Strand=+; Position=1 -64,378-585,618-1140
  Homolog annotation: Hit_ID=NP_608540.1; Match level="QueryCoverage =99%, HitCoverage=67%, E-value=5e-33, Identity=36%"; Hit description =CG2839-PA [Drosophila melanogaster] gb|AAF51469.2| CG2839-PA [Drosophila melanogaster]
MPKKKESEKEIKRRQAIRWSSRLDESGYLGKTGSGYFRVQQSRVRVQVFKPGTGGTESGRGTESGRESGRGTKVEEEKKVEEEQKWKRKRKTWKRKWKRNRKWKRRRGTESGRETESGRETESGRGTESGREEEEQKVEEKQKVEEKQKVEEKVEEEQKVEEKVEEEQNVEEKQKVEEKQKVEEKVEEERKWKRKRKWKRTERGRGTESGREEEEQKVEEKQKVEEKQKVEEKVEEEQKVEEKVEEEQNVEKKQKVEEKQKVEEK

SEQ ID NO: 156153 - protein, 217 aa, Heterodera glycines
  Coding regions on vcDNA: vcDNA=SeqID_82576; Strand=+; Position=1 -70,121-351,821-1030,1623-1720,1769-1813
MAINYYIFFTICLFFTKFAMTINGGPSSTNNQKPRTINRIAHPRNIEGQLAAGDHIPHTNQPTNNATNGHQNDQNANSENSDLLDNSATEQHSSVHEGNNAGRPTENLIIENEHRAHFFDQGKSIDTTSPSGYSNANATKLDETNDHQQLVSEGGNDDDDDERKMNDMEEEDSNNDPVVSECCPICLQPFTEASNKKVLNKCGHQFDVNCIDQWQTI

SEQ ID NO: 156154 - protein, 194 aa, Heterodera glycines
  Coding regions on vcDNA: vcDNA=SeqID_82577; Strand=+; Position=1 -464,507-625
MFLKFVFFPFFSISLAIAQQILPMTNDEIEMIKNIMGSIEQNLIMVEANCCAIDHENFDQFKKAVPKMFEKINQKIMIENETPKFADFQEFFAEIYAFLDKVHIEMEIFVKNLSPYCEQNEQKALTRFEMAMQMEKEFLMDNLVIIEEPNAKIKRFFEKFDSSLFAKLTLTIVDMLTMDSLLKDERNRHFSKLF

SEQ ID NO: 156155 - protein, 79 aa, Heterodera glycines
  Coding regions on vcDNA: vcDNA=SeqID_82578; Strand=+; Position=1-240
KCCLSCGCVVMSPWMLFVAIIGTPIGIVCEGANAVRRCANPTPKEMPSKIASKTSGTSKTTSKTASKTNSKNGEKKKNN

SEQ ID NO: 156156 - protein, 36 aa, Heterodera glycines
  Coding regions on vcDNA: vcDNA=SeqID_82579; Strand=-; Position=1 -75,901-936
MVNGFLKWCLYINYHKVIWSICGLMAVWSRIETAKQ

SEQ ID NO: 156157 - protein, 925 aa, Heterodera glycines
  Coding regions on vcDNA: vcDNA=SeqID_82580; Strand=+; Position=1 -235,385-1137,1275-1970,2485-3578
  Homolog annotation: Hit_ID=NP_502797.1; Match level="QueryCoverage =23%, HitCoverage=61%, E-value=1e-36, Identity=37%"; Hit description =HASI (4P602) [Caenorhabditis elegans] emb|CAB16520.1| Hypothetical protein Y57G11C.19 [Caenorhabditis ele
MYDFSPYIRENSEFFTKLAATKSDKKKNDLLKGASAEQILGLVEICANILKFNFRLNRRQRRRLALYADYYRAIARSRKSEYLALINLLKGGVGDGADSLQNEKALLDARIQRNLNDHKMDADVKMKRHSWLYKQRHQIKDMIDNKPQKVIVENASGSTPPNIAPYMGIQKAATPNKHLLDEVEDGRKTSPLKKRRRSMKTHNRVVATNTSNGASYCEETDAYTSAPETDLLLSKKREQKFLKLKTDPVHYDKLQSIIERNPAKYGVDKASGEILTNFKKPVVKSNYIDSLMYLTGQRADAPKGHRFFVQKIGNDPEIMTFFHAQQGEGEQVYYDLRSPASYAGIQKVLAEAQRRNPSITLRDVHQFLHKQRTYTLFKPRKNRFRRLKTVPSGLHTDWQCDLCIMDALKEHNDGFRYILVCIDVLSRKIFTAEAESKKSEHMIAAFEKIFKKAGVLPNKLYSDAGLEFQAKKMTDYWKQKDIIKHVMYSPHLHAGVVERANRTLKERLYKYFSEKNTKRWIDVLDSIVRNLNSSANRTTGLKPVDVNFKNADALRNRLYKQVGIDEDDIISIKLVNPSYRFLDDKKFLHIELKIPSMQFSSVEHLRLTLNNLITEAYQQQISSYLDDDAKRTKRQENVTDLFFHENPVDYWEKIGELRAKYEQLEKELTEEESELSANTTDAERRKVLESELPLKRLRTRRKKEELEELERAAERRDQESPEAEQKKIGEFFHHHPEDYNRKLNEARLIFTHHLSGLQAVMRKYIDEKDANKIRQLESEVEKLRLKIKRLQRNLTIFENATLQRDHQKSLSQYEELSHQQNSAYVKEFFQKHPTNYWQIIHNNYRGLTEHFQKIEELRAKAVGLKDNASFQQQIERAKQLIEYRRKRFAALEFEAKKLDESSIRMVVIMIKQMRVPKQQQLREKH

SEQ ID NO: 156158 - protein, 198 aa, Heterodera glycines
  Coding regions on vcDNA: vcDNA=SeqID_82581; Strand=+; Position=1-594
MTHGQTLIARLKQSEEQKKEWVAVPQDDDDDDRPALKHGDMLWKLLRSTTPHNQKQTAGDVIHRQFADAEHTRGQVMMELLKNILEEKSDAADAHRQQQQNYPRQKSAQVLRTKSRGEALKELIKKTQNEQLPQSSAKTRGEILKLMLENMKFSREEEVSFEKLVAKQKTEQTAAEFVFNDLAQRFVMKTGAGVLHVD

SEQ ID NO: 156159 - protein, 111 aa, Heterodera glycines
  Coding regions on vcDNA: vcDNA=SeqID_82582; Strand=+; Position=1 -24,326-637
MHFHYKLLKYSFLNLDIQEICNYGRDGTVEKVSIWTAFIQKIKPKPMPYDQIHLEKVIGRLFSIYIQDVQNPMLVKHPNRMKQLLVKDPCDEAKLKVKQIEGVGEDDENDQ

SEQ ID NO: 156160 - protein, 79 aa, Heterodera glycines
  Coding regions on vcDNA: vcDNA=SeqID_82583; Strand=-; Position=1 -56,592-775
  Homolog annotation: Hit_ID=NP_505582.2; Match level="QueryCoverage =87%, HitCoverage=19%, E-value=3e-21, Identity=65%"; Hit description =yip1 interacting factor homolog (39.1 kD) (5K530) [Caenorhabditis elegans] emb|CAA94831.2| Hypothetical p
MAFITYVLVSGFVFGVQKRFSPEKLGMLTTNALFYLFLENGIVFVMKYALNISQSLNIWHALSYSSYKFTGSDFLAFLK

SEQ ID NO: 156161 - protein, 106 aa, Heterodera glycines
  Coding regions on vcDNA: vcDNA=SeqID_82584; Strand=-; Position=1 -218,475-577
MFCEIRGQQQLTPFATMQRKDGKWNIEKQKKGCGRVEGMGPNFGAGYWALYYSHLGFCPQRITLINPSFLLNEKNHTVDSLHRASFHFVSAPSSLFCCGLSAGRKH

SEQ ID NO: 156162 - protein, 40 aa, Heterodera glycines
  Coding regions on vcDNA: vcDNA=SeqID_82585; Strand=-; Position=1-168
FGMSLTCITSKSSLILVILFFVYNVSTNFLHKNLLCDGSK

SEQ ID NO: 156163 - protein, 160 aa, Heterodera glycines
  Coding regions on vcDNA: vcDNA=SeqID_82586; Strand=-; Position=1 -57,806-959,1005-1060,1108-1220
  Homolog annotation: Hit_ID=CAE72941.1; Match level="QueryCoverage =77%, HitCoverage=34%, E-value=9e-27, Identity=50%"; Hit description =Hypothetical protein CBG20269 [Caenorhabditis briggsae]
LQKLKFVPDHGSLGFQEKSGETESKEVNSDEMNYLRQVGEILSRGTVRTDRTGTGTISIFGMQTRYSLRGGTIPLLTTKKVFWKGTIPLLTTKKVFWKGIVEELLWFIRAETNAKTLSSRGVKLLWFIRAETNAKTLSSRGVKIWGPKLFLNLFLYYLHL

SEQ ID NO: 156164 - protein, 44 aa, Heterodera glycines
  Coding regions on vcDNA: vcDNA=SeqID_82587; Strand=+; Position=1-134
YNTFLSTMRQHFRPLKTREKRSWSAEAFYYIGNIGKLRLVNMLI

SEQ ID NO: 156165 - protein, 69 aa, Heterodera glycines
  Coding regions on vcDNA: vcDNA=SeqID_82588; Strand=-; Position=1 -47,256-418
MDEGQFWSCALGEWVKDCVCGTSAADPWPILDPSQWPIVPSLQLRYAELCDGVALNLVLCYMYAFPSDQ

SEQ ID NO: 156166 - protein, 48 aa, Heterodera glycines
  Coding regions on vcDNA: vcDNA=SeqID_82589; Strand=+; Position=1 -105,329-370
MGGWDKSVSSDKKVWDNSVPYNKKLLFAGFVSREIVLCYSCLIKKSLD

SEQ ID NO: 156167 - protein, 141 aa, Heterodera glycines
  Coding regions on vcDNA: vcDNA=SeqID_82590; Strand=+; Position=1-426
MKVFLMISLFVFLIIILININYVGSEKKKMEQKTFDEIFGEKWEEKRNEGQKKREIIGKFNKIKEKIKQKGRKYSAKERSKIEGKIAKKLGTNRKNIQKWIKELKLNKFKSINDQRKFEIVQKFIEMSNEYKQKGTYSKKE

SEQ ID NO: 156168 - protein, 38 aa, Heterodera glycines
  Coding regions on vcDNA: vcDNA=SeqID_82591; Strand=-; Position=1 -35,258-339
MSAKSVGNGEVNATGPGSGSGQLSTIEYQGPGFDRDRD

SEQ ID NO: 156169 - protein, 120 aa, Heterodera glycines
  Coding regions on vcDNA: vcDNA=SeqID_82592; Strand=+; Position=1 -189,264-437
MHFQIVSFLVFCIFHNFPSFARYCGGKAISSFKKKLKYEPDQEGAPLEVKRESRNSFVGGNGKVYIGYVKKSPTYEGCVAIKIFNPNFYAIYENSKDFMQKIQSILPPDERKHLITMVDA

SEQ ID NO: 156170 - protein, 346 aa, Heterodera glycines
  Coding regions on vcDNA: vcDNA=SeqID_82593; Strand=-; Position=1-1039
  Homolog annotation: Hit_ID=AAL40415.1; Match level="QueryCoverage =84%, HitCoverage=29%, E-value=2e-26, Identity=28%"; Hit description =endonuclease/reverse transcriptase [Branchiostoma floridae]
MSIPKTTQKPKFINIRRFTPSNVSLLNTVISSRISTLSQGHFSVNEKYNAFNKTLLETLNECIPIKRLTKKELAPKYPTHLLASIKEKAKLYKLCKIDPTKRALYDSISLHIKIQTKKFHSQLEQKAISKGKNSIFKYIQKYDVNPFEISNLVSENKCYHNDQEKCELFANLFVNSFNNSEVDPGFLSLDNTFVNQSFISDIEFNIIETQKLLRKLPNKNGTSPDNISYKTLKNCHPSLATVITDLFRISLDSGSLPDIWKESIVFPLFKKGDKFNPENYRPISLTCSLCRVMERILSQNIYNFLLKNNKISEYQFGFVRNRSTTSQLITVVEDWYDAIINGKNAD

SEQ ID NO: 156171 - protein, 95 aa, Heterodera glycines; identical to SEQ ID NO: 125597
  Coding regions on vcDNA: vcDNA=SeqID_82594; Strand=-; Position=1 -787,954-1195

SEQ ID NO: 156172 - protein, 376 aa, Heterodera glycines
  Coding regions on vcDNA: vcDNA=SeqID_82595; Strand=-; Position=1-1128
  Homolog annotation: Hit_ID=CAA82797.1; Match level="QueryCoverage =74%, HitCoverage=42%, E-value=5e-19, Identity=27%"; Hit description =gag protein [Ascaris lumbricoides]
MSGFLRTKIAIELKALEKAKTATELYAEPDQTLTSLENAILLESAAERIKSEVEAVNAKIEQIWITASKWHDVIQKMDKDERKSEQTAYEQFQTTEKLNTKMEAANTKLTELKDLEMKVEAGAKLQRSKADRDARVEQREHAKAMSKSNAEADKGNNRARGNEMTAALYQLPTLRIKPFGGDKREWPMFEEAFKVAVDQKPGSKTEKLNLLKSLVEREAALLIGGLRLEEKNYEIAMKLLKDTYGDKGEYVRRLHTELSNLKRCFSVEDTKHFCMELERLARELEAAEEDIEGPPIYLMLEKKLYKPFLREILEEKAKNPDFWDTSSLRKALGSALSKELAIKEVMREYGFEGKEANPEHGFKRQLRRNRFGGSVN

SEQ ID NO: 156173 - protein, 110 aa, Heterodera glycines
  Coding regions on vcDNA: vcDNA=SeqID_82596; Strand=-; Position=1 -97,145-380
MAVTLDRFVDMADPGIREVFPGIVGHIKLRENNETLLNKVLAPFECSGGQIFRVYTRETMPRRYQWEMAQSKDDRCFLSDFRSATPVVDALANWSSTRQWAPNCSKRPRR

SEQ ID NO: 156174 - protein, 23 aa, Heterodera glycines
  Coding regions on vcDNA: vcDNA=SeqID_82597; Strand=+; Position=1 -53,128-146
MPNSFTNIDINPVELSQRRRLSA

SEQ ID NO: 156175 - protein, 87 aa, Heterodera glycines
  Coding regions on vcDNA: vcDNA=SeqID_82598; Strand=-; Position=1 -125,252-345,572-617
CVAKEKAISAPYLIGRAVQLSECRKLYRGDRICFRGIASQSGDSGSAVLASNGTDYVQIAVSSYVECISSAPEASYAIYSRIDAKWL

SEQ ID NO: 156176 - protein, 25 aa, Heterodera glycines
  Coding regions on vcDNA: vcDNA=SeqID_82599; Strand=+; Position=1 -27,942-992
MRRNKLTKKSPIINFDNFGEEKAKL

SEQ ID NO: 156177 - protein, 121 aa, Heterodera glycines
  Coding regions on vcDNA: vcDNA=SeqID_82600; Strand=-; Position=1 -145,505-725
MDINLMPWTVYYKIKGGGHCSGSLISSEFVLLAAHCVNEVKDGAKIILGFNSSERIRTGKPYNGIQLHLHKNPSNVFIHPGFVKKENLNTTGWNDLALIKALIKNNNKFNTGFCHSNFITP

SEQ ID NO: 156178 - protein, 265 aa, Heterodera glycines
  Coding regions on vcDNA: vcDNA=SeqID_82601; Strand=-; Position=1 -74,401-511,563-757,1197-1273,1773-2035,2258-2335
MFLANFIFCIFLFVFSELFAGLNGKKISLTLIFKTLSTLTLQVSKANPWPIQVFYRSKKCSSFWLCYNRTMTDKGFPWKLKKGFRFDQLFNVSSEPSISDQCGPNARKIHFSIANETLTIGNELITNNAKPNDTNIELKFDSFCGNVVLLNNDGQEQLNDFGKEFFAHSNFGPFLADYAGLWLLPLDIVSKLGGVMSDLISVVPDECKFEWRLIDPPKQCMPFDFEAAQKRRSARRINPLKNIFGILILLPSAGKSSNFQEHGCS

SEQ ID NO: 156179 - protein, 31 aa, Heterodera glycines
  Coding regions on vcDNA: vcDNA=SeqID_82602; Strand=+; Position=1 -58,207-244
MIHHNATINDRMMIIHWENDNTIIISDWTRI

SEQ ID NO: 156180 - protein, 41 aa, Heterodera glycines
  Coding regions on vcDNA: vcDNA=SeqID_82603; Strand=+; Position=1 -76,202-251
MYKMDFAPFKLLLLLCQNAERPRWPVSSMVAIGNRCLFLSI

SEQ ID NO: 156181 - protein, 36 aa, Heterodera glycines
  Coding regions on vcDNA: vcDNA=SeqID_82604; Strand=-; Position=1 -73,1340-1375
MLQQTANYPAATGTGNAQLNEGYNGNPGLPGMPGPK

SEQ ID NO: 156182 - protein, 111 aa, Heterodera glycines
  Coding regions on vcDNA: vcDNA=SeqID_82605; Strand=-; Position=1 -84,234-485
MTLHTIHSFCCTTLLMILKKDWKFRASSRRISKICPKMIKLCHFEGLKFNYKVEKWENSALLPGYGRGPYNPSVGNPSVVNPLVDNPSVKDNPSVMDNPSVYNSSANFFEQ

SEQ ID NO: 156183 - protein, 82 aa, Heterodera glycines
  misc_feature (26)..(26): Xaa can be any naturally occurring amino acid
  Coding regions on vcDNA: vcDNA=SeqID_82606; Strand=-; Position=1 -119,254-447,502-544
  Homolog annotation: Hit_ID=NP_740900.1; Match level="QueryCoverage =98%, HitCoverage=2%, E-value=6e-10, Identity=43%"; Hit description =chorein A (359.3 kD) (1J482) [Caenorhabditis elegans] emb|CAB02304.1| Hypothetical protein T08G11.1a [Caen
TIDVFRPPKSVRLHQLFWEPEDGKIXIESRSATALQHMVDVRKKLELEVKIDPAIFVVCSGGAFDPTKTTLIAELGQLKLNT

SEQ ID NO: 156184 - protein, 31 aa, Heterodera glycines
  Coding regions on vcDNA: vcDNA=SeqID_82607; Strand=-; Position=1 -69,358-383
TKGGGQVSVFPSNNIFIHFFKCTLTPKIFFF

SEQ ID NO: 156185 - protein, 88 aa, Heterodera glycines; identical to SEQ ID NO: 124691
  Coding regions on vcDNA: vcDNA=SeqID_82608; Strand=-; Position=1 -96,135-305

SEQ ID NO: 156186 - protein, 363 aa, Heterodera glycines
  Coding regions on vcDNA: vcDNA=SeqID_82609; Strand=-; Position=1-1092
MTLNSLPELKGNFGADGVRSFFRHFDVATEEWPEAKRLSALRSKCLGRAERAFNVAVANNPFRYDSVKRAMINLLEETDARQMSAFDELMSGAYRRNNERIDDLADRISSLVRKAYPGLLEHLYDDYSIRHFIRALQNPELALTLELARRPSMIFDEFVALAARAESTQKASKLAMQKSNNFSRFNSQFQVPQYSPRPMQQHFRQENFPQANDQQQNRPTCYNCGKFGHFARQCSEPQRNQGTQNNNSSTSNFVRQNFIVEQQERPPQPSQNLFVGGISMSPAEVEKLFGKDGTENETTKNLNKVSIGRIMALNVSVCGLTAKAMLDGGAQISLVSFAFFAKLLAEKRIDTDLRPTRHITSGD

SEQ ID NO: 156187 - protein, 133 aa, Heterodera glycines
  Coding regions on vcDNA: vcDNA=SeqID_82610; Strand=-; Position=1 -125,503-536,578-703,819-935
MTALMVDAKMHFDHRVGWSLVSMRSMGAVRTKCDPFFDWLKNRVARYRYRYRPKSKYRYRYRYRPVITGFFGTGTGTGFSEIKVSVPVCLVPVPPRLFICSGQVAKPSDFIISRLGSIPHWDRIFFIFSLPLF

SEQ ID NO: 156188 - protein, 80 aa, Heterodera glycines
  Coding regions on vcDNA: vcDNA=SeqID_82611; Strand=+; Position=1 -90,638-782,1104-1111
MKNPCCKALRIYEEQFMVFCVMCPYVKSDDSYRTTPTILNLIDSEQSYGSKSLPTTFRPATFWGAPAISYIHTVDMFPCR

SEQ ID NO: 156189 - protein, 71 aa, Heterodera glycines
  Coding regions on vcDNA: vcDNA=SeqID_82612; Strand=-; Position=1-216
MSLPTKATTPIRNVQPKTEAEGQSGAMTWNVAIVTIVAIAIFVAVAVSAVAVPTMTTTVAAVTQSVALFCG

SEQ ID NO: 156190 - protein, 107 aa, Heterodera glycines
  Coding regions on vcDNA: vcDNA=SeqID_82613; Strand=-; Position=1 -3,182-502
MKRAKQKAKLAGEEANGFEEEEKCQKEEAKKEEKAEGRRSEFGGGRRSGREWEKGDESHGKGRRMEGQQAVAEAAAAEEEQTEWKKNGRKKHRGKTKEAETYAKWTD

SEQ ID NO: 156191 - protein, 146 aa, Heterodera glycines
  Coding regions on vcDNA: vcDNA=SeqID_82614; Strand=+; Position=1 -213,327-593
TFVSIKMPLFHSFFLILLFLNLFFQFIFLKALKVPRFLVKKILNETMQNEAQTITEKPPPLGASAPSLGGSALSSLFASPLITLAPPITSSASFLLFLLTITFLLLISAFGLLLFKWHMRNGKSENGGSKEKAWNGRTPIISQPLR

SEQ ID NO: 156192 - protein, 71 aa, Heterodera glycines
  Coding regions on vcDNA: vcDNA=SeqID_82615; Strand=+; Position=1 -46,630-796
  Homolog annotation: Hit_ID=CAA74206.1; Match level="QueryCoverage =78%, HitCoverage=16%, E-value=4e-25, Identity=98%"; Hit description =serine proteinase [Heterodera glycines]
MRIKQKKDCRDVFFDENFVVPYGSADASNQQHKSGVEAIKYHPKTQHYEIKDKFRKNTRAYLFLNDIVVIK

SEQ ID NO: 156193 - protein, 27 aa, Heterodera glycines
  Coding regions on vcDNA: vcDNA=SeqID_82616; Strand=+; Position=1 -8,1263-1338
MICSNKARFGVSNCCRTVAIFSRLLIE

SEQ ID NO: 156194 - protein, 296 aa, Heterodera glycines
  Coding regions on vcDNA: vcDNA=SeqID_82617; Strand=+; Position=1 -300,565-747,787-1193
MALVRFSVGKTNRGRQLITHGGYEYLFEVKVFKKTKKQFSKADSRTEDGWSYWKCPRRPPYCPGRATVQSNLFVADDGSNYRLGRVTAQHNHEPVFGSLTEGDIGLDAMPPTNLLVPNALQNRVIYNQNLQGKKMLIFCSQFGLDALRNYGESVAIDGTFESCPRGFGQLYTMSVIIEHCAVPCAYGLLPNKNSPTYRIFFDSICASVGIGWYPARIMTDFEAGAINAAKIVYPNAIVSGCLFHLGKAFFRKIQSLPHLLDRYNNNEDVRKALRCVQALAFVPLNYVYNYFAIAMS

SEQ ID NO: 156195 - protein, 192 aa, Heterodera glycines
  Coding regions on vcDNA: vcDNA=SeqID_82618; Strand=+; Position=1 -25,1171-1207,1264-1474,1528-1598,1649-1745
  Homolog annotation: Hit_ID=CAE69211.1; Match level="QueryCoverage =98%, HitCoverage=83%, E-value=3e-44, Identity=50%"; Hit description =Hypothetical protein CBG15251 [Caenorhabditis briggsae]
LLSIHLEKEPIVIRGVGHLTMFGLNSHFFGLNSHFSTEFPSALTGKLAPEEFDDTLRRVNYVLQRNVSRNLRWLICGLLFCCCSFGISLWPVVCLNRRTISALEKTLDHENQQLYDKTISALEKTLDHENQQLYDKLGLHWKLARLPVEPSNRLTEYVLLKLARLPVEPSNRLTEYVLLLETLPRIPLSMPD

SEQ ID NO: 156196 - protein, 101 aa, Heterodera glycines
  Coding regions on vcDNA: vcDNA=SeqID_82619; Strand=-; Position=1 -207,980-1078
MGTFGIKRTERAIAVKSKQFHVLIRHGKGNSWQRFKQKDIFCQAIGRLNGQPGQLPEIAICSKQIEKLKRKMRIRNLAFDFLFKFTFGISNCQMDAEFRYQ

SEQ ID NO: 156197 - protein, 17 aa, Heterodera glycines
  Coding regions on vcDNA: vcDNA=SeqID_82620; Strand=+; Position=1 -28,623-648
MEFNNYFNKSTLPLAIS

SEQ ID NO: 156198 - protein, 193 aa, Heterodera glycines
  Coding regions on vcDNA: vcDNA=SeqID_82621; Strand=+; Position=1 -80,149-650
  Homolog annotation: Hit_ID=CAB62280.1; Match level="QueryCoverage =74%, HitCoverage=33%, E-value=1e-10, Identity=34%"; Hit description =hydroxyproline-rich glycoprotein DZ-HRGP [Volvox carteri f. nagariensis]
MRWQANAARMLMAIPLREPKTVDVPDEPKSSPTDPLSPYDPSHPRPTQPDYPDMRDYDPRSFKPPEPDDDPLRLHPILPAAPYAPPARPRPSQPNAPTRPPPTYPDIGRPYFDPLPHQPTNPYSDWPYGPAAPTGSGGYMGGYDGGVYEPRPDQPGNSNYDPYGRGGSDDGNHGHDGPGSSGGGGGGFFGPYL

SEQ ID NO: 156199 - protein, 122 aa, Heterodera glycines
  Coding regions on vcDNA: vcDNA=SeqID_82622; Strand=+; Position=1 -132,396-492,923-1062
  Homolog annotation: Hit_ID=CAE66815.1; Match level="QueryCoverage =81%, HitCoverage=54%, E-value=1e-09, Identity=34%"; Hit description =Hypothetical protein CBG12180 [Caenorhabditis briggsae]
MEEFEEMVAVLQLDGVLDFDAVRRAVSSGAIRVRECDAETPMVQIGSHLYSGQWSQTLGTDMLLCPSSMSDYHHHEGHQRLELVAVSDTRLCAQKVLLATDESPTNGNGTRNEQSTSNSSKA

SEQ ID NO: 156200 - protein, 63 aa, Heterodera glycines
  Coding regions on vcDNA: vcDNA=SeqID_82623; Strand=-; Position=1 -96,645-671,875-943
MWTSKNVQEFKDNIKKEGTEGVLKIGHGETVTTFRRDCHEESFLQQVISSRLIVEIYTVKGND

SEQ ID NO: 156201 - protein, 34 aa, Heterodera glycines
  Coding regions on vcDNA: vcDNA=SeqID_82624; Strand=+; Position=1-102
MGLCEKRKKLKTIGRCLSFIWAVIGEKNDINKRK

SEQ ID NO: 156202 - protein, 60 aa, Heterodera glycines
  Coding regions on vcDNA: vcDNA=SeqID_82625; Strand=-; Position=1 -31,254-405
MSEADPNFVKTWEDEIFRAPHFPIPFWNMHSQATSALARTNNGLEATHLHFMVFNFLKAN

SEQ ID NO: 156203 - protein, 136 aa, Heterodera glycines
  Coding regions on vcDNA: vcDNA=SeqID_82626; Strand=+; Position=1 -280,821-951
VVQGILVKLHQPETTPLAPITNEEVDNNQQTDNGKNAVESGGNASSSSSPASTVPLIILALILAVLVLVSIFWILIKRAKAGQEKQTDHANGKAVHLPSPAGDSTTPMLDMRGNAERTTAPDTVGMAPENGTAGRN

SEQ ID NO: 156204 - protein, 71 aa, Heterodera glycines
  Coding regions on vcDNA: vcDNA=SeqID_82627; Strand=+; Position=1 -126,1260-1349
MPPQDEAGPSSSAASAEEAMETPPPTPAPVPTPEMDEEKFGTRLEDQKENDNFLEHSDGENEDDAVIDVIG

SEQ ID NO: 156205 - protein, 59 aa, Heterodera glycines
  Coding regions on vcDNA: vcDNA=SeqID_82628; Strand=-; Position=1 -160,202-221
MPNQIFSPGFLTILELGEMSLDQELQRGKTKKSKNQLITMVKDIVSTLDVLHKELTILN

SEQ ID NO: 156206 - protein, 82 aa, Heterodera glycines
  Coding regions on vcDNA: vcDNA=SeqID_82629; Strand=+; Position=1-250
  Homolog annotation: Hit_ID=CAE74138.1; Match level="QueryCoverage =92%, HitCoverage=9%, E-value=2e-23, Identity=69%"; Hit description =Hypothetical protein CBG21809 [Caenorhabditis briggsae]
GQKQRIAIARALVRQPKVLLLDEATSALDARNEQLIRESLSACAKGRTVLMIAHRLSTVRRADRILVMEHGQIVQVRNRKRL

SEQ ID NO: 156207 - protein, 69 aa, Heterodera glycines
  Coding regions on vcDNA: vcDNA=SeqID_82630; Strand=-; Position=1 -61,193-341
MPGSKYQQLLLFIDELGRVILISDPENQRNSALVHFMSPIEFYESNLTFMSPIEFYESQSNIYESYKNL

SEQ ID NO: 156208 - protein, 304 aa, Heterodera glycines
  misc_feature (279)..(279): Xaa can be any naturally occurring amino acid
  Coding regions on vcDNA: vcDNA=SeqID_82631; Strand=-; Position=1 -134,249-558,944-1138,1573-1777,2229-2297
  Homolog annotation: Hit_ID=AAC69868.1; Match level="QueryCoverage =87%, HitCoverage=71%, E-value=1e-141, Identity=93%"; Hit description= dorsal esophageal gland-specific protein [Heterodera glycines]
FRTPNPSSNKKSKTQFSTKFNFFFLHKEIQFEFGARNGSKQMPNSVHHTNQKLQQSATSAAEGGGKFSDFEDGSDNELFISTTTINNNDGDNDNDEEEEEGKEAIPWHGGGKYAKCFEQIVRDGTLVAKVRCLICAKELSTKSRTSIREHSKLHQLVAESGIFDHSQEGIFDGMMPEAVGTALVEERTPIVIPFRRRVTTTEMMPSTSAQQKMRSQSVEDDILNDEELQQQQNLAHFDWNKQKIELQILEAELIQKQLSNFQRCTELGIPARVNLKKNXITMGSQSATGWNRRFATFSNAHALQ

SEQ ID NO: 156209 - protein, 109 aa, Heterodera glycines
  Coding regions on vcDNA: vcDNA=SeqID_82632; Strand=+; Position=1-330
MVGHENDNNQQPNGSDQALNRPSPADRRHPTAQSSQKDGANGGGGRQSRAVGAKADGAGSSSSTSSSTSAVVERGSLFAEMANLWILRAKIEKMPVEINAYLGIFGNFE

SEQ ID NO: 156210 - protein, 38 aa, Heterodera glycines
  Coding regions on vcDNA: vcDNA=SeqID_82633; Strand=+; Position=1-114
KTAKFLSILEQFTLCTMSRIFGRFVGTYPIAFLIFSLI

SEQ ID NO: 156211 - protein, 59 aa, Heterodera glycines
  Coding regions on vcDNA: vcDNA=SeqID_82634; Strand=+; Position=1 -170,767-776
MEKRRKRRKRMKIALGKEERRKRKREKGKIRRKKEGEKEEEKDENSIGEGGETEERETN

SEQ ID NO: 156212 - protein, 185 aa, Heterodera glycines
  Coding regions on vcDNA: vcDNA=SeqID_82635; Strand=+; Position=1 -109,180-449,518-696
  Homolog annotation: Hit_ID=CAH92906.1; Match level="QueryCoverage =90%, HitCoverage=25%, E-value=8e-10, Identity=29%"; Hit description =hypothetical protein [Pongo pygmaeus]
MAQKLCATQPPSVEEVGTSESGSESASDSSYSFSSSDSDESEQPAGHGGGRSQTPREKKQPLKKKAPGPSSRNPGRRVKKPSTKKSPAPRHANTSTKKRGRPAKKAEQAKPSDSGTAADSGRDDSGHSEESASGTKKKPTRKSAAAGHPTKQKASRGGRAGNKKAQEERSESSTESGSDREEDEE

SEQ ID NO: 156213 - protein, 42 aa, Heterodera glycines
  Coding regions on vcDNA: vcDNA=SeqID_82636; Strand=+; Position=1-128
VITRWRHPFHRLRHSFTVAIYANELAEHGQRSGQTVDGQQQQ

SEQ ID NO: 156214 - protein, 36 aa, Heterodera glycines
  Coding regions on vcDNA: vcDNA=SeqID_82637; Strand=-; Position=1 -43,319-386
MSTLVCGVPSVNALGHCRHQRKKEKKKRTNESNENY

SEQ ID NO: 156215 - protein, 62 aa, Heterodera glycines
  Coding regions on vcDNA: vcDNA=SeqID_82638; Strand=+; Position=1-186
HLHVIVQLPPSQNVLCPNAIADQQQQKGGQPLGQQIDDKTTSNSEHTLTHSVDGRKGKGRHS

SEQ ID NO: 156216 - protein, 181 aa, Heterodera glycines
  Coding regions on vcDNA: vcDNA=SeqID_82639; Strand=-; Position=1 -45,96-223,464-673,885-1047
MEENDLTNLMNANNTLYLLYRNVYPCWPLIIGAIAINLVAIFGMVANFGVIWTTFRTKSLHGTANVLLALCSFFELLHQHGHLLFLYVALSGHNFIPLSLAIKICSISLFAVSGISLIMAFTGLDRLFPRTVKKIPYLGTIIFVCVCISSHNLLLVFESTSKKPLLMVTGTIGDLLIVWPF

SEQ ID NO: 156217 - protein, 108 aa, Heterodera glycines
  Coding regions on vcDNA: vcDNA=SeqID_82640; Strand=-; Position=1 -163,209-372
MHFYDEKKREFIEQFDEFKCLYGQRKQNEFVKKLGINTTTLRKWKKELVPQYVKTPYSNEDKLRKIKEYFKIKERNAKISDVKIAKKLGIGIATLRTWRKKFDSVSEM

SEQ ID NO: 156218 - protein, 70 aa, Heterodera glycines
  Coding regions on vcDNA: vcDNA=SeqID_82641; Strand=+; Position=1 -44,818-986
MNIPLTDAFLGRVKRKSENEIFNLPNEEENLLIEPGDAQMALDEHVRSKDRVTNDQTGENGQILKRAKVQ

SEQ ID NO: 156219 - protein, 115 aa, Heterodera glycines
  Coding regions on vcDNA: vcDNA=SeqID_82642; Strand=-; Position=1 -12,167-280,370-448,622-764
MKCLHSSKSKTDDFGFNVCEVLNEDGTTQSNHQNNSAIFFYEFLPVMLLIQAALFYLPKWTRDKLLQNSCLLTNAVAQFVVVNALTGRGHRWWGIEVGKALLNGDEIKVEIEGND

SEQ ID NO: 156220 - protein, 82 aa, Heterodera glycines
  Coding regions on vcDNA: vcDNA=SeqID_82643; Strand=-; Position=1 -59,671-860
MKRSNRLRKCNRRRAENFKAKVLPFGNQKFLVQIHYKIIRNHGPKLGVGLIAYLCLCVEIKIASNNGQLSIKDQRFLRPNPT

SEQ ID NO: 156221 - protein, 175 aa, Heterodera glycines
  Coding regions on vcDNA: vcDNA=SeqID_82644; Strand=-; Position=1 -222,281-408,495-672
MLNTTKQSEADNWQTEGEGQQNDFLLAQSLENSISSEEEGLPYSRSTIHRRTNYGRRGKRMDRRTGERNPLSLEGNKIKLVDAENRKRQREKQLEKAKKELENVNKSYKEAQKKAKKLIKYLEKEGDGDKKKNTLRKVIEEIEKEKSFENEDQAQRFYVAAFDNWKQETLTTLVD

SEQ ID NO: 156222 - protein, 285 aa, Heterodera glycines
  Coding regions on vcDNA: vcDNA=SeqID_82645; Strand=-; Position=1-858
  Homolog annotation: Hit_ID=NP_917837.1; Match level="QueryCoverage =84%, HitCoverage=11%, E-value=7e-31, Identity=37%"; Hit description =B1158C05.18 [Oryza sativa (japonica cultivar-group)]
MKLTINQRLGQGQQAYLQMCRQIGLGETGEHFWIPPPFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNIVATNMLKLQ

SEQ ID NO: 156223 - protein, 184 aa, Heterodera glycines
  Coding regions on vcDNA: vcDNA=SeqID_82646; Strand=+; Position=1-555
MPTELIEEKSQLKRKDVPNPEDLSYQIDARDEELSKSLPAAQTDGTLTSTECDANTSITTPSISADLWAAAQQLSTSLHNNNKTSAVAYGKTSNLEVNLPALPPIVCGQFVIALLELPERVFPIYVDEHSVPWHWLHAAKNEKQATDGHEKRLIGNESEEVRLFGKISHVLPLLSEETVLRLCH

SEQ ID NO: 156224 - protein, 266 aa, Heterodera glycines
  Coding regions on vcDNA: vcDNA=SeqID_82647; Strand=-; Position=1 -102,146-623,665-883
  Homolog annotation: Hit_ID=BAB78478.1; Match level="QueryCoverage =72%, HitCoverage=32%, E-value=1e-11, Identity=28%"; Hit description =preproMP73 [Cucurbita maxima]
MAGDEALSLLRRGNSFWEKGTAGREMVDASTTMSRRSSSASGSFYFKKKVPRATSTTDLAQMATTNTQKMAKTFNQQKEEGQKREEAQDRAGRAEIEQTIQRIVKEELRKVREVGKERQGETWRGGQGHAESAGNGESAREKEDEEAEEEDREHQQNIMRKQHNVTAKFRAKHSARERTAQTDGQTNGENGKKNSEKELVKKVQHKIEEGGTEGKRIRRRMTPRGTERAEERGEEEVGVTELHILEQGLYPPMPHNQQPIGRMAEF

SEQ ID NO: 156225 - protein, 253 aa, Heterodera glycines
  Coding regions on vcDNA: vcDNA=SeqID_82648; Strand=-; Position=1 -180,987-1304,1413-1676
  Homolog annotation: Hit_ID=XP_391894.1; Match level="QueryCoverage =96%, HitCoverage=12%, E-value=1e-66, Identity=61%"; Hit description =similar to ENSANGP00000025395 [Apis mellifera]
MRVHFVPYSLMKVNPTAWLSQVTRHSAQHSVAKSRDLHWSLMAIGDHSQQIQLKSLRCLLDTGQVIPGGMAVVVKLCGAPRLCRADEVGEICLHAPSAAVCYHGLKGLSQNTFAVLPLGSDDKPIGPLEYVRSGLAGFLGPEGLIFTVGCKQSLLHVSGRVHSADDLIATVLAVEPMKFVYRGRIAVFSVSVLRDERVCIVCEQRAEISEEEAFNWMVRVLQACESIHQLGIYCLALVPPNHLPKAKATRPFK

SEQ ID NO: 156226 - protein, 423 aa, Heterodera glycines
  Coding regions on vcDNA: vcDNA=SeqID_82649; Strand=+; Position=1 -770,964-1094,1555-1925
MDKINWKLREIDQQKSKEKQLTEYLESGEFKFALQMSEKFTKLLPMVKRFKEKTMKVDEFMEELANIQQNLEEELQRNEQNEHLFNLITVIARNFGGVFVKIGDIHQIEICFDGAHKMLQKLYDLAIERLVKEKKGANGNDKQFECRGNDRNSFKAAIRELTGGNTAQSAKLLQYMDKFVPKREAPSHLINSFFTFATRLEAFLYGKSSGDANGEGEADRQAEEAKATKMAQPRHRIGAFIAATQCLGISATQMEESIFDSPIKVAKINSIEEKRAPLFGIIIEKPRAETEKQWIKAACKNNFKMLKQLEEHKFSIYDAIKLIRKIDQQIEFHHIKIEIPAEVIALVEQFGSEQKYLIGWHNYSKDVYKKIQKCQNARLLQKILARFIEKLRKIGIDPKAQMVSTDLSIGETIQQTIKFYCEA

SEQ ID NO: 156227 - protein, 32 aa, Heterodera glycines
  Coding regions on vcDNA: vcDNA=SeqID_82650; Strand=-; Position=1 -21,609-686
MQAQSPVLTHFSSQISFKICEIFPAAPIGTAG

SEQ ID NO: 156228 - protein, 220 aa, Heterodera glycines
  Coding regions on vcDNA: vcDNA=SeqID_82651; Strand=+; Position=1 -75,437-659,1245-1456,2032-2184
MSRYFALIIIPFLFDIILVVKSDIQEASFLHLKLCSNIDNSFNYSKSKDWQKLEEYVPNLLPYDKQKEFSEWEMCYESIQKFIIYCNFLQSSKNYYYNRDFYEYEFEFIALKPEFAYSNGDTMPMDDAMRQIVEAYKQLFERKKKNFKLNPFSKKAPPQVNFVNKENCANVIAWSAIHVKAVGKNHLAKENLQKVKNHLIENTPLALDFPPPIVQGINKW

SEQ ID NO: 156229 - protein, 23 aa, Heterodera glycines
  Coding regions on vcDNA: vcDNA=SeqID_82652; Strand=+; Position=1 -13,154-212
MHFKISEDHLIQSWRELVKWRSS

SEQ ID NO: 156230 - protein, 26 aa, Heterodera glycines
  Coding regions on vcDNA: vcDNA=SeqID_82653; Strand=+; Position=1-93
TLCRPSCCDDQNDQPPYIIDKYRIFH

SEQ ID NO: 156231 - protein, 159 aa, Heterodera glycines
  Coding regions on vcDNA: vcDNA=SeqID_82654; Strand=+; Position=1 -76,136-204,364-455,503-584,785-945
MSSLTTCSSTAEDEFSSDVFGQGGNAEVNDGGTTSVSADVNSRKTAIGDGGMKRKMTELFILTVVNITVTVALISFIAPIENGRVNAELESLKKFVGKMEQQHGNNDGQQTEFCAKMDTEKDMVKAIETKLNELVEQQKKEAIFIGVLKDRFGNGKNEN

SEQ ID NO: 156232 - protein, 58 aa, Heterodera glycines
  Coding regions on vcDNA: vcDNA=SeqID_82655; Strand=+; Position=1 -129,175-222
MAEVSATDRPGLLHSVGSYQTDLMRFSLSSTAGLHSAIRRLRQHGRRRRCALDPQPLY

SEQ ID NO: 156233 - protein, 818 aa, Heterodera glycines
  Coding regions on vcDNA: vcDNA=SeqID_82656; Strand=-; Position=1 -153,397-2698
  Homolog annotation: Hit_ID=AAK52058.1; Match level="QueryCoverage =50%, HitCoverage=38%, E-value=6e-67, Identity=35%"; Hit description =RNA-directed DNA polymerase [Drosophila melanogaster]
MVKASELTYRINEQHKKVRVTVSDQWRELTDELEKKVVGDYKLTWLCVLSFTIFSSSDPTAASTTTNVVNKSPRKRLRPSSVLQIGTSTTILILLLMIALVAIPVNAEQASESDLKAGTGIFLTLSDLLALLGIVVSLGAMAGFIAFHMSVLSKSRSFWATASSNHSIMEEIVANHTMTPRLTATVRSLINNRPVSCLADTGASVSLARMSLANELKCKIFPTNHTVRSASGHWINITAAAMVHIEIAGQKIFGEIKLIQDEVMSDRRDYQVILGCDLMAKLPPITFDFVQGLISISGKSVTMGERGDLLYSNVKVVARHHVDIQPGSYSMLTGKLDSQIQLDQVVTHSLDGRLSKMHVGMISTVAKPVEGCIKMILTNPTDAPINICAGMHVALANELKQSVDGPWLEEQSQVKEANVNPEITTNDPSFKINFAKSSATGENLNKLKKLCVEFADVFSKSQYDLGSCLVGEHDIITTTEDPITAKPRRTPFRFREEVRDHMQKWIKAGVMVNSDTPWISNIVLVQKKDGGLRPCIDFRKLNEITVPDHFPLPRLEVVLEKIGNCHWYTSLDLSSGYLQIRLTERASRKCGIITEDDVYQMTHMPFGLRNATSAFARVMAHVLSGLEDSVIAYVDDFLIYSKSPDFDLHLLALRKVFTRLRQFNLKVSPKKCVMASSKMEFLGFIINKDGYTPSLGKVEIIKDITAPTSLKEVRRFVGMASFFRKHIPGFSTITGPLTKLTKKDMPFSWDVEQHEAFNQIKKLLSEDPILRFPDYSKPFHIFTDASTVGQGGALMQKEQDNSAFHAVAYCSRTLSEAE

SEQ ID NO: 156234 - protein, 211 aa, Heterodera glycines
  Coding regions on vcDNA: vcDNA=SeqID_82657; Strand=-; Position=1 -60,176-331,412-533,586-669,953-1111
  Homolog annotation: Hit_ID=CAE62199.1; Match level="QueryCoverage =95%, HitCoverage=30%, E-value=3e-72, Identity=61%"; Hit description =Hypothetical protein CBG06249 [Caenorhabditis briggsae]
GGRRNRGGRGREEIRQRQNVQRVFGSPFPSNASWQHCAGSSPEFRGYTCGLWTIFHTITVHAYLDAVKGHFVNPLLPLRAIQGWVSTFFGCEHCRKHFMKMTTELFPMNEQRVNRLHDMVMYLWRAHNIVVNRLHDMVMYLWRAHNIVNARLHGDITEDPQFVKYQFPPLFLCSTCHSGGHFSRRQTRNFLLRFYGSIRPYHRTHSMAESR

SEQ ID NO: 156235 - protein, 47 aa, Heterodera glycines
  Coding regions on vcDNA: vcDNA=SeqID_82658; Strand=-; Position=1 -125,169-187
MGDITLDIISMADQHRSWELFAGQIIPLIGTTNITKLHINSSHSRRC

SEQ ID NO: 156236 - protein, 183 aa, Heterodera glycines
  Coding regions on vcDNA: vcDNA=SeqID_82659; Strand=-; Position=1 -146,517-1131
GRNGIASAALLHGISSSSRPISVMLRSEDCARTPSGLKCSGSAGTILTLLPSDPVNSFLMRSAQDELLRAVRLRLSSITMVCVPKTENWLRSYTVSTVAVKRCPAAGSCHDDEIFLKPKTPPGRSLRVQKRLSASVFPLETSRALLVVRWPLSLRHTLGVQLFCCRMARQTIPPSDWSEMCHW

SEQ ID NO: 156237 - protein, 37 aa, Heterodera glycines
  Coding regions on vcDNA: vcDNA=SeqID_82660; Strand=+; Position=1-114
KLIEIDRLPELINLRGLRIHNSESSASERLSHVQKNE

SEQ ID NO: 156238 - protein, 325 aa, Heterodera glycines
  Coding regions on vcDNA: vcDNA=SeqID_82661; Strand=-; Position=1 -282,326-1021
MPKKYKKANKDKVGLALPPVPPPSVEPPAAAIQYEDLTSDEELDSKAAGGTATAHPVDQQMESLLALSPENNGAMLALSPDSVDRLLEDQNAGESVPITAESNEKALGSTVLNEEDEFFQANSGENDQMNVEIAKIVSPLETMGALIGVISQKDDELVEKGPRDSSEKANAGEMEVEGNEKALGSSVLSVDQAENENEKADKSENEQFSKENSRASDEEENFGGGKKMVVCQIREDGVIVIAFGQDERAGFVFVANDLLSEIWETLARSSDTALKLGDIIWVTNWRVLQLNESWDWISNSKRINAEAEATSIAQVTMSLRIRTSA

SEQ ID NO: 156239 - protein, 107 aa, Heterodera glycines
  Coding regions on vcDNA: vcDNA=SeqID_82662; Strand=-; Position=1 -46,309-586
MRNFYPHRALILSHSAISGLSGDGRRTLQHWSDHYADLLMCHLRINHGNMGAAQRFAEMVHLIEALIFSAKREQDFLTYLAMVTEQGPFNVTLPAIFTPMLLYGRPK

SEQ ID NO: 156240 - protein, 230 aa, Heterodera glycines
  Coding regions on vcDNA: vcDNA=SeqID_82663; Strand=-; Position=1-693
  Homolog annotation: Hit_ID=NP_701480.1; Match level="QueryCoverage =90%, HitCoverage=6%, E-value=2e-09, Identity=29%"; Hit description =hypothetical protein PFL0575w [Plasmodium falciparum 3D7] gb|AAN36204.1| hypothetical protein PFL0575w [Pl
MKFCLLFSLSVFLIVLININYVGSVDKKLEQKTFDEIFGEKWEEKEEEKRNELKKREIIGKFYKIKEKIKQKGRKFSKKEWNKIENKITKKLLTNRNKIYEWIKEFGLQKQIKKSYKSKTDEEKFEIVQKFIVMKNEFKQKRKYSTKEWEKNYAEIYKKIGVSISVIKKWKKQFGISKKIITKEEKMKIYCEIKKENPKMSDTEIAKMMKIDRTNISKWKKQFGEEINEQ

SEQ ID NO: 156241 - protein, 94 aa, Heterodera glycines
  Coding regions on vcDNA: vcDNA=SeqID_82664; Strand=-; Position=1 -205,276-355
MPIIIYFSLNFQLAFLLFNIDIQGWDWLLYYNKLSPFPIILPSALNPIVSFCTINAYRIKFVSNIKCFGKSIKRLFRMKIGDQNAVSNIQMQQH

SEQ ID NO: 156242 - protein, 80 aa, Heterodera glycines
  Coding regions on vcDNA: vcDNA=SeqID_82665; Strand=-; Position=1 -123,164-283
MFICFFPPADHAILDDKSVAEILGINLDDQIILAAYAINVTDIHLALSLYYLVIISTFAYIIIFGLAYCIKKFLDMKTKW

SEQ ID NO: 156243 - protein, 362 aa, Heterodera glycines
  Coding regions on vcDNA: vcDNA=SeqID_82666; Strand=-; Position=1-1087
MSDQSVQNRSTDQSPQQEEAVSRPPEFTPSDHTEPTRTERMNGTKHQHCIDQQRLISNVPCLISTTDTDQKGADQQYYYHRNNNPDVVIQQQQHDDQLGNLDGILMKDDDSVECHAKLSTASSAIVFMPSTPSVIAASSLESCSGSGSPVRGGGCRSSPPSPSSPCSSTATIGPRFVRTPTTMSCGTGRMHLLPHQGSSQALLYVPEQRRVSTISGHSVRSCPNDICHTGLKEEEHADSGGQSSAALLARADDHQHAEEEEADEFQSLIRHHHHHRPRHHSPSSSVPECSSGRVAAAASASAAALCSFSRAQAASDAYCRVYGGGSSGVRGTDGTATAGDQMQQPNRLLAVIQDRNRKASPA

SEQ ID NO: 156244 - protein, 35 aa, Heterodera glycines
  Coding regions on vcDNA: vcDNA=SeqID_82667; Strand=-; Position=1-106
YCSSINIYLLIVFLKPSDRTIGAVTKIWTLLTSSG

SEQ ID NO: 156245 - protein, 950 aa, Heterodera glycines
  Coding regions on vcDNA: vcDNA=SeqID_82668; Strand=+; Position=1-2853
  Homolog annotation: Hit_ID=NP_491240.1; Match level="QueryCoverage =78%, HitCoverage=53%, E-value=1e-137, Identity=37%"; Hit description= zn-finger, CCHC type and RNA-directed DNA polymerase  and Integrase, catalytic domain containing protein
MTQPAAVQPNLQQLIDVIAQQQTQINQLINVQRNNQPNPAIIQTIPSMPDVAIFEQCDEKHRITEWLERFTFAIDSCAPNAADDIKVKALMNKLSETAFSEYSKFVLPAKVTDFDFDETISKLEKLFAKPQSIFVDRFACLMATKDDGEEFQQFVNRHKRLLKDFQFDKLNEEQFKGLMLLTALKSSKDAVLRQRILAKLTKDGDAVKYDELIEDCINFLSTIHEAKLIEATSVSSRTVNAVKPNQRRERPKPQSKQGQPNATPTQLQCWRCGKTNHTHRECSHKSAKCPKCHYTGHLENQCEKVQEWRRKNFKVKKVGTLSIGMALKSINSASLIKIKVLLNGRIVKFILDSGAEINVIDEETYRLIGQPKIWECAERGRMFDGTEKSFIGKGEGHFEFQGVKVKENFYVAEKGSMNLLSIQTMDAFGLLDGIKAKINSPINLCSAGEELRGKTHAPIKSNKVAGTPNKDAEKEISQLKQEYTNVFKTELGLCTKVKAHLELNANARPIYRKARPVPYNAKEAVDGELDRWEKMGVIGKVEHTEWAAPILVVKKADGSARLCIDYSTGLNNALKDHQHPLPLPEDIFATLNGGQYFSQIDLRDAYLQVELDEASKKLCAIATHRGNYEVKRLPFGIKTAPGIFQSIMDQMLADFDFATAYLDDIIIVSKGQKEHSEHLKKMFSRFQEWGFRVKREKCSIFQDEIKYLGQIIDKNGRRPDPSKITAINEMPEPMDVSSLRSYLGMVNHYQQFIKNMRFVRKPLDDLLKKDAEWNWSDKCKNAFDKIKKILSSKLLLTHYDPQKEIVVAADASDQGIGAVISHKFPDGTMKAIAHASSALTPAEKNYSQIEKEALAIIFAVQKFHKMIYGRKFTLLTDHKPLLAIFGNKKGVRQCSANRLLRWSLILLAYDFNIEYVNTNDFGQADALSRLIAKGKDAEDRVIKILRSIRR

SEQ ID NO: 156246 - protein, 72 aa, Heterodera glycines
  Coding regions on vcDNA: vcDNA=SeqID_82669; Strand=+; Position=1 -65,287-389,893-944
QQLTSENQMESEEAGEIVAGPALAEDDGMSSSESLSEDIRILTNDFFSEAPTSNSNGSAKREKQCATAKTST

SEQ ID NO: 156247 - protein, 72 aa, Heterodera glycines
  Coding regions on vcDNA: vcDNA=SeqID_82670; Strand=-; Position=1 -59,114-272
SSLLFVLSLVRRRRRRFRQRWGTRRTQQPFWRSWKEKVKDEGKTEKVQRNKHLINCSNYYIYSILCILNKFL

SEQ ID NO: 156248 - protein, 109 aa, Heterodera glycines
  misc_feature (19)..(19): Xaa can be any naturally occurring amino acid
  Coding regions on vcDNA: vcDNA=SeqID_82671; Strand=+; Position=1 -225,274-357
  Homolog annotation: Hit_ID=NP_505478.2; Match level="QueryCoverage =72%, HitCoverage=8%, E-value=2e-23, Identity=62%"; Hit description =DOPamine receptor (dop-2) [Caenorhabditis elegans]
PPKSVDSPFLLPLLSVSVXGTFLCCWVPFFSLNIANALCIEMGADWCQIGFGPFFYSTWLGYMNSFMNPLIYTIFNAEFRRAFNAEFRRAFKSLLLGRRKCFCQTNLKV

SEQ ID NO: 156249 - protein, 163 aa, Heterodera glycines
  Coding regions on vcDNA: vcDNA=SeqID_82672; Strand=-; Position=1 -241,654-763,1204-1342
MRFIILNVPNFENEIVHKKGGMVRRKEKFLGRDAPHLIFTLFCSIRGQRRLCSSTSNCPIKVLGLSTVKCGTNFGTVPPHAKKYAIIGLIEGFADFPIAKLPNVFLAFAQARLLQENALRWADERCRQNGIECSGENRRQMLGPILMAIRFPLMAQDEFLKII

SEQ ID NO: 156250 - protein, 675 aa, Heterodera glycines
  Coding regions on vcDNA: vcDNA=SeqID_82673; Strand=-; Position=1-2028
  Homolog annotation: Hit_ID=XP_320889.1; Match level="QueryCoverage =88%, HitCoverage=75%, E-value=1e-103, Identity=35%"; Hit description= ENSANGP00000012033 [Anopheles gambiae] ref|XP_313651.1| ENSANGP00000013044 [Anopheles gambiae] ref|XP_31
MAANPTIDELTKLLAKQQKLVEQLLIAQQTNAAPAQSTQLPALSNVECFDLDDQSGKNIESWIDRFVLALDCSSSNIQDQLKVKLVLTKLSEGAYNEYSKFCLPKKPTEFDFSETSAQLKSLFAKPQSVWIDRYECLRAVKQDDEDFRAFVNRHKRLLRDFDFKKLNEEQFNCLMLLIALKSPKDAELRKRILGKLTADGDKAKYDNVVSDLQMFLSTIAEAKAIERPSHSNVLAINRRPFQKREPNKSPTQPTCWRCGGGHEPRCCPHAKATCRKCSKVGHLQNMCARHREWLSKHSRKPTQGKQMNALQLGGISVNALNQPSRLVEAPVDVNGKPIDFVFDPGAEITVIDEEAHLQIGRPRLIQCSESAKYHDGTECTLLGKGFATFTFGGHTHKGQFYVTKKGSLNLLGIDILDAFGLLDTFRAKVKMAMKVNVVQAEGKDRMKSQILTKKDTTLLDLQSNFPHVFAEGLGHCTKAKAHLELKADAVPVYCRPRPVPFNTRLIVEAELDRLLAQKVIRPIDHTRWAAPIVVVKKANGAARVCADFSTGLNNELLLNQHPLPLPEDIFSKLNGGRIFSQIDLKDAYLQVELDEKSKELCTIATHKGNFQYLRLPFGVKSAPGIFQSIMDSILADCQFAFAYLDDMIVVSRSHEEHRKHLNEVFKRIGNFGIPD

SEQ ID NO: 156251 - protein, 259 aa, Heterodera glycines
  Coding regions on vcDNA: vcDNA=SeqID_82674; Strand=+; Position=1 -107,165-377,418-598,924-1202
MAENLQQKIKDKIGTGYYSITSDGWQQPTKSPSLQSVTIHSVDENFVRSDFVLNVAPIYDAHTGENLAEHIEKCLINNGFSMEKLVMMVRDDAKNMIKTCRILEIESFQCVNHFLHLTICDVLKEPKLSDLIEKVREWVKECRTTKGAALFRKKQNEQGQKTTKLIMFSTETSIASSVIPTLKKIRDFLAFTPFHPSVQFLATSLANAIDRRVSNLAHNTALQIATILDPRFAYDENIWRKSLWADIEEELKNFAKSSP

SEQ ID NO: 156252 - protein, 513 aa, Heterodera glycines
  Coding regions on vcDNA: vcDNA=SeqID_82675; Strand=-; Position=1 -817,881-1192,1333-1386,1817-2173
MPSSNSFYVIVPSNTNVEGNRTNSFRVRLPRKLQFNSEWDVGLGVIIYPHSWPSLGTSEDQFVQIEWKIGENVQIPIPSSNVTNPVELWKSLYKLLEEGNKPFAVKVEGVQKKFTEAANTARQLGRAEYINKQQQQQRDKRNVNDDDDDDDKNEEELLNALLAGVDTLLDLYGATSGGLLEREKRAATSKVPLRNWDDTEEEYQKKLDKYFLRLRGRNLEHLEGLITEKLNAEIALMDDEERTILDQTKELGMTAWIKVFQSAYSACFLHFDNQLAYILGFNSTEFTEKETIAKFMPDMSGGVASFHVYAPDLIEPMMIGDVIAPVLRIVTIRGKPDEIIEEQFLSVQYHRVLVKEISEIFIEIRTSGGNLMPFQYAGATTPVPYSMVINVDPSEVVVQYGGYNVFRGVPYQRGSGIGSVFRSLLRYLIPIGKEIGTAIGRQGLESGNRVLSNVLEGRDLKESLVSEGKTGLKNLLEKAANNINAQKGQGFDFKRYTKRNDAREGVAIGKAKK

SEQ ID NO: 156253 - protein, 640 aa, Heterodera glycines
  Coding regions on vcDNA: vcDNA=SeqID_82676; Strand=-; Position=1 -471,519-780,825-1143,1189-1744,1787-2098
  Homolog annotation: Hit_ID=NP_507780.1; Match level="QueryCoverage =99%, HitCoverage=47%, E-value=1e-68, Identity=28%"; Hit description =predicted CDS, DNA polymerase type B, organellar and viral family member (5T899) [Caenorhabditis elegans]
MGRENVVPIFLENGHWDGLKNYVCFFNRGRKFCVECECFYDQDVYHTMDCRARCYYCNRVGGMPCEKESGVKIECPKCRRYFYNWGCYSYHQGHQTCNLWKRCVICEKTYRINPKKDHECGETYCQLCSVSHDPKRGCYIMPIEEKEEKDVYRIVVWDSETSQDSIYKGDQKEHVINYISVRVTCTECCDDKNRTNCKICGEERIKDWSEAEGHEPTKDFVEWILTAFTNYDTYIFAHNAGRFDGHFVFNYLCRTGKNPLPLINGLKIYEFKVQNSKKHSRLIWRDSCLLMPVKLESLKATFNLDCEDKPFFPYYYNKKENYGVRLQHLPTMEDYSPGSMNKEKFIKFEKWYNENKETPFYLDEELKNYCRNDTEILLLSIIEFRRILINDITKGFDPLPRSCTNAGVAMNIFKAMFLLTEQLSIVPEKGYERCDRASVMAIKYLEWRSKRDGIEIRHAGNGREVKVGNYKLDGFIGNNGGRDKCIEVMGCYIHGCLNCYDPAAELIGGRTAQELNDETQERLMELRKTLDVEEVWGCQIEKELKKDEEMRDFFDDRGNEKGPIDPRMAYAGGRTGPMKLFAKSDEKKKISVYDIVSLYPSVNYGTAYPIGLPEIIIPKSDEINVNWTRPEDLKYKGLYK

SEQ ID NO: 156254 - protein, 129 aa, Heterodera glycines
  Coding regions on vcDNA: vcDNA=SeqID_82677; Strand=-; Position=1 -65,106-430
MNPRFSNSRTRADRDLDLASDKTARLALSHPAPILYAMPCLPCIHSSPVRLCHATGAVRGLVQQHTAAGGRLSAGLCPPAGPAVDGRVNAAEPTEAGRVTDTTSPIQTVGNGTDQLRSHVLVQRKVDHL

SEQ ID NO: 156255 - protein, 129 aa, Heterodera glycines
  Coding regions on vcDNA: vcDNA=SeqID_82678; Strand=+; Position=1 -119,816-908,1302-1451,2760-2790
  Homolog annotation: Hit_ID=NP_503124.1; Match level="QueryCoverage =93%, HitCoverage=46%, E-value=2e-40, Identity=66%"; Hit description =translation Initiation Factor 4E eIF4E (ife-3) [Caenorhabditis elegans] gb|AAC17807.1| Initiation factor
SSENSASIEADHNNSKLRYADAIIPHDLVERHFLQNTWALWYLKGDRNKNWTDCLKKVSTFDTVEDFWALYNHIQPASGLSWNSDYYLFKEGIKPMWEDKGNLEGGRWLVQVNTRNTTQLLQPLLLLLY

SEQ ID NO: 156256 - protein, 87 aa, Heterodera glycines
  Coding regions on vcDNA: vcDNA=SeqID_82679; Strand=+; Position=1 -105,545-703
  Homolog annotation: Hit_ID=NP_741502.1; Match level="QueryCoverage =98%, HitCoverage=34%, E-value=1e-28, Identity=66%"; Hit description =translation Initiation Factor 4E eIF4E (ife-3) [Caenorhabditis elegans] gb|AAM22022.1| Initiation factor
MYWQEMMMCIIGEQFEKWSDHICGAVVNIRQKGDKVSLWTRDAKDDSANMQIGHILKAKLNIPDTENLRYEVHAEYSARTGSAVKSK

SEQ ID NO: 156257 - protein, 82 aa, Heterodera glycines
  Coding regions on vcDNA: vcDNA=SeqID_82680; Strand=+; Position=1-249
MAWHLKKSKAKKEKRRKMQLEKKCQSADEEKGKESAKTNTAKAKPKVGTTTDTQWRVEDVQESEKTDGEQFIAVNCGRGYIQ

SEQ ID NO: 156258 - protein, 110 aa, Heterodera glycines
  Coding regions on vcDNA: vcDNA=SeqID_82681; Strand=-; Position=1 -118,166-259,499-616
  Homolog annotation: Hit_ID=NP_497817.2; Match level="QueryCoverage =50%, HitCoverage=11%, E-value=1e-11, Identity=41%"; Hit description =UNCoordinated locomotion UNC-79, putative cytoplasmic protein of bilaterial origin (97.8 kD) (unc-79) [Ca
MPCHLSKVRPFASVTDITHQHPFHAILSPAASSIHSSTNDGRYGRMREFTDEESNLCLLLNRVVDMQNSESNSDKCFTIPPARLRRAAVCNAFLYGLPEVLDSNLLIGNQ

SEQ ID NO: 156259 - protein, 65 aa, Heterodera glycines
  Coding regions on vcDNA: vcDNA=SeqID_82682; Strand=+; Position=1-196
QKGRDSGDNKKDSRRQTHFETESAKSIGKKTDGGCEPTFGRTKRHRNSSEETPVEEFGHHVEVQM

SEQ ID NO: 156260 - protein, 266 aa, Heterodera glycines
  Coding regions on vcDNA: vcDNA=SeqID_82683; Strand=+; Position=1 -46,94-290,694-746,801-914,992-1156,1232-1455
SYEAASAYITEFSSKTTLFVCPVPPTLDENGLKGYFLTFGDVRSVVVPHNPFTGEHRGFGFVDFANETSAKAAYAKRGLIWDGTPPMKKWVNVFDLPKSTNENSPSFRPSRRSENSSPTIHKQFFPDLVQQKASEFGKGRSQSMCRFLAKEEDDAYNGTSDRDQFEEGKRDNEWQQKGHHSQSEALNRAKVSIGAKRPLTGASSSSEDDSEVLVTREHVPRKGRTLFRAVDAMRCDSVGSAVSAQQHRSRSHKPKPGWNSVSGEGS

SEQ ID NO: 156261 - protein, 137 aa, Heterodera glycines
  Coding regions on vcDNA: vcDNA=SeqID_82684; Strand=+; Position=1 -262,356-507
MPSSVELMRHLLSTGEHSDVHFLVGDGDAKEASLIKNKNFILFFNCNFINYPRFLKVLPAHQLILKSASDVFEAMFRFDAKKERPENVSGNCPDVVEIPDIEAEAFKIMLSFIYTDDLSDLNGDNAMAVLYAGGFNF

SEQ ID NO: 156262 - protein, 79 aa, Heterodera glycines
  Coding regions on vcDNA: vcDNA=SeqID_82685; Strand=+; Position=1 -71,300-468
MLLFEFGFVELETCRNCVRFMIQVHSVGPMKNVVRMALNAPREIVVPYLVLHCSKFVFLISMRRILQNASVKILKSEIK

SEQ ID NO: 156263 - protein, 21 aa, Heterodera glycines
  Coding regions on vcDNA: vcDNA=SeqID_82686; Strand=-; Position=1 -33,227-259
MAQSLVRLFYIVQLKNLHSFK

SEQ ID NO: 156264 - protein, 380 aa, Heterodera glycines
  Coding regions on vcDNA: vcDNA=SeqID_82687; Strand=+; Position=1 -11,71-352,402-870,931-1217,1274-1367
  Homolog annotation: Hit_ID=AAL78214.1; Match level="QueryCoverage =39%, HitCoverage=75%, E-value=7e-11, Identity=28%"; Hit description =putative esophageal gland cell protein Hgg-20 [Heterodera glycines]
MNRRWICTDVWMDMFPFFDRLQLGLKLALLSPRFEFLVDKHFDGTSELPILKNIVLRKNKVTAVPELRVFIDNANYVPFPVPDHSLPKKIRFKHLRICYIDHSVIAFIRANQQMFDKGTNLEFFYVSWNETFFVQPIWNALIRHILPIFVPNIRQLKFPCADQLYCLLRFTSPKVLSDLNIHSIDAGRLFPNAIDSGDQLLDEICGDSDQPLAYSAGQILSEWLHIPAKDGQPKKLICWSDSSEIADLVNNFKKKFRRATTSSASYQIQFTVHVPTEIVPFQLVNERINEMLTLEKAENNDESMDEEDDDEWDERWIMKRCQIGETTAALNQNSGNLNNVSFTFYGNCIGPLSTPTEDEEAGQSAGKESTYCDMNGLIWK

SEQ ID NO: 156265 - protein, 101 aa, Heterodera glycines
  Coding regions on vcDNA: vcDNA=SeqID_82688; Strand=-; Position=1-306
AFLRANTSSTNYIIRLDVYESTPMEPFELINERTNEMLTLEKEEDEDENMDEEHDDDDDDGKYIGFLLKRWQIGKTVQWEDENLENLNNVDIRLYGEFDIG

SEQ ID NO: 156266 - protein, 95 aa, Heterodera glycines
  Coding regions on vcDNA: vcDNA=SeqID_82689; Strand=-; Position=1 -5,714-996
MRCAVTAITSVLERTSAANAQSRAMQLLRALFAAEDNKGFSAKVTCCNCWLNDDDDDVVMDKNANFAGINEATNNDQDDDAFEQFANSQINRRGQ

SEQ ID NO: 156267 - protein, 133 aa, Heterodera glycines
  Coding regions on vcDNA: vcDNA=SeqID_82690; Strand=+; Position=1 -3,490-649,1867-1912,1991-2050,2271-2403
MKNPTKTKRNFSIEMAGVKQEQQQKKQYELRKNMTMLDRAVVAVENARDAAAENDQQQASPEYFNEIAQRHVPGSKECWTRCKKTTSRPAFNYLFITQMEDKERISALEKQMLMVSVGLLICAGAVLFKHLKN

SEQ ID NO: 156268 - protein, 32 aa, Heterodera glycines
  Coding regions on vcDNA: vcDNA=SeqID_82691; Strand=+; Position=1 -49,658-707
MDPSTFVRSQRDQPKRKHIFKIILHENRKFEI

SEQ ID NO: 156269 - protein, 44 aa, Heterodera glycines
  Coding regions on vcDNA: vcDNA=SeqID_82692; Strand=-; Position=1 -19,172-247,305-344
MTAKRPRILPGKGLTYTEMSAELAGSKKFSKIKGSESLQILFSC

SEQ ID NO: 156270 - protein, 31 aa, Heterodera glycines
  Coding regions on vcDNA: vcDNA=SeqID_82693; Strand=+; Position=1 -5,385-475
MNVFVLRDSRLENFFLPLIHSFIHSIQLYLY

SEQ ID NO: 156271 - protein, 253 aa, Heterodera glycines
  Coding regions on vcDNA: vcDNA=SeqID_82694; Strand=+; Position=1 -136,199-824
  Homolog annotation: Hit_ID=CAI04822.1; Match level="QueryCoverage =55%, HitCoverage=44%, E-value=9e-10, Identity=25%"; Hit description =hypothetical protein PB106972.00.0 [Plasmodium berghei]
MLNPAKLQQLWTTVFTPQNSNGSETLLTNNSFAQKKQMFPSTPGEAAGSHHHYRHSHHQQNSSLTTTPKQRHKRGEGRKEDEEKRDNKRHNNEEENEQDDEPNEEEDEEEQREGTRNCRGDGDEAAGDCERRRRTPDASPTTPFSEKQQQNVASSTVLEIKEEKQKDEGIEEKQNGGEREGTNGRKNGAKNKGNNGNLTRVQSPTTKDTDGGERRMKRAARNVAGLEQTGGAATDKSQSAQPKSEQRSVGGEG

SEQ ID NO: 156272 - protein, 60 aa, Heterodera glycines
  Coding regions on vcDNA: vcDNA=SeqID_82695; Strand=+; Position=1 -78,554-658
MPLAVQMNVAMHETVLRARALISFHTRTMLREHYLNDPYPNPAKKKQLAEEANLTPMQGN

SEQ ID NO: 156273 - protein, 79 aa, Heterodera glycines
  Coding regions on vcDNA: vcDNA=SeqID_82696; Strand=-; Position=1 -184,341-396
MSRKSRLLPWPRFFCSFDLGFLNKNPGPGKIHVAEKWPRPGSRKNPGLDPGPGRALMVNDSQNCETERDIVQPSVDRVI

SEQ ID NO: 156274 - protein, 194 aa, Heterodera glycines
  Coding regions on vcDNA: vcDNA=SeqID_82697; Strand=-; Position=1-583
FIHVNKKALNGVLRQLRTGQLRTVQLRTTIADDNCGPYNCVRQLRTTIADDNCGPYNCGPYNCGRQLRTTIADRTIADDNCGRQLRKTIADDNCGRQLRKTIADDNCGRQLRKTIADDNCGRQLRTTIADDNCVRQLRTTIADDNCGRQLRTTIADDNCVRQLRTTIADRTIADDNCGRQLRTTIADDNCGRQL

SEQ ID NO: 156275 - protein, 195 aa, Heterodera glycines
  Coding regions on vcDNA: vcDNA=SeqID_82698; Strand=+; Position=1 -368,413-631
  Homolog annotation: Hit_ID=NP_741940.1; Match level="QueryCoverage =45%, HitCoverage=9%, E-value=2e-32, Identity=74%"; Hit description =nuclear Hormone Receptor (90.7 kD) (nhr-48) [Caenorhabditis elegans] emb|CAD36502.1| Hypothetical protein
MLTDSFDDDPSLPTTDFDYLYGHAQQQQQFSTNDELEPDDSAAAQFGCGGTKRKRAFSFSSAPSASATNTMTTSTTTIMGLVNGGGGAGPSSAMVGGGGPTAAVVEKRPATKICRVCGDKAYSYNFNVITCESCKAFFRRNANKEKVLAPNRPNLNFVPKEIRCPFNEQCDINILSRRFCQRCRLQKCFNVGMKK

SEQ ID NO: 156276 - protein, 202 aa, Heterodera glycines
  Coding regions on vcDNA: vcDNA=SeqID_82699; Strand=+; Position=1 -3,144-749
  Homolog annotation: Hit_ID=DAA01153.1; Match level="QueryCoverage =72%, HitCoverage=8%, E-value=2e-26, Identity=48%"; Hit description =TPA: RTl1 [Mus musculus] ref|NP_908998.1| retrotransposon-like 1 [Mus musculus]
MSLLSAAIDEKLSYFLLMAFFLIIVVGLLQLMIKGIADKILMRFWRNNGKGKEEEKEELVEEKGRGEKGGRHEEEPILEENDWDEEEEEEKEEEEAEGEEFVGEEDEEEELVEENGRGEDEARRQEEALLEELEGERDEEEEEGEGNEREEFVGEENEEEEEKEDGMEAFLEELEGTTDEEEEEEEEFDNDEEEKRKTKNQL

SEQ ID NO: 156277 - protein, 79 aa, Heterodera glycines
  Coding regions on vcDNA: vcDNA=SeqID_82700; Strand=+; Position=1 -156,275-358
MAFLKGVSLTSHRVFILYTFFSNTVRLLWTAICSQLTSEGPSAHSHGEKPFECTECGRRFAQISNLRVHLNRKKKCGKK

SEQ ID NO: 156278 - protein, 180 aa, Heterodera glycines
  Coding regions on vcDNA: vcDNA=SeqID_82701; Strand=+; Position=1 -60,806-958,1266-1391,2066-2269
MPFSLCVTMLLICSNLALQKDQDLPSDDHPLIQHFHRILTATLAEERTVLEQRLRELAQQKQQQSSPSAILPTPTIDGNALKDNLRKELDLKLRVEKEEINKTVNHFEEQIMTKLRTLIEQMHSQKDVLEHEIDEVRKTQLELKKDVEDTGKPLLKKEKITQQLKEDGRTETIKVRNYWD

SEQ ID NO: 156279 - protein, 158 aa, Heterodera glycines
  Coding regions on vcDNA: vcDNA=SeqID_82702; Strand=+; Position=1 -295,873-1054
MAKIVGVGGRGGVGVATLKNMGGPALNRRLWLSGPVFYQLNYRSCPLQLPTLIDRIGSIVASTGPLIFLFGKLLLLLYLRRETRAGGNGTAQKMVKCFEPFSLKSKSLAIKLFKNKIVQRRKYVWLPELVLFTCQAILFYCNRFYFIFTSKFYLIMMT

SEQ ID NO: 156280 - protein, 50 aa, Heterodera glycines
  Coding regions on vcDNA: vcDNA=SeqID_82703; Strand=-; Position=1-153
LQIYWLKLHMRYISKFFDSVRRFDKDGFRFAISRSTSEIGLEFFRQLRAI

SEQ ID NO: 156281 - protein, 21 aa, Heterodera glycines
  Coding regions on vcDNA: vcDNA=SeqID_82704; Strand=-; Position=1-63
MATLICLGVPSFEVGTMNEWL

SEQ ID NO: 156282 - protein, 33 aa, Heterodera glycines
  Coding regions on vcDNA: vcDNA=SeqID_82705; Strand=-; Position=1 -88,217-230
MLRYSAFLFGILFCIMSSICPPIWSNEINRCHF

SEQ ID NO: 156283 - protein, 23 aa, Heterodera glycines
  Coding regions on vcDNA: vcDNA=SeqID_82706; Strand=+; Position=1 -16,99-154
MRHISDQLGNHGNAKRKSNPEMA

SEQ ID NO: 156284 - protein, 102 aa, Heterodera glycines
  Coding regions on vcDNA: vcDNA=SeqID_82707; Strand=+; Position=1 -236,1802-1874
VLITHRAAITAVPYFLINRLNCVDLFDQHKHQQQEWAGMGSGMIVTRTLMGVAEGADELSTAPPPPSSSSHHLHQQHFKQWLLVGGGGGAGGEEVAEKAINK

SEQ ID NO: 156285 - protein, 181 aa, Heterodera glycines
  Coding regions on vcDNA: vcDNA=SeqID_82708; Strand=+; Position=1-544
  Homolog annotation: Hit_ID=XP_396309.1; Match level="QueryCoverage =90%, HitCoverage=8%, E-value=4e-09, Identity=23%"; Hit description =similar to hypothetical protein [Apis mellifera]
MVEHDGGTNFEEEEGKQEDEEELDGRPAQKRPRYVAPVEEEEEEAGNGTSAGNCTAEVDELKAVIEGMKTELEAANEEVGELKAEMGKLSAENGTLKADIRSIKAKIGSMAIIIRGNREERNEMHEEMQEMKADMAELRAENANLKADFGTIKAGIGGMRQMCGEMKEEQGKIQRGNARDA

SEQ ID NO: 156286 - protein, 67 aa, Heterodera glycines
  Coding regions on vcDNA: vcDNA=SeqID_82709; Strand=-; Position=1-206
KWQKIAPNLPSNDATALQSFHALFRNYRTVALHELKQQWELQKSIANKAGRNVKETAKKVLVANIIN

SEQ ID NO: 156287 - protein, 811 aa, Heterodera glycines
  Coding regions on vcDNA: vcDNA=SeqID_82710; Strand=-; Position=1-2434
  Homolog annotation: Hit_ID=AAN87269.1; Match level="QueryCoverage =40%, HitCoverage=13%, E-value=1e-40, Identity=31%"; Hit description =ORF [Drosophila melanogaster]
MPKSRVQITEPFQNVGLDYMGPLQIKSFTEKCWIILFTCFSTRGIHLELVTSLSVQHFLNAFRRFISRKGTPKNIWSDNASQLKLASKVLPEVLKLKDILKDDSIKNYFEKENIKWIFSIELAPWQNGAIERLNQNVKSAMKKAIGRKLIEFDSFQTLICEIEALVNSRPITFIYDEINSYQILRPIDFILPHKNLCIPPILEENETNDPTYLPKPTYYDQTIELWKKTTKILDDYWKIWTEEYLPSLRERYKTENKNPKNCVKSFPEPNEVVIIHDETPRAMWKTGIIKNVIKGKDGIIRGANIELPSKHVINRPLKLLYPLEINKNDCEENETITNLIKTTEHKQIGTNRKRKQSVLSSPKLSKVFLNTLTFLLLFMQLLPCLSHLYECPKTNEKWRTKYTTFCVENGFTIRQNKLTMEFCYRKIFCHKQHVIKNHPPYCGPQCKCPDWTIFCSFASYHRIKREITDQENIQNIISFFKPNVCSFNKTEKCSLMDKNIFSSIMLYDNSIHSVKSLNLLHTQANSRIDYRCLGEGNLTIGTQKFCQEHECTDTHGTKFCFYEPHEKTYLVKSDREIIPIKAWGSIERIFYLANDTLMDELKRKKREFDPFENEQISAECTKGGIKINPTHTTTELEILVDKYFILKRSPQSEEFISLPTKITMNEYKPVIKFMKGTSVSEYKNLTCPPSPICELIICRFCMEYIRNPQCIGQMHWALILIMIMLTLYVITLSLKIIKILYRFTIFIFLSVYNCGRKRKLQKIKIIKRKQFIYLIMIRLLLNSPTIFSCDEVTNMVAGTNDCAIDQNGKIE

SEQ ID NO: 156288 - protein, 15 aa, Heterodera glycines
  Coding regions on vcDNA: vcDNA=SeqID_82711; Strand=-; Position=1-46
MFERRMVIDIPEFYV

SEQ ID NO: 156289 - protein, 50 aa, Heterodera glycines
  Coding regions on vcDNA: vcDNA=SeqID_82712; Strand=+; Position=1-151
MDANENMQTEDNKKGKVTNDERNLVVSFIQFLRHKVSSNQCTDEQIEGLE

SEQ ID NO: 156290 - protein, 55 aa, Heterodera glycines
  Coding regions on vcDNA: vcDNA=SeqID_82713; Strand=+; Position=1 -21,108-254
MLRVGEALARSMQESNPDLVEQLRRQFGGEDGNDGGAGAGGNQNNNNQQPPPGSV

SEQ ID NO: 156291 - protein, 130 aa, Heterodera glycines
  Coding regions on vcDNA: vcDNA=SeqID_82714; Strand=+; Position=1 -57,119-451
MTALRYDAAKVVITEQNQEVVGLSPCFLARLFGFVFSRGVVRLVVVRGVLGPFGALFFLRVPWLSSSEFGLASARRFPGSGCCRCAVRRLRLRFRRVLRPVRVRLSFLAAALALRPFPSARRVRCFSPPR

SEQ ID NO: 156292 - protein, 91 aa, Heterodera glycines
  Coding regions on vcDNA: vcDNA=SeqID_82715; Strand=+; Position=1 -101,1075-1249
MTEQHFGINCVDLELPMDISQFTVNVSATLFDLSFSITRSFPINIHAVETAKKRIPIFLIDFGNNPDQSALREKSDGIEMLTDMDKKVNQF

SEQ ID NO: 156293 - protein, 299 aa, Heterodera glycines
  Coding regions on vcDNA: vcDNA=SeqID_82716; Strand=-; Position=1 -98,158-227,698-829,881-990,1083-1215,1289-1444,1578-1619,2132-2189
  Homolog annotation: Hit_ID=NP_060267.2; Match level="QueryCoverage =92%, HitCoverage=46%, E-value=1e-39, Identity=36%"; Hit description =BTB (POZ) domain containing 2 [Homo sapiens] gb|AAK25826.1| BTBD2 protein [Homo sapiens] sp|Q9BX70|BTB2_H
MSKAAIAGLKLMLSTGEYADVHFLAGDGDAKELVPAHKLILKFASDVLVPAHKLILKFASDVFEAMFRFDVSANCPVVEVPDVEAAAFKVMLSFIYTADLSELNGDNAMAVLYAAKKYNIPDLIDRSLQKKYNIPDLIDRSLQIPFSKLRNVFFALAQARLFDLENYVNNNYVNNCLAYIDNNADILIKSDAFLQIDQKMLCEILERDELKIREVKLFFSALRWTDQKCRENGIECSAENRRQMLGPALFKIRFPLFSKEDFSGKIVTSGILTAEEVVNLLLHMLVGPKISENFVKVQK

SEQ ID NO: 156294 - protein, 19 aa, Heterodera glycines
  Coding regions on vcDNA: vcDNA=SeqID_82717; Strand=-; Position=1-59
GPGSRSRVLKSSGPGPGRT

SEQ ID NO: 156295 - protein, 78 aa, Heterodera glycines
  Coding regions on vcDNA: vcDNA=SeqID_82718; Strand=-; Position=1 -169,222-286
MKKSVTFAVPEQKEINQPNAEVEPPKSDTTKKRKVEDRELWKLAKGKFMLATYLCADDWDRLFHNQQKVARLEDGRFA

SEQ ID NO: 156296 - protein, 79 aa, Heterodera glycines
  Coding regions on vcDNA: vcDNA=SeqID_82719; Strand=+; Position=1-240
MEKEKVELQTDMLRKEMEKHFRRQMLEMEERLDQKWTSLVDKERQRAQRIATQSSAVIGQLMMTKGDEEKENEKEGRKK

SEQ ID NO: 156297 - protein, 55 aa, Heterodera glycines
  Coding regions on vcDNA: vcDNA=SeqID_82720; Strand=+; Position=1-168
LHLVHVKDGLSLQEAVDASDGLAVIGIFYHIGDDGTSMANLESGLKRVAEKGIFF

SEQ ID NO: 156298 - protein, 93 aa, Heterodera glycines
  Coding regions on vcDNA: vcDNA=SeqID_82721; Strand=-; Position=1 -24,153-410
MLKLKCRLQFTDHILASGEEQLKRMVSEADFLKIKLSSEQKLFEIGPNGLHEYQTVNQIQKELENVLYSKENVSAITIKNTVTMFEIMEKFAI

SEQ ID NO: 156299 - protein, 116 aa, Heterodera glycines
  Coding regions on vcDNA: vcDNA=SeqID_82722; Strand=+; Position=1 -85,159-424
  Homolog annotation: Hit_ID=NP_495943.1; Match level="QueryCoverage =70%, HitCoverage=86%, E-value=3e-26, Identity=65%"; Hit description =dynein light (10.7 kD) (2J396) [Caenorhabditis elegans] emb|CAA90946.1| Hypothetical protein T24H10.6 [Ca
MSTIDVEETIKRIQSQKGVTGVIIMDNIGRAIRSTFDDDTTAHHAALLQQLCERSKNVVREMDTSNDLSFMRLRTKKNEIMIAPDKGMRSSFPLFGAFKFANFKFGCVKKKSPTNL

SEQ ID NO: 156300 - protein, 291 aa, Heterodera glycines
  Coding regions on vcDNA: vcDNA=SeqID_82723; Strand=-; Position=1 -283,391-673,1076-1384
  Homolog annotation: Hit_ID=NP_702063.1; Match level="QueryCoverage =94%, HitCoverage=6%, E-value=5e-13, Identity=21%"; Hit description =hypothetical protein PF14_0175 [Plasmodium falciparum 3D7] gb|AAN36787.1| hypothetical protein [Plasmodium
HFYHWDSIHQHSNQRDSIHQHSNHWDSTHQHFNRQHLTLQHFYHWDSIHQHSNQRDSIHQHSNHWDSTHQHFNRQHLTLQYFNQRDSIHQHSNQPFLSLGLNPPTFQSTGLNPPTFQSLGLNPPTFQSPTLNPPVFQSLGLNPPTFQLTGLNPPTFQSLGLNPPTFQSPTLNPPAFQSLGLNPPTFQSTHWDSILRHSNQRDSTHHHSNRWNLTSPDSSVSQPPRLNSPAFQSLGLNPPTFQSTGLNPPAFQSLGLNPPTFQSLGLILLHFNHRNSTLQHFNHWDSILRHF

SEQ ID NO: 156301 - protein, 55 aa, Heterodera glycines
  Coding regions on vcDNA: vcDNA=SeqID_82724; Strand=-; Position=1 -37,452-582
MFALSTFIFNYGVRNKLLINTANNHARVRILITLANNELQVVDLKKRKNTSINSN

SEQ ID NO: 156302 - protein, 215 aa, Heterodera glycines
  Coding regions on vcDNA: vcDNA=SeqID_82725; Strand=+; Position=1 -155,235-398,620-948
  Homolog annotation: Hit_ID=NP_299671.1; Match level="QueryCoverage =92%, HitCoverage=94%, E-value=5e-11, Identity=27%"; Hit description =autolytic lysozyme [Xylella fastidiosa 9a5c] gb|AAF85191.1| autolytic lysozyme [Xylella fastidiosa 9a5c]
MITAWAQNGEIEWPRVLGENPNLWGKEQKVLADAKATEDKQFQDPKFEQNFKAMNAIGMAHRGAYHYFRGEPGSAGALEQVRHFLNTSIRAGFNVHKDFAVVNVEIYKNEGADKDQFTGKLLNFVKLLKSKVPNLFIHTSVDHWSALINNDHDEFFAQFPLSVIDYDSQQSPALPRPWKVWQRWLHTMTVPVNGISGNVWLSRVNCSVKMMPNIF

SEQ ID NO: 156303 - protein, 58 aa, Heterodera glycines
  Coding regions on vcDNA: vcDNA=SeqID_82726; Strand=-; Position=1 -159,718-735
MALPLTHKVAPFSHMTEYIKNFTMNLKMGQLKNTKFKEKEKNVRKIYLTCPISAKMLS

SEQ ID NO: 156304 - protein, 37 aa, Heterodera glycines
  Coding regions on vcDNA: vcDNA=SeqID_82727; Strand=+; Position=1 -32,134-215
MTFRCAHLAKQARPGLESRPGFFCAWVFLDLLRKSRS

SEQ ID NO: 156305 - protein, 141 aa, Heterodera glycines
  Coding regions on vcDNA: vcDNA=SeqID_82728; Strand=-; Position=1 -198,274-360,482-622
MHYPTHVKLPQIDRRIGKVEDAFHEHSASSDCHLGPIAAEAAQLEERLVHQMLANHWQIVESVEVLALSSFITREKICSSTAFFSVTFDEKNLQIGMAPTLRGEKSRSFSGSARPESKSGSGWTKSVRVGVRSFSFLPLLI

SEQ ID NO: 156306 - protein, 111 aa, Heterodera glycines
  Coding regions on vcDNA: vcDNA=SeqID_82729; Strand=-; Position=1 -42,271-564
MIFVVGIFRGIWQCSDGEPSDGDDGEAVQRHSDEAVLDALRHQFAMLRLDELRERLRRRNCIAGPMNAGNRRIYEAKLAHLETRQWHGKGGQQQQQRDPNAIKRNKRGGNF

SEQ ID NO: 156307 - protein, 80 aa, Heterodera glycines
  Coding regions on vcDNA: vcDNA=SeqID_82730; Strand=+; Position=1 -133,238-347
MPSGHWTIWRPSPCAYESTAVFCQCFAVEPFETAQGKAKRRIGDGGLSVALRGVGSSKVGQIVSAPSGSRIFADQSTFPR

SEQ ID NO: 156308 - protein, 18 aa, Heterodera glycines
  Coding regions on vcDNA: vcDNA=SeqID_82731; Strand=-; Position=1 -39,307-324
MAYGNCVKRADEKAKLTC

SEQ ID NO: 156309 - protein, 180 aa, Heterodera glycines
  Coding regions on vcDNA: vcDNA=SeqID_82732; Strand=+; Position=1 -102,185-218,435-550,617-656,750-825,883-951,1089-1128
  Homolog annotation: Hit_ID=AAH77435.1; Match level="QueryCoverage =98%, HitCoverage=26%, E-value=2e-36, Identity=49%"; Hit description =Slc13a2-prov protein [Xenopus laevis]
VRLALAMLRPAKRLLTCILVPLLLSPLPLFFRTKASCAYVVMIMACFWLTEALPLAVTALVPVFAFPLLSIDTASRVSSVYLSDSNFVFFGSMIMAVDSNFVFFGSMIMAVAVESSRLHERIALNVLLLTGPNPRWLMLGFQLALMLGFQLATAFLSMWISNTATTIMQVPIVVAVIKEL

SEQ ID NO: 156310 - protein, 78 aa, Heterodera glycines
  Coding regions on vcDNA: vcDNA=SeqID_82733; Strand=+; Position=1 -58,740-918
MYTNKIAINFFFDLKLRDLAKPDRTFKVEKPGKTGKKPEISRSRSKLVKTRTSVLSCPCFGPGPDQHYLKLMLPLRDM

SEQ ID NO: 156311 - protein, 43 aa, Heterodera glycines
  Coding regions on vcDNA: vcDNA=SeqID_82734; Strand=+; Position=1-129
MTMRVNINVMLMKDMGEYCSKLLTFSLDNEACTEGNSDIKRRT

SEQ ID NO: 156312 - protein, 85 aa, Heterodera glycines
  Coding regions on vcDNA: vcDNA=SeqID_82735; Strand=+; Position=1 -48,1099-1305
MVEDRPYIKIISGLETSLFCDFGKKFAFVKHYFVELKRQVNMEYQFITEASEMLKKMEEAYENWMGICGTKCRIGNPKVADDVQM

SEQ ID NO: 156313 - protein, 114 aa, Heterodera glycines
  Coding regions on vcDNA: vcDNA=SeqID_82736; Strand=-; Position=1 -193,696-847
MRWEQNHWHGDWDEQMRTHPETIYPDYDILVNSKPYFLLNATLISRFPKPLNGQQFFVWLDAGYDDFARDDTKIPIRFQHHIRWMVRCLQTFAQSVTVGAAPDEIRYSLNAHCT

SEQ ID NO: 156314 - protein, 59 aa, Heterodera glycines
  Coding regions on vcDNA: vcDNA=SeqID_82737; Strand=-; Position=1 -130,300-349
MSRVRPGPGSRPGFFLDPGPGFDNLDFSWTWIFLDFCPGNPGPDVPKQLIEFFKHFFDF

SEQ ID NO: 156315 - protein, 109 aa, Heterodera glycines
  Coding regions on vcDNA: vcDNA=SeqID_82738; Strand=+; Position=1 -159,351-521
MDCPKKVKIPPELILELANFLHYNFRWFGIRISLFFDHFLAKNQRKIRRNKIKQLFEEIRAQEKAVADAKKLLEDAAVRFGEATARLKDLKQRYKKLVSFLYFDFYYSD

SEQ ID NO: 156316 - protein, 195 aa, Heterodera glycines
  Coding regions on vcDNA: vcDNA=SeqID_82739; Strand=-; Position=1 -143,237-351,409-552,623-754
  Homolog annotation: Hit_ID=NP_496075.1; Match level="QueryCoverage =100%, HitCoverage=25%, E-value=2e-81, Identity=75%"; Hit description= FiZzy Related (76.4 kD) (fzr-1) [Caenorhabditis elegans] emb|CAA87433.1| Hypothetical protein ZK1307.6 [
VCGLKWSPNKEYLASGGNDNQLLVWSLRRSEPIQTYTEHNAAVKALAWSPHHPSILVSGGGTADRSLRFWNTMTGQAMQCVETGSQVCNVAWSKHSSELVVCNVAWSKHSSELVSTHGYSYNQVILWKYPSMQPITKLSGHQSRVLYLAMSAMSPDGESIVTGAGDETLRFWHVFSKSSNLKTVRSRLNLHSCIR

SEQ ID NO: 156317 - protein, 191 aa, Heterodera glycines
  misc_feature (7)..(7): Xaa can be any naturally occurring amino acid
  Coding regions on vcDNA: vcDNA=SeqID_82740; Strand=-; Position=1 -133,485-673,923-1177
  Homolog annotation: Hit_ID=CAE56991.1; Match level="QueryCoverage =86%, HitCoverage=23%, E-value=1e-61, Identity=68%"; Hit description =Hypothetical protein CBG24857 [Caenorhabditis briggsae]
YHFPFCXDSQRLLKSPRKPQRKVPKNPYKVLDAPELQDDFYLNLVDWSSQNMLSVGLNTCVYLWSACNSQVVKLCDLSSENNESVTSVHWSERGDLLAVGTQKGFLQIWDTHAQKMLHNLKIHDMRIGCLAWNENVICSGSRDRFILHRDLRDIQRSEKRMSAHRQEVFREHTYILTMNSKQRHHNFWGGG

SEQ ID NO: 156318 - protein, 322 aa, Heterodera glycines
  Coding regions on vcDNA: vcDNA=SeqID_82741; Strand=+; Position=1-969
  Homolog annotation: Hit_ID=NP_508324.1; Match level="QueryCoverage =92%, HitCoverage=11%, E-value=1e-43, Identity=35%"; Hit description =predicted CDS, peptidase family A16 and RNA-directed DNA polymerase and Integrase, catalytic domain and Z
MTRIVTGPTTATHKAWIVLITCLATRAVYLEPVLDLTASSFLLILRRFTCRRGVPTRILTDNGTQFVLASKVSAALEAGRVPTSALDRFLAREAIHWRFIPQLSPWQGGVYERLVALVKSCFKRELGRVMLSWEELVTYTAEVEAVLNQRPLCHVSEEPDGILPLRPIDFLLPRAKLGIAFTADTDLDEFRISSTNQRDALIQRWHSVSSSIDHFWNRWQKEYLLMLRQRLQWKFKKQRNQIAREPMEGEVVLISEEKLPRNCWPMGRIVELQRSHGEIRNAKIRLATGKVLSRPLNRLYPLEVASPAGQDESHQQLDKPAA

SEQ ID NO: 156319 - protein, 97 aa, Heterodera glycines
  Coding regions on vcDNA: vcDNA=SeqID_82742; Strand=+; Position=1 -70,978-1060,1527-1667
MTNEYKQKGKYSQKEWNKNYAEICVLFFHIFLNICSTPMAPGGKTYARLKNAKGNAAAPSSSVSVRNPTRRAPSTRKAVAQQPQQRKLEKRKAVNLC

SEQ ID NO: 156320 - protein, 171 aa, Heterodera glycines
  Coding regions on vcDNA: vcDNA=SeqID_82743; Strand=+; Position=1 -228,287-574
MRCTGSSSMAATRTTSPIWSEPVTRHLVHTCAVCAKKYEFVLVRFPDTGVETPWHPVLQKHRNIRDGWTLLDLAMLEPDTIYAFDAAWQQCVAPDEAIGGNENDDGGDDENGRGNNSGGRNKKKGGQRRGGGGGQKDGGGSKDGVRRTKEEAKKKQEREETKRKRKKQEKN

SEQ ID NO: 156321 - protein, 64 aa, Heterodera glycines
  Coding regions on vcDNA: vcDNA=SeqID_82744; Strand=-; Position=1 -55,102-241
MKICLTKIKKAQKFNDYETLKFGQFFLLHFTQNTLNSLKRLCLTLQTKVEFSFSNSAIFCIKML

SEQ ID NO: 156322 - protein, 28 aa, Heterodera glycines
  Coding regions on vcDNA: vcDNA=SeqID_82745; Strand=-; Position=1-87
KETPPSAAGDVVAVPSERVVDEQQKEDE

SEQ ID NO: 156323 - protein, 78 aa, Heterodera glycines
  Coding regions on vcDNA: vcDNA=SeqID_82746; Strand=+; Position=1 -177,910-969
MRMAFMFGWMTDVRATKIKLTVDNGMQQNLSTVQWHRRRTKETVQSQLVQLGSMMTYLYSIKNKLKANDDEKRDGIVN

SEQ ID NO: 156324 - protein, 192 aa, Heterodera glycines
  Coding regions on vcDNA: vcDNA=SeqID_82747; Strand=+; Position=1 -194,690-941,1095-1227
MSISREHTKEDEIEIRLLTNSLWVHRLVRTSKPCTLFEFKNELYKVLWTRAEGYESVAEIANELYYRNASFQDLNRKLAGLPTEAELRMSARTAAKRARKSKQICGEIISYEIDVGSDNDDELNEVTEFIGDDGDEWTEGREDGDSSGGSVFAENIAIVEKTNHHNEKRKRDNEKEYALKMGKCFSSDFYEI

SEQ ID NO: 156325 - protein, 53 aa, Heterodera glycines
  Coding regions on vcDNA: vcDNA=SeqID_82748; Strand=+; Position=1 -124,606-643
MFEFIYLFLIFPIFCGGMQHYSPSSFKGGIINKIIRIPYSPARNSETLPTQPY

SEQ ID NO: 156326 - protein, 195 aa, Heterodera glycines
  Coding regions on vcDNA: vcDNA=SeqID_82749; Strand=+; Position=1 -228,619-978
MKLLCRHFSTIAHLFALSFSILAISSLNFRPMTMPRHRMDKRWPNGCSLHTQTMCQRCWLQMHDVNLASKLDAFKAAFSNASSPVNFIAVIWFPSSFAASVVPFDLINELTREQLALKGTEFSRCFLLVRCPIARDASKWSKWEKEAINWRIGDQWNRIDIQINDQDGIEDGSANAFSKIQNKFEKRMLLFQIMF

SEQ ID NO: 156327 - protein, 112 aa, Heterodera glycines
  Coding regions on vcDNA: vcDNA=SeqID_82750; Strand=-; Position=1 -56,365-647
MCKPTSKSLNLPPLSVFLDWVCFDVWMDIFPLFDHAQLGLKLALISPRFNSLVDKHFDGKRELTIWGSVIVSKDSDAAVAKLFVFIGANFVGFPLPDQSLPSKIRFNQLEIE

SEQ ID NO: 156328 - protein, 27 aa, Heterodera glycines
  Coding regions on vcDNA: vcDNA=SeqID_82751; Strand=+; Position=1 -70,230-243
MRGAVQTFVCLLDGEFALCKAGGDREH

SEQ ID NO: 156329 - protein, 69 aa, Heterodera glycines
  Coding regions on vcDNA: vcDNA=SeqID_82752; Strand=-; Position=1-211
IDRRSAQLNSRRKPGTVTVLMLLNALTRKKQFRILVSLIMLILSSHQHMTLSNASFFAFINGELDQTGS

SEQ ID NO: 156330 - protein, 301 aa, Heterodera glycines
  Coding regions on vcDNA: vcDNA=SeqID_82753; Strand=+; Position=1 -156,235-346,620-679,729-1306
  Homolog annotation: Hit_ID=AAS54428.1; Match level="QueryCoverage =36%, HitCoverage=9%, E-value=2e-09, Identity=35%"; Hit description =AGL062Cp [Ashbya gossypii ATCC 10895] ref|NP_986604.1| AGL062Cp [Eremothecium gossypii]
MDSAADSIRQLQRAVREQQQMIFLLRSQIVDQRAVLLQNMTRIESTEGYLANSRGNQRFSPRYSPMAGVELSLLGRRLEERERRQQSRLESNVAGPSTASNGGDDERENGPVLSAVIEGHMNRSRMRLIRDEMVHRAVQQQLEHQHHLLLQQAQQQQQREERERQQHFDQQMEEAELLHEQLQAAEQENDENIEPQPPQQQPQPQPLIRHPQLQFERNVRLQLRESQRFERGVASLVLVPPAQLYWETECIICTSNRAHFYSRNCGHIYLCSTCAVNAVIHKIATCMLCRVRIDGIYPFVR

SEQ ID NO: 156331 - protein, 119 aa, Heterodera glycines
  Coding regions on vcDNA: vcDNA=SeqID_82754; Strand=+; Position=1 -211,261-409
MLCKCGECFECEDEKRRLKRNRELNTRKEQIKNCTGNHLAPAMMDLKRRNMELFKKAYRPVKGVINKITGGPWNVECEVCHETFTYFMVEWENSRTDFSWGPGRTMVEADNIVKIFEIL

SEQ ID NO: 156332 - protein, 142 aa, Heterodera glycines
  Coding regions on vcDNA: vcDNA=SeqID_82755; Strand=+; Position=1 -288,672-812
MQWIKFNCTLCPIGLHCFYPRKYAKPVLCAHPSVRNITDFLSTGQLDEAATTTTTTTALPTTAEVSAAAECAPPPAHLTAWIAVCTALVALLVIAEAAGQRRADGTDEEPVYDEVPLDSDIAVEMRDGENGEEDEEDDDSDF

SEQ ID NO: 156333 - protein, 192 aa, Heterodera glycines
  Coding regions on vcDNA: vcDNA=SeqID_82756; Strand=+; Position=1-579
MVTKEGITLWCTRIEKAQFVPFDVVYELPGHCFFRVKNKARVFSVPYSELSSSDRCAQPLPPPPPPPPMTTAKHQRTPDDEEEKNLRRKAKVALDLVEAGLAADAMMQDGTRWKKAKTAINVLANLLLAESLTDVSPTFDQQQQQQQLSSKEEEKEECTNSSSAAVTTESASDADVMDDFVNSIQAATSNMQ

SEQ ID NO: 156334 - protein, 50 aa, Heterodera glycines
  Coding regions on vcDNA: vcDNA=SeqID_82757; Strand=-; Position=1-151
MGKERNANGVFTGQSKGILTTAGMAYKDQLSWRGEELIDQRASKGGSLGI

SEQ ID NO: 156335 - protein, 148 aa, Heterodera glycines
  Coding regions on vcDNA: vcDNA=SeqID_82758; Strand=+; Position=1 -116,173-389,437-547
MRLSTSQRRSSPSDDQNRSLAVGFGFAITALFSADISQNFSSGLKTDNGFIAGISTITHCTYDFDKLKLLTDDLQKEQPQLKVLFAYSGKDHLIETEISEEFSRALGGPILISTTNPKEEDSELLAKFNQLTAGEHGQNRLSILFTKE

SEQ ID NO: 156336 - protein, 278 aa, Heterodera glycines
  Coding regions on vcDNA: vcDNA=SeqID_82759; Strand=-; Position=1-834
MFNLIVLLTIASQVIAERVTILSDTQLFDDKYLTMPKSSVNERQFGFDRSRLCTINRNLISGWSLSIQEINSIEKSGPTNVKLYQDFRQLKPRACFYYNDHSYLIFQNEKTNETSITRGSQEMVVRNFPGGDLRFDHIDGRLFVIRDDRIDEIDLRTIENLWTKHNETEIISKPIGSMPSAYTDFLINEGQIYLIKEKKIYKDRFDSNEILPKYVSDTDSEFFNFVVFKEFEKIRVSSSNPWVYFLSILDLVVVVICISVLRILKIKRKGKNSSYGGE

SEQ ID NO: 156337 - protein, 141 aa, Heterodera glycines
  Coding regions on vcDNA: vcDNA=SeqID_82760; Strand=-; Position=1 -103,173-289,347-549
MTTLKKIDTASEDGLEGGLSLFDIPPTNVAINKSNNQFCDFNKTFLYLSTSIERKDKSNWIPITKDSEADQHVGVESYDSGIYYAFRAYMMNELGFSEDVKKGLCEASCYYVDDVDQDDYTNSGFKNRASRFADGAKCETM

SEQ ID NO: 156338 - protein, 41 aa, Heterodera glycines
  Coding regions on vcDNA: vcDNA=SeqID_82761; Strand=-; Position=1 -109,745-761
MGAELERLAAQSAGGVDLFGGTVLFRISAVWPLDASAKKKT

SEQ ID NO: 156339 - protein, 152 aa, Heterodera glycines
  Coding regions on vcDNA: vcDNA=SeqID_82762; Strand=-; Position=1 -7,747-1198
MSGFSAKKELNRFQNQLKMAFPLAIPILLKFTKIWDQARSIIPNKQHQVFIPPYFVKQNASARVEQAVPMSALVTVGICLAVLLALLGLWLLISAITELSSIRRRRRRRRSSDQRQQQQQQQQQQQQQQQQQRTQRQNDEEIIGRGKALEEE

SEQ ID NO: 156340 - protein, 87 aa, Heterodera glycines
  Coding regions on vcDNA: vcDNA=SeqID_82763; Strand=-; Position=1 -28,194-429
  Homolog annotation: Hit_ID=NP_508927.1; Match level="QueryCoverage =47%, HitCoverage=3%, E-value=6e-13, Identity=75%"; Hit description =dihydropyrimidine dehydrogenase (XG89) [Caenorhabditis elegans] gb|AAK39195.1| Hypothetical protein C25F6.
MTYALIVENDNVSDYLLNNLLDYLKNSVNNKNKSFSYMTCNDSGYQAISFDKHTHLAKVNEENCTGCTLCHSVCPIPGKTQDSGAAF

SEQ ID NO: 156341 - protein, 227 aa, Heterodera glycines
  misc_feature (14)..(14): Xaa can be any naturally occurring amino acid
  Coding regions on vcDNA: vcDNA=SeqID_82764; Strand=-; Position=1 -178,472-555,607-723,984-1034,1122-1288
  Homolog annotation: Hit_ID=NP_508927.1; Match level="QueryCoverage =92%, HitCoverage=16%, E-value=2e-69, Identity=64%"; Hit description =dihydropyrimidine dehydrogenase (XG89) [Caenorhabditis elegans] gb|AAK39195.1| Hypothetical protein C25F6
CRTGKSEINIKYIXKLFLGKDLVTNVSPRIVRGTTSGPIFGPGQGSFLNIELISEKSAEYWLTCVKELKRDFSQKIVIASIMASFNQQDWEFLASRSEEAGADALELQDWEFLASRSEEAGADALELNLSCPHGMGERGMGLACGQNPEMVKQISEWVRSAVKIPFFVKMTIPFFVKMTPNITDVRVLAQAARDGGADGVTATNTVSGLMGLGSDGTAWPNVGKAKF

SEQ ID NO: 156342 - protein, 25 aa, Heterodera glycines
  Coding regions on vcDNA: vcDNA=SeqID_82765; Strand=+; Position=1 -24,349-402
MINPSNISNHERTFMSEIRKYQYCF

SEQ ID NO: 156343 - protein, 99 aa, Heterodera glycines
  Coding regions on vcDNA: vcDNA=SeqID_82766; Strand=+; Position=1-300
MKKSSDDSEVAESSSNEAIWKQQIAQYVKIADSDENYEYKELLNEALIEKGKEREGNRAKIELARKAFDNLLKSMTETAKMQSGEGFGKNKPVLRWLFL

SEQ ID NO: 156344 - protein, 342 aa, Heterodera glycines
  Coding regions on vcDNA: vcDNA=SeqID_82767; Strand=-; Position=1-1029
  Homolog annotation: Hit_ID=AAC52010.1; Match level="QueryCoverage =99%, HitCoverage=99%, E-value=9e-61, Identity=37%"; Hit description =mariner transposase [Homo sapiens]
MNANKEHAHKLLHQQFKKGEKAAPAARKVNEFLGADVISPRQAQKWFQQFRAGRNSTKRKLGSGRPSTVDKNVLAQRLRRHPESSCAELSVGCHKTTTWRWLRKSGRRPMRSKWVAHRLTDQQKQRRLNLCLSNIARHRRGYVLNRLVTCDESYICYDGTAQKIVWRKKEEDPILVPRPNLHQKKRMLCIFWSVHGPLYWELLAPGTILDSNRYINQLRAVDIAYRIRRQQGQFDGPLLFHHDNAPPHRSHLTTQYISQTLNWNVLPHPPYSPDLAPSDYHLFLSLKNFLRGRRFTEDAEVEEAVGQYLTSKIGTDFFRRGIRKLPSRWRKVVRVQGNYFVE

SEQ ID NO: 156345 - protein, 67 aa, Heterodera glycines
  Coding regions on vcDNA: vcDNA=SeqID_82768; Strand=-; Position=1-281
ANFVTSSTQISKNFSRRRLSAPPDLHFPLFLQVFCLKTAKIWSFLVKKCSCYPAVEKKLLVNSKKKK

SEQ ID NO: 156346 - protein, 388 aa, Heterodera glycines
  misc_feature (101)..(101): Xaa can be any naturally occurring amino acid
  misc_feature (131)..(131): Xaa can be any naturally occurring amino acid
  Coding regions on vcDNA: vcDNA=SeqID_82769; Strand=+; Position=1 -64,1222-1466,1497-1702,1874-1958,2029-2200,2251-2436,2747-2787
  Homolog annotation: Hit_ID=CAF98446.1; Match level="QueryCoverage =97%, HitCoverage=54%, E-value=5e-49, Identity=31%"; Hit description =unnamed protein product [Tetraodon nigroviridis]
MLTTKFFISHYKKAPFFMQRPTIYEYYQQKGLRCIALRYFFSLFRFAFVVFFSTFLLQCVDYGVIFNTRNATFDGIPLPEKKQIQVLRSIIGSFRLTLLSXDNPLVKIALLLALLFWVGQFARICCRLVHXDNPLVKIALLLALLFWVGQFARICCRLVHLCETRNFFATQLQINDSDLQNLSWNDVVHNLCRAQERIHLIVNRDSISSLDIYQRILRHRNYFVALVHKSLLPPQIRLPSLLPPQIRLPFVGSVHYLSSGLRFNIEWLLFWGPWSPWKSSYALKDEFKERDNLERIARNMQMNLLVMSVVNLVRNMQMNLLVMSVVNLVFLPFVVVYQVLFSFFSYSEHFQRDRHILGMRKYSNYGRYNLLFPGEIFKNFHFRGGGGG

SEQ ID NO: 156347 - protein, 102 aa, Heterodera glycines
  Coding regions on vcDNA: vcDNA=SeqID_82770; Strand=-; Position=1-309
MVALGRGHRHVLRGRRTEAIGRQNGGGRDSALLQRLFHLVEGRVGRRLEQREGLRVQNGRSVGIGTVAAIFVRPTGDVNLMRNLQTKQWHYQWGEKPNERKD

SEQ ID NO: 156348 - protein, 432 aa, Heterodera glycines
  Coding regions on vcDNA: vcDNA=SeqID_82771; Strand=+; Position=1 -174,231-499,547-608,658-768,861-991,1053-1329,1609-1883
  Homolog annotation: Hit_ID=NP_076990.3; Match level="QueryCoverage =85%, HitCoverage=45%, E-value=2e-58, Identity=36%"; Hit description =APG9 autophagy 9-like 1 [Homo sapiens] emb|CAD97944.1| hypothetical protein [Homo sapiens]
MDSELDARLNRSYEFAVRYTDQFVSTQSKIIAKNIAFVAAAVFVVLCSLTAYDEDTLKIEHVTTLITISGAIVLACRVFIPNEHLVFCQHQLMRQIVANIHYAPKSWLQKAHSMEIYTEFTQIFRLKAELLVEELLSPLFTPFILYFYIRPRMMEIVEFFHKCTVRVDGLGDVCSFAQMDICRDGEIRLMSLNNESVVVHDSSNNAAKQKRSGNSYGKVELSLLNFAVQHPDWTPPKECAEFIDNVKALVSHEIYIASRSYENGGDGANANTSSVLDAQTLALLQASTHASLHQMEQSLQQCAVPSSAILSSDCLRPSPSQNMAMSTAQGDHDEVDELYQNESNFRALEMSMHALLINQMLFANSFASPALRSSRHHPFGYGSIPFGSVSRRGPVDSIVDSNIFGVPAGASQIQLMDELENEFDPLSNNRRV

SEQ ID NO: 156349 - protein, 251 aa, Heterodera glycines
  Coding regions on vcDNA: vcDNA=SeqID_82772; Strand=-; Position=1 -149,200-344,399-579,634-855,901-960
  Homolog annotation: Hit_ID=NP_499989.2; Match level="QueryCoverage =97%, HitCoverage=36%, E-value=8e-35, Identity=36%"; Hit description =SKp1 Related, ubiquitin ligase complex component (75.5 kD) (skr-18) [Caenorhabditis elegans] gb|AAL32223.
CAIATSDDVEIVRLALLWTVSLFLLRPAFFRSSVCVNEFFCRLAEIYLIGPEVFLYDDQIRNCVSILVNDFLIDARKRGPLALRLRQPIAFLDQFMPFFEDLLQRYENFSAGDDNFALLLLIGTYLNSSRLDGLLMAQTLWSPKRDVVRQMILSEEKAGPFLPFGFANAFSVESQGNGDDTRQKTLINEEIVKLMANYARALKEGAVVKERNEATRAIAIAEIKEFIGRNEANGDNAELLNDLRETISKIS

SEQ ID NO: 156350 - protein, 54 aa, Heterodera glycines
  Coding regions on vcDNA: vcDNA=SeqID_82773; Strand=-; Position=1 -55,584-693
MELINRKLICPYSKDIELAIHGAALFKGGLGKLVASRNVAGRILDHSFLPSQPY

SEQ ID NO: 156351 - protein, 96 aa, Heterodera glycines
  Coding regions on vcDNA: vcDNA=SeqID_82774; Strand=-; Position=1 -188,1579-1681
MTVTFFSMTVTSFSMTVTFFSMTVAFFSTTATFFSMIGDAFFNRRRLFHGGPLPFQEVAFGSRDFKQSQKRMFFTWLAIRVPWDREFLTKPGLAGT

SEQ ID NO: 156352 - protein, 26 aa, Heterodera glycines
  Coding regions on vcDNA: vcDNA=SeqID_82775; Strand=+; Position=1-81
IMSENTGFQKQLLEMVKALREKVAVD

SEQ ID NO: 156353 - protein, 224 aa, Heterodera glycines
  Coding regions on vcDNA: vcDNA=SeqID_82776; Strand=-; Position=1 -183,752-849,1193-1326,1729-1850,2233-2328,2449-2490
  Homolog annotation: Hit_ID=NP_495835.1; Match level="QueryCoverage =59%, HitCoverage=23%, E-value=1e-24, Identity=39%"; Hit description =cuticlin protein like family member (2I920) [Caenorhabditis elegans] emb|CAA88879.1| Hypothetical protein
MGPNVPPFGGHVYLKGFFFTDHCHLDYTKQPIDQPFYFHIPFRSDCQASVPQITVEKYIYIHHRLFVTNRDKAYAVNCFYHEAKGLFERKLEVGDLSLFDVNGTKEAPLCTYEVLKDGEPIRYANVGDVLVHRWSCDTALFIKNSSNLFFGPAQMCHRFIIVGPTDLHQPTEFLLYTNKPAICELTPLPSEGGAAMPVVEASRDHPPTMARLILLNDPLRVSNC

SEQ ID NO: 156354 - protein, 118 aa, Heterodera glycines
  Coding regions on vcDNA: vcDNA=SeqID_82777; Strand=-; Position=1 -53,165-186,392-673
MTKEAAATATDGQIKFLREKLHIIKGRKSLDSTNIKPKYIPNENETEDRSLNLLTASTNAKSKQQIKPNNDGKGSSSSKRWPNNFIKVEKFFKILSKMIAATTRKYQFFDVKVFKIRQ

SEQ ID NO: 156355 - protein, 173 aa, Heterodera glycines
  Coding regions on vcDNA: vcDNA=SeqID_82778; Strand=+; Position=1 -25,199-347,706-1053
METFEFQSCHKLLLNGSFLVGSELEGSDLDLICVVSNKIIVQNFYGSDDGTLFTILKKKLANAKVNCISGRIQLLRIELESFEIDLSFVPVPEKYLEQNDGGDLSREKIIEEIKYESGIYSLAGEQKIIILNENSKFRLSIGTFSTLNFAGQKCICEFIENRQSLGKKSVKYY

SEQ ID NO: 156356 - protein, 25 aa, Heterodera glycines
  Coding regions on vcDNA: vcDNA=SeqID_82779; Strand=+; Position=1 -40,295-332
MIRLSLDGPKKGYGQSPFKEGTLTQ

SEQ ID NO: 156357 - protein, 84 aa, Heterodera glycines
  Coding regions on vcDNA: vcDNA=SeqID_82780; Strand=-; Position=1-370
FLCLLAGIGRNIELRAKALPGVISTLSIPLRTKSLGPGFGQNHPVLPVRVVPVPRIPSCPSRAVARALSSPWAGEGGRDRWMGN

SEQ ID NO: 156358 - protein, 95 aa, Heterodera glycines
  Coding regions on vcDNA: vcDNA=SeqID_82781; Strand=-; Position=1 -96,140-331
  Homolog annotation: Hit_ID=NP_509297.2; Match level="QueryCoverage =78%, HitCoverage=15%, E-value=3e-11, Identity=39%"; Hit description =syntrophin gamma (58.2 kD) (XI296) [Caenorhabditis elegans] gb|AAA93388.3| Hypothetical protein F27D9.8a
MPDGHFENAKQRWERRFLIFKGANLCLFESPPLNADELEKCLSMYKVYETALRTAIKRFDRREHVFMLATVRGVPTNDGIAVPGISYAFLASSWH

SEQ ID NO: 156359 - protein, 22 aa, Heterodera glycines
  Coding regions on vcDNA: vcDNA=SeqID_82782; Strand=+; Position=1 -51,203-220
MSRSHALYDFTVHPCGQVYFMH

SEQ ID NO: 156360 - protein, 94 aa, Heterodera glycines
  Coding regions on vcDNA: vcDNA=SeqID_82783; Strand=+; Position=1 -42,84-324
MAPYRIVAYDLECTTNTILDENSRRKETIHKPNFVSVRFTCSLCDGETKNCEICGTGPRHLKWCSKDGVKPLNCFIKWIINFEKYDTYAYAHFS

SEQ ID NO: 156361 - protein, 55 aa, Heterodera glycines
  Coding regions on vcDNA: vcDNA=SeqID_82784; Strand=+; Position=1 -43,457-581
MAKEAERTVPYFVMGFFFMFGFAVYTLLCGAFIYGVMDWAKPLLALAISKNVCLT

SEQ ID NO: 156362 - protein, 77 aa, Heterodera glycines
  Coding regions on vcDNA: vcDNA=SeqID_82785; Strand=+; Position=1 -25,367-477,765-863
  Homolog annotation: Hit_ID=CAE69686.1; Match level="QueryCoverage =87%, HitCoverage=7%, E-value=5e-12, Identity=51%"; Hit description =Hypothetical protein CBG15941 [Caenorhabditis briggsae]
ICGIGVNDAFLMAHSWNRLAHQKLAAPKRIGLVFEEVGPSITITTLTNVVTFAIGALTPTPGLSCDCPPKRRRMCEE

SEQ ID NO: 156363 - protein, 74 aa, Heterodera glycines
  Coding regions on vcDNA: vcDNA=SeqID_82786; Strand=+; Position=1-225
RRHQEYVCVDGRTHFWSVEYREYVDAYAHIYRITLIYHSHVDNVGIKNKYVLMDVRISGALNIVSKLMRTHAST

SEQ ID NO: 156364 - protein, 112 aa, Heterodera glycines
  Coding regions on vcDNA: vcDNA=SeqID_82787; Strand=-; Position=1-557
VPQRLVLVPNDLARFRSSSIYASGSTVARMSCTCCSETWRSAETLSSTCALLSCEPPTCALLFEISRCAVTTSPFSTHTQPRPTAASWELRYFFFGNLVDIIKDFRYECITT

SEQ ID NO: 156365 - protein, 838 aa, Heterodera glycines
  Coding regions on vcDNA: vcDNA=SeqID_82788; Strand=-; Position=1 -264,1084-1666,1888-2597,3069-3917,3969-4079
  Homolog annotation: Hit_ID=AAA93301.1; Match level="QueryCoverage =31%, HitCoverage=70%, E-value=4e-41, Identity=38%"; Hit description =HASI
MDSFPIIDHVDLQFRHPFTMIVSGSTGSGKSEWVMRLLHNLEKMISTPIERVIYGYGELNTNILNLQRTGKIGNVPVTVHSGVPSAEQSLATLSPSDGSPIGLVRARIKQIKNDDAINEAERAVKYEQEIKRLNKLKKDEDERPVGVKLENLSDVVDAMPKPFNIKRPIVVATRRHLKVGRARKENVEQLEDDDDEDDYETPRASSTNKRPTQMEILNLIYKNAQSLGVSEEGQVLRAGGRPFITSSVDDIVSHLLNKDKRGQKEPTAFKEFIERAKQNRQLTTQRTYTLHRQAKRRYRRLPTLAPGLHTEWQADLAIFDRIAKQNRGYKYLLVCIDTLSRQVFVEPVKTKTSANMINAFEQIFKRSKYIPWKVLTDQGKEFTARAVQQFFRTKDVEHFCMLTSPQFHAGMAERANRSIKERLYRYFTEHNTYKWIGVVQDLVYAINHSQNSSIGMCPADVNFKNAEALRQKLHDAASNVLRHQPKYRVGDRVRIEKYKHVFQKGYLPRFSNELFTVVEIEWQTGNMVRIELPSSNVTNPHELSKNLYRLLADGSDPLAKKVRSTQNSFMLATNKARRWAREEYIRRKTKEKLGVRDEELLLQALMTDTGPLVGLNTVTQGLLAREKHAETSNIALRTPTDDNDSYQKKLDDYFSKLSEKNLSIVDELGMIKLNAEIKNLTEEERVILEATKEMGTEAWIQAYREIRLVCQFNYDISRNRFVLNTDPRYVKKVEISPQLAYILGFNNTEFTQPKKEARFMPDMSGGVSSFHVYTPDLIEPMMIGDVTAPVLRIVTIRGDPDQEVSEILIEIRTNSGSLMPFQYGTCTLTLNFRKMSYF

SEQ ID NO: 156366 - protein, 345 aa, Heterodera glycines
  Coding regions on vcDNA: vcDNA=SeqID_82789; Strand=+; Position=1 -232,276-547,801-1334
  Homolog annotation: Hit_ID=AAA79368.1; Match level="QueryCoverage =55%, HitCoverage=82%, E-value=7e-16, Identity=34%"; Hit description =TATA binding protein
MDLILATDWIHNAYPEMDQQDHNKEPPKRDQQDHNKETPKNDQEDEEETKEPSWISLIDEEQKQDQFTPIYDEPPRASTPKTCACAERPRPIPLVEHLCKRFNCSAHELHVLFRNLEKRRDIVEHLRSAQLRTAHLRPFVRNFPVRCNDLSILDAHSAPAYRGFLGITMKISNCTVIFKINSLNTQQFLTIAQRGINTEYNPRRFHAIIMRIRYGAKTVAALIFQSARVVLTGVPHPDQAQKFAARVLRRIQYTQCRTMTIYELRVVNIVGVLTFDQRIRVEKLQQSLGGIYDPTIFPALRCKLDNGATCLIYISGKVILTGVKDVENLKNSFDYLSKIVPNYFR

SEQ ID NO: 156367 - protein, 272 aa, Heterodera glycines
  Coding regions on vcDNA: vcDNA=SeqID_82790; Strand=-; Position=1 -160,204-486,537-912
  Homolog annotation: Hit_ID=NP_001004509.1; Match level="QueryCoverage= 68%, HitCoverage=11%, E-value=7e-09, Identity=28%"; Hit description =si:busm1-180o5.3 [Danio rerio] emb|CAD60788.1| novel protein similar to DNA polymerases [Danio rerio]
MDRVVVRKRPEFAKAPLTNCLPVAIFVTSYARLHLYGYMEQVLALNNAEVLYCDTDSIYYVNKIGAPCVPEGEALGQMKRELVDRRIVEFVAGGPKNYGIRHTARDRADERANLKIRSFRLSYATQQLINFDAMKELTLSTYNIDGPIDDVIDNDDLFVYGGGAHRAIRVSFPQIDRNVQADLFTREAHKDYRPFYAKGRVRPGMQTRPFGYVEDAPQPMDVEQQPPPPPPVRRKRTLIEADPTQPGSFAMVLTYFSMYFFFVFFFVSIYLY

SEQ ID NO: 156368 - protein, 136 aa, Heterodera glycines
  Coding regions on vcDNA: vcDNA=SeqID_82791; Strand=+; Position=1-411
  Homolog annotation: Hit_ID=AAS38789.1; Match level="QueryCoverage =96%, HitCoverage=63%, E-value=9e-09, Identity=34%"; Hit description =similar to Dictyostelium discoideum (Slime mold). Transcription initiation factor TFIID (TATA-box factor)
MRIRYGTKTVAALIFQSARVVLTGVPHPDQAQKFAARVLRRIEYTQCRTMTIYELRVVNIVGVLTFEQRIRVEKLQQSLGGIYDPTIFPALRCKLDNGATCLIYISGKVILTGVKDVENLKNSFDYLSKIVPNYFR

SEQ ID NO: 156369 - protein, 45 aa, Heterodera glycines
  Coding regions on vcDNA: vcDNA=SeqID_82792; Strand=-; Position=1-207
MESVCIIPTCRVSSNLEAVITKPFSRLKFSLLCFRCFSLFNFCCF

SEQ ID NO: 156370 - protein, 528 aa, Heterodera glycines
  Coding regions on vcDNA: vcDNA=SeqID_82793; Strand=-; Position=1 -207,252-593,710-864,911-1194,1238-1520,1574-1889
  Homolog annotation: Hit_ID=NP_001004509.1; Match level="QueryCoverage= 92%, HitCoverage=34%, E-value=6e-49, Identity=28%"; Hit description =si:busm1-180o5.3 [Danio rerio] emb|CAD60788.1| novel protein similar to DNA polymerases [Danio rerio]
MWGCQWKERLRRDHELKQRYEAVFTPCPLDPRNDALRGGRTEPFKLHHVCADDEEVLCIDIVSLYPYVMKVNPFPVGNPMVLTREVLLHPPTAPLPWTCPENNTFRGLLLVRVLAPRNIRVPLLGYRTKDERFTFPLCGLCADRRQQRPCRHDDDKRSWVCAYTHVELNKALQLGYVVTDLFEASGWPEGCDAEEQRQAFVAEFLRTEGIHLDPTKMALNPGLRLIAKTLANSLWGKLAQRVGHTEIQYTRTPAEFHKLLDDPTYDKLDFVHVSDHMDRVVVRKRPEFAKAPLTNCLPVAIFVTSYARLHLYGYMEQVLALNNAELLYCDTDSIYYVNKIGAPCVPEGEALGQMKRELVDRRIVEFVAGGPKNYGIRHTARDGADERANLKIRSFRLSYATQQLINFDAMKELTLSTYNIDGPIDDVIDNDDLFVYGGGAHRAIRVSFPQIDRNVQADLFTREAHKDYRPFYAKGRVRPGMQTRPFGYVEDAPQPMDVEQHPPPPPPVRRKRTLIEADPTQPGHSRWF

SEQ ID NO: 156371 - protein, 98 aa, Heterodera glycines
  Coding regions on vcDNA: vcDNA=SeqID_82794; Strand=+; Position=1 -60,126-362
MYTDPKHYHYNSTQIHVNCFKAQGGTVSFWGYSNPETREIIRVDEVHCLTDKAAGVPKQFKSLQAEEQPPMKLSPTRPFLANNASSLMHVFVPFGDHP

SEQ ID NO: 156372 - protein, 110 aa, Heterodera glycines
  Coding regions on vcDNA: vcDNA=SeqID_82795; Strand=-; Position=1 -162,247-379,437-474
MPSQRNMALVDEDNNGTANYGTHISATDEEEREEEEVEEEERRSGMKKKMKKSHTIKILVSPVFVDLNQIFEIFLKKLITLPRFYQQTIGQRERISFKVTFHLFRLMQRP

SEQ ID NO: 156373 - protein, 56 aa, Heterodera glycines
  Coding regions on vcDNA: vcDNA=SeqID_82796; Strand=+; Position=1 -150,317-337
MVNQLVNNAVLDSEEIIAKSKRAVLEKVPEQIGSVELVRKVATEYGMMDEAGYHPA

SEQ ID NO: 156374 - protein, 56 aa, Heterodera glycines; identical to SEQ ID NO: 156373
  Coding regions on vcDNA: vcDNA=SeqID_82797; Strand=+; Position=1 -150,317-337

SEQ ID NO: 156375 - protein, 93 aa, Heterodera glycines
  Coding regions on vcDNA: vcDNA=SeqID_82798; Strand=+; Position=1 -65,558-774
MPKVSQIFAHFLLIFIPIICRRKLNEISKCLWEKYQSKSLNIDAIRNINLENEEELNFEIKEDKDGINENVQKRRKQINFERTNGQRKTSERI

SEQ ID NO: 156376 - protein, 27 aa, Heterodera glycines
  Coding regions on vcDNA: vcDNA=SeqID_82799; Strand=-; Position=1-135
NCFEERSSKNAFLHSLKIFDSNVIIVH

SEQ ID NO: 156377 - protein, 39 aa, Heterodera glycines
  Coding regions on vcDNA: vcDNA=SeqID_82800; Strand=+; Position=1 -58,217-278
MSCHWLRDVVKDFPLMRPITKSLHFYFMEFGYRLAKKIL

SEQ ID NO: 156378 - protein, 126 aa, Heterodera glycines
  Coding regions on vcDNA: vcDNA=SeqID_82801; Strand=-; Position=1 -55,583-799,845-953
MTSVVYLIVGFVIKKKTAGLPSAGQINHRAFRALICIVSVNFGGYCIYLFYTVLINPTISSPITAWFLQLIAAIPLNIGAASNGPILYFTSTEYRQAFQAEFSFVLKGISNQNQVEPQPNVVAPNH

SEQ ID NO: 156379 - protein, 55 aa, Heterodera glycines
  Coding regions on vcDNA: vcDNA=SeqID_82802; Strand=+; Position=1 -70,460-557
MRCTQTKNVLVGEAIQKESKAPTEKFKMIPNRAIIPTIEAHPMSDQLGFSFLNVK

SEQ ID NO: 156380 - protein, 112 aa, Heterodera glycines
  Coding regions on vcDNA: vcDNA=SeqID_82803; Strand=+; Position=1 -34,203-311,369-564
  Homolog annotation: Hit_ID=NP_495862.2; Match level="QueryCoverage =62%, HitCoverage=17%, E-value=1e-09, Identity=40%"; Hit description =FUcosyl Transferase (50.0 kD) (fut-1) [Caenorhabditis elegans] emb|CAG32977.1| core alpha1,3-fucosyltrans
MIKQKLSSKLLSLDVPPNAFIAADDFDTVEELADYLTKLRNDTERYLKFFEWTKTYQKNHFAIMHSPFCKLCEFAHRQYDEDLKSTVDFSKHWTTRDCIKGFVQKFLIEKKR

SEQ ID NO: 156381 - protein, 78 aa, Heterodera glycines
  Coding regions on vcDNA: vcDNA=SeqID_82804; Strand=-; Position=1 -156,612-689
MANNFISIIERCLKNEEEIEIVEDLAFDENADKKFKFSMWKEFTRKVTQFVIVFVILSVGEFTQFAKRRMHNGEMILL

SEQ ID NO: 156382 - protein, 48 aa, Heterodera glycines
  Coding regions on vcDNA: vcDNA=SeqID_82805; Strand=-; Position=1 -89,255-312
MAIPRDKMVQIKVSYHFPRPGPIQKGKNQRSLTKESVRVMVELPNETL

SEQ ID NO: 156383 - protein, 190 aa, Heterodera glycines
  misc_feature (189)..(189): Xaa can be any naturally occurring amino acid
  Coding regions on vcDNA: vcDNA=SeqID_82806; Strand=-; Position=1 -183,375-447,917-1243
  Homolog annotation: Hit_ID=NP_497425.1; Match level="QueryCoverage =84%, HitCoverage=46%, E-value=3e-31, Identity=42%"; Hit description =MOB protein family member (3C674) [Caenorhabditis elegans] gb|AAK84597.1| Sphingomyelin synthase protein
YPSVRSAASSSSSSLSSSLHGPTDKYSAEPRKLSFVLLFLVVAALSNWAALSYVHDFIGRSPLPDIVFTFIDEQPWAHPVGDFMVSLSSASLIFLFVLHKHRVLVIRRTLFITACLYSLRTLMMLITQLPSGYSDNGAKCRAELAPEQRTLRVYIQRTLEQTIHVGFQVKEQRKWGTNAFCRTLLKMPXP

SEQ ID NO: 156384 - protein, 88 aa, Heterodera glycines
  Coding regions on vcDNA: vcDNA=SeqID_82807; Strand=-; Position=1-267
MGHLLRFCSLLLLPLLLLIPFSVRPHGHQHLRESAPHQQFQLAFVNIEFDRMGEYDGMELGVEQFAKACQPVVVHAAHAATCATVAHL

SEQ ID NO: 156385 - protein, 278 aa, Heterodera glycines
  Coding regions on vcDNA: vcDNA=SeqID_82808; Strand=-; Position=1 -210,987-1160,1207-1659
  Homolog annotation: Hit_ID=NP_497046.1; Match level="QueryCoverage =94%, HitCoverage=10%, E-value=1e-45, Identity=37%"; Hit description =basement membrane proteoglycan (2O938) [Caenorhabditis elegans] emb|CAB07706.1| Hypothetical protein ZC10
MGQGAYTCEPINVKGRVLATPDCIVRIVSIPAPQTPQPPPPPPPEPQRLACNSQGAYSPYSDARGQCQCKQKLFFADDAQGVELSNVQGQTQPGVQFEFEKYGYLTHTEPHFSQTLYWKLPKRFLGNKVTAYGGDFTVQLQYDGQAQIREEPLVVIQVGSKPYVDQCRSINALIASIKGNGVTLVHKPTDQQAQFVPGQPFTISVNTYEAINHNANASLINAAFVQQNFEHQNGSPASREDLMMALAGLNLVLIRATHTDDQTSTRWEFEKKNQFYIY

SEQ ID NO: 156386 - protein, 205 aa, Heterodera glycines
  Coding regions on vcDNA: vcDNA=SeqID_82809; Strand=+; Position=1 -158,231-480,532-743
  Homolog annotation: Hit_ID=CAE66469.1; Match level="QueryCoverage =88%, HitCoverage=31%, E-value=6e-11, Identity=35%"; Hit description =Hypothetical protein CBG11746 [Caenorhabditis briggsae]
PSQRQQLHPAATEPSSRCCNNNTQSQQQNAAVAALMGQLFGAATFQQQQQQQQRAAAPPAVQQQQAPPPAHPPSALPSNTAQHIGTAQNGPNVAQQQQQAMMLLEMAAAAAMNPQQLMALMAGSGLDARILDELRGHLLNQQQQQQLTANAAAAQHQQQQQALAAQQQQAVHQQQQQMLAMLATSGALTPEHLQMAVIGQQQQVT

SEQ ID NO: 156387 - protein, 73 aa, Heterodera glycines
  Coding regions on vcDNA: vcDNA=SeqID_82810; Strand=+; Position=1-220
MDGNGSQNSAENIWPLAHVDNAELDDGTSSKANSTEFCEETTEEGGEEKGEDNSSDGPNEEPQSEDGSGNEDE

SEQ ID NO: 156388 - protein, 155 aa, Heterodera glycines
  Coding regions on vcDNA: vcDNA=SeqID_82811; Strand=+; Position=1 -182,342-627
MPRALINRQPPVISASTKKTGRKRMSASSSAFVPEDEEDAPAAYRLPSNAMGDARGQKRKSSSSASSHTPLKNAKPNASEHPSKRTPNEREKSNDMSGSGGTTISCSTVDQLALKVTKAEQQEVNAQNVAQMDDESGHKVAQKAEMHLNNKNFSN

SEQ ID NO: 156389 - protein, 449 aa, Heterodera glycines
  Coding regions on vcDNA: vcDNA=SeqID_82812; Strand=-; Position=1 -104,173-355,401-506,551-616,674-797,923-1098,1503-1652,1729 -1935,1987-2219
  Homolog annotation: Hit_ID=NP_496802.1; Match level="QueryCoverage =91%, HitCoverage=28%, E-value=1e-97, Identity=46%"; Hit description =TBP-associated factor BTAF homolog (btf-1) [Caenorhabditis elegans] emb|CAB04949.1| Hypothetical protein
MKIYKLSQFKAVAAAELQKSAFVLVVSYEELKSNRLSTVTSEGHRWNYLVLDEGHCIRNPNSQLFDFCCSVRAAHRLILSGTPVQNSPADLWALFHFLMPGYLSTRAVFQAKFMRHILACRNARATEQQCKDGEKALQLLHRQCLPFVMRRLKTDVLTELPEKIVQDQQCELSDLQKALYQLVVDNCAVGQQPNSASDRNRWFSPLQALHMLRKIVDHPSLINANLIDQICAGNSEAAEMEKRQRIMEEMKKLLIIHFLDRGAFGAEISWLRLDSTVPAKDRQSVVDRFNTDPSIDLLLLTTHIGGVGLNLTGADVVIFVDHDWNPFRDLQAIDRAHRLGQKRTVNVYRLITRGTVEEKVMRLQRFKSDTANALVGADNRSLAGMATDELLELFSLGDGADDSAGKRRREQPKAKRPRMDADEAIAAAGQWAMEELWTVAGDEDDEKTE

SEQ ID NO: 156390 - protein, 66 aa, Heterodera glycines
  Coding regions on vcDNA: vcDNA=SeqID_82813; Strand=-; Position=1 -126,736-808
MDALRVIFPALRSSVLRRRIIRERIAPHIQNCFVLLSSANPARYSHFLAELADPSDGNSQLANAYA

SEQ ID NO: 156391 - protein, 342 aa, Heterodera glycines
  Coding regions on vcDNA: vcDNA=SeqID_82814; Strand=-; Position=1 -141,263-474,592-727,784-881,1265-1430,2119-2361
  Homolog annotation: Hit_ID=CAB03945.2; Match level="QueryCoverage =98%, HitCoverage=98%, E-value=4e-87, Identity=47%"; Hit description =Hypothetical protein C34F6.4 [Caenorhabditis elegans] gb|AAS89253.1| heparan sulfate 2O-sulfotransferase [
MKILRKNALFVAIFFLFAWVFLWFFLSPQNKANGLSLRPLLLFYNRIPKTGSTTFVNAIAYDLSTVNGFHVAHLNLTKNRYQMNAIDQARLVQNLTNWQRMHPLFLHGHFAFFDFERFGLPPPIWINLLREPFDRFVSYFYFLRYGDNFRVGLRRSKAGNNETFDECFRRGGRECDPSAITFDECFRRGGRECDPSAIWLQIPYFCGTAHFCSIPGNAQALQLAKRNLLDHFLLVGLTERIEETVLLLEQLLPAFFLGAGEHFRLLNGDRKSLRHTLRKFPPTIETLRKFKQHKVYRMEREFYDFGKAEFELAWKRSIGGKGRRKQQKFMSGQFHFEKIKRG

SEQ ID NO: 156392 - protein, 51 aa, Heterodera glycines
  Coding regions on vcDNA: vcDNA=SeqID_82815; Strand=+; Position=1-154
MDYGKGYFRSEGRDYCKFICRDGDDPNLEQEEAEESEEEGFEIVLSKEKEM

SEQ ID NO: 156393 - protein, 738 aa, Heterodera glycines
  misc_feature (414)..(414): Xaa can be any naturally occurring amino acid
  misc_feature (483)..(483): Xaa can be any naturally occurring amino acid
  Coding regions on vcDNA: vcDNA=SeqID_82816; Strand=+; Position=1 -1969,2000-2162
  Homolog annotation: Hit_ID=S08405; Match level="QueryCoverage=99%, HitCoverage=65%, E-value=1e-102, Identity=32%"; Hit description =hypothetical protein 2 - silkworm transposon mag
SLVPKTNGKLRLSFDYKVTVNPWLDIHKYQLPRPEELFSILNGGEKFTKIDLKDAYLQLLLDEKAKSCLTICTHKGLFHFARLPFGVASAPAIFQLVMEEVLQGIDGVAVYLDDILITAATDQQHVKRIDQVLKRLSENGLRVKREKCEFLKPEIEYLGHIVDKKGLHASPGKIEAILKMPKPKNLKELQSFLGMVNYYGKFVPSLATLSEPLNELRRNDAKWTWTKSQQKAFDGIKKVLTSTEVLVHYDPQKPLFLAADASDYGVGAVIFHIDEKEKLVIAYASRTLNSSERNYSQIEKEARAIIFGVDKFKQYLYGRKFVLQTDHEPLKKIFGPKGELPIVAAKRLHRWSLTLMNFDFAVVYCSTKNLAADGLSRLPCPEETTIDCVGLELQQVQAENISCLPVTVSAIAKXVKTDEILRKVKEFIEKGWPQKVEEGLKSFHVLRNEFALMEGCIMFGNRTIPERPWKRIHIDFCGPFWGXMWLIIMDAKSKWPEVVRMRTTTALATIEALRVVFTAHRLPEQIVSDNGPQFSSKEFGDYCQSRGIVHTLIAPYNPKSNGAAERFVQTFKQGMNKLKKEEMKQEIALSQFLLKYRITPHAATELAPSEILFGRRLRTLLDLVKPTAANEVEAAKMQKSSYTERMKRNFDRETKVYARNYRDGSKWIQGQITRQIGTNFDRETKVYARNYRDGSKWIQGQITRQIGTAMFLVRTARGIWRHFDQLKENGPKSLRTIL

SEQ ID NO: 156394 - protein, 101 aa, Heterodera glycines
  Coding regions on vcDNA: vcDNA=SeqID_82817; Strand=-; Position=1-306
MPINKFEGEIAKKLGTNRYKIYKLKKKLGQTRNYNEYMDINKDTKSELIGKFDQMRKEKIYGFKYDKKIINVIERRIAKDLEINRDIIYKWKREFGKKRMA

SEQ ID NO: 156395 - protein, 66 aa, Heterodera glycines
  Coding regions on vcDNA: vcDNA=SeqID_82818; Strand=-; Position=1-198
MILEQMLSALEILEEQNDNLKIKVPKIEMKQLNEEQFRNEFDEQADQNVSSIDHSNSADDEDYNNK

SEQ ID NO: 156396 - protein, 175 aa, Heterodera glycines
  Coding regions on vcDNA: vcDNA=SeqID_82819; Strand=+; Position=1-528
MWRSDKSINVDKKPMVSRAVLREGEKLVITQSQHNPECKAETMVIIKAEQVDRKQKKRKSSSVIRMLRQSGDKVLKKLGKKMLQAQGSEAADPFDVPPRLQLTKFGAIKLIMGKTIAGSEWMIYKNKQIGVTIRFQNSIGSSKKLSEMSPTRHSNSHQKVSDRFGSSMAWYIFII

SEQ ID NO: 156397 - protein, 26 aa, Heterodera glycines
  Coding regions on vcDNA: vcDNA=SeqID_82820; Strand=-; Position=1-89
IIAGTPNYDQDVMAVVNDPIKEHNIM

SEQ ID NO: 156398 - protein, 73 aa, Heterodera glycines
  Coding regions on vcDNA: vcDNA=SeqID_82821; Strand=-; Position=1 -52,209-378
  Homolog annotation: Hit_ID=XP_328828.1; Match level="QueryCoverage =93%, HitCoverage=88%, E-value=7e-12, Identity=46%"; Hit description =predicted protein [Neurospora crassa] gb|EAA34645.1| predicted protein [Neurospora crassa]
MGEKEKKKKEKREKGEKGKGRKDKEKGGKEKKRKGEKGEKEKKEKCKGKERKEKEKEKEKKEQEKSMRKVLTE

SEQ ID NO: 156399 - protein, 59 aa, Heterodera glycines
  Coding regions on vcDNA: vcDNA=SeqID_82822; Strand=-; Position=1 -5,223-349,784-831
MRGLTNGLFVLLSTFHFSFIFCACTPGFSKWKFDFPHKIIYTLYQKVGSVKLLIVRAMI

SEQ ID NO: 156400 - protein, 160 aa, Heterodera glycines
  Coding regions on vcDNA: vcDNA=SeqID_82823; Strand=+; Position=1 -94,143-304,394-491,623-751
  Homolog annotation: Hit_ID=AAB53231.1; Match level="QueryCoverage =98%, HitCoverage=62%, E-value=3e-67, Identity=75%"; Hit description =prohibitin-like molecule TC-PRO-1 [Toxocara canis]
MMAAQRILGALGQIGVGLTAAGVLAQAALYNVDAGQRAVIFDRFTGVKPNVTGEGTHFLIPWVQRPIMFDIRSTPRAVNTITGSKDPSKLPQIYLNIGTDYAERVLPSITNEILKAVVAQFDAHEMITQRESVSHRVSVELAERAKQFGFILDDISIVFF

SEQ ID NO: 156401 - protein, 92 aa, Heterodera glycines
  Coding regions on vcDNA: vcDNA=SeqID_82824; Strand=+; Position=1 -210,266-334
MLNGRQLEDMQNVLNTQPNWASKEVAEGSADFPRFAPIAKKAAATGVLNKFGGSGARNCYFSPVSCMLLHDVPKYKKLIESTPNGWAPLHFI

SEQ ID NO: 156402 - protein, 50 aa, Heterodera glycines
  Coding regions on vcDNA: vcDNA=SeqID_82825; Strand=-; Position=1-198
NFFIWTSLFVTRNHYFWGFVTKIVKNHYFWRFVTISTFFGKFLNKNAIKP

SEQ ID NO: 156403 - protein, 114 aa, Heterodera glycines
  Coding regions on vcDNA: vcDNA=SeqID_82826; Strand=+; Position=1 -152,461-534,635-755
RTGAVVEVHELQQKDAAQQQQQPNECVNVSQPITQYDVHFRKHGTDKHQQEKIKNAHSSSNRIVVDNGVLEKYTDARPIGGQTVAHRFWLSVRAQGPKSVGTDAGHGAAQLDLA

SEQ ID NO: 156404 - protein, 158 aa, Heterodera glycines
  Coding regions on vcDNA: vcDNA=SeqID_82827; Strand=+; Position=1 -92,179-323,532-771
DSMFLRWNTLMAGVDVSSSQLVQISIQYRQSGVDASWTDVRNSTFSLTDLPQRFVYVDQLHPATAYDYRYAAEYTTIFDGIGTMPTAGSGAVDGAQQQQQPTVPSGDAKESQQQQQWDGKKSMLAETFYQQSQQARTKAGTPSAPLEVKLNNEQCYSN

SEQ ID NO: 156405 - protein, 98 aa, Heterodera glycines
  Coding regions on vcDNA: vcDNA=SeqID_82828; Strand=-; Position=1 -93,1055-1169,1358-1446
MASLRNLTLFSSQLSFKYLIATRTDVGGILFYPHAIQHENNISENSIISISNQKLMPPGPLPEALLSLNDFFENRKKMQLDLNLPLDKLFITWRFATP

SEQ ID NO: 156406 - protein, 249 aa, Heterodera glycines
  Coding regions on vcDNA: vcDNA=SeqID_82829; Strand=+; Position=1 -144,418-583,876-1089,1425-1650
MALDRPPDCPNELYDVMKQAWTVCTEKRPQFADIQPRLETMRGLPAFQSRDPFPPSSLCGDNSFFDASQNSSTSKGEQSSTTTTTNGDGEESYTTACQFDKSGESFSVRRNAKRSRRKMPSRSSVEASTGAAGTAGGGGPSASYSFGTTSTGVDSSEYELPRSGAQLMLTLPGSRPTNHRRSATTGFHQNDAFVADSSVDESANGSTGGDQQRFTRSISLAGTSRAAADEPLTTPFRQFGASSSRISRV

SEQ ID NO: 156407 - protein, 134 aa, Heterodera glycines
  Coding regions on vcDNA: vcDNA=SeqID_82830; Strand=+; Position=1 -170,364-598
  Homolog annotation: Hit_ID=XP_318614.1; Match level="QueryCoverage =92%, HitCoverage=15%, E-value=2e-45, Identity=65%"; Hit description =ENSANGP00000021005 [Anopheles gambiae]
MLSWKMAACLAAGNTVVHKPAQVSPLTALKFAELSHRAGFPPGVINGGNTKIEKLISCAKSNVKKVSLELGGKSPLIIFSDVDVDKAARKAMDAVFFNKGENCIAAGRLFVEERIHDEFVRKVVESGLMGKQLK

SEQ ID NO: 156408 - protein, 93 aa, Heterodera glycines
  Coding regions on vcDNA: vcDNA=SeqID_82831; Strand=+; Position=1 -26,79-144,203-392
  Homolog annotation: Hit_ID=CAE61979.1; Match level="QueryCoverage =100%, HitCoverage=10%, E-value=1e-32, Identity=74%"; Hit description= Hypothetical protein CBG05984 [Caenorhabditis briggsae]
MVISKFDERDTELVVERANRTEFGLAGGVFSSDIPRALRVARQLRCGTVFLNTYQKTDVAAPFGGFKQSGFGKDLGEEALNEYLQTKTITMEY

SEQ ID NO: 156409 - protein, 147 aa, Heterodera glycines
  Coding regions on vcDNA: vcDNA=SeqID_82832; Strand=-; Position=1 -175,219-343,391-534
MVANKIAAESAKLTLSSTKFNTLLELGNSIEEGGGARRWENSKKVQKTLDNCWDSEDGAGHVKLTPSDSGDPGFMRIELSSKLRLVGQTSKDAEEKEDEVPRSVSEPKIGTGNEGIANSAAFSCSKFSTLAELANSLAKEDKDGNTH

SEQ ID NO: 156410 - protein, 21 aa, Heterodera glycines
  Coding regions on vcDNA: vcDNA=SeqID_82833; Strand=+; Position=1-64
MSGGGMTFDRFGSSFFVRNCS

SEQ ID NO: 156411 - protein, 538 aa, Heterodera glycines
  misc_feature (6)..(6): Xaa can be any naturally occurring amino acid
  Coding regions on vcDNA: vcDNA=SeqID_82834; Strand=+; Position=1-1639
  Homolog annotation: Hit_ID=NP_504187.1; Match level="QueryCoverage =93%, HitCoverage=40%, E-value=5e-73, Identity=35%"; Hit description =predicted CDS, integrase, catalytic domain containing protein family member (5E782) [Caenorhabditis elega
VKQLVXKPSEDPLDNDDALALALFNDSVQFGGRYEVGWPWRPGGRDRLSSNFSLAFSRLSALSQRLRANPELREKYQAVITDQIERGIIEPAVRTGAGEHFIPHHAVITKKLRVVFDASAHEKGKASLNELLLPGPNLVPELAGILLRFRASAYPVLGDIEKAFLAVGLREEDREVAKFLWPKDPSQPLNPGNLEIYRFKRIAFGINSSPFLLASVLRHHLSSLGDPLGARNFYVDNLLICSETPSEAAAAIQTARRTMANAGMNLREFVAADPLILSALSIDDVLVGDVQKVLGISWDLPREKLIFGFPNSCDFPPTRRGVLSAVASLFDPLGLCSPCLVKAKLFFQSLWDLGTGWDEPIGEAHKKTWAVITSEWDAPPLTFARLTPCSQAALQLHIFSDAGPNSFAAAVYLRAERNGRAEVSLLFAKSRLRPKKFKNDGLTIPRLELLGLVAAIRAKNFVAANFDLSFEKIIFWADSQIALSWLASNAPQPVFIANRLAEIRREKNAFKYVRSCDNPADLGTRGAPNELRDLSLWH

SEQ ID NO: 156412 - protein, 46 aa, Heterodera glycines
  Coding regions on vcDNA: vcDNA=SeqID_82835; Strand=-; Position=1 -3,311-448
MTEISKFSGPDRTGILKNDRIPDPVSHNPVNPDFHIAGSGTGLVNI

SEQ ID NO: 156413 - protein, 150 aa, Heterodera glycines
  Coding regions on vcDNA: vcDNA=SeqID_82836; Strand=+; Position=1 -15,158-337,536-599,863-1056
MYLQKEISKVRRPNAGLLATVFWSGLTGTDKANELANAMNQFNEINRTQLFVVSLNAKANLTRLKELAGDQWHVFVEGRASQFIGEASQHLLDCVLPPSGAQMHSSNNNDEPELLDTHEPLTSVERVEHLQAAARAFQKHPLGNCKDGNN

SEQ ID NO: 156414 - protein, 169 aa, Heterodera glycines
  Coding regions on vcDNA: vcDNA=SeqID_82837; Strand=-; Position=1 -80,388-475,565-702,1402-1506,2024-2122
  Homolog annotation: Hit_ID=CAE66610.1; Match level="QueryCoverage =97%, HitCoverage=17%, E-value=7e-41, Identity=49%"; Hit description =Hypothetical protein CBG11942 [Caenorhabditis briggsae]
MVQKDFVKFVSSEKLACILMNNVQQLRVQLEKIYENMGGTNLDADSNKVLNNLQKKLNNVLDKLSAQFVVSLEHGIQEQINKLGILLTKIKGPQLQKSQMAGLLKQLPNAKIGGVTKLMSTHLKEGVKSMSSVKDMMEVARDSERSLTPKQCAVLDAALDAIKEVRAIN

SEQ ID NO: 156415 - protein, 193 aa, Heterodera glycines; identical to SEQ ID NO: 134779
  Coding regions on vcDNA: vcDNA=SeqID_82838; Strand=+; Position=1 -178,218-492,535-663

SEQ ID NO: 156416 - protein, 491 aa, Heterodera glycines
  Coding regions on vcDNA: vcDNA=SeqID_82839; Strand=-; Position=1 -312,1269-1638,1686-2371,2689-2796
  Homolog annotation: Hit_ID=NP_502797.1; Match level="QueryCoverage =44%, HitCoverage=61%, E-value=2e-31, Identity=34%"; Hit description =HASI (4P602) [Caenorhabditis elegans] emb|CAB16520.1| Hypothetical protein Y57G11C.19 [Caenorhabditis ele
MEETFDHTDVQFRHPFTMIVSGSTGSGKSEWIMRLLRNLDKIISVPIERVLYCYGELNPNILNLQRNGRIDNITVTVHNGVPAEDYIKGNAKKEKLLLVLDDLLEMTEAMPKPFNLVRRPVARRRRNIKLGKTRKDEENEVFEDAETFDQGDIINYIYKNSEALGINEDGQIIKTNGHVLRTSNIEDIVAHLLNKDKRANAKEPTALKEFVARAKQNPLLSKRLFSEAFVMDLKKQRLLEFLYKDINSPVAFTSLEPLLREAKKRQRKITRADVQNFLYTQRTYTLHRQAKRRYRHLPTLAPGLHTEWQADLAILDRLAKHNRGFKYLLVCINTLSRQIFVEPVKSKTSINIIKAFDNIFMRSKYIPWKILTDQGKEFTAHSVKKYFDTKDVKHFCMLTSPRFHAGMAERANRSIKERLYRYFTERDTYKWIEIVQDIVKGINQSINSSIGMRPADKKKQNGIEYVLVKWKGYSIKFNSWVPLSSISEKNI

SEQ ID NO: 156417 - protein, 286 aa, Heterodera glycines; identical to SEQ ID NO: 142642
  Coding regions on vcDNA: vcDNA=SeqID_82840; Strand=-; Position=1 -277,320-602,652-952

SEQ ID NO: 156418 - protein, 60 aa, Heterodera glycines
  Coding regions on vcDNA: vcDNA=SeqID_82841; Strand=+; Position=1 -179,221-224
MLTLEKEENNDENVDEYDEDDEYTNCDWLFKRWQIGKTIQWEDKKTDNLNNVNISICRFG

SEQ ID NO: 156419 - protein, 78 aa, Heterodera glycines
  Coding regions on vcDNA: vcDNA=SeqID_82842; Strand=-; Position=1 -43,256-449
MSIFGCPIPQIVLGVFILLAEYFLFETFIIPYLLLNLDEISDPLFERDTSFFIGLPILSYISCAIFSGALIKVHPNNA

SEQ ID NO: 156420 - protein, 307 aa, Heterodera glycines
  Coding regions on vcDNA: vcDNA=SeqID_82843; Strand=-; Position=1 -129,579-827,1249-1444,1505-1699,1788-1942
  Homolog annotation: Hit_ID=CAA33463.1; Match level="QueryCoverage =98%, HitCoverage=77%, E-value=1e-115, Identity=41%"; Hit description= twitchin [Caenorhabditis elegans]
MKNLVVRAGQTAKWVVKFGGKPAPEVTWSKNQQPITDLSGSIQVDTKKNDHTILCIPAAVRADRGAYALLVKNSSGTDTVTADLTVLDKPSKPRGPLEVSDVTEDGCALSWKPPEDDGGLPIDHYEVEKLEGGKWVPCAKVPDCAAQVKGLKKGQQYQFRVKAVNKEGKSEPLSTEQEIVAKNPYDEPGKPGVPDIVDWDANRADLVWEPPKNDGGAPIEDYIIERKSKHDRNWKECARVGGPTTKATVQGLKEGEEYEFRVKAVNKAGPGEASDPSRKLLAKARHQKPKIDRSAMQTVTIKVFREN

SEQ ID NO: 156421 - protein, 168 aa, Heterodera glycines
  Coding regions on vcDNA: vcDNA=SeqID_82844; Strand=+; Position=1 -99,528-795,1099-1193,1247-1289
MPMSFVPLATSANSYERKAKRETNEAKDDANARIEDAIASAINGGGSATVADIALLRNGRLSGASSVVAAGANDDFVRRLVDLVRREPALYDPSHEHYGNRHASAHFRTAIWQRLCKELDYPDDPQALQKQWKSIRDKYIKEKERRKGGTTTMMDHSESMTNGTRNFN

SEQ ID NO: 156422 - protein, 102 aa, Heterodera glycines
  Coding regions on vcDNA: vcDNA=SeqID_82845; Strand=-; Position=1 -111,212-283,998-1123
KYALEAVKGSSLERMVKRLGQIAHSAHRQLSDLSPNEFHDFAFKLSEALYSAGEFEEMLHVALTFMKKYADFRSSVPTQEIQYNMGPDVPSDGSFRECSQML

SEQ ID NO: 156423 - protein, 55 aa, Heterodera glycines
  Coding regions on vcDNA: vcDNA=SeqID_82846; Strand=+; Position=1 -63,121-225
MCVNENHKKCKAILSLNWSIKVTVCGIFRGENKTGICDIPKHYHLSLIKRRKVMA

SEQ ID NO: 156424 - protein, 71 aa, Heterodera glycines
  Coding regions on vcDNA: vcDNA=SeqID_82847; Strand=+; Position=1 -13,123-325
MLTKGEAAQFLIDLFMIAKNYQSSIGYIPVNFGTQSNALTAFVSSPIETKVIDVSIFADSARIGLILKRLK

SEQ ID NO: 156425 - protein, 213 aa, Heterodera glycines
  Coding regions on vcDNA: vcDNA=SeqID_82848; Strand=-; Position=1 -74,291-404,481-934
MSSTVLQNALRLLFITLIVFNCCHGASTRVKHKKPTDETTSTNEFAGLSVKLWIIIGVSVLLVLVVVCAIVVICCLCRKRRAGQQDNDELSTSVPSSYYKSRQGPTDSMDWPPPSAAGHGRGGRSGGGAMTAVPSGMMSKMPTMKTKQPFLFRMLMPESLRSIGPSRPAPSTATMERGGAQTKVKTTTMLGGDQTKVKASSTVPSGGEHYTTW

SEQ ID NO: 156426 - protein, 136 aa, Heterodera glycines
  Coding regions on vcDNA: vcDNA=SeqID_82849; Strand=-; Position=1 -117,164-302,518-555,704-819
  Homolog annotation: Hit_ID=CAE71145.1; Match level="QueryCoverage =91%, HitCoverage=13%, E-value=2e-46, Identity=58%"; Hit description =Hypothetical protein CBG18000 [Caenorhabditis briggsae]
MYEENFEGGREFLRVLNEVIGDFDELLDRADFAHVEKIKTIGPCYMAASGLNPERRRLSLHPYEHLYQLMEFAIALQNALAFFNQGVIGTTKLYYDIWVSSYTRDLLIDRYDFEYRDRIQVKAIITAHFAIKLLLL

SEQ ID NO: 156427 - protein, 63 aa, Heterodera glycines
  Coding regions on vcDNA: vcDNA=SeqID_82850; Strand=+; Position=1 -78,187-300
MLDLDEKEKSIVEKHVLAPNRARPTEEDNLFEQFILSTQISYCYYADSHRILGNTFGMARAAR

SEQ ID NO: 156428 - protein, 45 aa, Heterodera glycines
  Coding regions on vcDNA: vcDNA=SeqID_82851; Strand=-; Position=1 -93,498-542
MIKGFSHARQLESEIASLREQNRMLMAERVEARQRPNPALTTPFF

SEQ ID NO: 156429 - protein, 26 aa, Heterodera glycines
  Coding regions on vcDNA: vcDNA=SeqID_82852; Strand=+; Position=1-77
TSRPRSIQWYIAYMHFPTHSSECSLV

SEQ ID NO: 156430 - protein, 46 aa, Heterodera glycines
  Coding regions on vcDNA: vcDNA=SeqID_82853; Strand=-; Position=1 -53,576-663
MYEEDLPRHGHGEPFKVPNIYWMYNPDNPCSNVTKQYTKVGYAWKV

SEQ ID NO: 156431 - protein, 124 aa, Heterodera glycines
  Coding regions on vcDNA: vcDNA=SeqID_82854; Strand=+; Position=1 -36,750-1085
  Homolog annotation: Hit_ID=NP_491574.1; Match level="QueryCoverage =98%, HitCoverage=11%, E-value=2e-35, Identity=59%"; Hit description =protein N-acetyltransferase-like (1F918) [Caenorhabditis elegans] gb|AAB54126.1| Hypothetical protein F55
MANLPPVVAQQKSAAGGDVSSELARLQQSLADTKPIGPLLHRCRTLCQAKALLRLLDLVTDKMSNSMCAITAARGRGKSAAMGLAVAGAVGCNLTNIFVTSPTPENVRTLFEFVLRGFDAIGYQ

SEQ ID NO: 156432 - protein, 107 aa, Heterodera glycines
  Coding regions on vcDNA: vcDNA=SeqID_82855; Strand=-; Position=1 -147,254-296,775-823,1635-1719
MAAQQILSAAAERSKCNSKDQQQKRENDADEHCCSQRHNAVDIDERTMVILHCPLGQMASADLAVYTNCDLSDATTSLCWWTNRSTKRRRRQWKKRTQNTEDECRLT

SEQ ID NO: 156433 - protein, 107 aa, Heterodera glycines
  Coding regions on vcDNA: vcDNA=SeqID_82856; Strand=+; Position=1 -226,293-390
MCKISSFLMIFFAVFLSVAKVDGMSDAFKSTKEWVKKKLSSNSSQPLSSSSFHRPLLDTSDSSSSSFSFNPPIYKNNLEDNSSSSSVFGTHPFRNKIKKEYFQNLLI

SEQ ID NO: 156434 - protein, 64 aa, Heterodera glycines
  Coding regions on vcDNA: vcDNA=SeqID_82857; Strand=+; Position=1 -139,230-282
  Homolog annotation: Hit_ID=NP_490687.1; Match level="QueryCoverage =96%, HitCoverage=7%, E-value=1e-12, Identity=61%"; Hit description =PaTched Related (90.7 kD) (ptr-11) [Caenorhabditis elegans] gb|AAB97556.1| Patched related family protein
MLLTVKSDLIGSIAVTIVCMAVVCSLFIYSRLGVGAIALCITSICFTLVGVLSWCGADLDPVTM

SEQ ID NO: 156435 - protein, 18 aa, Heterodera glycines
  Coding regions on vcDNA: vcDNA=SeqID_82858; Strand=+; Position=1-56
IDNVAHSRKKLILTGLVL

SEQ ID NO: 156436 - protein, 29 aa, Heterodera glycines
  Coding regions on vcDNA: vcDNA=SeqID_82859; Strand=+; Position=1-88
MIDWIGILGCSLIVALLFDTALTRSFRWI

SEQ ID NO: 156437 - protein, 86 aa, Heterodera glycines
  Coding regions on vcDNA: vcDNA=SeqID_82860; Strand=-; Position=1 -74,426-612
MSFMFALGIWTEALFGAATELTIMTHHPLLKRRLIILLKKIFHLNQNQIGDVPTNTMELAPTVANPTNGGDEMAAHFKMLQQLWNK

SEQ ID NO: 156438 - protein, 94 aa, Heterodera glycines
  Coding regions on vcDNA: vcDNA=SeqID_82861; Strand=-; Position=1 -156,540-668
MTRESPNKKAIFVSKKENVIQRLHVRNYFVVNSVKFNQKYLCEFTLMPLNSLIQHNQDPSPIPSPTPQASSSASSNSSGENKLPSIDGNPEEGN

SEQ ID NO: 156439 - protein, 52 aa, Heterodera glycines
  Coding regions on vcDNA: vcDNA=SeqID_82862; Strand=-; Position=1-189
LCNIAANYSVFHHWCFFCRLLFIAASSLYNSSIFFLLCLNICLMRVKPTEKQ

SEQ ID NO: 156440 - protein, 375 aa, Heterodera glycines
  Coding regions on vcDNA: vcDNA=SeqID_82863; Strand=-; Position=1 -361,671-819,863-1160,1209-1352,1394-1570
  Homolog annotation: Hit_ID=NP_503721.1; Match level="QueryCoverage =60%, HitCoverage=44%, E-value=5e-65, Identity=54%"; Hit description =transposase family member (5D107) [Caenorhabditis elegans] ref|NP _503720.1| transposase family member (5D
SVAFATNPRLVLTDVENAPGLVTPFHHAHSQAMVKKDTDQKSSVADATSLVTVTSTEMQMPLARHNLPAKQQPRIWCFHNFRESVEDLPSRKNWTSLNTQKRHQFTLPADISKSAETTFAASHGWLESFMSRHSFSLRKPTTLAQKPPDDYAKAIVNFIVYVQKLWHEKNYSGVFACDETAVWLDPTGANCVSEKGAKSVTVLTTGHEKARVTVMLTARSDGTKLRPFVLLHKKRPVPDIAKRFKNDLVLCWCGRTWMDNELTTKFLEEVLGNFAFGRRLLIWDSFRCHISDDTKQTLRRLSIESAVIPGGTTKYIQPPDVCWNAPFKNKIRQIYDEWMVNGEKETTASGNMKAPPPMETYLHGLSPPGTHSRRN

SEQ ID NO: 156441 - protein, 17 aa, Heterodera glycines
  Coding regions on vcDNA: vcDNA=SeqID_82864; Strand=+; Position=1-68
HKHLFDLFYHIHNLIKI

SEQ ID NO: 156442 - protein, 46 aa, Heterodera glycines
  Coding regions on vcDNA: vcDNA=SeqID_82865; Strand=+; Position=1-239
NFFIWTSLFVTRNHYFGDFVTKIVKNHYFGVLSLFFHYFDIFWKIL

SEQ ID NO: 156443 - protein, 175 aa, Heterodera glycines
  Coding regions on vcDNA: vcDNA=SeqID_82866; Strand=+; Position=1-528
MVLVIEFCAQILGCSPKSLRDKLNHPEDRVKALKELVGKKVRTTYQDRNGMQKTFFVDGISDHGAALTPAYGRLRQPYNINIAAHFYARHRIKLHFPYVPCVVEKYSGCGEDRYYPMELLEIVDEDYTNKERWLGKLFTEIEDDFIPVKRRGRVDENEEIDAGRFECSQPSYVYW

SEQ ID NO: 156444 - protein, 1323 aa, Heterodera glycines
  Coding regions on vcDNA: vcDNA=SeqID_82867; Strand=-; Position=1 -1794,1841-2898,2951-3714,3761-3987,4035-4162
  Homolog annotation: Hit_ID=NP_001004509.1; Match level="QueryCoverage= 94%, HitCoverage=81%, E-value=1e-103, Identity=25%"; Hit description =si:busm1-180o5.3 [Danio rerio] emb|CAD60788.1| novel protein similar to DNA polymerases [Danio rerio]
MDNHPRKRFTNFSIDHILSAPKKPRQGFLINELGVFHFHESVQQADGTSNVVKDYVKKLENNIEHMAKFHYVKVKSKFTITDLPSTPEALLAGIFQHCIDEAIVESRERNIEPTHLGCMISSPLLEGGDIPIPIRQMTNNTLDTILNQFKKVAQSKQQKNVSLWGEPFTVTITTLDRNGLPSKRRVNGGARRPVKTAVHHRINDQCLIKIRNNDNHFCLFYALQATMVAKTCNWPRWKFFDYVNDRKGQQGQLYHDAVELMQQVNAPMDLDGYDANTFVPHVVDYWNNAQRQHRFAVFIFGSLGQYKPIYKYIDTTYDTPLLLYFNEDHFDGVQKQGGLFGRPYCLECERPYRRMSEHSKTCKARCVLCSRVGPLFPCQPTDGFIKKCKECNKKFTNNGCYQHHLQSGYCKRSKKCKDCGAVWDVAVNNRNGRKGHVCGERFCKMCNNYHNTERGCYIQPIEPKERDPYRIVAFDLETMQHMPSEKPEKREHLPNFIAARVACPDCIENESWREASGGCEVCGPNRTVAFCQRRFTETTVDKQVVAENPLEALVSWLINDLPLAYDTYAFSHFGGRFDMVLVFRELFKRGYNPDMLRKGNKMYEMRIRRQKKRNPNIVFRDSFNLMPMSLASLVPSFGLDVEDKPFFPHMANHPDNYGKQIHPMPDDYLVSGMMPDKRQKFDEWYEQHRQEPFFLDEALTSYCTNDVEILMAALVAFRHEFLDVTKRNEGIVAERAAFYEHHDGIDVLRECMTIAGACMKHFRTNHLPKKHLAIVPERGYDNAQNQSLLALRFFHWYAEEHGVVVQTAHSAGGEKKIGQYSVDGWVEEERRAIEVNGCVWHGCKECFPSDNMLMPNGKTAGEVRERDQKRLEFIESQVSRVDVYWECQIERMLHRDPDMRESFADYVDDGPLDIREAFMGGRTGPLKLYHKAGEGEKISYFDFTSLYPYVNFSTTYPIEHPKVLILNENVEWTTARDNPYKLSLLKVWVIPPRKCDVPVLPVKVNERLCFPLCMQCALDYPKGGVDFDYQCEHDDQQRGWVTTCTSIELDAALEEGYRVTKVFRLLKYKHGDDKLFRPYIAEFMSQKIEASGFDASIKGNTELEQQFIRECAEKFGISIDKDNMKVNKGKRSLAKLCLNNLWGRFSLRNFGLAQTLITDDPVVLAEYLDNRSVDVTSIDELDADHILISYVQKKEWVEEHECSNTVISLWTTSKARLLLLKAMQKVMRTPGCRLLYTDTDSLIFVHPIGLNPLETGPHLGQFTDEYPNHEIVEYCSGGAKQYGLKLRRNGQEEFVLKLRGITLNYDVMQNQSLCYDTFKEEVL

SEQ ID NO: 156445 - protein, 208 aa, Heterodera glycines
  Coding regions on vcDNA: vcDNA=SeqID_82868; Strand=+; Position=1 -150,250-444,491-723,997-1045
MKRPNPLNLPMSEKKPKLRRRLPAELNNELVSFIPLVCLFANVKRAPIGPKGVIALFDVMFEEKRTPKKKKVGRLLLQEELPHDLSRNELLHYLCYGRLGTNLFETYFVMTHATNSIAIGNLFGLLLDFAMSSPTPWLMKRPICCGIFFRQHLPWILQQPMNVMLSHGFFPEVRSDGFEFFWLFNPHLKKYAGNDDTMTDGIFWAKLS

SEQ ID NO: 156446 - protein, 313 aa, Heterodera glycines
  misc_feature (168)..(168): Xaa can be any naturally occurring amino acid
  misc_feature (197)..(197): Xaa can be any naturally occurring amino acid
  Coding regions on vcDNA: vcDNA=SeqID_82869; Strand=-; Position=1-973
  Homolog annotation: Hit_ID=NP_510671.1; Match level="QueryCoverage =93%, HitCoverage=30%, E-value=5e-55, Identity=44%"; Hit description =predicted CDS, endonuclease/exonuclease/phosphatase family and RNA -directed DNA polymerase (XR69) [Caenor
KGRNQFIISKICHPFEIPNLIYEDKCYHNSAEKCEIFAKLFANSFNSQTDPSNTLEIYQCFISDINFNIIETQNLMKKLPNKNGTSPDNISYKIKNCHSSLSTVITDLFRISLDTGSLPDIWKESIVFPLFKKGDKNNPENYRPISLTCSLCRVMERFQADIFTIFYXNKKISEYQFGFVRNRSTTSQLNSCGRLVXGNYKWKNVDCIYIDFQKAFDSVPHELLLYKLEKIGIRGKLLIWIKDFLSNRTFRVKIEDALSSNKKVLGVPQGSVLGPLLFLVYINDLPDALPSGVRIKLYADDVKLYICYKARAD

SEQ ID NO: 156447 - protein, 80 aa, Heterodera glycines
  Coding regions on vcDNA: vcDNA=SeqID_82870; Strand=+; Position=1 -101,541-679
MTENGTSKQIADLEMHEVEQGSRSLPENQEAYKNQMKSYHAKLWTERKSDVLVALGDCMTVSENFPLALEEFTSALEIRK

SEQ ID NO: 156448 - protein, 123 aa, Heterodera glycines
  Coding regions on vcDNA: vcDNA=SeqID_82871; Strand=-; Position=1 -348,641-664
  Homolog annotation: Hit_ID=XP_522969.1; Match level="QueryCoverage =98%, HitCoverage=73%, E-value=4e-12, Identity=35%"; Hit description =PREDICTED: similar to putative protein family member (XC187) [Pan troglodytes]
MIKRGTKVIQRGISVIKKRTKVIRRGAKVIRRGTKVIQKRTKVIQRGTSVIKKRTKVIKGGTKVIKRGTKIIKRGRKVIQRGISVIKGGTKVIKRGIKVIKRGTTVIRRGTPWLGERLEEVQL

SEQ ID NO: 156449 - protein, 94 aa, Heterodera glycines
  Coding regions on vcDNA: vcDNA=SeqID_82872; Strand=+; Position=1 -54,134-364
MQEWHSPWPENGPVDNKYRFKRLDTVVSVWTNSIESNQNKYKKVPLKNHPKPISINLIIFVEIHPSRIRTVKLKIIRVSKDIKLTQNGMSKSKD

SEQ ID NO: 156450 - protein, 236 aa, Heterodera glycines
  Coding regions on vcDNA: vcDNA=SeqID_82873; Strand=-; Position=1 -114,415-522,1354-1599,1899-2029,2105-2214
  Homolog annotation: Hit_ID=CAE69591.1; Match level="QueryCoverage =97%, HitCoverage=21%, E-value=9e-83, Identity=55%"; Hit description =Hypothetical protein CBG15813 [Caenorhabditis briggsae]
MQFSETLEVLEQIFEQHKLDNRDIQDFRQTVDECIARQAEVSAEDSYDYCELLKMMESEYQQLRELSAGRMVDLLLHEIELHEKQFNDVHNQGAALINQRHPAGEVIEVYLRTMQNQWDWMLNLSKCLEGHLRDAYNAKAFVEESEQVEQQMQQQLDHLDREYSRTDFSLDDGEQMLRQLDSVREYIQQLHARLLSLTDRCAQISPLWQRGEPISKPLPVMALCEYKSKDKIHIRQ

SEQ ID NO: 156451 - protein, 126 aa, Heterodera glycines
  Coding regions on vcDNA: vcDNA=SeqID_82874; Strand=+; Position=1 -238,421-563
  Homolog annotation: Hit_ID=NP_112263.1; Match level="QueryCoverage =96%, HitCoverage=82%, E-value=1e-43, Identity=66%"; Hit description =ubiquitin-conjugating enzyme E2D 2 [Rattus norvegicus] ref|NP _082778.1| RIKEN cDNA 1700013N18 [Mus muscul
MDDGKDMFHWKATIKGPPESPYEGGTFHLDIVFRRDYPFTPPIVKFETPVYHPNVNKQGGICLDVLKTTHWAPSLTISKVLLSISSLLCDPNPDSALEMDIAIIYRNDREQYNRNAREWTQKHAMK

SEQ ID NO: 156452 - protein, 110 aa, Heterodera glycines
  Coding regions on vcDNA: vcDNA=SeqID_82875; Strand=-; Position=1 -27,518-589,654-767,975-1094
MTIFGHSVTDYSANDLISLMQRIGQQFSKDFDRVDSVLEAQSEQLSRFERHIEQLESAQNGLLSTLSDTIKVAFLLTLLIGGFILLLLANKLLKGYKQKVAHVPLATSAI

SEQ ID NO: 156453 - protein, 48 aa, Heterodera glycines
  Coding regions on vcDNA: vcDNA=SeqID_82876; Strand=+; Position=1-146
LTPTPIGVKGRGSGLSGYEASGFGIGVFPENGQKCRGSGSGRGRGCNP

SEQ ID NO: 156454 - protein, 72 aa, Heterodera glycines
  Coding regions on vcDNA: vcDNA=SeqID_82877; Strand=+; Position=1 -159,271-330
MHLYSNIYNIKDENLTPRRLKPKQGAVFKNKTPKRGKAVEKGVKELHVSESAKGPKSDIFRIEIRPEHSEVT

SEQ ID NO: 156455 - protein, 333 aa, Heterodera glycines
  Coding regions on vcDNA: vcDNA=SeqID_82878; Strand=-; Position=1 -348,889-1082,2469-2578,3008-3192,3669-3830
MSSFGPVLSSFVNSMLSESSSIVDIPSPSPSNGTQTLGTAVNGIGTSHSSTRHDTSSPLVASETFVDDAPDDSDSSSAVFYVRNNGTDGGKQKANKKQKDTFKCANCNINFKSDEMLELHQNNCRRSVLSAPANFCSSLSFCDICNRKFISPRGVALHKGKAHKGESSSKLVKPKNMAKCPGRHRTKPTNAATAQQQPNGNVQIPKLRRHGHPVKMEVGSSLADQSYNKRRTNGAGGEQRRAPNGDGGDRPNGGGTQMDDDDGFGGEAEEDDIVILEPETKHGIVPRNTFGTVGPQQQQQNCAASGMAVPSSSSSMISHYAGMVISACAQSNM

SEQ ID NO: 156456 - protein, 24 aa, Heterodera glycines
  Coding regions on vcDNA: vcDNA=SeqID_82879; Strand=-; Position=1-72
MHSIWSRANTIFAFSLTVLSTVTL

SEQ ID NO: 156457 - protein, 47 aa, Heterodera glycines
  Coding regions on vcDNA: vcDNA=SeqID_82880; Strand=-; Position=1 -14,97-226
MPCKTNSPPRVQCVHVRCGQPTHFAAEVADKNHIPRPVDEHMLQVWY

SEQ ID NO: 156458 - protein, 95 aa, Heterodera glycines
  Coding regions on vcDNA: vcDNA=SeqID_82881; Strand=-; Position=1 -24,299-400,447-608
  Homolog annotation: Hit_ID=CAE63461.1; Match level="QueryCoverage =85%, HitCoverage=25%, E-value=1e-19, Identity=57%"; Hit description =Hypothetical protein CBG07927 [Caenorhabditis briggsae]
MPFRRTCQVILLIWTVSGLLSLPEPFTLRIYPAEYARNLTTTWGTRCKESWSPEFQQKYQLIQTLALFLAPLTIISALCVHMSIVLRNKAMQVVN

SEQ ID NO: 156459 - protein, 86 aa, Heterodera glycines
  Coding regions on vcDNA: vcDNA=SeqID_82882; Strand=-; Position=1 -68,214-406
MTFRQQFKFKTAGGYSSEEELDRLNDDEYVDFVADFLKPTPIEWVFVAIFAILMAVGVCGNCRDSKFSKIPFFRKFRPRGLRRLKK

SEQ ID NO: 156460 - protein, 137 aa, Heterodera glycines
  Coding regions on vcDNA: vcDNA=SeqID_82883; Strand=-; Position=1 -87,351-558,612-730
MELTPTQFLNIVEFGFIFLDLPNKNLSRKPLFEVKMDESLGNKRRRHSTVKEDDSVSLCGSVATTAAGDGSLLDFGLDEETLAVESDTEFERKFFVMKEGSFPGKVFALPHPASRERALYLVSQRKRTRKSQRKANE

SEQ ID NO: 156461 - protein, 95 aa, Heterodera glycines; identical to SEQ ID NO: 124528
  Coding regions on vcDNA: vcDNA=SeqID_82884; Strand=-; Position=1 -659,824-1123

SEQ ID NO: 156462 - protein, 55 aa, Heterodera glycines
  Coding regions on vcDNA: vcDNA=SeqID_82885; Strand=+; Position=1 -136,219-250
MDFTKPVITDVIFVKPPADDSPGFVLSAWRCSYHNDETYLCQRPEGSVPIFVAHP

SEQ ID NO: 156463 - protein, 76 aa, Heterodera glycines
  Coding regions on vcDNA: vcDNA=SeqID_82886; Strand=+; Position=1 -97,361-494
MRGTYDEDGYGSLEDKECDKGQQFCYLANCKTDMVSYLSWDCAKDTDCAKISADWTMNRGGGNYSCECTFGAPGLT

SEQ ID NO: 156464 - protein, 115 aa, Heterodera glycines
  Coding regions on vcDNA: vcDNA=SeqID_82887; Strand=+; Position=1-348
MFYRIVGHLSLFEWSQRNAHFRRPGRILRASVSERLANGTAHKHTTPFSAAKRTVRGFAVSGSGKGRGADGAYHSRDDGTRGDNGKMKQSAGINENKDIKTKTMTLPKAFIGHPN

SEQ ID NO: 156465 - protein, 307 aa, Heterodera glycines
  Coding regions on vcDNA: vcDNA=SeqID_82888; Strand=-; Position=1 -241,697-778,837-1046,1106-1178,1246-1406,1532-1657
  Homolog annotation: Hit_ID=NP_510115.1; Match level="QueryCoverage =91%, HitCoverage=68%, E-value=5e-41, Identity=37%"; Hit description =nuclear Hormone Receptor (nhr-17) [Caenorhabditis elegans] emb|CAA90291.1| Hypothetical protein C02B4.2 [
LAWACGQGKYGPKHSSLGDPFDRGQEDPLISRLLAKRRQFRTLLTSSSTPIFETIDHAFQQRTVFDGPMKIFENFKLRPGIQLDFYDWRARILSVAVWVKSFSELQEIPEIPLSDLQSLIVHCSFALLVFCEAFETPERFSDRLVYPDGLQVTRNFSKGIVSRKGLIRGIVAVINHILAPIRRIQLNAPIRRIQLNEVEYVFIQSLLLFDSDCCLSLGEKTQQIVNEKQQKLLESLQRYLNRKKDDAMESVKRMAELLLRIPNIQKVAAFKRQFFLDENGLRILGPNCAKCSFAIQIASLYLNTSFF

SEQ ID NO: 156466 - protein, 91 aa, Heterodera glycines
  Coding regions on vcDNA: vcDNA=SeqID_82889; Strand=+; Position=1 -10,294-559
MKVDNRFVQQDSTRQMMRNRREWAVQRLFRHYANVGVPNSTVRLGEILLLLPELEVLQYGDSMWELRSNIDPKNPGDRPNQYQSAGINGLF

SEQ ID NO: 156467 - protein, 161 aa, Heterodera glycines
  Coding regions on vcDNA: vcDNA=SeqID_82890; Strand=-; Position=1 -151,444-778
MARNSDFRYFWGRNPTSEIFHKKSEFFGKNLLKIAKFILEFCMIIENTFLGITEQNTQKSNKYFGQKSKTLMNRARKNKHMYIFFPWARNSQKLTKNITEKFLKKSQAATSSQAAEDELSINQNNLEESILNAKGKQNKIEIEPPNSPDNPSQLPFESSVL

SEQ ID NO: 156468 - protein, 233 aa, Heterodera glycines
  Coding regions on vcDNA: vcDNA=SeqID_82891; Strand=-; Position=1 -160,209-318,575-713,1134-1426
MFFFHHFFASADCPHVIEVTDVEAEAFKVMLSFIYAEDLSELNGQNAMAVLYAANKYNVSLLVKALLAFPINELSNVFLAFDEARLLNENAIRWADDRCAQMLIECSAENRRAVLGPALSRIRFPLITKREFSLNIVSSCLLTVEEVIGVFQYHCHPNLRGAPGQYPMAFPCHGRFSDQKEGTLSMEIEKLSEFARERVNSSRYSKCIYIKGLPWKIWAQINTKKDSTEKFII

SEQ ID NO: 156469 - protein, 117 aa, Heterodera glycines
  Coding regions on vcDNA: vcDNA=SeqID_82892; Strand=-; Position=1 -57,384-680
MYKNWSKYVHKYVKKIPKYVHIHPYLDGNGRVARLVENWVLIQRVLPMFIPAEEARDEYNANIALAVRGRNEGHATGLDLELNRNGDTDWLKPFINMFYVFLQNATENGAEKAADNE

SEQ ID NO: 156470 - protein, 140 aa, Heterodera glycines
  Coding regions on vcDNA: vcDNA=SeqID_82893; Strand=-; Position=1 -156,254-390,446-573
MNIISDRTRSAVATATPGGTRGKRKVMRFDNSEDDPIVQFWDVQDRRYKLIKALYNLISMSVTAEDNDAAVGDEPSRTQSSALRYLWTNRQSEDNLKICILSIVCKFLENPEVCKAGGRTNMFNVFTLLRLICICWDMNK

SEQ ID NO: 156471 - protein, 287 aa, Heterodera glycines
  Coding regions on vcDNA: vcDNA=SeqID_82894; Strand=-; Position=1 -133,549-915,1090-1255,1462-1658
SAEACRRHHQSPTEQWKQSEMGLAVDAITYSGLAGDGPLVAAVMVTNCVNPICASKALAEPYASSNSCFDSSAAAVGLVQPMVLAGPGADKLCASLGIGTVPSNDQLRTRSAVKEHRRAKQMMALAAPDNGDKSAAPAMALGTDNAIRRMDTVGGVAIHVRNAVDNTQFGAAIWAEQCAASSSSAAANSDFGLSVAVSVSGCGEALTRTHFAEALAQQILSMDVDDLAFVQCITHFLDHHFIRSRRLCSFPSDRLLLGGLAVIQQQIQKCPGDESDGNESAKLCHRN

SEQ ID NO: 156472 - protein, 48 aa, Heterodera glycines
  Coding regions on vcDNA: vcDNA=SeqID_82895; Strand=-; Position=1 -8,273-359,730-781
MCRIDNVRVHMEEINLTFSHRFAVMPDKSLSMVSKTARKPSISFSQKK

SEQ ID NO: 156473 - protein, 62 aa, Heterodera glycines
  Coding regions on vcDNA: vcDNA=SeqID_82896; Strand=+; Position=1-189
AIFLEILSPATFQANLLNPYMLDLLILSPQALVADLLSPQLIQPKILSPQSFSAGVLSPRNY

SEQ ID NO: 156474 - protein, 60 aa, Heterodera glycines
  Coding regions on vcDNA: vcDNA=SeqID_82897; Strand=+; Position=1-183
ILSPEIGGGHDESEFETEGENVFIWPKTDEPDEEAYLGENSAHPDTSAHIHPNILHPDGS

SEQ ID NO: 156475 - protein, 418 aa, Heterodera glycines
  Coding regions on vcDNA: vcDNA=SeqID_82898; Strand=-; Position=1 -308,357-558,705-802,874-992,1234-1457,1754-2057
MRFIYNQIGGSQHILLDRFYKKYFTAENESERKKAAQKIEIYIHIYFLSYKIEQNKEKLANILVAYLEEEEEEKQNKKGTKAMKKGPKPTITAKAFYQRRMLRLMFNNRLQLDFNVMELFDTHFQKPKLFCELLRLKAELLTTINANGTQRVTMARQKEWPNCKNDEEIKETIVANEENIKEWIFSDIFHFLPTRKKLLQYFDEIKLKKGDLRSARIGFINLIGFSRMSILCKKYSDQLSFLANFVAIQFEAMFLSELKYLWQLYTQNFWSNEKIIRIKNESFLKETMKGKALKNASESLSAHQKQLEELAQSINEMDQFLWWDNGPTDTFLLRALAICANGAIDEFGKKFPNSSAKNGELEEFTRECQCNFLICVGKTLRKNTRRDEFLSELHFQKMDNLLNDGRESETFRGDVIDH

SEQ ID NO: 156476 - protein, 26 aa, Heterodera glycines
  Coding regions on vcDNA: vcDNA=SeqID_82899; Strand=-; Position=1-79
MLKLSLLIIFVLLLHFALSNDEEINE

SEQ ID NO: 156477 - protein, 276 aa, Heterodera glycines
  Coding regions on vcDNA: vcDNA=SeqID_82900; Strand=+; Position=1 -810,860-880
MVITRSPILTRQRALNLEIAVDRSGHQINVGGNQQNSLQRQNHSAGESFPQNQQIENSPISPTELAGFNGENGDDSSLVLEPNMTEEELRRRLLVVSIERSQPPSNGNAGNGENAEGLRNAIRENDGRPNFGVNGQTFAHQRRPHDTFLSNLMNNGIGNFPQNLVHVPRTSTPTRNVEFEQQIGPFPFVVDRNNRAPTPPLNIRQQIFHPIPLNAHRINQVSVNAQRNIDVQYVPNNCVNVPPNVQRHCDIQYTAPNLVAAPIPVSSIMNLAVTIS

SEQ ID NO: 156478 - protein, 311 aa, Heterodera glycines
  Coding regions on vcDNA: vcDNA=SeqID_82901; Strand=+; Position=1-934
  Homolog annotation: Hit_ID=CAA82797.1; Match level="QueryCoverage =42%, HitCoverage=22%, E-value=2e-09, Identity=33%"; Hit description =gag protein [Ascaris lumbricoides]
MSSARCRMALGPALFRLRQHVTTAENLLDEPVINAETTENLEQERGHITRILSRMEVELDAWGAIMNGLQGPAREAEEALFTAFIRDDRHLTEWLEDAREMLAHIAAELADEHNQPIAAGGQQPAVAVNPPVPAVPFVNNAVFPGGANAQQPAAVANVANQPPPMPINAGGVHYQQPFAVANPANLALPVPINAAPVPLATARLPQLSLPIFSGEPMEWPAFWQSFESAVDRAALEPVDKLNYLHGCLRGKAARAVTAYRGGDNYAHAVAALRRLFGDPRKIAEALQSELINLRPVDDSVGSLQHFLETLQ

SEQ ID NO: 156479 - protein, 50 aa, Heterodera glycines
  Coding regions on vcDNA: vcDNA=SeqID_82902; Strand=-; Position=1-154
SFIIFTKMLLFLAFPLLFTLALHCYAFNGANLASGDIEPLLNELRENSRS

SEQ ID NO: 156480 - protein, 286 aa, Heterodera glycines
  Coding regions on vcDNA: vcDNA=SeqID_82903; Strand=-; Position=1 -306,613-803,870-950,1006-1154,1205-1340
FRTVRRGGGTRRQSAEYEDGKETKQKEEGDEHRHQSSFSSANFGRSSDSEQILREFNKEFSGFMRQFVMSRDKKPGEFDERMKAFIRDFNKKMPPEFEVERTAESVRFMPNIFLGGIGLAFLGAFIAYRLLSRNAILPEHRAIVAQQHSAVSYDEFVQHFLAAGEVRMIYFYPSKSVAVAVLHPGAVIRGQPYHGSAVLIRLDSYAASGSHFLQGVEDAQNRLGIDPREHVPVAIHFPSVLPAFMLILGWSILFAMFFKYARTSLRQSLFKVKRKDGGSKEGKAGE

SEQ ID NO: 156481 - protein, 40 aa, Heterodera glycines
  Coding regions on vcDNA: vcDNA=SeqID_82904; Strand=+; Position=1 -18,669-773
MDCGVVQLMDPSKKAFYNKNEDKVTLAIDFTVNEVKTDPI

SEQ ID NO: 156482 - protein, 247 aa, Heterodera glycines
  Coding regions on vcDNA: vcDNA=SeqID_82905; Strand=-; Position=1 -204,255-452,500-553,610-806,870-958
  Homolog annotation: Hit_ID=NP_494593.1; Match level="QueryCoverage =86%, HitCoverage=20%, E-value=2e-22, Identity=30%"; Hit description =eukaryotic initiation factor 2C2 family member (2D895) [Caenorhabditis elegans] gb|AAF60724.1| Hypothetic
MAYTISKHMLKLNGTYWMQQPRVTTVQMAAPMVSAIKEALLTFNVQNGFFPEHIFVFRAGASEGEYKKVAYWEGGAFTTAFDELINERKMPKKPALTLIVCQRNSNYRIIPKNVQPGGRAPDQNCQPGTVLDKRAMHSSLTEFLLVGHRTIQGTAQPLRCTVVVDTAEPRVKLSELEQISYALCYQHGICCSPTAVPGVLYSAGDLATRGRNNWRTSTADGDTIQEFDLPPQGQPEEVRAQAQAQLD

SEQ ID NO: 156483 - protein, 137 aa, Heterodera glycines
  Coding regions on vcDNA: vcDNA=SeqID_82906; Strand=-; Position=1 -37,88-289,920-1094
MAAQEENEIQLPQKISNDHEVRGIAPVGVLINAFELNLRGSPDKVYQHELRFTAEYPKSSKKGKEGPAEPRELARGPRNENEHFVFGNRMFEKNSVLQLQGDPRICKEGMQKNVRFVGDNPQQSMAIIQLDGPLCRH

SEQ ID NO: 156484 - protein, 38 aa, Heterodera glycines
  Coding regions on vcDNA: vcDNA=SeqID_82907; Strand=+; Position=1-249
IRIYPLYYPLPNLRPIRIIKNSNSRLGHFVAWTFCGSA

SEQ ID NO: 156485 - protein, 163 aa, Heterodera glycines
  Coding regions on vcDNA: vcDNA=SeqID_82908; Strand=+; Position=1 -207,588-813,976-1034
MLTKIDFFSHFKNNFYGIFNNLKNKDQIPNKTTKFIDIQQNLALVFNYVPTDEGVSSGNEQLFLPLHQQIDYVPLLRLAADARLRQQQNGTTLWWTDRCGGGADLVIDPTLWENNSTNWGRIFLMDRSNNEGLFNEQIFSLFGNNNKIIYLSQTPCGPHACLC

SEQ ID NO: 156486 - protein, 206 aa, Heterodera glycines
  Coding regions on vcDNA: vcDNA=SeqID_82909; Strand=-; Position=1-619
  Homolog annotation: Hit_ID=AAV44035.1; Match level="QueryCoverage =92%, HitCoverage=11%, E-value=4e-14, Identity=33%"; Hit description =putative helicase [Oryza sativa (japonica cultivar-group)]
MWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKEES

SEQ ID NO: 156487 - protein, 31 aa, Heterodera glycines; identical to SEQ ID NO: 126976
  Coding regions on vcDNA: vcDNA=SeqID_82910; Strand=-; Position=1-93

SEQ ID NO: 156488 - protein, 96 aa, Heterodera glycines
  Coding regions on vcDNA: vcDNA=SeqID_82911; Strand=-; Position=1-291
MGIQFTDHAKSLLAVTDFSRQFVDQILGQLLQVPVLQCGDRVPNGHAVLNGVGPVNALEARGDDMLTPIGRVGAGTGTGDDPTPAKKNTMKKHNGQ

SEQ ID NO: 156489 - protein, 316 aa, Heterodera glycines
  Coding regions on vcDNA: vcDNA=SeqID_82912; Strand=+; Position=1 -143,180-256,306-351,406-530,718-910,968-1046,1225-1370
  Homolog annotation: Hit_ID=NP_573336.2; Match level="QueryCoverage =91%, HitCoverage=11%, E-value=9e-43, Identity=36%"; Hit description =CG32542-PA [Drosophila melanogaster] gb|AAF48900.2| CG32542-PA [Drosophila melanogaster]
TQQVRSKLRKKILFASAAPPVIPPLVELAARRVASALSFELIEATYAHLPEHLVLPILRQCFPNSHLPEHLVLPILRQCFPNSADNIRLYSCLTNCSEGPFVIGEQCLTNCSEGPFVIGEQLFQLFQNGAVSELFQIGSFLDQILQKKMPKGYHLSAVVNDHQRVVSCSCSCSNSSYWCQHVVAACLQRIHRPDSVQYRVAIWDSITALKDRDLKKLAQYLINELPREYIPVAQKLIDALRDPYIPVAQKLIDALRDPSAINCTHGAPAPSAGLSHAQPAVWYMDETALRDEVHKILLDFAQVVLTERGLRVPIAA

SEQ ID NO: 156490 - protein, 67 aa, Heterodera glycines
  Coding regions on vcDNA: vcDNA=SeqID_82913; Strand=+; Position=1 -171,264-296
MRQSVTKTTTKRQAGEGAYAGEKVVGYVQQQRVYCKSKGRKKGGKVRPKKGRTVRLPHQLQKVIIHS

SEQ ID NO: 156491 - protein, 46 aa, Heterodera glycines
  Coding regions on vcDNA: vcDNA=SeqID_82914; Strand=-; Position=1-137
KIPSKIKGRLRTALPIMLESICMCIKFIKKRDSHFSGIEYKFKNSL

SEQ ID NO: 156492 - protein, 232 aa, Heterodera glycines
  Coding regions on vcDNA: vcDNA=SeqID_82915; Strand=-; Position=1 -448,612-862
MNLEKLEKANSILLEAAKRETERAWRDVVVLSDDVSDFAKSSRETLNRAIKSREKAPYANGVRELYLKMSDSIWEIFKILDQINLESEKAESAWREFERCKTFDQATKLEEQSQNSLTEARRLHFESRRVQSQMLNYENRLQTIVWEHMDILTSLIEENYKNEQGKFRSILKLSFGFESFYCPLRYPNENTAEALFQHVLLKEEQYSLFYPLDGVITLEVTIIPDVYSNSRN

SEQ ID NO: 156493 - protein, 94 aa, Heterodera glycines
  Coding regions on vcDNA: vcDNA=SeqID_82916; Strand=-; Position=1-283
MNLEKLEKANSILLEAAKRETERAWRDVVVLSDDVSDFAKSSRETLNRAIKSREKAPYANGVRELYLKMSDSIWEIFKILDQINLESEKAESAW

SEQ ID NO: 156494 - protein, 98 aa, Heterodera glycines
  Coding regions on vcDNA: vcDNA=SeqID_82917; Strand=+; Position=1 -21,1389-1664
MGNQWKKSDRVNENDLVKSLSQCLLAKYELLKRTSFKKEFSVSKRGFVRDADIGEMFSDRRERELRANVLKKSEKLLMDVLGYRVRGGISDRFLFFFS

SEQ ID NO: 156495 - protein, 118 aa, Heterodera glycines
  Coding regions on vcDNA: vcDNA=SeqID_82918; Strand=-; Position=1-357
MKSKTDEEKLEIVQKFIEMTEEYKQKRKHSRKEWNQNYAEICKKIGVGYDTIRKWKKQFGISKKRLMEEEKMEKMKIYWEIKKENPKMNEKEIAKIVKISQTNIHNWKKQFGEEILKD

SEQ ID NO: 156496 - protein, 233 aa, Heterodera glycines
  Coding regions on vcDNA: vcDNA=SeqID_82919; Strand=+; Position=1-702
  Homolog annotation: Hit_ID=XP_528877.1; Match level="QueryCoverage =84%, HitCoverage=70%, E-value=2e-20, Identity=36%"; Hit description =PREDICTED: similar to endoplasmic reticulum membrane protein family member with at least 5 transmembrane
HFNLWDSNLRHFNHWDSILLRFNHWDNPPTFQSLGLNPPAFQSLGLNPPTFQSLALNPPTFQSLGLNPPTFQSPGLNPPTFQSLGLNPTAFQSMGLNPPTFQSLGLNPPAFQSLGLNPTAFQSLGLNPTAFQSMGLNPPAFQSLGLNPPAFQSLGLNSPAFQSLGLNPTAFQSLGLNPPAFQSLGLNSTAFQSLGLNPTAFQSMGLPTNGSITSTPLTKFLRQRYSLGRFAAS

SEQ ID NO: 156497 - protein, 29 aa, Heterodera glycines
  Coding regions on vcDNA: vcDNA=SeqID_82920; Strand=+; Position=1 -3,191-277
MVFFIFKYYLFYVLHIFGIFFIIYYKFSK

SEQ ID NO: 156498 - protein, 184 aa, Heterodera glycines
  Coding regions on vcDNA: vcDNA=SeqID_82921; Strand=+; Position=1 -133,166-188,672-1070
MSTVHEFPIDEHGEIATKIFKILGKRLVTQILRAMDYCEQACDENKNIRKYRLRQSVDNFGRVANEQYLATLIAKKRTIILGLSTEFNTFLVEVEHEKFANNGWTTEKLTLLIEKMDKFFHKNKIYCANAGFEHAKNEHNRLVRGKKAMENHHQDGQIMDENGKDYRCTYKFAKILSSFKKSLG

SEQ ID NO: 156499 - protein, 119 aa, Heterodera glycines; identical to SEQ ID NO: 152897
  Coding regions on vcDNA: vcDNA=SeqID_82922; Strand=+; Position=1 -334,688-713

SEQ ID NO: 156500 - protein, 339 aa, Heterodera glycines
  Coding regions on vcDNA: vcDNA=SeqID_82923; Strand=+; Position=1-1020
MHSNHWDSFSCISITGTQPSSSSITGTQSTSIPVTGILFSCIPITGTQFSCISITGTQPSSISITGTQFSCISITGTQHTSISITGTQFSRTSINGTQFLCIPITGTHSPAFQSLGLNTPAFQSPGLNSPGLQSLGLYSILVHFNHWDSTHQHFNHRDSILQDFNHWDSTLFSCVSITGTQFLCIQITGTHSPAFQSLGLNPPAFQSLGLNPPAFQSLGLNTPAFQSPGLNSPGLQSLGLYSPAFQSPGLSFYAFQSPGLILLHFNHWDSTLQHFNHWDSILLHFNHRDSILQDFNHWDSILLHSNHWDLTSPGPSASQSSRLNSAIFQSPGLNSATFQ

SEQ ID NO: 156501 - protein, 29 aa, Heterodera glycines
  Coding regions on vcDNA: vcDNA=SeqID_82924; Strand=-; Position=1-88
AEPVDFIKHNLTIQSYYLAGNAPKALTPL

SEQ ID NO: 156502 - protein, 338 aa, Heterodera glycines
  Coding regions on vcDNA: vcDNA=SeqID_82925; Strand=+; Position=1 -52,92-1056
  Homolog annotation: Hit_ID=NP_702063.1; Match level="QueryCoverage =61%, HitCoverage=4%, E-value=1e-12, Identity=21%"; Hit description =hypothetical protein PF14_0175 [Plasmodium falciparum 3D7] gb|AAN36787.1| hypothetical protein [Plasmodium
MGFQRKFKMPDTTNFRTLESVRLETSPSSKVPIATSPVPSTAVTRLCTTFPATIFYNYQHQWSYYTSWNREHLGRGLSHPVFVQWPSTPQQFFAPKVLARPLRGLVLGPSAPPQFSAPIHHHLIAGTQPTNIPIANTSTGLNPPAFQSLGLNPPTFQLLGLNSPAFQSLGLNSPAFQSLGLTPPTFQSTGLKPPAFQSPTLQRDSIHQHFNRQHFNGTQSTSISITGTQPTNIPITGTQFSCIPITGTQFSCISITGTQPTNIPINGTQSTSISIANTSTGLNPPAFQSLGLNPPAFQLLGLNSPAFQSLGLNPPAFQSTGLNPPAFQSLGLNLSKFL

SEQ ID NO: 156503 - protein, 155 aa, Heterodera glycines
  Coding regions on vcDNA: vcDNA=SeqID_82926; Strand=-; Position=1-466
WDSLPQHSNQRDSNHQHFNRQHFNGTQSTSISIANTSTGLNPPAFQSLGLNPPTFQLLGLNSPAFQSLGLNSPAFQSLGLNPPTFQSTGLNPPAFQSPTLQRDSIHQHFNHWDSIHQHSNYWDSILLHFNHWDSTHQHSNQRDSIHQHFNHWDST

SEQ ID NO: 156504 - protein, 381 aa, Heterodera glycines
  Coding regions on vcDNA: vcDNA=SeqID_82927; Strand=+; Position=1-1147
TSITGTLFSCVSITWTQFLCIPITGTHSPAFQSLGLNPPAVQSLGLNPPAFQSLGFCSPAFQSLGLNSPAFQSLGLNPPAFQSLVLNSLAFQSLGLNTPAFQSPGLNSPGLQSMGFSFYAFQSLGLILLHFNHWDSTLQHFNHWYSILLHFNHWDSTHQHFNHRDSTLQHFNHWYSILVHFNHWDSTHQHFNHRDSILQDFNHWDSTLFSCVSITGTQFLCIQITGTHSPAFQSLGLNPPAFQSLGLNPPAFQSLGLNTPAFQSPGLNSPGLQSLGLYSPAFQSPGLSFYSFQSPGLILLHFNHWDSTLQHFNHWDSILLHFNHRDSILQDFNHWDSILLHSNHWDLTSPGPSASQSSRLNSAIFQSPGLNSATFQKMGLN

SEQ ID NO: 156505 - protein, 30 aa, Heterodera glycines
  Coding regions on vcDNA: vcDNA=SeqID_82928; Strand=+; Position=1-91
AEPVDFIKHNLTIQSYYLSGECAEGADPAS

SEQ ID NO: 156506 - protein, 103 aa, Heterodera glycines
  Coding regions on vcDNA: vcDNA=SeqID_82929; Strand=+; Position=1 -183,345-399,735-808
MGLLPSNLSISPLCNSFSNCHGFAPFPLALFVKLAAKSQLRYVPTFCQCFENWFPEENWKSKISKISCRISREYTQIDLDQFGIWTNEKRRRKFNFILFVNIS

SEQ ID NO: 156507 - protein, 84 aa, Heterodera glycines
  Coding regions on vcDNA: vcDNA=SeqID_82930; Strand=-; Position=1-362
SPSSKNAQISCRRCENSRLLQGYNTINNINPAYQNDQNYHTMLILIISSIFSLNFSKIMKYARSHSSMFCYFFVENTLINMLWC

SEQ ID NO: 156508 - protein, 220 aa, Heterodera glycines
  Coding regions on vcDNA: vcDNA=SeqID_82931; Strand=+; Position=1 -68,193-319,531-666,1080-1247,1480-1641
  Homolog annotation: Hit_ID=CAE59031.1; Match level="QueryCoverage =96%, HitCoverage=25%, E-value=2e-22, Identity=27%"; Hit description =Hypothetical protein CBG02311 [Caenorhabditis briggsae]
TYDHVTVKPGPHINVVIGPNGTGKSSIICGICLAVGGSPKLLGRSDLIGDFVKHGKCEGSVDLFLWDSRRRRERCFSVHIKLPNSASFFVDNQSMKLTQLRELVKEYNIQAGPTELVQLHESLLEKSEEGNELQAQFDRGKKRMDQLELELKTKKARVDSYKEWSNEYESELDVQRQQLVELDEISTQLKNVEKVEKKRKKAVENIGRTAAELTEELEQM

SEQ ID NO: 156509 - protein, 93 aa, Heterodera glycines
  Coding regions on vcDNA: vcDNA=SeqID_82932; Strand=+; Position=1 -72,983-1192
MCFLLFARQGNMASKACPNKIIAKQSDYVQQQNANNSDLGDNKNGNANAILVMRMPRTRSQQRRVWLETLGEENKMSGEEEEEEEEEEDVILL

SEQ ID NO: 156510 - protein, 90 aa, Heterodera glycines
  Coding regions on vcDNA: vcDNA=SeqID_82933; Strand=+; Position=1 -63,181-390
MFYRRIFALFLCIFVILFTLQFLPVIDGMQFDVVQCGHSKRCEFGGCAPGKAQNAASCAYLFSMEPEGPDSVRMGQTKIKNSYKENFSLT

SEQ ID NO: 156511 - protein, 103 aa, Heterodera glycines
  Coding regions on vcDNA: vcDNA=SeqID_82934; Strand=-; Position=1 -152,282-441
MSSDLQSTAEQMMGQFDGAMALMHVIVMGRFGLTEKKKEQMPNIPTVLAIPFNSFLFSTDSSGLFVSPFFADDSFHPFVSLRSFGDKIEANFGANFKFDLDAL

SEQ ID NO: 156512 - protein, 97 aa, Heterodera glycines
  Coding regions on vcDNA: vcDNA=SeqID_82935; Strand=-; Position=1-294
  Homolog annotation: Hit_ID=EAK95015.1; Match level="QueryCoverage =88%, HitCoverage=34%, E-value=7e-11, Identity=38%"; Hit description =hypothetical protein CaO19.11552 [Candida albicans SC5314]
MLYLNAHFLITVVPLLITLVPLLISVVPLLISVVPLLITVEPLLITLLISVVPLLITVEPLLITLLISVVPILITVEPLLITLLISVGPLLITVNLF

SEQ ID NO: 156513 - protein, 55 aa, Heterodera glycines
  Coding regions on vcDNA: vcDNA=SeqID_82936; Strand=-; Position=1 -111,159-215
LAYTEWSERSLEAIIRHAQDFVMFLSKNHADFYDVEKDYMLAPAEYHKRVWGNHS

SEQ ID NO: 156514 - protein, 192 aa, Heterodera glycines
  Coding regions on vcDNA: vcDNA=SeqID_82937; Strand=-; Position=1 -188,245-413,456-548,598-724
MPSRNLSAKKKQQNSLVRDESTSSPSRTPKSVSKASNSSSSQQKLQKKQNSSELSTISSGSVDSSMSTNPHGHPTDKKWTIGEKVLCRYLNSEHIYYEAKVMFLKDLSGGDVGYGIHYPGWSNRHDEVVPQHEALIRFKNYSDEEATKAKEDVKRAQQMLNAKKRKQSELKNRSQAHDESSRSSTPGSADNA

SEQ ID NO: 156515 - protein, 104 aa, Heterodera glycines
  Coding regions on vcDNA: vcDNA=SeqID_82938; Strand=+; Position=1 -57,103-360
MSATKYPDPLWVFMPPPPTAFANASSPVNLIAIIRFPPIFGFYVVPFDLINELTREQLTMKKMNDINRVLLIRCPIVRDESKWAKWVEEAIGWNFMDQWNRIDI

SEQ ID NO: 156516 - protein, 1149 aa, Heterodera glycines
  Coding regions on vcDNA: vcDNA=SeqID_82939; Strand=+; Position=1-3450
  Homolog annotation: Hit_ID=EAL50744.1; Match level="QueryCoverage =41%, HitCoverage=49%, E-value=4e-16, Identity=24%"; Hit description =regulator of nonsense transcripts 1, putative [Entamoeba histolytica HM-1:IMSS]
MRTKNLPSKLSNPEVLTSDESSASFESPAGTIYESFEALSIDSSKVASSPEGYTNVGAEIVIEETESNENPEGSGYDEVRNEGSSVTFKAMEVALDQVDAEGFANNGFDDEEPEACPPAKDVSKSSLLYLVSQAGDGYVIACKKSPKSKPNWPFFMNIEDKLIESAPGFQRKLEVGDFVAVSSFEWNQKLRYLAEHRQDATQSCKFWFNENTQLLPKQADATDVVQLMYMNIGRKQITGVVYWIKRKIQSVPSSFVHANIACCGLAVSARINRRHLDGINPEDLKLGSLVTVVVANIPQDSLVSMGYILPDASPYKLGTERRAETPEFFGAVACIRPHLLEWPNLNANMTPKVYPCSADTKHHVVAMEHVVGAALQIEMEREVDMMIEARFEGRARKFDGADCLIVFGSRSKKEVNELAKVWEPESQVKVFKELGEKHFALGVVKDVEVLHAEYEKLELHIVIFLNNIQERKNVDIARKVDEFIQGGSVVIHPVPATAVEDRLFCFRCNVPSIIADEDSPRGRIMAVLLGRPAMEGIRMEKESVDDSTDSWMEEEGPLHPAILALNSRQRVTARLMLGGGLVQQQAPPGTGKTKVAAAIIKAMMDSNPGFRIVVMACANIPVAKLVQEAEGTCAANDLDGARAIALFSGFARCKYTDQIKDVQRHTLPNKVNSEEFVKQLSPNVQKQVKEYLAHCEKNPRLAPERAIGKVFNSCMAPKIVFSTAAMAANLLHGEGNITDADVLLFDESTQAQWAVVVHLVARMPKLKALLLTGDRHQLGVHLQELPDIFHSGYGLESVILQAEASIGTNYTFLTKMYRSHPFLAKLISYASYELHNEQLIPARSAEERSLITGSDFLLPVQECPVGLINAFSSFRVDPKSDSLTDDHQTEVASFLVQALLEHFGNAFSSRIIVLCMYTYQTSEIERKLKHCGVRALTVDAYQAQECDVIIIVTTRSKYSEVGSGRTDNMHFFEDDQRATVALSRARHAVFIIGDLVSISAGQVWKRFIEMAITRTSVVRAEYVLALLGRTLVRSSTCLFDSAKRESVEDEGFLESWALKHGLRLDRTNSFGQQQSQQPRAPSFQFQNRHFPALQTTGPSDQAGPSGSGGQQRGAPTLAPQYGRGQGRRGPDNQWMHYGGNPKRQKGGRR

SEQ ID NO: 156517 - protein, 162 aa, Heterodera glycines; identical to SEQ ID NO: 132939
  Coding regions on vcDNA: vcDNA=SeqID_82940; Strand=-; Position=1-487
  Homolog annotation: Hit_ID=NP_500013.1; Match level="QueryCoverage =94%, HitCoverage=10%, E-value=6e-31, Identity=43%"; Hit description =predicted CDS, polyprotein family member (4B673) [Caenorhabditis elegans] gb|AAC02594.1| Hypothetical pro

SEQ ID NO: 156518 - protein, 1826 aa, Heterodera glycines
  Coding regions on vcDNA: vcDNA=SeqID_82941; Strand=+; Position=1 -3909,5001-5343,5773-5949,6316-6554,7170-7982
  Homolog annotation: Hit_ID=NP_500013.1; Match level="QueryCoverage =31%, HitCoverage=47%, E-value=5e-47, Identity=31%"; Hit description =predicted CDS, polyprotein family member (4B673) [Caenorhabditis elegans] gb|AAC02594.1| Hypothetical pro
MFPFSDGDPPNRSAAASNNALTDPEGLSNDLPELSVVDKLMFAGKILSTPARLSDVDKLHTDLVRTEDGVNRMTRHLNRTINQTNRDLTELKDDTQTLITQVNTLANSYGTVQVLQNQNQSPLVNNPPVLNWATPSPLRNPNNSFGNANTSVIEAIHSEEEDEEFELNPSGFHHVNMLFAESSPSFTIFSGNSPLEFDRWARKFMDLLDCNGRKWDDSEKVARLKACLDGEPRRIFDNLMPAHKATSSEAIQRIKENLDTPQNKELTYQALSMCKQREGESVDEFSARLIPLIEATTADLTTNASEEVLCRAFLEKLNPNLKFLTRTLSGPVRRDFQILRMNAREAEMMHREIPKSIPAPLFPISEQQNPRFNNTEPPNHPEGNFRTWAPTGSNREPISPRQRNRNNWDNNAQASRGSFNRSNNHPQNDRRWNNRTSRNDRRWNNQTPQNDRRWNARPVCNYCGKVGHLAFKCFKRREEFTQASKNLNFIRAIDEQNRLINDLSTKVNSLTFRNDQSAEAASQNINTIQKLTKSSTDKSPSMMNDTLKAPSKISNWETSKMVQPKFFPVLMGLTLISSLSSTLVKDFNTIPASPMICQTRVQPMTWSLPKFPRCPRMSIDTSKPLTKQRRTIYFPNSLEFSTKAWACRRIIKSIQKYTTISGVSVEQHLDSEQIVMSHDECLRMANNKHCSLGYLKNDSGLWHTDRKIDQTPRPWLLGSFSWKKVQSENCFAFETEVYSHIGATSIITPAGTAQACPYEKGNCVLFDKTVLVWVPQKDKMCKYSPIGIMDGHNLGNVWLSTLGDLGLTSSIVRNISDCGRNLTVSDQGPAFTINSQTPRHKRGIFGLDSEGVVTSSQLASQLSYLHTNISRSVNIAFAQAFNSFCDLMLDTQRWVQSSYLNDPTSLTRFIHQNNFLIAKRVGVSLLRTWPCVPLSQSDFEFRPTHTNSSCFEFLPIIVKLNGKEHIAFLNPTYLTVSLHSKTAPCEDQRNILIQMADRTIEVDQVDGTINNVHVHEIREVELDFGKPTRIPKLSPHAFHHLVILNLTDLATHAFASNLVQVSQFTYRADKTHSSEIKTTLSDEWSALEESIVQKAMGNYSLAWQIGITICLLLCMVDLLTRLFFAYIGIRLQDPVETLGRPMITTIANLFGRKKQNLDCDNKNHPNSPTKTIGHITSSHLRSVAATPINEATGQSFFRDTLNGNSCNFIEAYPQSSNSKEFKKIWFTKETNFSAWLNNYLSKPVNHEIPLLLPRNSGELAQFLDVATHFGKEIPNFNSKIGPISRISGDEHLKWDKQRVAAYQELCEEFQDIFSKSQYDLGSCTAGEHDIVTTSDTPVSSKPHRTPFKYRDELQKHIDQLLASGVMVESDTPWVSNIVLVQKKDGGLRPCIDFRKLNEVTVPDHYPLPRLETIMERIDPKTIREVKHVVGMASFFRKHVPNFSTIVEPLTRLTKKESNFEWGTEQAAAFNEVKRILTGKQNLLADGLSRYPHERTQEIAIRDLAELEDIANFPVCLALNMKPRMVHEHFLLTITARDIEGKTFAIDVRKEQNDDSESFCSLLYINKCYAIPHWSQGNAVVERSFRTFHNILAKYISSEEPDFDEFLECANFCYNTSIHSSTKETPFFLVFGRDPIFCIEQILNPNTEPENTSEVDNVKQKLVKSLRKAWESAAAVIKEAQLRSKVQYDKLVRNQTVQIGDRVLLRNYAGKVKTSKKFQLPWKGLYRVIEINGVLITIVSCTSPQTNPRIVHINQVKKYFECSGPPCTTKNLQKDEEQALKEVESREQINVPGYSHDSYQKISDNTVLIENTPALTPNPSPPSQSNN

SEQ ID NO: 156519 - protein, 223 aa, Heterodera glycines
  Coding regions on vcDNA: vcDNA=SeqID_82942; Strand=+; Position=1-672
MTYAAAFENFNLGEMRMISLPDGHSLMAFQGANDPFSNFHFSPFVHEEEKYCCVEQAFVMKKVRTYELNGVAAEVMQFVHKDDSTPNSPRWPDGHPRELKWFGREAEERASPATKRNWSENAQRSSIAFFVELKFRQNQHLAALLLATNDMWIAEACKDRKWAVGYYKDDPFLHNYPPENGAFGRNWMGNILMSLRMRMLNEQQSVAGPSRQIGKREDSIAYN

SEQ ID NO: 156520 - protein, 241 aa, Heterodera glycines
  Coding regions on vcDNA: vcDNA=SeqID_82943; Strand=-; Position=1-723
MEREAEGVPAQVPEVVVLDESIEENACGQNTDNENGVVEVLPLANPSDPLGLATVEPVVPEEVKEMEVDEQNGDQGGDSFGNGGFSGDESSSRHTFLSNKAKRLDQTNASKCSSSSQACLEDGALIDEFQAIGRAKDKLTKTRIQGPYPGKKEDEKAPKWYLVAQTAANGVVAARVQLAEQWPALIWVDNDIVQKTRPLEVGDSVKVVSVEWAQTATGWAGAGDWLIMVNKRLNHRSRAKE

SEQ ID NO: 156521 - protein, 1824 aa, Heterodera glycines
  Coding regions on vcDNA: vcDNA=SeqID_82944; Strand=-; Position=1-5475
  Homolog annotation: Hit_ID=EAL39732.1; Match level="QueryCoverage =41%, HitCoverage=72%, E-value=6e-89, Identity=31%"; Hit description =ENSANGP00000000214 [Anopheles gambiae str. PEST]
MSPVLLPAKLILQEVQNMNPKWDDELPANISKDWLKLMAQWLDRGEAITIEFPRHIQAIDSVEFHCFCDASKYGMGIAVYQKAKTTIMKDECNLIYAKSLVKPIKVAAHDGTIPKLELQALTLGVKAVKFIQAQIKFADHQVIMWTDSQCSVERLRENKRQDRFVTNRLQKIREANFQVRHVRTDSNPADMASRGADPQCLRSSLLWRFGPVWLSKADKWPKSNVIYRPGDEFKEVEEPPIIELTTPVHVEEQFKPSIHFERFSNWNRLKATAAHAMRFIKKLRTIENGTISEPHQNNKPLTMAQLQQAENWILRETQRLHPPSNDQIRELQLFRQEGIWRCGGRLEEAPDLPYDSKHPIFLPPHAWITKLIIRHYDKQLKHCGPRILLSTLREKFWIPRGRKTVQQLLNSPQHGCLECRRERVKPYTYPEASDLPRGRVSEARPFDKTGVDYFGPLKVKQSNDVVKIYVALFTCLAIRALHLEVAEDYSAEAFLRAFRRFTARRGIPSLIMSDQGTNFVAGAKVIKENWTDTLMPEDMQQQMAQSGIRWIFNTAHAPWKGGIWERLVGITKNALRRTVGRNLLTLDEFGTMLCEIEAIINNRPLTFESDQEPIKVLRPINFLIPYSKANNNFPIINNDTDDPTYEPYPTNRDKMVTTLSHVNARLNKFWEIWKSDYLLSLREHDRPNATTGLQTPNNGDIVIVEDDQMPRSLWNLARVEKVLIGKDGRARSALIKINGKLRDRAINQLYNLELSPEVPEQPIQQVHCLIASIMEDSVSLAGSDDEEQRPRNTEDFKIPKRRSALLRPIGEQQSPLQGQHKRRKQLHDSGLLKLFHAIADQQGSSKATIQAIAENREVRKAPQHEQIEHEQQMVQKAQKEAKRHLRTEQHEREMPQPQKEEQQREAERQQIERQQNDEQRATNQQAHSKAWQELAQQFDYDLMDQPDPTEKHAEETDQSTKSKQQSAKDKELERHRIGRKKTIDMQEKRQRSRDEWPEENETLLSYVQRIYGPENWTSAWQRGRVLRELHELEDQGRWMIHHKTDRLQLSVSRLYGGKRPFAEFRFVDGGYYSHMVPEDVIFLQAVPTEEPEIITLDDTPTTEKTATDNAKQPKQPKTSAPTIEEYRMADPKPNNFNEFNLFEPCDDSHTTCAKTATYGSIAGNRFQVEEFNNCRATNFFQALIFNWLTRNMNLPADEIWAAHDNYTQLNAVTEEIAKKFHQQQVVSKGRQIGRDQHFTEVINVWRNSCDRFGELYNQPAHKQVKFRPIIPEKEQPSDYEEWIERLNNRTAEILTKARAKVQHPTFLNYNCTTILIGDNVAEVFKPLFYDAKWFTHFPADEFRLIPGPKVKHMIFAYQATADNMAAQIAPMLHRFLRSDIEITLIVAKDDNAQWINNKKYLIDITRELKAGFFVFNREMGEARQIANRIRQAIPEPMDLEQELGPSSSTNTSRQGPSTSRQVISSLMLISMFCLLFTGTAQGLPSRQKRITQVKAWHGGHVSNFLNIFTERDRRASTKYSPYVQRYIDKVLALNRSLSQSTNPPRSTTPPWTTIQPTTTTSRPRTTTTTATTTTTRTTNWPTRLTTRPTARTTTTTPMPWSMDHRTTTVSRVRQQQRPRPGIKLIRWPKSTITTEKGRDVFWCSNHGSTLWELKGPENSPFCRPPPALTAQWTPLTITLYTKIHRPEPIATAWHCSIKTTTENYYTNIVGDKFVEINKEFPLVSKRLCQRMAHQQECPLAKTEMHHDDNNRIWATNDQLQVDFPGPITGLFKGKQTSSATNCFAQPATLFVKWHSLQLLSPIHRADHCNYASEYCQLHDNSSLI

SEQ ID NO: 156522 - protein, 34 aa, Heterodera glycines
  Coding regions on vcDNA: vcDNA=SeqID_82945; Strand=-; Position=1 -36,337-405
MVQLDSYDALKTKGYIKGVKGPFDWYIVSKMQKR

SEQ ID NO: 156523 - protein, 227 aa, Heterodera glycines
  Coding regions on vcDNA: vcDNA=SeqID_82946; Strand=-; Position=1 -61,132-494,537-635,677-815,868-889
  Homolog annotation: Hit_ID=NP_496594.1; Match level="QueryCoverage =63%, HitCoverage=9%, E-value=4e-40, Identity=54%"; Hit description =prion-like Q/N-rich domain protein PQN-87, Prion-like Q/N-rich domain protein (pqn-87) [Caenorhabditis ele
DESDQCDEDALSQLMLHSELFRQRSSVGVQTDYNEEFPPLKFLRALGEDPTMMGHPPFFFNASGAISEVPSSQQQAHQLSMPNLSASVPATAASAAMNAANAVDATSSASSDGMLQLVIQNFRHMSDTVRGPCKYIQGVPWRIMVMPRQHVVQKKGTQKCLGFFLQCCPDAYSESWSCQASAELRLISQKHGVPNFTRKTNHVYTAKENDWGYSCFMTWADILDEAQ

SEQ ID NO: 156524 - protein, 207 aa, Heterodera glycines
  Coding regions on vcDNA: vcDNA=SeqID_82947; Strand=-; Position=1 -152,199-277,323-470,515-760
RKRNNDAYSFEDDELLAVSSYSVSEVLQSAKRSTEGFNRIGKEEDQHSKTPKRKYTRQNSSSIEMANAKITERTNSVNSILTERMKRKARSLFASSEIANDDHSVLTDIPIPTCTMRSCSSNENECTPLLPKLIIRFPKKESSSNDEQTAQKHATHKGNKRKKRDKDVDWTETKQWHGARTKDKHHREKGHRKGHHKKRKYSTEADQ

SEQ ID NO: 156525 - protein, 255 aa, Heterodera glycines
  Coding regions on vcDNA: vcDNA=SeqID_82948; Strand=+; Position=1 -133,326-588,686-785,853-1124
MFFFAIFLFFTFFPIAGQNLLKNENKYKFIPRGQYEIIIAKGQYDGPKQFGFLTNRDGTIEWNFLDNFHRNKLINNQFKDLKSQEKFTILVQKENDKRIIRTFKNYAEMHRTMNQKEGTFYARNQIFFNNLPKAPPDLPVDWIGNSSYTFLPPRKYRIIVASGPYDGQKQTEFLTDNDGKIEQNFLGNFLDKRLNDGWNINPPESAEKITILVEKGNDKRIISEYTNYAELKKTMDENDGKLFNSNYIDFEALTV

SEQ ID NO: 156526 - protein, 184 aa, Heterodera glycines
  Coding regions on vcDNA: vcDNA=SeqID_82949; Strand=-; Position=1-555
MTIVGEIKVQLGNVICHRLRVVIPIKLSQSDREAGDDQHENEAELGHIDQHAAQGDLQGSQVGIGLEQVDDAGEAEMCRTWPAVPMAQLQPSRTQPEHVADSEQRLTDQHGLKRIPMRADDVAGCELLANVVHHVNRIGRKSVQKKGRRNERRQNRKGRERRRTKCQREEGQTEWKWCTSTDRP

SEQ ID NO: 156527 - protein, 453 aa, Heterodera glycines
  misc_feature (4)..(4): Xaa can be any naturally occurring amino acid
  Coding regions on vcDNA: vcDNA=SeqID_82950; Strand=+; Position=1 -45,108-151,214-384,495-531,681-801,853-890,942-1065,1174-1256,1320 -1491,1549-1668,1739-1779,1845-1866,1933-2007
  Homolog annotation: Hit_ID=NP_498881.2; Match level="QueryCoverage =95%, HitCoverage=33%, E-value=1e-121, Identity=55%"; Hit description= transient Receptor Potential channel subunit (118.1 kD) (trp-1) [Caenorhabditis elegans] gb|AAA28167.3|
SRSXNWAIKYEQKTFVAHPHCQQLLTSIWFVAHPHCQQLLTSIWYEGFPLKRHRSSSLRTLLIALLLVLGWPLMALCYIAFPKSRVGEIVRSPFMKFLYYSTSFGCFLALLTMVTFEAHREQTGEVKGGTATRAADRGPTPTLIEWLVFIWVIGMLWSEIKMLWSEIKQMWWRGFTKYIHQWWNWLDFVMVGFTKYIHQWWNWLDFVMVCLYLCTISIRSSFFPLAFRSSPLRHVIRTHWNAFEPVLVSEALFAVGNVFSFARIIYLFQTNFARIIYLFQTNPYLGPLQISLGCMLVDVAKFCFIFVLIISSFSIGLAQLYWYYDSQTPVCLSSDRCKIVPNAPVCLSSDRCKIVPNAFSSIASSYMTLLWSLFSITKVEDTEVVEAHHFTVWVVVEAHHFTVWVGRGLFILYHMLFILYHMTSIIVLLTSIIVLLNMLIGKTVPSVTRKDSL

SEQ ID NO: 156528 - protein, 251 aa, Heterodera glycines
  misc_feature (9)..(9): Xaa can be any naturally occurring amino acid
  Coding regions on vcDNA: vcDNA=SeqID_82951; Strand=-; Position=1 -33,2746-2860,3521-3713,4094-4249,5135-5400
  Homolog annotation: Hit_ID=NP_741956.1; Match level="QueryCoverage =93%, HitCoverage=64%, E-value=2e-46, Identity=44%"; Hit description =protein phosphatase 1 (39.7 kD) (XS238) [Caenorhabditis elegans] gb|AAM69102.1| Hypothetical protein H18N
YFLIPNQKXRARVRFADDCGQCLETVRVMTEPSDYPPKISPGVLYRIRDEFEAEEERQRKGGPIHRRSWKMAFKQPASEYVHFRDTLDRQRVALENVMLKNELSRMVGTIKVANMAFEKHVFVRHTANGWKTFSDVEAQWQCSPSKAFDTFRFDVPLPRNNECFIRFEFCVRFLAGSSPSVEEHWDSNDGKNFVLLSQDQFPTTMTASSSSPVLASSQPSFWHCRINRRRQRHTDYGRHAKSGGSASSPFL

SEQ ID NO: 156529 - protein, 340 aa, Heterodera glycines
  Coding regions on vcDNA: vcDNA=SeqID_82952; Strand=-; Position=1-1023
  Homolog annotation: Hit_ID=AAM45327.2; Match level="QueryCoverage =51%, HitCoverage=6%, E-value=3e-09, Identity=25%"; Hit description =similar to Plasmodium falciparum. Hypothetical protein [Dictyostelium discoideum]
MESTGFQQRYNFRVRRPINYMEQEESSHSRHSRRNGTEQNNGLNLAPQNILDNVQDPNPFPRNFENSIPQQVGVQQNVEEQMQLAVFRPPNQNVAQSFGNPRAHSTPQNVSPHISYNGQQENFEQNQNRNPDANRYGNHRRQNPRIFVNSQMANNHQFSARNSQNFVPNQGIRAQPVRNAHNPGYGELIGEQNRNVHNPNYGREIGMNYPIQNVRDFGNGPNFPNYNPVRNMNQQNYQQQPNPNFEPQPNQFQPFLPDQFPNTQNFEFVPQQNFLQNQIPDIVMELHKVTLSNQYANTLREIPNLYGTEGRDKIKDFFLNVQMCAGEWRPEKQKELLQTK

SEQ ID NO: 156530 - protein, 60 aa, Heterodera glycines
  Coding regions on vcDNA: vcDNA=SeqID_82953; Strand=+; Position=1 -97,1034-1119
MHIFRPIEFYNCNFISGKCAFSDRILQLYFISVALRCASRAVPNGWNKCTKDLPKLAVHA

SEQ ID NO: 156531 - protein, 138 aa, Heterodera glycines
  Coding regions on vcDNA: vcDNA=SeqID_82954; Strand=-; Position=1 -161,689-848,1273-1370
NFASTTSLLVARRAAEVLEFGGQLFGQLKSQQQDVQLVAEHFEYRRQSAHFNASTRLEKTAFPTAFRLIASIMHEQPILANLLCICSTRSALLGWRNAMQLQLMDCSLWSDFALRSRNPHGAALGPLADAAPSTFQRL

SEQ ID NO: 156532 - protein, 62 aa, Heterodera glycines
  Coding regions on vcDNA: vcDNA=SeqID_82955; Strand=-; Position=1 -108,173-253
MPISDFKMHLWPADFTIMPWTNYQHLGARNYCQFMAVQPTSLVSPLAQGSLDIFMPDKGIIF

SEQ ID NO: 156533 - protein, 68 aa, Heterodera glycines
  Coding regions on vcDNA: vcDNA=SeqID_82956; Strand=+; Position=1 -24,740-769,818-968
  Homolog annotation: Hit_ID=CAE59457.1; Match level="QueryCoverage =82%, HitCoverage=7%, E-value=3e-10, Identity=46%"; Hit description =Hypothetical protein CBG02837 [Caenorhabditis briggsae]
MERHVFPDMDERYDDIQQDFLKAFLGKQSKSPRWKDCSSSVSQRMSYASGAMYVRKHLTRRAKRPHGN

SEQ ID NO: 156534 - protein, 199 aa, Heterodera glycines
  Coding regions on vcDNA: vcDNA=SeqID_82957; Strand=+; Position=1 -115,167-286,337-468,527-670
  Homolog annotation: Hit_ID=NP_496490.1; Match level="QueryCoverage =100%, HitCoverage=22%, E-value=4e-48, Identity=50%"; Hit description= neprilysin-like zinc metallo-peptidase (2L946) [Caenorhabditis elegans] emb|CAA93770.1| Hypothetical pro
VIGHEITHGFDDQGHDGINLKDWWTRTRSSTCGAKGRCIIDQYSSRCIIDQYSSFEVPDINLHVNGILTQGENIADNGGIKQAYQAYKTYLNKLGREEAYKTYLNKLGREEKRLPGFERYNNEQIFFISFAQTWCGHTKPETLIRQILTDPLIRQILTDPHSPYRYRVNGVVANQPEFTRAFGCPAGARMNPARRCSVW

SEQ ID NO: 156535 - protein, 38 aa, Heterodera glycines
  Coding regions on vcDNA: vcDNA=SeqID_82958; Strand=+; Position=1 -93,1581-1604
MTIYAAGLVEDPFAFFHSSSLVAKWLFCLPEVVYFILK

SEQ ID NO: 156536 - protein, 62 aa, Heterodera glycines
  Coding regions on vcDNA: vcDNA=SeqID_82959; Strand=-; Position=1 -45,89-232
MRISDKRLISEGLQNRYRSDPAFAETSHMITALAFVPIQHLTAAITALNDVVGQELDQILGW

SEQ ID NO: 156537 - protein, 48 aa, Heterodera glycines
  Coding regions on vcDNA: vcDNA=SeqID_82960; Strand=-; Position=1 -95,127-178
MNIMRIFCFRLIIKTREIIHEITSTLIYNNKKTNVKNQDTQNQFIRPF

SEQ ID NO: 156538 - protein, 146 aa, Heterodera glycines
  Coding regions on vcDNA: vcDNA=SeqID_82961; Strand=-; Position=1 -232,327-487,1519-1566
MLIYIYNCFITSCADGASATNIWQWYYTKGAVSGTNFTTGLGCKPYLINSSEPDESLFCKKECDGQSPFGYREGRIFNLSSQPSRWNGLEKNREADMMMEIYENGPIQVGVTANRALLYYGKSNGRINIYVFLFIFFPFFSKYFIK

SEQ ID NO: 156539 - protein, 140 aa, Heterodera glycines
  Coding regions on vcDNA: vcDNA=SeqID_82962; Strand=-; Position=1 -42,214-594
MNSVSLIATRLCIEALVFTVPYSDLPSDTCITTTTTTLSKQETQTDKDLKRKALVETGLMAYSMQDGARLKKAKTAINVLGNLLLAESLDNKVTNSPVDEENMQDERRQEDDLKIVLSFFYTFWFCSIIYLFMGFYYVIQ

SEQ ID NO: 156540 - protein, 91 aa, Heterodera glycines
  Coding regions on vcDNA: vcDNA=SeqID_82963; Strand=-; Position=1 -40,416-651
  Homolog annotation: Hit_ID=BAB10420.1; Match level="QueryCoverage =75%, HitCoverage=6%, E-value=3e-16, Identity=55%"; Hit description =alpha-mannosidase [Arabidopsis thaliana] ref|NP_201416.1| glycosyl hydrolase family 38 protein [Arabidopsis
MGWKKTVDDYYTGANGKISNAGVRYILNTVVDELQKDQRRRFSYAETGFLTRWVEEMAPDRVEQLRKLVVEKGNFNNKVKIVPQPSLIEKF

SEQ ID NO: 156541 - protein, 286 aa, Heterodera glycines
  Coding regions on vcDNA: vcDNA=SeqID_82964; Strand=-; Position=1 -66,1799-2023,2333-2718,5004-5191
  Homolog annotation: Hit_ID=CAB62280.1; Match level="QueryCoverage =98%, HitCoverage=92%, E-value=1e-48, Identity=37%"; Hit description =hydroxyproline-rich glycoprotein DZ-HRGP [Volvox carteri f. nagariensis]
TCPTVTCPPTRAPLLLPPPPPPPRPRAPPPPPPPPGRRPRHGPSPPAPPPPPTPAGRSFRPPPIPPAPAPYPPSSPPPHPERPPRPSRAAAPSRRDSPSPPRLPLPPRLKTKAELRPPPPPPPPPRRPSVKIEKKEQNLVEMKASTPKQADHPTPAPRANREPMSGLDPRPSTSRQAGYFPPATYKIEPKHEPTKRPMPYRIPKKEPKSKEKPPQTQQQQPPPAAKTPVTPKVPTPPPAISPTPTIVKTPAPPSDTTPSPPTTVKPPVTVPPPITKPITPAPPPAT

SEQ ID NO: 156542 - protein, 80 aa, Heterodera glycines
  Coding regions on vcDNA: vcDNA=SeqID_82965; Strand=-; Position=1 -93,141-290
MDSADRRSPTPDMELCELSSWYDILQDDDDNILNWFTPVTARDVCQEVLAFAQERRMPFEKIVKWKQILDKICAQIAQKK

SEQ ID NO: 156543 - protein, 107 aa, Heterodera glycines
  Coding regions on vcDNA: vcDNA=SeqID_82966; Strand=-; Position=1 -61,166-341,749-832
  Homolog annotation: Hit_ID=CAE71172.1; Match level="QueryCoverage =71%, HitCoverage=2%, E-value=1e-15, Identity=53%"; Hit description =Hypothetical protein CBG18029 [Caenorhabditis briggsae]
MPGEEPSPRAILTGHDSEISAICVSAEHGIVLSGSTDGALLMHSTQGDLLRSIICSNGNGTDTLAPINNILFSRDCYIAQCDSPIRSLALSTNQRLIFGGLDSGAIV

SEQ ID NO: 156544 - protein, 53 aa, Heterodera glycines
  Coding regions on vcDNA: vcDNA=SeqID_82967; Strand=-; Position=1 -17,494-638
MRTEEKLDILKKAGPGPGFHVGLGPGFPGQKSRSRKNPGSSRPGSRPGPGFFN

SEQ ID NO: 156545 - protein, 76 aa, Heterodera glycines
  Coding regions on vcDNA: vcDNA=SeqID_82968; Strand=+; Position=1 -128,655-754
MRRAFAGSAFRDRIRGIGPMHALGHGAVAAQFVRPSISTDREIILICYLGSLDPSGSNWAYGMSPEIQFQVPNHQE

SEQ ID NO: 156546 - protein, 77 aa, Heterodera glycines
  Coding regions on vcDNA: vcDNA=SeqID_82969; Strand=+; Position=1 -42,364-555
MSPEIQFQVPNHQESKVAEECLEYQKKFDKKINQIASHWHGVRVSAPKAFGGIMIELSIAKEKWKLKMELEWDGVAI

SEQ ID NO: 156547 - protein, 57 aa, Heterodera glycines
  Coding regions on vcDNA: vcDNA=SeqID_82970; Strand=+; Position=1 -7,183-349
MDERDCTIGQLTIRQWNPTVVDNRTMDNPTINYTQRYENAVPKAIDCADLKKIGNKL

SEQ ID NO: 156548 - protein, 22 aa, Heterodera glycines
  Coding regions on vcDNA: vcDNA=SeqID_82971; Strand=+; Position=1-67
ASQVPESPGPGFAQNSRSRGTL

SEQ ID NO: 156549 - protein, 108 aa, Heterodera glycines
  Coding regions on vcDNA: vcDNA=SeqID_82972; Strand=+; Position=1 -168,355-511
MADSSAPVDKEEPWVRRFPPYRCSIEVEELNEFYVLHQQVVPNRVVPCCVDCVEITEIAAIAVEKINSDRISEGMKPLNLVRIIHATTQYVSGRSFCLQILFKQTKVN

SEQ ID NO: 156550 - protein, 77 aa, Heterodera glycines
  Coding regions on vcDNA: vcDNA=SeqID_82973; Strand=-; Position=1 -26,489-696
MSDFHGTILSQIIVENYKNFQSLTIYLCLFKKYLKTKASARNVLCGCMDDPDKIQRLHSFTDPIAVYFLNRNCSNFL

SEQ ID NO: 156551 - protein, 86 aa, Heterodera glycines
  Coding regions on vcDNA: vcDNA=SeqID_82974; Strand=-; Position=1-829
KNRFIFVFGAVPPNRCAQIYGETESFGNSFPIACTLILRWIFAPHNCLSTPNGHLKKSIFLFSGQSPRTDAPRFMGRPNPSGVASL

SEQ ID NO: 156552 - protein, 343 aa, Heterodera glycines
  Coding regions on vcDNA: vcDNA=SeqID_82975; Strand=-; Position=1 -276,328-757,809-1089,1142-1187
  Homolog annotation: Hit_ID=AAL78214.1; Match level="QueryCoverage =39%, HitCoverage=72%, E-value=2e-11, Identity=30%"; Hit description =putative esophageal gland cell protein Hgg-20 [Heterodera glycines]
FISADCWLCVFDLITPSQLGLGIAMISHGFDFYVDEHFKTRKWTFGNIRINNKIGENGQKKMEITNCRWKSMQIPQKPLPKKVVGFEDILIRHINNSAIAFLRHFRPLFAKCQINLAMRTNSRRTLEFILRNIWPMIEKNIHGFELPVGIFHRLRQFTPSLLNECPSLRIVKLYGFDDFFTEFPADDNATASDRQAVAKWLFTPRPDNVPKVLKCSLLMDMGDGVLSPSIEALKTAFFNASSPVNFIVIVYSFDDSVVPFYLTNELTREQLALKRINFSNRVLLIRCPIERDESKWAKWEEEAIGWDCFYQWNQIDIRIDDGEIEDGSVLLDETPGPSDQHQK

SEQ ID NO: 156553 - protein, 41 aa, Heterodera glycines
  Coding regions on vcDNA: vcDNA=SeqID_82976; Strand=-; Position=1 -47,240-318
MAYSKATKRDPEKEKKHAESKYVLRFESSFSLSLYSSNFMH

SEQ ID NO: 156554 - protein, 129 aa, Heterodera glycines
  Coding regions on vcDNA: vcDNA=SeqID_82977; Strand=+; Position=1-390
MSCFFSPLALYWSLLLLFPGNAFANLKCQNAMTNEAYEVPNDNVLVKLFQDGKLSIGEEMKQFVCDLSKQSMALEAADTDTSAQLTECQQPMAAQLIPNLRSAIRKLTTAINGGKNGTVYNKTVNPNLF

SEQ ID NO: 156555 - protein, 208 aa, Heterodera glycines
  Coding regions on vcDNA: vcDNA=SeqID_82978; Strand=-; Position=1 -205,385-585,926-1032,1531-1643
  Homolog annotation: Hit_ID=NP_496959.1; Match level="QueryCoverage =91%, HitCoverage=40%, E-value=2e-33, Identity=38%"; Hit description =EATing: abnormal pharyngeal pumping EAT-2, nicotinic Acetylcholine receptor Dalpha5 family member (55.0 k
WYRTPSRLATVLLPFHVADITPPTSTSVPIIAAFFSISMVILGSSIIFTLLIINVHFRSPRTHKMSPWVRTIFLEWLPWLLLMNRPGKQFKKPKRKRRRALVARVPLRTAPAQCHQRVFPVQLCTSESTTSRSTLNSFRELSDFLLLSQQIMEEEEEEEEAKADWRFMAMCLSHSSLSFSLSLSFSLSLFLFSISPTLLSLSPSLSLS

SEQ ID NO: 156556 - protein, 201 aa, Heterodera glycines
  misc_feature (186)..(186): Xaa can be any naturally occurring amino acid
  Coding regions on vcDNA: vcDNA=SeqID_82979; Strand=-; Position=1 -118,181-297,359-379,518-612,667-711,809-898
  Homolog annotation: Hit_ID=NP_510285.1; Match level="QueryCoverage =99%, HitCoverage=29%, E-value=7e-37, Identity=40%"; Hit description =acetylcholine receptor, one of nine alpha a7-like nicotinic acetylcholine receptor subunits (acr-9) [Caen
WARWSDYKMVWDPREYGGIDRIRLPSSTLWKPDVILFNSADENFDARFAVNFVVDHDGADENFDARFAVNFVVDHDGSILQTPPAIIKSSCQIDITWFPFDEQIFPFDEQICHFQFGSWSHTRNSLDLCVNGTSLDMVKDSIADLGYYVHNGEWEVIVDLGYYVHNGEWEVIVVELHFVANFLKFXSFPHQFIHIRRKTIY

SEQ ID NO: 156557 - protein, 112 aa, Heterodera glycines
  Coding regions on vcDNA: vcDNA=SeqID_82980; Strand=+; Position=1-339
MNFLTLIILLLIIPCVFGHYQWVQVLLRLFRWIVPRTLTLSASVASVRTAASYRTALSTIGRAASHGKLKILASGSAGLGGGAGGTMLLMELLEKNRNDIKGSPELDKSSKH

SEQ ID NO: 156558 - protein, 85 aa, Heterodera glycines
  Coding regions on vcDNA: vcDNA=SeqID_82981; Strand=-; Position=1 -186,685-756
  Homolog annotation: Hit_ID=NP_060277.1; Match level="QueryCoverage =92%, HitCoverage=23%, E-value=2e-29, Identity=79%"; Hit description =O-sialoglycoprotein endopeptidase [Homo sapiens] dbj|BAA91150.1| unnamed protein product [Homo sapiens] g
MLVEITERAMAHSGTAEVLIVGGVGCNERLQQMMDTMAQERGAKLFATDERFCIDNGAMIAQAGWEMYRAGLRASLDQAINSLTH

SEQ ID NO: 156559 - protein, 236 aa, Heterodera glycines
  Coding regions on vcDNA: vcDNA=SeqID_82982; Strand=-; Position=1 -201,478-543,945-1094,1417-1489,1607-1824
  Homolog annotation: Hit_ID=NP_497625.2; Match level="QueryCoverage =100%, HitCoverage=60%, E-value=1e-100, Identity=75%"; Hit description=o-sialoglycoprotein endopeptidase (3D923) [Caenorhabditis elegans]
MVCILGIEGSANKIGVGIVRDGTVLANPRRTFHAPPGQGFRPTETAVHHRQHIVSLVIEALQEAQIKDPVLELDAIVYTKGPGMGAPVKVGAVVARTLGQLWAKPILPVNHCIGHIEMGRLITGAENPVILYVSGGNTQVISYLNHCYCIFGETLDIAVGNCLDRFARVLCLSNEPSPGHNIEQLAKQGTKFYPLPYAVKGMDLSLSGILSHIEKAAPALIRSGAYTAADLCYSLQ

SEQ ID NO: 156560 - protein, 115 aa, Heterodera glycines
  Coding regions on vcDNA: vcDNA=SeqID_82983; Strand=-; Position=1 -97,424-635,880-918
MHEIMYALVKKKYIINKKMIFIHCHFVRPCNNEHSNFYLVCLMSPVRSVVAHRTKVLSIYKHLLRRFCAEFELSDPDYLSQRIRDEFRANKELSNKQAEHKLKKLEQIVKQKLVI

SEQ ID NO: 156561 - protein, 490 aa, Heterodera glycines
  Coding regions on vcDNA: vcDNA=SeqID_82984; Strand=-; Position=1 -250,602-743,1153-1253,1296-1389,1594-1708,1849-2444,2670-2765,2920 -2999
  Homolog annotation: Hit_ID=NP_491525.1; Match level="QueryCoverage =90%, HitCoverage=41%, E-value=5e-59, Identity=32%"; Hit description =WD repeat domain 11 (113.9 kD) (1F691) [Caenorhabditis elegans] gb|AAF60426.2| Hypothetical protein Y110A
FNNGKFVQISHKPQKVHSCPVKCLEWCGPNAFISAAYLSSLSASSSTVRNDIFITDIRTGTKRRVRPEQEEGPVELLRVSHYGCYLAISFRSDPLEIWDLNTFRLLRRMSKKCPVIVDMAWSTKHHQVKLWKSGAALLRCMVWKDDVLAFGDSAGRVGVWDLARSQCRQTGLSQSTRGPVQRVVFSRLTGDYTLAAQHPTSVVVWDTERLQSLFSLQKPGHSIIDIDMCGLNPVYIASDGMFRFAFSDTDEKSRTNNTNLNTSPPLIKSGPDFVTSNFFKYFFLLSDIPLLLRPSYCQALLSLLSTDTPPAAVAEQNNNDDTTTKSNQENAVPFGIDHDGHQLHTFDDPDIDHLINRLSAKCCRTPLDRAIVLHQFVGQQCLADLGRIVQCAATTTISTAGDDAANRPPPPQLRQPMLPPNLMLFWPKKAYQKRVERFTRLLLSTFRTERQLEMAIEKCVIMRKNDLALYYLLNNDQLAFGGGAATAGAW

SEQ ID NO: 156562 - protein, 187 aa, Heterodera glycines
  Coding regions on vcDNA: vcDNA=SeqID_82985; Strand=+; Position=1 -166,210-607
MSFLNVPEILKQKLIEVEGTLKAISPQSSHGESLPAPAQYAEPLSFKKGRFLLWKGVETGFLYLTGHPNPGSLTVYDYKNGTANAVLCFSHQFGPTALIIDAIYFPLSTDHPGILVAVTDRSMDQHGDYLAYFSLLSHTLLNAFYVPQPITSICSILDGSAQRDQFLRLSNSFHKVFLELLDYAIIC

SEQ ID NO: 156563 - protein, 110 aa, Heterodera glycines
  Coding regions on vcDNA: vcDNA=SeqID_82986; Strand=-; Position=1 -223,647-756
MYYSYFLCPTIVVSFVMDGSVPQAFGHLSPGSVTLSVILIQVDEIMEQIMFQMLATHPSDMNRETIGPRVLAVRVLDTSWVFILLDISWLGHFVHFCLYELSSWYSEAIL

SEQ ID NO: 156564 - protein, 63 aa, Heterodera glycines
  Coding regions on vcDNA: vcDNA=SeqID_82987; Strand=+; Position=1 -125,174-240
MNLQFLVFRLAPGNCRPSKFQKNHWPKLFGRPRRRMPRSGHGSARCWDSEWAGWGISNSNLGN

SEQ ID NO: 156565 - protein, 278 aa, Heterodera glycines
  Coding regions on vcDNA: vcDNA=SeqID_82988; Strand=+; Position=1 -616,661-782,830-928
  Homolog annotation: Hit_ID=CAA42642.1; Match level="QueryCoverage =82%, HitCoverage=88%, E-value=8e-10, Identity=31%"; Hit description =unnamed protein product [Hordeum vulgare subsp. vulgare] pir||S18350 seed storage protein - barley
MSNLSGSDQQHATPNQPGGQQFGAIQQPLWSQLAPQNQFFGAIPPPSHQFTAPPPSVQHVAAGGGVQPPQQFPGPIAGGGAGSVQPQQPQQHSQFFGGIPPQQFTGPVAGSVQPQQPQQHSQFFGGIPPQQSTGPVAGSVQPQQPQQHSQFFGGIPPQQFTGPQPLPHVAGGVQQQQQFFGGFQPRQFGVHPVRPYPQFGTAQQFVGQHNPKLDHQFFAHSNASGVPQRPFMPPPPQYHHPQYQSGGYLPNIAQFCVDGTTSTAFLNGCVDTFNRVLP

SEQ ID NO: 156566 - protein, 170 aa, Heterodera glycines
  Coding regions on vcDNA: vcDNA=SeqID_82989; Strand=+; Position=1 -93,580-999
MSKHFGHHQPFTFYKAKFLEKASGVKLMHLTSEETKTFDHQKAFDELEKNILAKLEQMDMKLGSNAQGWSSFLMKSVGIGIGAVIFLQIAKRIIHSHTKKGVRRHGQFLFRMTDFKAFSQGNGPKEVKSDTIGYINGMPWQIAIQNNGASIGLFLNCSSLKIRKCDPIGS

SEQ ID NO: 156567 - protein, 19 aa, Heterodera glycines
  Coding regions on vcDNA: vcDNA=SeqID_82990; Strand=+; Position=1-58
CHGTRKLLLGRVKCDGTRK

SEQ ID NO: 156568 - protein, 53 aa, Heterodera glycines
  Coding regions on vcDNA: vcDNA=SeqID_82991; Strand=+; Position=1 -53,88-194
ECHGTGNFCQNRDRDLPGPEKPGPGPGPRFFFGTGNREILKIQKNFKNLKKNS

SEQ ID NO: 156569 - protein, 97 aa, Heterodera glycines
  Coding regions on vcDNA: vcDNA=SeqID_82992; Strand=-; Position=1 -201,259-351
MCPKVEKMAVIEKGMEKETGDRPTTHLKECPMTTPAGIFQGFDEGEDGQREAGPRAVDKLLPLVVEFMLENEVGFEGERGMIGSMATRTKGNSYFTK

SEQ ID NO: 156570 - protein, 978 aa, Heterodera glycines
  Coding regions on vcDNA: vcDNA=SeqID_82993; Strand=+; Position=1 -636,683-2621,2674-3035
  Homolog annotation: Hit_ID=NP_507780.1; Match level="QueryCoverage =65%, HitCoverage=43%, E-value=3e-55, Identity=25%"; Hit description =predicted CDS, DNA polymerase type B, organellar and viral family member (5T899) [Caenorhabditis elegans]
MENRPPKRPFPFTINDILTTPPPPKTLQQGFLINQLLGLTVQEGEGAESSSNKKLPSEFVEKLECSVEHVAKFNYTKVKSSFVIRDVPADPESLLSSIFKHCIDEAKSDSREKSSEPTHLGCLISSALLDGGDVFVPVRQITANTIDAILNLFTKVAQSKQQKGVTLWGEPFTITITTIDRSGLPVKRHIKGGARRRLTHVQHQVHEKCLIKINNQNWDNSDNNYCLFYALQATMVSKTRGWPSWKFFRYINDQFGQRGLLHQETVQLMRQIKVPLDLDAYDADTYVPLVINHWNNAQQRHRFAVFIFGTTGHYKPLYKYGNDDYDTPLVLYFNNTHFDDVHFLSGLFGGKKYCLECEKPYKKPSEHNQTCKAHCLMCSRVGPAFPCPSEPDFFRKCKECHKNFNNAGCYNHHLQSNYCKRSKKCKDCGVIWNVADNNRRGRKGHVCGEKFCQLCNNFHSTERGCFIAPLEPKDEMEAYRFVAFDLETMQHLPADPHLPERRNHEPNFIAAKVSCPMCIENGRWKQGTAGCWICGPHRTVAFCQRPFTDTPVDKQVVTDNPMQAFVGWLINDLPIKANTFAYSHFGGRFDMVITFRELFRRGYNPEMIRRVSMFLHIFYSDKQIKGNKMYEMKLRAQKNRHPNIVFRDSFNLMPCALGQLVPAYGLDVEEKPFFPHMVNRPDNYGREIFPTPDDYLAHGMMPEKRRQFDNWYEQHRSEPFFLDEALASYCTNDVEILMAALVAFRREFLEITRRQEPVDGRETHNGIDVLKQCMTIASACMKHFRTNHLPAGHLAIVPERGYDNAQNQSLLALRFFKWYAEKHGVQLQTAHSAGGEKRVANYSLDAWIEAEKRAIEVNGCVWHGCSKCFPEDNMLLPNGKSAGEVRERDAKRLEFLRNQVGVVDVYWECEIERMLASDPEMRQAFAGYVDDGPLEIRAAFMGGRTGPLKLFHKAREGEKISYYDFTSLYPFIKSFLIS

SEQ ID NO: 156571 - protein, 677 aa, Heterodera glycines
  Coding regions on vcDNA: vcDNA=SeqID_82994; Strand=+; Position=1 -475,529-871,923-1494,1540-1731,1917-2047,2094-2414
  Homolog annotation: Hit_ID=NP_001004509.1; Match level="QueryCoverage= 90%, HitCoverage=43%, E-value=2e-71, Identity=29%"; Hit description =si:busm1-180o5.3 [Danio rerio] emb|CAD60788.1| novel protein similar to DNA polymerases [Danio rerio]
MPEKRRQFNNWYEQHRSEPFFLDEALASYCTNDVEILMAALVAFRREFLQITRRQEPVDGRETHNGIDVLKQCMTIASACMKHFRTNHLPADHLAIVPERGYDNAQNQSLLALRFFKWYAEKHGVQLQTAHSAGGEKRVANYSLDAWIEAEKRAIEVNGCVWHGCSKCFPEDNMLLPNGKSAGEVRERDAKRLEFLRNQVGVVDVYWECEIERMLASDPEMRQAFAGYVDDGPQEIRAAFMGGRTGPLKLFHKAREGEKISYYDFTSLYPFINFTTRYPIGHPKVHVLNEEVEWKCATDNPYDLSLLKVWVIPPRQCDVPVLPVKVDDRLCFPLCYKCAKKYPTGGVDNDYHCRHSDEQRGWVSTCTSLELNAALDEGYRVTKVFRVLQYEQSDDQLFRSYISEFMALKIQASGFDSSIKGNTEMEQEFVRECYENFGITIDPAKMEPNRGKRSIAKLCLNNLWGRFSLRNFGLSQTLVTDDPAVLAEYLDNRSLEVTAIDELDAEHILISYETKKEWVEENSCSNIDTDSIILTHPDDNCPLKTGPHLGQFTDEYPKHEILEFCSGGAKQYGLKLRRKDAPPDAENEYVLKVRGMTLNYDVIQNQGLRYETFKEKVLRFAETGEPQPINVIYPNFLRPSIKDGRVISCPLQKIYKPFVGKGIVGADYKILDFGHTL

SEQ ID NO: 156572 - protein, 38 aa, Heterodera glycines
  Coding regions on vcDNA: vcDNA=SeqID_82995; Strand=+; Position=1 -27,162-251
MPIIREGGGAVLINNLLKQLRLKVGQANKTHGNNDRHN

SEQ ID NO: 156573 - protein, 150 aa, Heterodera glycines
  Coding regions on vcDNA: vcDNA=SeqID_82996; Strand=-; Position=1 -234,310-528
  Homolog annotation: Hit_ID=CAE67320.1; Match level="QueryCoverage =100%, HitCoverage=9%, E-value=5e-42, Identity=52%"; Hit description =Hypothetical protein CBG12782 [Caenorhabditis briggsae]
SRQSFTLIYAGWVEFCLKRKSADTENENGYNSVQNASLVTSFCFALSMLGRRALGTAAYNRHSSAAESFLFGMHTLFKGDMRIAHPADEWVFADLDILNSVVSPAIRMALKLHQDHFAAVVDLDEPAELFELIDDYRKRLFISHEHDPEW

SEQ ID NO: 156574 - protein, 101 aa, Heterodera glycines
  Coding regions on vcDNA: vcDNA=SeqID_82997; Strand=+; Position=1 -82,148-371
MVIIFKNGAKNWGLTKRNAINQKLMKKTKEWHQNYAEICKKIGVSYGTIMQWKKQSGLSNKRITEEEKIEKLKIYWQTKRENPKKSERAFAKMLKIDRKNI

SEQ ID NO: 156575 - protein, 329 aa, Heterodera glycines
  misc_feature (291)..(291): Xaa can be any naturally occurring amino acid
  misc_feature (326)..(326): Xaa can be any naturally occurring amino acid
  Coding regions on vcDNA: vcDNA=SeqID_82998; Strand=-; Position=1 -76,125-273,314-429,480-675,721-847,947-1035,1196-1245
  Homolog annotation: Hit_ID=NP_510045.1; Match level="QueryCoverage =97%, HitCoverage=42%, E-value=1e-40, Identity=35%"; Hit description =putative protein family member, with at least 9 transmembrane domains, of bilaterial origin (XM884) [Caen
GPLESWPSGRGTGSLYLRLGTLCFGSSGIVLFCLEVFICFFGSSGIVLFCLEVFICFSDKACFNYQLINWLFAGTFTFIQMHFIFCNSKLIIVDSKNSAKLGTMLIIVDSKNSAKLGTMHLLAVNIWTWLRFVIAKNAALDKPWYQLLQIFRLKRDLTNGVSWYQLLQIFRLKRDLTNGVSSEEMEQSAPTDGRVGVRPSKAPLPSKVYSFNYFGDFATLLTTCIVEYSVIGAAVMVCLWREYSVIGAAVMVCLWRSIGEHRTESEGKSCDETKPQKEHKSGKSGILAGLXYLIGHLSRGKQTLVTHLSDSPGAAARGSIPDLVTXMTP

SEQ ID NO: 156576 - protein, 124 aa, Heterodera glycines
  Coding regions on vcDNA: vcDNA=SeqID_82999; Strand=-; Position=1 -99,141-417
SYVVSLLVVGCGSILWFFWDYVKKRRRQNKKEIFISADCWLKVFDLLPRSQLGLGIALISRRFDRRVDEHFKTRKWKLDNKLWIHKRKGWNGTTEMKIVNANGGKALPIPQIPLPNKSSYSDAF

SEQ ID NO: 156577 - protein, 19 aa, Heterodera glycines
  Coding regions on vcDNA: vcDNA=SeqID_83000; Strand=-; Position=1-58
GPGSRSRVLKSSGPGPGRA

SEQ ID NO: 156578 - protein, 113 aa, Heterodera glycines
  Coding regions on vcDNA: vcDNA=SeqID_83001; Strand=-; Position=1 -114,1519-1746
MWHSKPATEPILHANGTIPSANCGHFVCFASHKFELFSDIAKDEDAQSAIIDEILWNTEQRSLETSLRERSVSFHQRENHTQTEIIGRHGKMKEQKSERKGKLKLAQLKRRQK

SEQ ID NO: 156579 - protein, 148 aa, Heterodera glycines
  Coding regions on vcDNA: vcDNA=SeqID_83002; Strand=-; Position=1 -24,68-212,464-595,890-1035
  Homolog annotation: Hit_ID=NP_501577.1; Match level="QueryCoverage =36%, HitCoverage=11%, E-value=9e-12, Identity=53%"; Hit description =alpha precursor (60.8 kD) (4J842) [Caenorhabditis elegans] emb|CAA92567.1| Hypothetical protein ZC410.3 [
MPNLKRKSRFHIVKDGQREAAVFAGKGVQTLNVHHQQQQNIDNETVARPKQTPMFGGPTNAHQRAIREAFRYAWNAYKKYAWGHDQLMPISHSFHEWMECASRSQHTGFIWVFWTRSYNRRLTGYPVDHGFAGRICGRQTMGGDGIAL

SEQ ID NO: 156580 - protein, 352 aa, Heterodera glycines
  Coding regions on vcDNA: vcDNA=SeqID_83003; Strand=+; Position=1 -583,686-1161
MEKARKSTPPRSMTLEALLEECRSIQSLKNSAAALSGPGQVHSVQVRPQRVSDGSKKSNRGKMVNQKGNVSVPISKENNFPFNSNRTDQDQNVQQKCKRCGQFHVNDCPYAADVNCYRCGKRGHIRPVCPERTQSNAVTVASTFCVTQKCHDWIWTHPLINGHPVKLAADSCSHLTIIQEPLWISLGSPKLRKQVANTGAPNIMGLDWIVPFEKATQSPIATTLDLSSAPTKVNTIDERPRHFKIGDTVRVLNYGKSGKSNWFEGKVVAGKGLIWKVKIPLLNITVNRHVNQMRSFVPYQSETTFPNDTVDQVPQQKSPCHSTVTTTPPTNLPVQPTQRPQRQRRPPIRYSP

SEQ ID NO: 156581 - protein, 118 aa, Heterodera glycines
  Coding regions on vcDNA: vcDNA=SeqID_83004; Strand=-; Position=1 -122,331-431,882-973,1599-1640
MYYKIVSFYGFQATASSTVLKDTKSVRFAQQKVVLFELGRCQIRLPIGSDCWPAQIPLTARLRGAGPEPNGRRMCIMMDPVNGKSRGYGFLIYTDKTHAQEAAKKTNLCHQQTHSHIF

SEQ ID NO: 156582 - protein, 174 aa, Heterodera glycines
  Coding regions on vcDNA: vcDNA=SeqID_83005; Strand=-; Position=1 -213,403-714
MASPSDLDMKMVPQNGDFKHDVSEEVQQQQQQQHQEQKQPNDLVKNDEDGGGAEAGQDGTAPTETEQKPSPELESDTTYDDTDTFKMFMGKSLSKPVAVILMRMFDELGLNTDEFDERAVEMLATFPFEQANFILKELKVLLFVHFFFWFTWVGTRGCYFEKEAEIVIRPASGI

SEQ ID NO: 156583 - protein, 29 aa, Heterodera glycines
  Coding regions on vcDNA: vcDNA=SeqID_83006; Strand=+; Position=1 -42,639-686
MLIIYYYLFCYIIKRIVRFMMWSCKTDKF

SEQ ID NO: 156584 - protein, 104 aa, Heterodera glycines
  Coding regions on vcDNA: vcDNA=SeqID_83007; Strand=+; Position=1 -218,1096-1192
  Homolog annotation: Hit_ID=NP_001004193.1; Match level="QueryCoverage= 63%, HitCoverage=21%, E-value=5e-09, Identity=45%"; Hit description =homeoprotein TOX [Mus musculus] gb|AAQ94736.1| TOX [Mus musculus]
MVLQFLEAQFLQQQQQEEDEDDEEEDESEEEEKEEEGEKESNEREGGEENGQKGGEQRDVRNEKGEQDEVAKSWGIEPNRKRIKGRRFSQQTTFEFELSKNNVL

SEQ ID NO: 156585 - protein, 340 aa, Heterodera glycines
  Coding regions on vcDNA: vcDNA=SeqID_83008; Strand=+; Position=1-1023
MEEFAIETTLHILDNNGRTVVATFEHFLDNKRKFVDLVEFWEEDAAIQARLKGVRKTCANGQILEVNKYVQGGMYVFQARILLAYQAAKNHDSDGDFEFICEGHEVVLSPCESATAMVNRMTLFYSNSFSLISSEQSGTGQIWRALLSSSDEQSLPAQITETRHIRHPALKRLEGGQKQSAMLMLDDQPRIVAQQAPPGSGKTFTLAAIVAALLERPDAKFLCMAPLNVAVVKICEELVDALRVEGVAVTPLALFSGNGKGKYRDQLDRISDNLLEAAATSEEFWKKLNEKEQKEVKRYKNMPEKGRELPKRRKLQKLCSQLKAKEFCVAHWVLRNKLAD

SEQ ID NO: 156586 - protein, 174 aa, Heterodera glycines
  Coding regions on vcDNA: vcDNA=SeqID_83009; Strand=-; Position=1-523
IMDRNMIVLDESGQAPFVQVCSVLSPLQEVQKLFITGDRYQLAVNMKDIPEQLRVGFGFDTVLLNTDSSPGVDKTTLEVNYRSHPEIVNCVEYAAYTPHGERLRSGPGIFRMLTSFAKMPIAESPIVLIHQDSPMEAEETSFSATNSGQTRTVIDLLRSWRGFPGSVRVISLYS

SEQ ID NO: 156587 - protein, 16 aa, Heterodera glycines
  Coding regions on vcDNA: vcDNA=SeqID_83010; Strand=+; Position=1-48
MRERRDPCRLFCGMAW

SEQ ID NO: 156588 - protein, 384 aa, Heterodera glycines
  misc_feature (133)..(133): Xaa can be any naturally occurring amino acid
  misc_feature (378)..(378): Xaa can be any naturally occurring amino acid
  Coding regions on vcDNA: vcDNA=SeqID_83011; Strand=+; Position=1 -800,860-1153,2883-2914
  Homolog annotation: Hit_ID=NP_491240.1; Match level="QueryCoverage =100%, HitCoverage=31%, E-value=4e-92, Identity=44%"; Hit description= zn-finger, CCHC type and RNA-directed DNA polymerase  and Integrase, catalytic domain containing protein
KAKLHLKENSNSVFCRARPVPHGVQEAVDHEILDRLLEIDANRSIDFSQWAAAVRKKNGAVRICIDFTTGLNEALELNRHPLPRTDDIFHSLRGSKIFSQLDLRDAYLQLELDDESKALVGINTHRGLFQYQXLPFGVKSAPSFQKVMDQLTSGISGVFVHFGDLIIASPNMAEHLLVQRELKFLGHIVSADGIRPDPSRSAAIREMPPPHDLCTLRSFLGAINYYGRFIKKMRTIRAPLDLLLKKETPWEWGPKQQKLLNRQKAADASQHGIGATAADASQHGIGATISHKFPDGSEKVVEHACRSLTSAERNYSQIEREALGLFFAVRKFHRMVYGRKFVLLTDHKPLLAIFGGKKGIPIYTASRLQRWKMKILNXFFTLNF

SEQ ID NO: 156589 - protein, 74 aa, Heterodera glycines
  Coding regions on vcDNA: vcDNA=SeqID_83012; Strand=-; Position=1 -39,462-647
MCAAFFPIETQTAAREIIIPSFYNVANFPGVIGAIDCTHVRIIPPASAHEKDYFNRKGYPSINVQGTIHIKWTE

SEQ ID NO: 156590 - protein, 96 aa, Heterodera glycines
  Coding regions on vcDNA: vcDNA=SeqID_83013; Strand=-; Position=1 -207,289-372
MVARLIAREQEESAEFSSQQVVVEEGKSYAVLGTVPRGEAVKTPKFESSTSRVPFRSRAGTASTVTAADDVLDDVKTFFTEGREFFRGKHSNEKET

SEQ ID NO: 156591 - protein, 66 aa, Heterodera glycines
  Coding regions on vcDNA: vcDNA=SeqID_83014; Strand=-; Position=1 -176,263-314
VIVHLCNSFASDHLQSPHVMEHTLRCPLLKFSRPTFGIAQSIALPLDVSFPSVHTFPPSPPLLLLF

SEQ ID NO: 156592 - protein, 146 aa, Heterodera glycines
  misc_feature (95)..(95): Xaa can be any naturally occurring amino acid
  Coding regions on vcDNA: vcDNA=SeqID_83015; Strand=+; Position=1 -297,406-578
  Homolog annotation: Hit_ID=EAL43895.1; Match level="QueryCoverage =94%, HitCoverage=71%, E-value=4e-13, Identity=30%"; Hit description =transcription initiation factor TFIID, putative [Entamoeba histolytica HM-1:IMSS]
MQRPIIVNIIALANLGTGIKLNSLTITECEFKYNPRKFNAAVIKCISPIKATALLWESGKMICLGTKSLIDCENAIKIFIEIIKGSGCPGASYTXLNFKRGKSMTALIFWTGKVVITGTKNNSEIEEMYHHILPYLKMAQKNLMRR

SEQ ID NO: 156593 - protein, 44 aa, Heterodera glycines
  Coding regions on vcDNA: vcDNA=SeqID_83016; Strand=+; Position=1-134
MAVVRLRMFAHRTALAAAIRLEQTPHIVNRTFFQNTFCQSLAVR

SEQ ID NO: 156594 - protein, 141 aa, Heterodera glycines
  Coding regions on vcDNA: vcDNA=SeqID_83017; Strand=-; Position=1 -13,186-286,556-867
MPNKAQLKRNIKTMCTTDNEEEKAEPWKKFCKMFSRVQQMPLNASTPVTPKPPFWLVTDPFWRPVVMTMFYTTLVMCGLLFVFVYAYSYSFIACCLVWQTMEELYCNPVMILNSLKRRRKPSLILLYCLANGKRLDLYVCN

SEQ ID NO: 156595 - protein, 141 aa, Heterodera glycines; identical to SEQ ID NO: 156594
  Coding regions on vcDNA: vcDNA=SeqID_83018; Strand=-; Position=1 -13,186-286,557-868

SEQ ID NO: 156596 - protein, 156 aa, Heterodera glycines
  misc_feature (5)..(5): Xaa can be any naturally occurring amino acid
  misc_feature (31)..(31): Xaa can be any naturally occurring amino acid
  misc_feature (155)..(155): Xaa can be any naturally occurring amino acid
  Coding regions on vcDNA: vcDNA=SeqID_83019; Strand=+; Position=1 -132,1425-1553,1852-1985,6923-7003
  Homolog annotation: Hit_ID=NP_494570.1; Match level="QueryCoverage =95%, HitCoverage=11%, E-value=3e-33, Identity=52%"; Hit description =AdaPTin or adaptin-related protein (140.0 kD) (apt-5) [Caenorhabditis elegans] gb|AAB66112.2| Adaptin or
NLRIXNSAGFESRHHQQQQEGIKEESEFSIXIKKTTILLPTFLQVLGYDISWTTFNIIEVMSSTRYSEKRIGYLAAVQAFNDETDVLMLTTNLIRKDLQSSNTDDVGVALIVSGLSCFTTTDLVLDTAEELLKTGKCKFSIICKKAIGFLAHVFXI

SEQ ID NO: 156597 - protein, 164 aa, Heterodera glycines
  Coding regions on vcDNA: vcDNA=SeqID_83020; Strand=-; Position=1 -280,411-724
MPIQQCHLPYSFTYWPKGGIGFPYPPYSTHGQSILRPKRVGPSVHQRNQQLDPVIPTQHILNAALSCSRVLACLFYRLFAAPLSPYPYELYKCPVWQFQLRLGIILQLNGSTKAEEITMSPGITHHWPLAKLSVTFTPSGLPPLPILGSDFIANRSHAALVPEW

SEQ ID NO: 156598 - protein, 57 aa, Heterodera glycines
  Coding regions on vcDNA: vcDNA=SeqID_83021; Strand=+; Position=1-176
SKREFCANLGFGEWLWHLSFVLLYAMMSLPISAVAILFLFSQINCRSSVHLILLGLI

SEQ ID NO: 156599 - protein, 49 aa, Heterodera glycines
  Coding regions on vcDNA: vcDNA=SeqID_83022; Strand=-; Position=1 -18,90-221
MDLHLSLPPFTDFTDLRPEIFVHPSYGSKEDLLNLLNPKHIRQVKKGRN

SEQ ID NO: 156600 - protein, 37 aa, Heterodera glycines
  Coding regions on vcDNA: vcDNA=SeqID_83023; Strand=+; Position=1-115
FNFAFALKIKTKKNLFSFGFTLNFSAFLAPDHFWGIS

SEQ ID NO: 156601 - protein, 520 aa, Heterodera glycines
  misc_feature (406)..(406): Xaa can be any naturally occurring amino acid
  Coding regions on vcDNA: vcDNA=SeqID_83024; Strand=-; Position=1 -193,947-1019,1117-1187,1235-1342,1412-1437,1489-1642,1697-1728,1797 -2002,2061-2275,2390-2683,2745-2777
  Homolog annotation: Hit_ID=CAE56301.1; Match level="QueryCoverage =94%, HitCoverage=35%, E-value=1e-130, Identity=51%"; Hit description= Hypothetical protein CBG23957 [Caenorhabditis briggsae]
PLVPSPQRCPSDSVVYSSQLIQQPLYQIYYLRPAAADPLRLAASSSPSASISASDPSSSILTTPVRRERLLGGSKYGSQRSLWCELPEVKEAGLLVKEAGLLDQLDDGQKKLQEAYFEVITSEASYVITSEASYLRSLSFLISHFMSSPELLGSKSDRSIITTSERKHLFSTSERKHLFSNIVNIVAIRDCSERLLCDLETRLKDSLVLSELCDILCYYYECHFSPYISYCSNQVYQDRTLKALKVYQDRTLKALKSNSLFLACIQRLETDRQCQGLDMRSFLMLPMQRITRYPLLIFAIRERLHPDKIQHSVATRALTLANQVVHNCNEGARKMAVHNCNEGARKMAQTEQLLEIDAKVVYRGSELRRVPLVSSGRYLVKSGRLSQLVVERRGTSALKTRHLVKXRMLFLFSDLLLVTKGRTNGTFVCKDYALRRFVFAEPLEANDARVPLRALHAIGSSSSNLHLILCTLAQNARGKQMELLLNADSESDRERWLTAMRPPTSAKGESAKGEERVPKE

SEQ ID NO: 156602 - protein, 354 aa, Heterodera glycines
  misc_feature (352)..(352): Xaa can be any naturally occurring amino acid
  Coding regions on vcDNA: vcDNA=SeqID_83025; Strand=-; Position=1 -104,148-255,323-377,423-513,574-703,768-876,1010-1165,1217-1242,1287- 1351,1404-1446
  Homolog annotation: Hit_ID=NP_497206.1; Match level="QueryCoverage =98%, HitCoverage=54%, E-value=1e-140, Identity=37%"; Hit description= nematode-specific EB region and pancreatic trypsin inhibitor precursor family member (171.6 kD) (3B124)
YRYFNSQSQECSSYQYNGCDGNSNNFATRDDCESYCGVGSYCGVGGCPNGGTPERNEFGQLIVCGTGVNCPSTHECTSVTTGTCTSVTTGTSVINRCCPTRAYICSLPPQQGATCSYICSLPPQQGATCSSSASSRYYFNIVTKECTQFTTQFTYNGCSGNLNNFGTIEQCNNFCLSAACTPGDVAYVNPNTKLPFECNSALSNSCPNNFVCTYDPLSTNSVCCGATNMGVCPEGEKAYVNALDMSVRECLINVDGSCPSNYLCRFNAPKNRYYCCASISGDLCPIGKALLCPIGKALYRDPSSKYRDPSSKMAVRCAINGPNNPCPPTYSCQSPTYSCQSEVQSAFQGEGXRG

SEQ ID NO: 156603 - protein, 208 aa, Heterodera glycines
  Coding regions on vcDNA: vcDNA=SeqID_83026; Strand=-; Position=1 -117,163-276,711-778,827-1046,1187-1294
EGIYRLIHIFRQSGGSFSKIDLLEKKYSDNYGTRLNSTERNRLLGAPAATRIAKDSFSKAAYPGLFRVTERMANYYGPKPADDIPQFTHFCGQKIESVLSAYSDLLESLKEPPLSPPFTVGQFVLFRHDKLGMCHGTVVRQDSQHLVVKHLVTQDAHYVKMEAIFAFPDQLLKECSTNSRQPRSEMASHPGTQLAFAVPISEQFFHHF

SEQ ID NO: 156604 - protein, 114 aa, Heterodera glycines
  Coding regions on vcDNA: vcDNA=SeqID_83027; Strand=+; Position=1-345
MTREYADSEILEFVSAGPKQYALKLRRKKDGVIWHKTKIRGMTLDRRNEFKYDLFKEMVLDYKKGVKKVFHYPEKIGPTNDFRVLSKDVQKEYTPVQKKGIIDDHFNVLPFGYY

SEQ ID NO: 156605 - protein, 166 aa, Heterodera glycines
  Coding regions on vcDNA: vcDNA=SeqID_83028; Strand=+; Position=1 -405,552-647
MSKKNFQETSKEIRRSKNTKNYFKNSANLGKCFEEVESHIKENKKFGIKEHVTTFYFKCPENEDPEKMFKKILKKLMGDAMSREDEPGWKIEKISVDLYCSALSDPVIIPARPFQQSNPDIVFNEFMHRQQSFGELKCIRFKNILWRLSKKKIFSGRKTEQKWRHC

SEQ ID NO: 156606 - protein, 194 aa, Heterodera glycines
  Coding regions on vcDNA: vcDNA=SeqID_83029; Strand=-; Position=1 -7,203-322,381-464,1051-1253,1580-1750
  Homolog annotation: Hit_ID=AAS47831.1; Match level="QueryCoverage =40%, HitCoverage=29%, E-value=6e-09, Identity=41%"; Hit description =metalloprotease IV [Ostertagia ostertagi]
MNNSCKGHEDKCQNGGYLNPNDCTKCHCPDGYGGQYCKELEENLNCEDLSGIPRELVANQSAVLLKTKAKCNVKLIKSSKCRYAGNLYAEKRNPGSGTLQCYDAVKQKYNDCPCSDGDKKCLTEEKWSHDHFVCPILKKAEGGTVSFWGYSKPNTKEIIRVDEVHCLQAWAVAEVPKQSKSLQVEEQPPAVGKN

SEQ ID NO: 156607 - protein, 320 aa, Heterodera glycines
  Coding regions on vcDNA: vcDNA=SeqID_83030; Strand=-; Position=1 -86,398-569,1180-1378,1432-1544,1592-1727,1809-1919,1966-2026,2165 -2247
MKDPEGPPSEKHRYFDACNKVPTEEKCENSEELIGCYKSSKKWPGNSPIAEMCQKHLEGISDGADANANVAGFIVKICAHRNENDLSNGIGTILKDISPQMVNGTLVKIIHFVPPSDDDKMHAFFQIERPIFSKRIINDTDLLPYQDDPNRFNSLDPCDEYGADCVPIRNLLLKIEALANCGKNESKTNAIFKKPDWAPLPPEMPWKKPSETLLCGGDMFCDKRRLQQQYNRLRKICGLQPEEVESQRKKRQYNPFEKWTEFPIKIAFNKDALPKDGYQSWKHAIEIGADLIMEVTCVRFEFVDKMVKGQNGIAVKNGVG

SEQ ID NO: 156608 - protein, 105 aa, Heterodera glycines
  Coding regions on vcDNA: vcDNA=SeqID_83031; Strand=-; Position=1-318
MNLIEFMTASTFPCCAPVTSICNPFGCLVWRSVYTFGWHFFKFGTFKNIMPFKKKVCLLCLELALPARQVLVFKKADSTLPNGTYKSSPIQNGKMPKKWRAMAPI

SEQ ID NO: 156609 - protein, 171 aa, Heterodera glycines
  Coding regions on vcDNA: vcDNA=SeqID_83032; Strand=+; Position=1 -186,322-651
MLFAIGNLFLGFTRNNPFGSPGELKNMLIDYSKSEWFEQNTNAMETVLQLWQKFPKTALLVTNMLNVDRKNRLTAKGILNYIKGSCQIGEFREVKSSKDLRIFNSVKFGEFLNKLRIIKLKNKAKCLIEKYRELNGTYKKIKIMVKKVIEEQQMEIEEKKNPEKLDDCETN

SEQ ID NO: 156610 - protein, 60 aa, Heterodera glycines
  Coding regions on vcDNA: vcDNA=SeqID_83033; Strand=+; Position=1-189
VLFIVRSLESQLSLALQFRHFFSLKKGKRAPNSIFPTHFEPFYIDSDRFKAFLSLGPMIN

SEQ ID NO: 156611 - protein, 390 aa, Heterodera glycines
  Coding regions on vcDNA: vcDNA=SeqID_83034; Strand=+; Position=1 -495,577-684,740-1278,1782-1812
MFSAKSQRRAWAPRAALNNGTSKNGTNFGDRRSLPVNTSFRGTYSWGPTNGKAKNAVKGSNGSDTLPIGDNSPKEAYCTVEEIQLGKRHSKSPIMDNGMGTTRQIQWRHKTEEGEGKSEQGQDELEENHYEDGDEGEERNSGGSSSREQAEGGGRHGKGTAQMAKALPPRVPPLPPPLPPPKLFGNGKSEMKPRPKSNLTRFWPALAFLAFCLILLSIAFLSLWVANNNSEKRHKSQINWPLRLVPVLKPSSTTHATTPKGRGKLIAQREEENEDEGTDEDGEEEGAEKGALASEESDQQSKGAAARPMQSETPAPPEGTTALGGDQQQQNAVESCSQILCSSAKENDHQFVAQPEEFVRWIADGQMRKRLRLFEVRERNSCSVWTVPFC

SEQ ID NO: 156612 - protein, 269 aa, Heterodera glycines
  misc_feature (1)..(1): Xaa can be any naturally occurring amino acid
  Coding regions on vcDNA: vcDNA=SeqID_83035; Strand=+; Position=1 -125,176-320,434-593,641-778,837-976
  Homolog annotation: Hit_ID=NP_498593.1; Match level="QueryCoverage =99%, HitCoverage=99%, E-value=4e-47, Identity=40%"; Hit description =haloacid dehalogenase-like hydrolase, similar to Homo sapiens GS1 protein that escapes X-chromosome inact
XMASITHVVFDLDGVLIDTERHYTTANERTLEKFGAKFTREMNLKIMGRKKTENLKIMGRKKTEAVTVLLKDAGIADRVTMDQYIAEYDKHVLQIMRALTELPGATKLIDHLYAHNIPMAICTGSDNEEFASKMLKFDEWLKKIPLRVLCGSDPEVRIGKPNPDAYEVTIVRIGKPNPDAYEVTIGRFAAKPTSPKNVLVFEDSINGVESALGAGFQVVMVPQREFQVVMVPQREFLPNDSEKELRSRPTALLDSLDNFCPKQFGLPDY

SEQ ID NO: 156613 - protein, 418 aa, Heterodera glycines
  Coding regions on vcDNA: vcDNA=SeqID_83036; Strand=+; Position=1 -501,1153-1413,1513-1869,2339-2409,2464-2529
  Homolog annotation: Hit_ID=AAH08931.2; Match level="QueryCoverage =39%, HitCoverage=39%, E-value=9e-18, Identity=34%"; Hit description =SETMAR protein [Homo sapiens]
MNANKEHAHKLLHQQFKKGEKAARKVNEFLGAYVISPRQAQKWFQQFRAGRNSTKRKLGSGRPSTVDKNVLAQRLRRHPESSCAELSVGHCHKTTAWRWLRKSGRRPMRSKWVAHRLTDQQKQRRLNLCLSNIARHRRGYVLNRLVTCDESYICYDGTAQKIVWRKKHIFPPEQSTEEAEKEHSLSDDSETLICKDCMDKYAFLGFYVKVPSTNEEEMSTSQNRNAEEQRDDVCKLEAMKKKGEKETGKSVWMENLYEDLDCSFLLEPEDTLAHFEQQNREKASQKDGAKDIYQMVVEETKEHETALKMMVGFEQMKRHCKEFLHKRADEKSGLITGEDVEQCFAELRAKRMKLEEEPQQNEPNSGGDGPWTQGRHKKTQKFRNKLQKLIKPTDDRIKDEIRVKKPPKEDENALKIKE

SEQ ID NO: 156614 - protein, 142 aa, Heterodera glycines
  Coding regions on vcDNA: vcDNA=SeqID_83037; Strand=-; Position=1 -47,107-435,1009-1061
MSDNRNEAEQKMAKAIFISADCWLCVYDLLPASQLGLGIAMISHRFDFYVDEHFKTRRWNLGSMKIKMKFEADGTKEMDVVNANLESFGITQKPLPKRVVGFKAISLKRDFDTFLFCKTIPSFFTGILHGFISRQFHRCHSH

SEQ ID NO: 156615 - protein, 15 aa, Heterodera glycines
  Coding regions on vcDNA: vcDNA=SeqID_83038; Strand=+; Position=1 -27,365-385
MAEEEQSLKTKIKQK

SEQ ID NO: 156616 - protein, 156 aa, Heterodera glycines
  Coding regions on vcDNA: vcDNA=SeqID_83039; Strand=-; Position=1 -98,175-347,577-776
MLFKKIGTGLGFLYIFLTYLGITCYTYFETFLSKKHWCKSLLDNKLLNNKTKLTQLINGKIPLWPKQINEILSRRCDIDDNFKKEVKCPKGLMAATLDPYFTTFVKNSPKKACDNKKLVSILRVNFQVPTPVPAISKLGTAINTYLPPISQCWNIC

SEQ ID NO: 156617 - protein, 148 aa, Heterodera glycines
  Coding regions on vcDNA: vcDNA=SeqID_83040; Strand=+; Position=1-447
FFVSANAAAGVALTHDAVLRELGAALTLRKEQCLRRERRALARARGLPDEAAVPAEELDRTPFAAAAAACRDATTIVAPATAAVMMTALNQAALMPSAEAVAAQRVAILSAGGGAALHQRDKMEQFGDDEEDEEENADDDEAGTQKQR

SEQ ID NO: 156618 - protein, 283 aa, Heterodera glycines
  Coding regions on vcDNA: vcDNA=SeqID_83041; Strand=-; Position=1-852
MSKSDMISREKSEIKIRSFKFHELAPITANFGNWESMNPKVSGIGMPNKKLSGIATRRFKNVGNWQPNQKMSGNGSPWVQNAGTGISKCREFESMDSKILGIHFQSLWQYHFLVRSEFIRCALLALSRDLRRREHLAFCRNLALILNTVRATTTSVPLCVPNVYGRTSSRTNANNVLISSADLAVASRASMCRAQLEWALERRVKIGIWNCVRVSCQSEFCAFLRLQPSPDDGGADSAWPPPPDVVKCVEQVAVSLRHALEGAVAFRGAPFLQGNGKHLWAPI

SEQ ID NO: 156619 - protein, 109 aa, Heterodera glycines
  Coding regions on vcDNA: vcDNA=SeqID_83042; Strand=-; Position=1 -236,701-740,1581-1634
  Homolog annotation: Hit_ID=CAF96184.1; Match level="QueryCoverage =90%, HitCoverage=27%, E-value=1e-30, Identity=56%"; Hit description =unnamed protein product [Tetraodon nigroviridis]
YCPNCKTHRRAFKKLDLWTLPQILVIHLKRFSYGRYTRDKIETELELPIRGLDFSDKVLNPEHSQEKYDLIGISNHSGGLGSGHYSACALNGGDGPWKFGIFSGLGSPG

SEQ ID NO: 156620 - protein, 84 aa, Heterodera glycines
  Coding regions on vcDNA: vcDNA=SeqID_83043; Strand=-; Position=1 -163,393-481
MSKHQKSAVTPPTTTTTAAESGGEGDGRTETTSGQRKRHSANQTDSANGAAGGQGSNNAVVLSSSESAAKEAKVRKMSTTSQNK

SEQ ID NO: 156621 - protein, 42 aa, Heterodera glycines
  Coding regions on vcDNA: vcDNA=SeqID_83044; Strand=-; Position=1-126
LCPNGQRTSMCRNCRHNHHLTASRSGQFVCDQNAAGRALGDG

SEQ ID NO: 156622 - protein, 96 aa, Heterodera glycines
  Coding regions on vcDNA: vcDNA=SeqID_83045; Strand=-; Position=1 -67,1864-2086
  Homolog annotation: Hit_ID=CAE71733.1; Match level="QueryCoverage =95%, HitCoverage=7%, E-value=7e-27, Identity=61%"; Hit description =Hypothetical protein CBG18715 [Caenorhabditis briggsae]
SQQIKGETNEFSFKIIILPLNPNLCSLLPSASNGLNPIWQERFVFHVRHPEMALLRFHVEDGDFVGPKTDPFIGQAVFPLDSVRCGFRSVPLHFEY

SEQ ID NO: 156623 - protein, 190 aa, Heterodera glycines
  Coding regions on vcDNA: vcDNA=SeqID_83046; Strand=+; Position=1 -132,438-761,1312-1427
MKRNGAEAAADGVERKHGLANERIRLRTDEIAVFHMKAQQCHLRKLEVGLPVGVAQPKCQRVEPSGHLEDEALGLEQSQDEEGHPAAKEHRHHHAQRLSGFVLTLTVLRFSKSAAGKDADYGRGGGGIGAQLTEGTKMRSEKRRGIDRDMCTQENRLSLALSRYYFGIASLAIGEPKKGRGKEQALTLPN

SEQ ID NO: 156624 - protein, 52 aa, Heterodera glycines
  Coding regions on vcDNA: vcDNA=SeqID_83047; Strand=-; Position=1 -144,577-591
MRGIFFSALFYAVPTLTRRIRETTMVFITAAQFWAPSTIMLDFSSQWSLSSF

SEQ ID NO: 156625 - protein, 164 aa, Heterodera glycines
  Coding regions on vcDNA: vcDNA=SeqID_83048; Strand=-; Position=1-495
MNDKIDWLGRFDLWDSTHQQFNLWGSILRHSKQWDSNLPQSKHWDSTHQLSMTFQSLGLNPPAFQSLRLNPPAFQSLGLKSPAFQTRGLNPPAFQSVGLKSPAFQILGLNPPAFQSLGLNCQAFQTRGLNPPAFQSLGLKSPAFQSLGLKPPAFQTLELKSAAF

SEQ ID NO: 156626 - protein, 106 aa, Heterodera glycines
  Coding regions on vcDNA: vcDNA=SeqID_83049; Strand=-; Position=1 -64,128-384
MTIVSTVIIYALIALIIHCRKVPSNSSAAQFIKRIFRSLFIIVFFNFGGYIISIFAVILLESIDIDHNSIFLWNCKQIMGILLHFSAASCGPILFLTRQKLNLLLI

SEQ ID NO: 156627 - protein, 35 aa, Heterodera glycines
  Coding regions on vcDNA: vcDNA=SeqID_83050; Strand=-; Position=1 -68,120-159
MNLMTTFLTTKRKSWVLISFHFQNCGPEQRLLRQK

SEQ ID NO: 156628 - protein, 184 aa, Heterodera glycines
  Coding regions on vcDNA: vcDNA=SeqID_83051; Strand=-; Position=1 -426,523-649
MPQINFVIILFIFLFVLIDGIDEDLFDDLWKNQKPSTSKNFKKQKFGKNYAIKEEIVDNNEIHEQQNFNKIKMEDIKPKKLQNIKKEQLEDENNNLKIKVPKIELDKLNEDPFEKEFNEQVDQNISYAEQSNSANEEAYNNTNRETRNKMEILNEFNLMKRNLRKKVFIKICPILHWECEIGKK

SEQ ID NO: 156629 - protein, 65 aa, Heterodera glycines
  Coding regions on vcDNA: vcDNA=SeqID_83052; Strand=-; Position=1 -98,995-1094
MDISNEFNFMKKELRWNYKIMPIIKFEREIAKKIYSVKEDLGVQNSDGAIIKFSDAQFNLIFYLI

SEQ ID NO: 156630 - protein, 50 aa, Heterodera glycines
  Coding regions on vcDNA: vcDNA=SeqID_83053; Strand=-; Position=1 -58,815-909
MKLPLPVCLVPVPPVKICTDFFNADPEKQYFKNEMGLDHLYFDQIVNMVK

SEQ ID NO: 156631 - protein, 17 aa, Heterodera glycines
  Coding regions on vcDNA: vcDNA=SeqID_83054; Strand=+; Position=1-62
HKHLFDLFYHIHNLIKI

SEQ ID NO: 156632 - protein, 178 aa, Heterodera glycines
  Coding regions on vcDNA: vcDNA=SeqID_83055; Strand=+; Position=1 -271,355-620
MSFLFGHCPFSLSLFCFFFFLCFSLLVLADEFAENGQNGALKSQSQPKERRLRNRPRDFLSECVTGYRERIEFHCQFPNMDKPCLRENAEDSVHQLDVLAAECCASPRLCSVDDIESFCCRTMDCLGLCYGDSFLAQIQSRFRYADILLKRHSSKGAEKRGRRTTEEEEEEKRDEEEE

SEQ ID NO: 156633 - protein, 407 aa, Heterodera glycines
  misc_feature (240)..(240): Xaa can be any naturally occurring amino acid
  misc_feature (374)..(374): Xaa can be any naturally occurring amino acid
  Coding regions on vcDNA: vcDNA=SeqID_83056; Strand=+; Position=1 -212,268-335,428-473,564-714,770-922,1005-1165,1225-1344,1410-1639
  Homolog annotation: Hit_ID=NP_510681.2; Match level="QueryCoverage =83%, HitCoverage=17%, E-value=2e-64, Identity=42%"; Hit description =OSMotic avoidance abnormal OSM-1, g-protein beta WD-40 repeat (osm -1) [Caenorhabditis elegans] gb|AAA8233
LAQLGHSQTESSFLQLIEVELIEGSPIDWLELNERANKLLFRDLRAALHLYSLENGITTHLVGHCSYVQWVPVPRSDVIVAQSNEQICVWYGKILTERVVHFTTERVVHFTVQGEVEQVARVARDLSRTEVIVLESVQRVAYELDSALIEFGTALDELDLGRAVAFLEQSVSGIDVQTMWRRLAQSGIDVQTMWRRLAQVALQHGQLMVAQRCFASLNDIVRVQFLQQTQMRAERLFINXKNKNDQMRKVRARLAMMAKQFKMAERIYLENNATAEAIAMWQRMGNWDQALEALELAKAVNWADLDQLQAKHQLWLEETGQMGKVAELKATQGGLLHEALEMFLSANQPGKAADLLENKQMLQMEAERVGKRQXKSKRLNVLNSSEEGDEQPMVERIYSSLAQRTAG

SEQ ID NO: 156634 - protein, 131 aa, Heterodera glycines
  Coding regions on vcDNA: vcDNA=SeqID_83057; Strand=-; Position=1 -110,199-484
MTRNRNSFNNKMEGKGRTELPFFRDLFSRCYAQKTGPTFPPLVQTLRRLPISPQIFVVPMEIDGKRQGDTIRKQSQNHCEKIEFIHFFINVALFGNCHINGLLQQLVLIQQFDSRIATQTFGPLVSNLKMQ

SEQ ID NO: 156635 - protein, 246 aa, Heterodera glycines
  misc_feature (4)..(4): Xaa can be any naturally occurring amino acid
  Coding regions on vcDNA: vcDNA=SeqID_83058; Strand=-; Position=1 -168,247-336,587-719,790-942,1519-1711
  Homolog annotation: Hit_ID=AAA79337.1; Match level="QueryCoverage =91%, HitCoverage=66%, E-value=8e-48, Identity=49%"; Hit description =CeMEF-2 gb|AAA79336.1| CeMef-2
QNVXCLCFILSSMCPKFQVTFTKRKFGLMKKAYELSVLCDCEIALIIFNSSNRLFQYAYASTDMDKVLLKYTEYNEPHESRTNTDIMETLQRKEGKQGVGADSDDDGFSPPASPSLPATVGGGGGVAQLANGALASQMAALSGSAGTAAAFTQSQIATLAATAAQYANGQQGECQNLKKKTIFRHEYVLATSTTAEAATATTTTTAATSCTKNCTPPATATTGGKEGRPGNFSDGDPDQIPLISRS

SEQ ID NO: 156636 - protein, 97 aa, Heterodera glycines
  Coding regions on vcDNA: vcDNA=SeqID_83059; Strand=+; Position=1 -188,643-748
  Homolog annotation: Hit_ID=AAM69111.1; Match level="QueryCoverage =98%, HitCoverage=18%, E-value=4e-15, Identity=40%"; Hit description =Glycosylation related protein 12, isoform b [Caenorhabditis elegans]
MARTAYYGVVPFYQHGVQLFAVHTALNWTTDFDARNSSEIYLTEWDLKSKFLDFAETYCVPKKWTGNCDPYDPKMRAWFAAKGWTKRLESWLPVTVF

SEQ ID NO: 156637 - protein, 17 aa, Heterodera glycines
  Coding regions on vcDNA: vcDNA=SeqID_83060; Strand=+; Position=1 -10,98-141
MRPKSALKHTKLYLQVN

SEQ ID NO: 156638 - protein, 95 aa, Heterodera glycines; identical to SEQ ID NO: 136988
  Coding regions on vcDNA: vcDNA=SeqID_83061; Strand=-; Position=1 -722,892-1100

SEQ ID NO: 156639 - protein, 130 aa, Heterodera glycines
  Coding regions on vcDNA: vcDNA=SeqID_83062; Strand=+; Position=1 -225,758-868,1069-1125
  Homolog annotation: Hit_ID=NP_505132.1; Match level="QueryCoverage =71%, HitCoverage=28%, E-value=2e-13, Identity=40%"; Hit description =predicted CDS, aspartic protease family member (5I746) [Caenorhabditis elegans] pir||T29409 hypothetical
MIVSKKITLDDGTTINGTSAATVDSGTSFLIGPFDEVNNILRHYGVDPENSTMPCDQKFGPIIFTIHGQEYKVEEKTLLFDKGDGTCFVGLRTLNSIPFWLLGDPFCREYCQIHDVEKKQFALPQAMKEK

SEQ ID NO: 156640 - protein, 149 aa, Heterodera glycines
  Coding regions on vcDNA: vcDNA=SeqID_83063; Strand=+; Position=1 -304,455-516,585-668
MMLWEDAPNNANRVLLFNALAICIKKVIGEYDAKSMNTNLDKLKEFGEKTSQNMLKCMARLSSKNRQIKDQFLAKLYLDKITKLIEEDAISEQLEKALREKNELLYELMGSEDVDKLEQLYKQNHSYFLPSENFISSDEETFHDAVDDK

SEQ ID NO: 156641 - protein, 436 aa, Heterodera glycines
  Coding regions on vcDNA: vcDNA=SeqID_83064; Strand=+; Position=1 -568,939-1230,1309-1759
  Homolog annotation: Hit_ID=CAE70527.1; Match level="QueryCoverage =37%, HitCoverage=40%, E-value=7e-10, Identity=26%"; Hit description =Hypothetical protein CBG17156 [Caenorhabditis briggsae]
MNESEGQQSNLNNESEWSSEKNSSKIWEQNLSEENAKKIKDEILGLKTETNLWTQTDQYRKGKSKKLKKIYKMEDKMGKSEEENSSKKDKQNLNSNAETKGQTSKKLEENSNLNPSMLINTEKTHQMLEGKNQSEAKSQKAEKKLKKINKKQPKSGNHEEKGQNISKNDDIYPTDCTMLMGQLGIYKIRDLFNDSLMRKLHISSLENVFYNECEKYLGISAFALAIEANLEFNKFCHENYAQKSEFEQLEKSWAKFITTELDRFEGTQFLLEKLYFVLNELIEFSFDPSNNQFIEKGLAFMEEPQLRLIGKCKENEMDKIGKNSPNSEKETPKRESEVKSSQFGHYSTDKFELMITVLQEDIFNIIKAKNEIEKLEKKENETEKWENEWQEKFGANKTFNKNLFDLYEKAIKQIVAMQKLGIIKQLIIYFIHKLTN

SEQ ID NO: 156642 - protein, 150 aa, Heterodera glycines
  Coding regions on vcDNA: vcDNA=SeqID_83065; Strand=+; Position=1 -37,351-533,684-760,805-864,1149-1244
MTVGYISVRCFEDFASKHNLSVLIPSSELANFKCRSLVVDFELIIKKYGIDLIVATTGAARDKLARLLVRFCSDSNFASTIRKFMEKNRDKMSQIFADLEKEKEKRKDQMLSEEESLQIPNRWSVSKSQIGLLILEPDYRKAAVIGNING

SEQ ID NO: 156643 - protein, 29 aa, Heterodera glycines
  Coding regions on vcDNA: vcDNA=SeqID_83066; Strand=-; Position=1 -72,269-286
MGNFWACVATVMRSRAVPWCWWHKKCVID

SEQ ID NO: 156644 - protein, 119 aa, Heterodera glycines
  Coding regions on vcDNA: vcDNA=SeqID_83067; Strand=+; Position=1 -126,435-512,1109-1264
  Homolog annotation: Hit_ID=AAP30776.1; Match level="QueryCoverage =100%, HitCoverage=42%, E-value=5e-26, Identity=58%"; Hit description= putative gland protein G34B08 [Heterodera glycines]
QTPPGSPKGGHGNNKSPTTPHSTKRETELIIEKGNQQNHATGKPSPDSPKRETELIIEKGNQQNHAAAASHLVPPTPGNSPTAHDSRHTGPKVAHVAAAANLGQGHQESANVSRVDDVT

SEQ ID NO: 156645 - protein, 52 aa, Heterodera glycines
  Coding regions on vcDNA: vcDNA=SeqID_83068; Strand=+; Position=1-198
NRKNVAIKSFKFKTKIKTIFLFRAFHTLPVSREKIMDCCHIINCQPYKSHFF

SEQ ID NO: 156646 - protein, 100 aa, Heterodera glycines
  Coding regions on vcDNA: vcDNA=SeqID_83069; Strand=+; Position=1 -105,349-546
MANSSLMLPIFSLFVVLIVIQFYATEQSSISVDLAQLDRQISEKKQRADQLRQQIASEKNPVIKQSDTRTLQAILEEINKLEAQKKSFQNTDQNARNNLG

SEQ ID NO: 156647 - protein, 89 aa, Heterodera glycines
  Coding regions on vcDNA: vcDNA=SeqID_83070; Strand=+; Position=1-270
MAEKQKIGPVLAAIVRGMQREESSVHVRLAAAKALSEIVDWVATRTLEEHVDAIVDATCAFLWVFFSHIFNGCLRQGHTTELGMDEQIC

SEQ ID NO: 156648 - protein, 122 aa, Heterodera glycines
  Coding regions on vcDNA: vcDNA=SeqID_83071; Strand=-; Position=1 -76,128-238,1587-1748,2680-2699
MTFFTALQNIAAILVSFAFLPHFCGALKCAWGSTGVKDDLPFRVQDCPSAKNLYCYKGNCTAADSRFFVMGCEDLNNTDSINERMVQQISTPNFAAKWECHVVVGDTNEPMPFPMPGGVKKG

SEQ ID NO: 156649 - protein, 50 aa, Heterodera glycines; identical to SEQ ID NO: 142711
  Coding regions on vcDNA: vcDNA=SeqID_83072; Strand=+; Position=1-186

SEQ ID NO: 156650 - protein, 153 aa, Heterodera glycines
  Coding regions on vcDNA: vcDNA=SeqID_83073; Strand=-; Position=1-462
MGLPESQKQKPSKRVAEDRTAISGVLDKLGIESPITVYRMGSPDQTKTGQNRPRLMKVIFGCSKHQKQTLAQWKAQWNKVRAQINQKMGMSNIRIRPSLSQEELKARRVLQEECSRKRKEDGGEWVVYADKVMLTKGGGQVSVGFQNETWLGG

SEQ ID NO: 156651 - protein, 108 aa, Heterodera glycines
  Coding regions on vcDNA: vcDNA=SeqID_83074; Strand=+; Position=1-327
MSSQKPNKQDNDVMFVVSEPDWAVYDENERRRAEHKRLRREEQSRFRIHSLYICLLFVCLLAAQWTALWQLIGFTTPTLNINSLEPEAEEETKTTNRATLPLLMASTG

SEQ ID NO: 156652 - protein, 27 aa, Heterodera glycines
  Coding regions on vcDNA: vcDNA=SeqID_83075; Strand=-; Position=1-83
NSALVLIWQKIKPFFLRTHWCSIHLTK

SEQ ID NO: 156653 - protein, 154 aa, Heterodera glycines
  Coding regions on vcDNA: vcDNA=SeqID_83076; Strand=-; Position=1 -53,105-165,216-366,510-616,659-751
MTFKAEIIVKNKKKEPTIKFQAEDKLMVNGKVMNVNKYLLAAHSVFFKILFFEFNEKMPKIEIDNDKNAVGNFEKLISFMNSPNAELEVVFCCESLCTFFGPKSKKPFIHKFLLAHQYNFIGMKKKISEEMSWHIFYLTVEDIFPILIISLKNS

SEQ ID NO: 156654 - protein, 76 aa, Heterodera glycines
  Coding regions on vcDNA: vcDNA=SeqID_83077; Strand=-; Position=1 -78,887-1039
MSDFSAFIAFVSFLGRIFAHVCLTTAILKKLEWYGTGNFGCKTGTGTCRDPRSQDRDRDLGFCPGPGLETGTNREY

SEQ ID NO: 156655 - protein, 199 aa, Heterodera glycines
  Coding regions on vcDNA: vcDNA=SeqID_83078; Strand=-; Position=1-600
MYLLLIKILSNALIMFIFVSALQAPQIFVCFKCRDTCINAFYVVAPLLRRYIDQTVIEFFRLNKQIFDRRGTKLKLHASTGTAIWDVLVREIWPIFAPTIRHLAFYSPANLNNLRSFVSPTILTDLTQLKSINSYRLFPAPIAYDGKNATAGEVLSKWLHTPTTDGQPKHLLCRFTGNYASRGQELVNKFKEVVHLLSP

SEQ ID NO: 156656 - protein, 291 aa, Heterodera glycines
  Coding regions on vcDNA: vcDNA=SeqID_83079; Strand=+; Position=1 -863,3278-3299
  Homolog annotation: Hit_ID=CAE56395.1; Match level="QueryCoverage =96%, HitCoverage=36%, E-value=5e-45, Identity=38%"; Hit description =Hypothetical protein CBG24082 [Caenorhabditis briggsae]
DVSAQKWGNNIKRVNTRVPTFEAHKYLWSLKAETNINIIKAFDNIFMRSKYIPWKILTDQGKEYSSFSKKYFDTKDVEHFCMLTSPQFHAGMAERANRSIKERLYRYFTERDTYKWIEVVQDIVKGINQSINSSIGMRPADVNFENAEELRQKLYNEAKFPKKSPKFKVGDRVRIEKYKHVFQKGYLPRFTDEIFTVAEVHTERSPVVYRLSDDSNEIIKGWFYSNDLCKILKNKESLYDIEQILKKKKQNGIEYVLVKWKGYSIKFNSWVPLSSISEKNYKNFIDDSCFE

SEQ ID NO: 156657 - protein, 70 aa, Heterodera glycines
  Coding regions on vcDNA: vcDNA=SeqID_83080; Strand=+; Position=1 -199,400-413
MGRCLFAAGGQCEKTVLQTKTATVASSVARMATPRATAPTPNWWPNFKSSSFFSNIHCCHGNAEEGGVPL

SEQ ID NO: 156658 - protein, 81 aa, Heterodera glycines
  Coding regions on vcDNA: vcDNA=SeqID_83081; Strand=+; Position=1 -37,146-354
MNNCFLLYLGAPASAAERHHTFITKKVFILIGFPFFAYFWHIEQPSPIFYIFWHLNQSSPNFVHFLPHLINNRAYLMFDRL

SEQ ID NO: 156659 - protein, 67 aa, Heterodera glycines
  Coding regions on vcDNA: vcDNA=SeqID_83082; Strand=-; Position=1 -101,1027-1129
MKLFTPLYVGPIVLNFLLKLMVCRSSRTRRTRIISGPTGSTKCSYRPLKLCPIVALVPTPLLTNCDQ

SEQ ID NO: 156660 - protein, 81 aa, Heterodera glycines
  Coding regions on vcDNA: vcDNA=SeqID_83083; Strand=+; Position=1 -98,457-478,536-659
VDVFSEKMNGTLKAKNAIADANITCGLNSNFYFGWSTCMKIAFYGDDGYEKHAAKYGLEQTEGPEENFKNMTQFDKYGFMH

SEQ ID NO: 156661 - protein, 73 aa, Heterodera glycines
  Coding regions on vcDNA: vcDNA=SeqID_83084; Strand=+; Position=1 -105,172-204,432-515
MLDLTNNDNYDRSGQYIDAKLVKMEPKIVSPPKPTEKPDVVEPVEPKSKEEEGEIMFDEKSKSEDDELEEKKK

SEQ ID NO: 156662 - protein, 76 aa, Heterodera glycines
  Coding regions on vcDNA: vcDNA=SeqID_83085; Strand=-; Position=1 -194,572-608
MAFCLINDDDDDPSPKRWGVLLLGIRQNCPNFVLLGWHYEEEMPKMERSKIKLERKKQMTTIFCCLRQSSVSLFIC

SEQ ID NO: 156663 - protein, 39 aa, Heterodera glycines
  Coding regions on vcDNA: vcDNA=SeqID_83086; Strand=-; Position=1 -49,269-339
MALLDTEMNDNDDDDDEAYFNFRHVTQYSDVINLTDLNI

SEQ ID NO: 156664 - protein, 45 aa, Heterodera glycines
  Coding regions on vcDNA: vcDNA=SeqID_83087; Strand=+; Position=1-140
TGQDRDPSFFGSDSGIRPVKKQPNRNAENFLIFIPNPVPEAILEE

SEQ ID NO: 156665 - protein, 181 aa, Heterodera glycines
  Coding regions on vcDNA: vcDNA=SeqID_83088; Strand=-; Position=1 -94,382-687,1141-1286
MVQNQLQNDPALLYSLEKLFFIYQMLKSLKIDANRHENYLTASLEHSMTLMANRFGIRFNEISNVVEPRKSAFMLKEITNLLNDQFENDRTGNEHEKEENGQDGYRKNQKWAFRQLSNNSNNLFGKWFNSFHKGLIESDICEKPDSGIAKSRKAEFGTCGIQKSRGSGLAESRTAGGNCGL

SEQ ID NO: 156666 - protein, 160 aa, Heterodera glycines
  Coding regions on vcDNA: vcDNA=SeqID_83089; Strand=+; Position=1 -164,217-307,702-805,868-991
MGIFDEFVIVDEKAFTNLLIEKGNTCHLHINCLGCANGRTKNVTKFSDVTQFAALEFQFQNANCALEVKDIGNASESDVPLAQIIRQTLNIGGTLFFHQFYASSSIIIRILKKRQKDGPNPTPSFLGSPADDDLTVQIGDKKVKSATVHAIIEFKSAEMN

SEQ ID NO: 156667 - protein, 75 aa, Heterodera glycines
  Coding regions on vcDNA: vcDNA=SeqID_83090; Strand=+; Position=1-225
MSENEHSNVGGASHQDEDSSDDGLWNEFETCATSGSESSCLALFEFGLFSVTHLYRNSNWRTLQQAAASATQLYK

SEQ ID NO: 156668 - protein, 61 aa, Heterodera glycines
  Coding regions on vcDNA: vcDNA=SeqID_83091; Strand=+; Position=1-204
GSIHTHLFIDLFFFLNDLPHPSRKLFFVPPSVNLCPLHIFPIFVTLVRSIQQQCFLIHNFV

SEQ ID NO: 156669 - protein, 74 aa, Heterodera glycines
  Coding regions on vcDNA: vcDNA=SeqID_83092; Strand=-; Position=1 -39,335-379,1495-1634
HNNANNTVGGPIMQSPANATNPSQDAILNYMDLYSFYDDNNQLNALSFWHYQMKYGNEVTSTLLTKAIDRECVA

SEQ ID NO: 156670 - protein, 66 aa, Heterodera glycines
  Coding regions on vcDNA: vcDNA=SeqID_83093; Strand=+; Position=1 -19,789-970
MNKLVKEIVGLIFIKMKINILLLCLLLIKNTIDQIVSMKIKQPKGFDEIFGQRWDERAEDNEVDQT

SEQ ID NO: 156671 - protein, 116 aa, Heterodera glycines
  Coding regions on vcDNA: vcDNA=SeqID_83094; Strand=+; Position=1 -97,161-414
MPTKMLEKEIAKTLGVHERTIYDWKKKFGVNGKSKIKRYSKEQKFKIVQQFDEIKSRKKGKSIAKSANEMDHQISKELGVSRSMICQWKKDFCMTSTFVNKYVFSSWNKIFLNFRV

SEQ ID NO: 156672 - protein, 251 aa, Heterodera glycines
  Coding regions on vcDNA: vcDNA=SeqID_83095; Strand=-; Position=1 -217,374-627,677-778,826-1006
  Homolog annotation: Hit_ID=CAE58210.1; Match level="QueryCoverage =78%, HitCoverage=61%, E-value=2e-13, Identity=25%"; Hit description =Hypothetical protein CBG01305 [Caenorhabditis briggsae]
MWKKAFGPNFSMFFVLDQNRVPMGCISMALYPQVAHWSMFYVKDPYHGHQLGRALARRALEFAGDRPVFGYAVPEMWHKYEEEYAFHHYLDWRLWSFGAKCADVRPERLDHDSSVELKDWREASFDKLLLFDRQQTVGIDRSAYLREALRLPQSAAKVAVCRETGDVVGLCQVRHLLGDRLGISLFYANSESIASALLRAVLLQFAGPDPSAKFDSFIYKTPSTNTESIRLFRQLVQNGPVERRLFYPQFS

SEQ ID NO: 156673 - protein, 210 aa, Heterodera glycines
  Coding regions on vcDNA: vcDNA=SeqID_83096; Strand=+; Position=1 -325,1106-1252,1350-1508
MHHTLTILLCSLVSTVASIEEAKIKIEPKEEQFTAEIKKEFAPITTVKVELELEQRKAVKKEPKEEANYYGLMESKSNRFREIEEGKNDSSCVDHSDEDSAKSDQSEGASKIYSDEDKRSIVKQFKKLRNEKQKVKEIPKMLGIGVGTFYKWKDEFSDEEDSEKSVQNDSNESDRSILPETDQSEEEQFPELPKDDMILLMMDHHPLIAT

SEQ ID NO: 156674 - protein, 169 aa, Heterodera glycines
  Coding regions on vcDNA: vcDNA=SeqID_83097; Strand=+; Position=1 -133,378-524,622-851
MKKERFLCDGKNKTVQKIEEEISEELQVTRKSIYNWIKKFGMKNASKIYSDEDKRSIVKQFKKLRNEKQKVKEIPKMLGIGVGTFYKWKDEFSDEEDSEKSVQNDSNESDRSILPKTDQSEEEKFKKLPRIDYDSADDGPPPFDSKAWAWNFSVAKRKNHLKNGIKIKI

SEQ ID NO: 156675 - protein, 24 aa, Heterodera glycines
  Coding regions on vcDNA: vcDNA=SeqID_83098; Strand=+; Position=1-77
DCWGRGFESYRASYLLCSTYDCTE

SEQ ID NO: 156676 - protein, 293 aa, Heterodera glycines
  Coding regions on vcDNA: vcDNA=SeqID_83099; Strand=-; Position=1-882
  Homolog annotation: Hit_ID=AAB02297.1; Match level="QueryCoverage =96%, HitCoverage=47%, E-value=1e-31, Identity=30%"; Hit description =reverse transcriptase
MGGRVANLPELDQVRSYHWLERARIGKRSFRDCIAAQEGQLKARELKCPHMSARAKWCRRCGDPRVETEQHILSGCAWSRTGTMLDRHNGVVRQVHTALCRKYGLPVSSHTVPLHAVLENERAKILYDVALHTPPASVLPQEGGSTGYIGLRSNRPDMVVFDKGSRTIRIVEISVPWRENLRNQELIKWRKYAINSMIEPLELAEVEVPGPNLQNVLGRAYGKDFPIVKVVPIIVGSCGEVLPNITGRLSELGISAREVPNLLESIQRAAIIGSGHVIRTHLSVPRNGSETDL

SEQ ID NO: 156677 - protein, 74 aa, Heterodera glycines
  misc_feature (68)..(68): Xaa can be any naturally occurring amino acid
  Coding regions on vcDNA: vcDNA=SeqID_83100; Strand=+; Position=1-224
  Homolog annotation: Hit_ID=BAD26579.1; Match level="QueryCoverage =95%, HitCoverage=88%, E-value=7e-23, Identity=77%"; Hit description =cytochrome P450 like_TBP [Citrullus lanatus]
WGALPFYRLSKESMKVVVFHGRLAAPTYATPLMILHKVRLESSSTGSSFPAKFAKPVPLAVVSLDSRXGQWESR

SEQ ID NO: 156678 - protein, 173 aa, Heterodera glycines
  Coding regions on vcDNA: vcDNA=SeqID_83101; Strand=-; Position=1 -63,409-504,610-735,799-992
  Homolog annotation: Hit_ID=AAH61266.1; Match level="QueryCoverage =95%, HitCoverage=38%, E-value=1e-27, Identity=41%"; Hit description =Hypothetical protein MGC75701 [Xenopus tropicalis] ref|NP_988997.1| hypothetical protein MGC75701 [Xenopus
VRGQHTKTTGRKGRTVGVSKKIYQFKPPFDPYLCDQFFPRSSTEAEETAQTQFLLAKHNDILPSTVEQSAISALVGKVKQTLDKIIVAPETFNSAIEEVREVGSYKKGTMAIEEVREVGSYKKGTMLAKHNVADLVIVLKTLPLIEAVNALGQKIVLDLKAENHAVRMNEERT

SEQ ID NO: 156679 - protein, 267 aa, Heterodera glycines
  Coding regions on vcDNA: vcDNA=SeqID_83102; Strand=+; Position=1 -207,292-444,502-563,816-912,975-1258
  Homolog annotation: Hit_ID=NP_508471.1; Match level="QueryCoverage =76%, HitCoverage=15%, E-value=2e-44, Identity=49%"; Hit description =c2, putative phospholipid binding domain containing protein (XD240) [Caenorhabditis elegans] pir||T33337
RLCEEECEQLVGILPSRYLKAENNCANSNGIMARKDPNKMLSERFAQFSLKNAAERKNEKPEELKKQINDLYLETLYTILHKIGKEAVANEDQLAQYAKSAFQVEERTHQTLMEKARSEKPPILLLNVLLLEARDLIAKDIDGFSDPFVMLGLVPRGGSQRSPGADDQNSPTNEISEADSSASAADGGAGGGGNSARKNPLLQRFSGSFRRKARKARGETQTFDAENGIPARIIKASSVQRKTLNPKWNEKFQFVIGDVTDRFHLDI

SEQ ID NO: 156680 - protein, 101 aa, Heterodera glycines
  Coding regions on vcDNA: vcDNA=SeqID_83103; Strand=-; Position=1 -38,180-265,353-534
MPAQKSNRCPSVRIGGGHNGCPICRQEILDTDMLSTTTENAQANNNNNNNSNGGTQNEVIIEINDNNYNNGTEQNEQHQQQQTAIENDNNNDRLSENDRRA

SEQ ID NO: 156681 - protein, 120 aa, Heterodera glycines
  Coding regions on vcDNA: vcDNA=SeqID_83104; Strand=-; Position=1 -151,181-392
MVEIAQVAIKIKEKEGQMMKKNSLDLLLELIKSIWTKPHFLMGERVIRKINERRRRRRKRMIFANLLCYLLLAMCVLIILCLSLIACHNAQNIARNINRNNGQTEANGAMSNKRCNKKAL

SEQ ID NO: 156682 - protein, 139 aa, Heterodera glycines
  Coding regions on vcDNA: vcDNA=SeqID_83105; Strand=-; Position=1 -240,294-473
MSAELPICLLLLLFLSFSLSAFATFDGQQNLRDGQFLGCQIKNLKLLQTKFMDRKLMEKFHFELSKKQRIFEALFVGEEKHLLRSDAFPPPLIAADEFECLKTKLNSIHANDPALSQLLNGLFAAEMRAKRKLESLAGK

SEQ ID NO: 156683 - protein, 260 aa, Heterodera glycines
  Coding regions on vcDNA: vcDNA=SeqID_83106; Strand=+; Position=1 -68,343-615,667-1108
  Homolog annotation: Hit_ID=AAL78214.1; Match level="QueryCoverage =55%, HitCoverage=77%, E-value=8e-10, Identity=25%"; Hit description =putative esophageal gland cell protein Hgg-20 [Heterodera glycines]
MFVDGCAILWSYWDRFKKPKKKIFISADCWLCVFDLLAPSQLGLGISMISHRFDYYVDEHFKTRRWALKSMEIWSKIEENGTQEAAIVNDRKALPIPKIRMPRKVIGFKNIIIGYMDHNVITFLRHFCQIFAVCPINLSIHTNSNRILEFVLRNIWPLLGKNICAMELSVGVFHHLRQFVPSILNDLPLLRIVNFQVADLFTEFPADDSATASDGQAVTKWLFTARPDNVPKVLQCALLMDMDDGNLVSRVEAFKAVISN

SEQ ID NO: 156684 - protein, 41 aa, Heterodera glycines
  Coding regions on vcDNA: vcDNA=SeqID_83107; Strand=-; Position=1-223
FRIFRVFGVAEYEYPLYITPCLTLVHLNNKKLKFETWTFRG

SEQ ID NO: 156685 - protein, 60 aa, Heterodera glycines
  Coding regions on vcDNA: vcDNA=SeqID_83108; Strand=+; Position=1 -80,112-214
MAQQMTNIGTAIRLKNEKEKSRKNAQKEKKSNRETKRNKWRERMKENGRGGKAFIAKLRL

SEQ ID NO: 156686 - protein, 51 aa, Heterodera glycines
  Coding regions on vcDNA: vcDNA=SeqID_83109; Strand=-; Position=1 -36,676-792
MPKVPKHRFQISRVSFFTTTANAKFILLLTDHEIGHLVANIMCPDGFKFLN

SEQ ID NO: 156687 - protein, 80 aa, Heterodera glycines
  Coding regions on vcDNA: vcDNA=SeqID_83110; Strand=-; Position=1 -105,208-342
MAFCQRFDSADQSWSLLVRPHQKKRSGDYARSVVERYTAIPLLTLAPVDLAHPSNVFSVIEMYEANGRRETPDKVYFVRL

SEQ ID NO: 156688 - protein, 136 aa, Heterodera glycines
  Coding regions on vcDNA: vcDNA=SeqID_83111; Strand=-; Position=1 -127,1096-1379
MGEQMLKKLKEKLKRLFAVKKNDQVMAQIMENLFSFIKKIIKGESPQTVKHYLLFTIEIFALRERISLSENMTKNKIEINHSKLFKMVLEESNEQKEGNSERRKTILTSLYTEVGSLEVPSGIEIKKCKISSLGSD

SEQ ID NO: 156689 - protein, 307 aa, Heterodera glycines
  misc_feature (294)..(294): Xaa can be any naturally occurring amino acid
  Coding regions on vcDNA: vcDNA=SeqID_83112; Strand=+; Position=1 -238,299-323,384-436,497-674,735-839,1031-1239
  Homolog annotation: Hit_ID=O02623; Match level="QueryCoverage=87%, HitCoverage=57%, E-value=2e-83, Identity=61%"; Hit description =[Pyruvate dehydrogenase [lipoamide]] kinase, mitochondrial precursor (Pyruvate dehydrogenase kinase) gb|AAB525
FKFKCSIVSCYKYYQKKVNDQIYRFTVQLQIILRRHSTVVQTMAEGIIELKETGGLEPGSEQGIQYFLDRFYLNRISIRMLQNQHLVMLQNQHLVVFGSVLPESVFGSVLPESPRHVGCIDPMCDVSSVVNDAMCDVSSVVNDAFENARFLCDRFYLTSPALKLDCHNSISPDKKISIVTVPSHLYHIMFELFKNSMRATVENIFKNSMRATVENIGTDEDLPDLHVRVVRGYEDLSIKISDRGGGVPRKILSKLFNYMFSTAPPPPQDGTQTPLVSKGETAYISRCFLLSKFXKLIIYSNVVQFHS

SEQ ID NO: 156690 - protein, 29 aa, Heterodera glycines
  Coding regions on vcDNA: vcDNA=SeqID_83113; Strand=-; Position=1-90
HKHVKVNTYKTRQWFRECNKQLTIINDLS

SEQ ID NO: 156691 - protein, 79 aa, Heterodera glycines
  Coding regions on vcDNA: vcDNA=SeqID_83114; Strand=-; Position=1 -132,191-225,280-321,451-479
  Homolog annotation: Hit_ID=CAE66444.1; Match level="QueryCoverage =97%, HitCoverage=19%, E-value=2e-23, Identity=61%"; Hit description =Hypothetical protein CBG11719 [Caenorhabditis briggsae]
VLHHYITCVLCCITLTWSGGDCYEHMRPTFVVLVCYVSSVQIIQYKYQTGCLRRLHALGQRHSMDITVEGFSSWMFKGL

SEQ ID NO: 156692 - protein, 100 aa, Heterodera glycines
  Coding regions on vcDNA: vcDNA=SeqID_83115; Strand=+; Position=1 -254,468-516
MFSSLCPSVVRHKCLRCSTRTLAFSGHNLSDYLPAAQPSSRSQKAREILKRHQYALKRRPKKWKGAEFGTFVEQMDSIAAKCYLGNEFGLKKYSDHESEL

SEQ ID NO: 156693 - protein, 25 aa, Heterodera glycines
  Coding regions on vcDNA: vcDNA=SeqID_83116; Strand=+; Position=1-76
PPNCLRHKKSEMYVEKSDLCVPNLV

SEQ ID NO: 156694 - protein, 263 aa, Heterodera glycines
  Coding regions on vcDNA: vcDNA=SeqID_83117; Strand=+; Position=1 -78,125-322,788-928,980-1105,1197-1445
  Homolog annotation: Hit_ID=CAE73333.1; Match level="QueryCoverage =81%, HitCoverage=29%, E-value=1e-21, Identity=26%"; Hit description =Hypothetical protein CBG20762 [Caenorhabditis briggsae]
MLRSAFSTTKHPKYVVLQGIIGSSFREWEENKQPVSVDKTIKYFDGQLENADEIAQIEGNGPKKRPNMNLNDFTFKLGNWCFDTPGTVNSEQLTVFASNRLRIELMDTARVDGFLRRFNGHPSLGAPIGGPKRMDKFPKLEPCDFVVQNEGAFNEEESGFADVVFSSVGWALLTSSADSVKIRAWTPAGKGLLLRQPPLLPYAAKYRGQRQPGTDIYRMRPLQHCETFSDTQRSERPKRIVGENYKAPPTAGQIMEYVNFDFD

SEQ ID NO: 156695 - protein, 124 aa, Heterodera glycines
  Coding regions on vcDNA: vcDNA=SeqID_83118; Strand=-; Position=1-629
TVHQTFRDRDKCQEEKSALDLTVTTDQEGNYYILFLYLGVPNAEVGLQYHQTSEIRCAPRDHRQLFSGSPNITCLQFCFHFPRNGKRINSPCPWTKPSNTSMGNWKMPTKLPKLRAMDRKSGPT

SEQ ID NO: 156696 - protein, 306 aa, Heterodera glycines
  Coding regions on vcDNA: vcDNA=SeqID_83119; Strand=+; Position=1 -59,214-570,719-845,899-1276
MSIGGALFCLFVALWAVGIDVVFPLSLLLSASLGFLSASSLVHNAHLCFGAQIVLAQLLNLLPSADDSVSKGQTADEQQKNGGDEENKGQRHFATFKGSGHANRNYIVPPWERVELDARLNHELEELFETLLESYVSSCSVDLRSLLINELFPLVLAHVERICRLTNAIFGHENHQEIAQLPVSLIEFKVFDQWADDVHWAMRSEANRDAYLRMVADLLIRQFVDDIRIGGCFVDEEHAKIVNRNGEGTDNYAGAGGGAAAMPPATSKVFCHYLRILPLPPMSVVLPQFAALSARVALFLCASPHS

SEQ ID NO: 156697 - protein, 141 aa, Heterodera glycines
  Coding regions on vcDNA: vcDNA=SeqID_83120; Strand=-; Position=1 -277,430-581
  Homolog annotation: Hit_ID=NP_496431.1; Match level="QueryCoverage =85%, HitCoverage=10%, E-value=8e-37, Identity=59%"; Hit description =ankyrin and PDZ/DHR/GLGF domain and sterile alpha motif SAM (122.6 kD) (2L676) [Caenorhabditis elegans] e
FWRSVLSFSPQLSPPPFSPQKCLCVSLDEFVWDIKFRLLRSLPQKLDKEFNFGLFLPPCDGRAGKFLLEDRQIREYPFHDCVPYVELKYKKRVYKMLRLDEKALNVVHSRTNLRKVAEAVQGRNATKVRQESQKNGKFNSK

SEQ ID NO: 156698 - protein, 71 aa, Heterodera glycines
  Coding regions on vcDNA: vcDNA=SeqID_83121; Strand=-; Position=1-213
MMSNSAAVAPSSADGLLRKSATSASALYSSSPQHGTTANHFPTIPEDQGLTMSAGRDKMPQTAASASPPKS

SEQ ID NO: 156699 - protein, 84 aa, Heterodera glycines
  Coding regions on vcDNA: vcDNA=SeqID_83122; Strand=-; Position=1 -120,959-1093
  Homolog annotation: Hit_ID=CAG06108.1; Match level="QueryCoverage =83%, HitCoverage=16%, E-value=2e-12, Identity=51%"; Hit description =unnamed protein product [Tetraodon nigroviridis]
MTDVGTLNSFFCFVEGGQLGTGASGSVCKYRFRSRPIAVKQMKRTDNVTETKRIFMDLEVISKCKDCPYIVTYYGYIITFVSVL

SEQ ID NO: 156700 - protein, 130 aa, Heterodera glycines
  Coding regions on vcDNA: vcDNA=SeqID_83123; Strand=-; Position=1 -11,81-200,575-836
MNRRWICNDVWMDIFPSFDHSQLGLKLALLSPRFILSNDTKKIGWICNDVWMDIFPSFDHAQLGLKLALLSPRFNALVDKHFDGKSELTIWRTIEIRKDKGPEPKLFCTNRLQICGISIARPSVAQQNPF

SEQ ID NO: 156701 - protein, 90 aa, Heterodera glycines
  Coding regions on vcDNA: vcDNA=SeqID_83124; Strand=-; Position=1 -215,394-451
MPIEPFELVNERTNEKLTLTKDENGTGEFNWLLERCPIIGETAAVQKQQQKRDENSDANLNKVFFRLYDDIGPLSPPAEEEEEADQSNGD

SEQ ID NO: 156702 - protein, 251 aa, Heterodera glycines
  Coding regions on vcDNA: vcDNA=SeqID_83125; Strand=-; Position=1 -375,840-984,1302-1538
  Homolog annotation: Hit_ID=EAL25521.1; Match level="QueryCoverage =87%, HitCoverage=4%, E-value=3e-21, Identity=28%"; Hit description =GA14781-PA [Drosophila pseudoobscura]
YSDLLDSVNARHQQLEDALILSQEWAKQKRQLANFLDESERQLHAFEHIPTDAQKMEEQTQLLDQLQQATDQQRADFDRLVELGTELAQMVSLEEGQELDADMHQLITRYDTLGTRLGQIGQLMGTLAEDISQFLQSTEQLLNWLKEVEDEMHKFDDPSTEPEELGRQSDELATLVASIADQGQLVTQVVEISQELCAHTSGAEALSLQFRTDNLRQRYHPAGGRSCEPHHRAGEGAAVGRGPQGGHGRTR

SEQ ID NO: 156703 - protein, 86 aa, Heterodera glycines
  Coding regions on vcDNA: vcDNA=SeqID_83126; Strand=+; Position=1-262
KFLFGSVSPANVLPNITVSAERHGMQVRNALGENLIVPHTAQMYQRQLAQSWGQRPSPAATASDNGQVDRSGATSQLQRMASFHFW

SEQ ID NO: 156704 - protein, 39 aa, Heterodera glycines
  Coding regions on vcDNA: vcDNA=SeqID_83127; Strand=-; Position=1 -16,223-326
MTKFKVHSGSLNQIWAKWIKICRLGIQFPIEKGDCSYSR

SEQ ID NO: 156705 - protein, 310 aa, Heterodera glycines
  misc_feature (10)..(10): Xaa can be any naturally occurring amino acid
  misc_feature (309)..(309): Xaa can be any naturally occurring amino acid
  Coding regions on vcDNA: vcDNA=SeqID_83128; Strand=+; Position=1 -231,294-448,510-630,709-876,1301-1489
  Homolog annotation: Hit_ID=S15795; Match level="QueryCoverage=92%, HitCoverage=28%, E-value=4e-85, Identity=55%"; Hit description =vacuolar proton pump homolog - Caenorhabditis elegans
IENGKQMFIXIFHMFFGGRYVIFLMGLFSIYTGLIYNDAFSKSFNLFGSSWLNPYPVDILKADPEQILTLDPWESYASSPYASSPYPVGVDPVWNLAETNKLNFLNSMKMKASVIIGISQMTFGVALSYYNHKYFGSDLDIKFTFYFGSDLDIKFTFIPQMVFLSCIFIYLCLQIIAKWIFYDALGHPVFTGHPVFTYEYPGAGCAPSLLIGLINMFMMKSRNKGFIPPGGKEPYPNCHLNYWYPGQSFFESLFIPTAVGCIFVMLFAKPYVLWQQRQQHSRSLSGGGGGVHTQLVFVGTAFTHIYRAXR

SEQ ID NO: 156706 - protein, 169 aa, Heterodera glycines
  Coding regions on vcDNA: vcDNA=SeqID_83129; Strand=+; Position=1 -235,494-665,716-818
  Homolog annotation: Hit_ID=NP_741262.1; Match level="QueryCoverage =95%, HitCoverage=17%, E-value=2e-58, Identity=66%"; Hit description =V-ATPase a subunit; ATP-dependent proton pump involved in the acidification of intracellular compartments
MQEDGAEVLHHEDTSTTHKNHETATGGEKGGGQGQQHGDGSFGDIMVYQAIHTIEFALGCISHTASYLRLWALSLAHAQLSDVLWSMVLRNGFVQSGYLGAVITYLIFIVFGTLTLSILVLMEGLSAFLHALRLHWVEFQSKFYGGMGHPFVPFSFEKILEESRQSEDS

SEQ ID NO: 156707 - protein, 117 aa, Heterodera glycines
  Coding regions on vcDNA: vcDNA=SeqID_83130; Strand=-; Position=1 -156,206-241,340-397,454-557
  Homolog annotation: Hit_ID=NP_741119.1; Match level="QueryCoverage =96%, HitCoverage=49%, E-value=9e-25, Identity=47%"; Hit description =putative membrane protein of eukaryotic origin (25.0 kD) (3F971) [Caenorhabditis elegans] gb|AAK93840.2|
PNVVSTLPYPVKLTARHPMRYFRVREEWRVTDVLMNPMMLMMGAAFILVVLMPKLAAQDPNVQKEMQNMQLPKVDMPGKTLTGHMADMLANIWSSGSNKKGSRKQISSGQNTKRVTR

SEQ ID NO: 156708 - protein, 27 aa, Heterodera glycines
  Coding regions on vcDNA: vcDNA=SeqID_83131; Strand=+; Position=1-129
FCIKRILQMIEKESFISPRIHFFRIVF

SEQ ID NO: 156709 - protein, 228 aa, Heterodera glycines
  Coding regions on vcDNA: vcDNA=SeqID_83132; Strand=-; Position=1 -106,416-573,1100-1370,1417-1547
  Homolog annotation: Hit_ID=CAE67074.1; Match level="QueryCoverage =99%, HitCoverage=67%, E-value=1e-62, Identity=58%"; Hit description =Hypothetical protein CBG12483 [Caenorhabditis briggsae]
NAELTVISALSGECQSNDSQQKARSKKRNLEQKAKSRNSIAGERKRRRTQRNGTVSGTRLEPSASQLLSWRRILLLIMAVTVHNFPEGLAVGVGFGGVGKTPSATFEKAFNLAFGIGLQNFPEGLAVSLPLAGFGYSKWRAFLYGQMSGMVEPIAALLGASLVLMMEFVLPYALSFAAGAMIYVVFGAMIYVVFDSIIPEAYSHGNGKMSSLFAILGFMVMMSMDVGL

SEQ ID NO: 156710 - protein, 98 aa, Heterodera glycines
  Coding regions on vcDNA: vcDNA=SeqID_83133; Strand=-; Position=1 -221,282-357
MPIEPFELVNERTNEKLTLKQKIDEFGVNVYNWLLKRCPIGETATAIKWEDSVNPSANLNNVTFDLWSFDKSIGPLSPPTKEEKEEEDKADKRNGNVV

SEQ ID NO: 156711 - protein, 29 aa, Heterodera glycines
  Coding regions on vcDNA: vcDNA=SeqID_83134; Strand=-; Position=1-89
VGSFCGSMSTGLTNFFNLICVSQRAKKNC

SEQ ID NO: 156712 - protein, 405 aa, Heterodera glycines
  misc_feature (3)..(3): Xaa can be any naturally occurring amino acid
  misc_feature (396)..(396): Xaa can be any naturally occurring amino acid
  Coding regions on vcDNA: vcDNA=SeqID_83135; Strand=-; Position=1 -130,185-233,283-355,410-472,515-571,675-765,827-922,1043-1168,1222 -1479
  Homolog annotation: Hit_ID=NP_508769.1; Match level="QueryCoverage =97%, HitCoverage=71%, E-value=4e-53, Identity=36%"; Hit description =rhodopsin-like GPCR superfamily (XF87) [Caenorhabditis elegans] gb|AAR25650.1| Hypothetical protein F02E8
PIXASLAVSDLLLIFVGISFDLFSLWRRHEWMDLSGFCEATSTSISWFTTSISWFTFCSILTIVGLTGERLVAICYPFSLLTGERLVAICYPFSLRPYFYHRSMLWLIAVLWLISFFLWLIAVLWLISFFPSLYIGLQFKTVVRDFCGEFLAFTIYFKTVVRDFCGEFLAFTIYGRCSAHRCSAHSLAMTFVSPLFKAQLLLTFVFPVAFVIYCYIKILQTLNEIYCYIKILQTLNEATSNSHQLTAAQPKRSEKGRFFVWSKHTANSTPRRKLTRNSSGRGSVRSQQAHKTVLKMLVTITILFFICYLPYHLERLVVKYVTITILFFICYLPYHLERLVVKYARGYCARCAILYPITGLLQYISATLNPIIYTVMSRRFRREFLRIFQKMWAEKXRQRRTETGI

SEQ ID NO: 156713 - protein, 74 aa, Heterodera glycines
  Coding regions on vcDNA: vcDNA=SeqID_83136; Strand=+; Position=1 -7,233-450
MPVDAAYQVAPSSVSSSLKRRGINTNEWWMNEWEDGEDVKDEAGEGGRGGNLGVCAFLNLLASRKFAIIVCMYI

SEQ ID NO: 156714 - protein, 50 aa, Heterodera glycines
  Coding regions on vcDNA: vcDNA=SeqID_83137; Strand=+; Position=1 -45,94-199
MVLLLNFAFIFFAFLSSIYAEEEDPKVTHKAFFDISIGGVKKGRIVIGLF

SEQ ID NO: 156715 - protein, 30 aa, Heterodera glycines
  Coding regions on vcDNA: vcDNA=SeqID_83138; Strand=-; Position=1 -15,261-338
MPLSETNFVSKIVECRGGDGIPVICMPFDE

SEQ ID NO: 156716 - protein, 337 aa, Heterodera glycines
  misc_feature (112)..(112): Xaa can be any naturally occurring amino acid
  misc_feature (183)..(183): Xaa can be any naturally occurring amino acid
  misc_feature (197)..(197): Xaa can be any naturally occurring amino acid
  misc_feature (243)..(243): Xaa can be any naturally occurring amino acid
  Coding regions on vcDNA: vcDNA=SeqID_83139; Strand=+; Position=1 -136,349-453,624-718,1082-1154,1316-1391,1527-1562,1608-1872,1934 -1974,2031-2116
  Homolog annotation: Hit_ID=NP_493375.1; Match level="QueryCoverage =98%, HitCoverage=62%, E-value=7e-57, Identity=39%"; Hit description =cysteine endopeptidase AUT-like (1O128) [Caenorhabditis elegans] emb|CAB54483.1| Hypothetical protein Y87
NIKLLSMVDVCLTLEPGFSTLEDLAFLDLAGGSVHLLGTTYSSKGNIEAIKEFSRSLIWFTYRKNWPAPIGGFDGPTSDRGWGCMIRVGQMVLAQVIEKNVGSKFQFTRPKXFQAYLRLLRMFQDKRTAQFSIHQIAQFGVSEGKPIGEWLGPNSMAQVLKKIVVYDEWSNLVVHVAMDNVNXKKDFLTHFAKITNXKKDFLTHFAKITGFHCFSLISDEVSLPLKTVIYSFLFFFNLFFRHXENGQNESAEREQQTNSPTTGQWIRPLLLIVPLRLGLTAINLTAINPCYFNAIAEYFKLPQCVGILGEYFKLPQCVGILGGRTRHAVYFYGTAGK

SEQ ID NO: 156717 - protein, 36 aa, Heterodera glycines
  Coding regions on vcDNA: vcDNA=SeqID_83140; Strand=-; Position=1 -67,301-344
MCYKPKIASTYRNRIEIAGIDRAAMTPLCERRPKLG

SEQ ID NO: 156718 - protein, 51 aa, Heterodera glycines
  Coding regions on vcDNA: vcDNA=SeqID_83141; Strand=+; Position=1 -15,214-354
MMSIEIFFTGISWDRDFIGDPTTIRQFRGSRGIGVIKFFEYFQITYKDPNR

SEQ ID NO: 156719 - protein, 80 aa, Heterodera glycines
  Coding regions on vcDNA: vcDNA=SeqID_83142; Strand=-; Position=1 -66,146-322
MKENRGPNIRGEKQMNIRNVSKQIIASNMNENFFFCFSCPFLTSAALQISSGDVSAVIGVNWLYGTGMVLALWYVMDTLK

SEQ ID NO: 156720 - protein, 141 aa, Heterodera glycines
  Coding regions on vcDNA: vcDNA=SeqID_83143; Strand=+; Position=1 -163,603-865
  Homolog annotation: Hit_ID=NP_494372.2; Match level="QueryCoverage =92%, HitCoverage=36%, E-value=9e-20, Identity=37%"; Hit description =FUcosyl Transferase (44.3 kD) (fut-4) [Caenorhabditis elegans] gb|AAF39933.2| Fucosyl transferase protein
MSRKKRFALQIVSHCGAPSGRDVLTKQLQELIELDMVGECSGKDCDQKCYEQQMESHFFYLAFENTVCSEYVTEKFWNALRSLTVPVVLCREVVRESGIPDDLYIAADDFDNATALADHLKALQKDKDRYLGSVFNEQKGQ

SEQ ID NO: 156721 - protein, 132 aa, Heterodera glycines
  Coding regions on vcDNA: vcDNA=SeqID_83144; Strand=-; Position=1 -263,544-679
MAPPPTAALGFSAVTSSSIIGGVSNGHQATAVAQMLFSPPNIVPIAADQQQLFIAGNNSFVGHGHHNPSLAAMPTHGAGGSLDLNNYKVPVKAAGDVSLNGLQLAAFLTKATLLLQPVGLAHLRTIKILTEI

SEQ ID NO: 156722 - protein, 33 aa, Heterodera glycines
  Coding regions on vcDNA: vcDNA=SeqID_83145; Strand=+; Position=1-99
MAPNQANIWATTSSGAASLPYSNMAMHPLISSS

SEQ ID NO: 156723 - protein, 385 aa, Heterodera glycines
  Coding regions on vcDNA: vcDNA=SeqID_83146; Strand=-; Position=1 -433,690-950,1276-1736
  Homolog annotation: Hit_ID=CAE68667.1; Match level="QueryCoverage =42%, HitCoverage=20%, E-value=5e-23, Identity=38%"; Hit description =Hypothetical protein CBG14568 [Caenorhabditis briggsae]
MSQVGAGEMAESNSCRFGGSQYSRVTGGAFGVEEDELGTANDRQLGRRPSQRECRPSAIGAAFPSQFATPSPKWSTFRFCLSLSCASFACPTFSRCSAFTCLLFSSPIWPLPKAFPTPRQLSFCRSSELPTLLVLCANAVLFAVAAYVCLTSIVLADLLGVERLTNSFGLVVVSRGFASLLGTPIAGIVYDLSDSYGASFIYAGLLIFLSGLVSCIIPMVHRHQRSQLKNEGALMYELDEYRKRSQRLDEGYEEETEEQQTEGGGEAHCRGAETETHAAQTEANKAGQEDAEAEKKNTEAENKNTEAEKKNTEAENNDAEAKKKDAEAEKKDAEAEKTTEARNMQMRNAEATDNDPQREQQKGEMAEANISLAGAINGGNAIPLQ

SEQ ID NO: 156724 - protein, 33 aa, Heterodera glycines
  Coding regions on vcDNA: vcDNA=SeqID_83147; Strand=+; Position=1 -42,711-770
MPTPKMGGQTKQKKEFPILSIEFGNAIKEKPMK

SEQ ID NO: 156725 - protein, 299 aa, Heterodera glycines
  Coding regions on vcDNA: vcDNA=SeqID_83148; Strand=-; Position=1 -198,317-431,485-637,702-786,837-929,975-1033
  Homolog annotation: Hit_ID=NP_508461.1; Match level="QueryCoverage =92%, HitCoverage=46%, E-value=5e-57, Identity=46%"; Hit description =solute carrier family 7 member (53.9 kD) (XD175) [Caenorhabditis elegans] gb|AAB71312.2| Amino acid trans
LPLPLPPSLSLSLFFLFPSLSLFIFPCPFILSFALQEFANKMYGPFAFTMPLFVACSTLGSANGVVVVVSRLFYVGAREEQMPVLLTMINRRTRTPVPAVVFLGLLSLVYLAFGDNALTLINYGLLSLVYLAFGDNALTLINYIAISYWLAIGLAIASLFYFRMKMPNAPRPIKVNLIFPAIVNLIFPAIFLLGCVALVVIPIVGKPKDTAIGIAIMLTSVPVYLVFICWKERAIGIAIMLTSVPVYLVFICWKERPSFFNKASASITIFCQKLFLVSNEASITIFCQKLFLVSNEAEK

SEQ ID NO: 156726 - protein, 141 aa, Heterodera glycines
  Coding regions on vcDNA: vcDNA=SeqID_83149; Strand=+; Position=1 -221,301-505
MRAKILASVKVSWMKVANLTERQLRAVRKTKRKHLQMKAAFESANLSGQPQLFEQNHQGFCNLRRTGAKCIWQNSRPPDDECFDPKSYECQKRTKRLHYVGIVATRLFDESAKFGIAIGTEPNEEAAKEPNEQGKADTSSI

SEQ ID NO: 156727 - protein, 17 aa, Heterodera glycines
  Coding regions on vcDNA: vcDNA=SeqID_83150; Strand=+; Position=1 -42,256-267
MICVHICEFICDLKNIL

SEQ ID NO: 156728 - protein, 161 aa, Heterodera glycines
  Coding regions on vcDNA: vcDNA=SeqID_83151; Strand=-; Position=1 -214,1045-1169,1274-1358,1470-1528
MALYGVRDDRLYHQRTQTDDTVLVEDRSYKRDGSSQQLIVPTSMSHCLSRTNATKRNNFLWTFICVTNRTKDNISADAEQIDPKMLRQDLVHLASVCPQGFFCQLSGIHKTSHGDSGSPLLRKSGGKWYAIGIVRGHESKKNLFTKISPYCDWLKEKSRGE

SEQ ID NO: 156729 - protein, 133 aa, Heterodera glycines
  Coding regions on vcDNA: vcDNA=SeqID_83152; Strand=-; Position=1 -115,679-965
MKRWIKRSLARFSVLSVVALFGTNLGVNLAERPATEHPECISFGCLTSDASRLIYAVNRFAVALPNFLAGISFLAALFAFRRRLNGINGPITIVQNTNNTRNSTQQNGTVTNLNTKMATVNTDSRKMVNGRKF

SEQ ID NO: 156730 - protein, 399 aa, Heterodera glycines
  Coding regions on vcDNA: vcDNA=SeqID_83153; Strand=+; Position=1 -41,290-623,754-1341,2068-2193,2266-2376
MSHAFRVPPPHRPHNKSEGERNDADDDDDDQTEIEQFNRELNEICQMLREHYRNEVPKIGRLCAQMSEGTRQALAIQQQIPNPDEVQQQHGENNARDNRSNRSSDETISSNNSSNCDNANVKCESGLHQNAWWQQQFHEIEQALDNDADDEGISSVECSENGTNENDNKSDDDIESDAESDDKPYECDCESADHPMECPLLAARRALRRLKLPTILDICAATEAEVRQYGTKLSDTIKQIAKLRVQNGGALTSEWELRSRQKQAQNLLQQIGNLMPQLVVEEIEVAKILKFVEQSADRFSIGFRDRKQQKQFKKAIRQPKKVETEWTHIVHAMLQMRKLINAAQYLVKEAQPKPLACDRKFSDQKQPSLCSLDRLYAKLYGKPSQIKRVRDFRDLVISL

SEQ ID NO: 156731 - protein, 441 aa, Heterodera glycines
  Coding regions on vcDNA: vcDNA=SeqID_83154; Strand=-; Position=1 -142,214-650,692-1438
MTIRLSDLHSLTEEAKRETPREMENEGRIATATMRRRELSGQSAALKAAFLEKRPESRWRTRASPGNEEDIREMLLTKRRHSTENRTDHHQQKGAATSTASFLLEEMNNNEEGTEDRNRRGQRKEQMDRNGKGTEGLTGGDSAKQLFEEAENGEEEEEEEEGTDGLMSGERELYENVISEFDGLRQTVNNYITKMKQFASELEQQSAPSSSSSSAVPLLPHSSQQQSPPVVAPESTKEKRRNFFYGKQKQIAQRPATTTGAFSASHFSYSTSVTAASSANSKTPTNCSTISDPKTQRPQSSPAGTMAEGWQNRLENLEVPSKKTEIKNSHVKFIDDDIISGEECPLIRPNSSGKVPTANVPSNFLSNTTMPHKLQTTSTRKDSNCSVTSLLPNAEKEFDKSFAGVALSCGGGKKAHQLNDIKAVVEKASAMPLLPSLVVML

SEQ ID NO: 156732 - protein, 76 aa, Heterodera glycines
  Coding regions on vcDNA: vcDNA=SeqID_83155; Strand=-; Position=1 -150,221-301
MIFGLRKMSAKIRCDIQMNGPSRIDLIKQINVLVASSISILLYGHALEDVEEMDGFLDIKEKMRFLFAMFPWHDRR

SEQ ID NO: 156733 - protein, 30 aa, Heterodera glycines; identical to SEQ ID NO: 126607
  Coding regions on vcDNA: vcDNA=SeqID_83156; Strand=-; Position=1-91

SEQ ID NO: 156734 - protein, 93 aa, Heterodera glycines
  Coding regions on vcDNA: vcDNA=SeqID_83157; Strand=-; Position=1 -151,548-678
  Homolog annotation: Hit_ID=CAE72082.1; Match level="QueryCoverage =93%, HitCoverage=24%, E-value=9e-09, Identity=35%"; Hit description =Hypothetical protein CBG19168 [Caenorhabditis briggsae]
MFIGLLLLNVFAILFWNFVWKRRKLPPGPSPLPLMGNLHQLANFPDHGGAGTHGLHGVSRTHGEGWLFLRRFTLETLRDLGMGRSRMSQEVKI

SEQ ID NO: 156735 - protein, 98 aa, Heterodera glycines
  Coding regions on vcDNA: vcDNA=SeqID_83158; Strand=-; Position=1-297
MISEQRRMKRNIPLSQREQQQNESEGEEEEEEEEERGGGRGGRGGQKRKIKHREEEEEETEEDEEEHNFGTGRGRRMGAKRQRMARQNRQREEREGEG

SEQ ID NO: 156736 - protein, 67 aa, Heterodera glycines
  Coding regions on vcDNA: vcDNA=SeqID_83159; Strand=+; Position=1 -24,496-675
MRAHAKSQSNGTTTALSTEAQRKKKQQRPAEVAEEEDGEEEGQWVLKRMPLAEGRHGRKSRALVEGD

SEQ ID NO: 156737 - protein, 72 aa, Heterodera glycines
  Coding regions on vcDNA: vcDNA=SeqID_83160; Strand=+; Position=1 -84,144-278
  Homolog annotation: Hit_ID=NP_741446.1; Match level="QueryCoverage =86%, HitCoverage=34%, E-value=1e-22, Identity=74%"; Hit description =serine/aRginine rich pre-mRNA SPlicing factor, Serpin (20.5 kD) (rsp- 6) [Caenorhabditis elegans] gb|AAA82
MSSRRGGGNNVEGKVYVGGLPEDATSEELDDVFHKFGRIRKIWVARRPPGFAFVEFEDTRDAEDAVRSLDGT

SEQ ID NO: 156738 - protein, 66 aa, Heterodera glycines
  Coding regions on vcDNA: vcDNA=SeqID_83161; Strand=-; Position=1-200
MVPFELVNEWTKEKLTLAKANELDNRWIMKRCKIIGETAAVYWEDGNWDNNCNNVFIWLVAGTNCI

SEQ ID NO: 156739 - protein, 93 aa, Heterodera glycines; identical to SEQ ID NO: 154974
  Coding regions on vcDNA: vcDNA=SeqID_83162; Strand=+; Position=1 -272,530-539

SEQ ID NO: 156740 - protein, 165 aa, Heterodera glycines
  Coding regions on vcDNA: vcDNA=SeqID_83163; Strand=+; Position=1 -201,764-1041,1483-1501
MQLLLAKRCPNGCTRRHPNGHRKRLFCENSIRTNFPMDHQFQRGVVVVVVLRFSSYLGVSGPIFHTKKFICARTSSVSYKIRFGVFSPPSSIEEPFELVNEWTKEKLTLIKENAYYWLLKRCPISEKAAIKWGNDGNSDNNNTKWNFIHFNLVCCKNSIGGVTKG

SEQ ID NO: 156741 - protein, 80 aa, Heterodera glycines
  Coding regions on vcDNA: vcDNA=SeqID_83164; Strand=+; Position=1 -136,374-447,500-556
PPFSIFFLLSGGNTQTHIPHLFFIICSSFLHSLFTKPYSPNSLYEYWKMTISVEIFDAKSPSRPGFTIAEVEPDYKKCVN

SEQ ID NO: 156742 - protein, 132 aa, Heterodera glycines
  Coding regions on vcDNA: vcDNA=SeqID_83165; Strand=-; Position=1 -91,295-479,860-982
MIVINVLYAFVLVSFISDQHRIAVTGDSNHVPSPPRNVNVVQINSSSIKVTWEPPADGDAQLLYGYNVYKFQIVNNQFVNNLHRSVAIVDKNALVQFAVEKVRFVVEANCAGQLPKGRSRPDGAKLCVGQSL

SEQ ID NO: 156743 - protein, 99 aa, Heterodera glycines
  Coding regions on vcDNA: vcDNA=SeqID_83166; Strand=+; Position=1-300
MGSSTVRSIMFNSRIVDSAIPGLHLHWLHANAALLLGKYSLLGHLPSALLFSLVIVSVLFWWHAAKLAVYLAMLYGDLAGWALLLIAAALFIGFGIFLI

SEQ ID NO: 156744 - protein, 234 aa, Heterodera glycines
  Coding regions on vcDNA: vcDNA=SeqID_83167; Strand=-; Position=1 -72,133-346,421-641,710-907
MVLIDLSLLLILSQVFAAIAAEYEQITKLRAFLCKDLAKASTYRNREAWRKLGTFTEKVPKNLLDSLAEWQFQYLSIERLFIFCIALENGKHRNIDERLLGKISLKPKFIDEKSGKELTIEEAMRQIVTAHKIIFGGKSKKIIQKCIEYCKIKKQLPQMRFENKVNCFEVIGWAFVLETTNECQMKESALIELESVKQYLLLLSDGKYPQLQITKPPKKPMRKGNGKRRASHRY

SEQ ID NO: 156745 - protein, 213 aa, Heterodera glycines
  Coding regions on vcDNA: vcDNA=SeqID_83168; Strand=+; Position=1 -192,245-355,563-595,651-836,1104-1220
  Homolog annotation: Hit_ID=NP_001003255.1; Match level="QueryCoverage= 85%, HitCoverage=64%, E-value=2e-21, Identity=31%"; Hit description =annexin XIIIb [Canis familiaris] emb|CAA56507.1| annexin XIIIb [Canis familiaris] pir||B57076 annexin
MPWLEEEHKKRIIMHNEQQISGGDDFDDDERVEAIHKSLESAEEPDEERCQKLVHLLGTANINQRQNLKQKYAAKFGGLNLKDELMKRLPASELITKELLQGLGTNEDMLIEILVTRSNKQLLAIKSAYKAMFNRELEKEVRAETSGTFKALLLDLLEANRDESHTADEGKAKKYEIVAKHPIEKGIQAEFSGDSLRAFLALVEFVRNGPAVQ

SEQ ID NO: 156746 - protein, 21 aa, Heterodera glycines
  Coding regions on vcDNA: vcDNA=SeqID_83169; Strand=-; Position=1-63
MAGVEHCMSSLTENELEGSKK

SEQ ID NO: 156747 - protein, 153 aa, Heterodera glycines
  Coding regions on vcDNA: vcDNA=SeqID_83170; Strand=-; Position=1 -341,395-517
KQAVLFNLIDLSSDCCSSRRSGILMGDDDDVLVLNDGGAGGDVEVVGERRRRLARPSVHERGERVEHGHGREQHNTQDRHSRFYVDPTLQISAISCWLFVIMCTDKLRDWFWELFYFMRVLACYNVSTLISTRPSFLCRGMSSKGISWTCLLG

SEQ ID NO: 156748 - protein, 47 aa, Heterodera glycines
  Coding regions on vcDNA: vcDNA=SeqID_83171; Strand=-; Position=1-143
PVMCHLGDPAHQPETAYYTDINALISYCAEFVCYALIWLIIWRRTAQ

SEQ ID NO: 156749 - protein, 15 aa, Heterodera glycines
  Coding regions on vcDNA: vcDNA=SeqID_83172; Strand=+; Position=1-46
EYEEGVAQLEQEHVK

SEQ ID NO: 156750 - protein, 151 aa, Heterodera glycines
  Coding regions on vcDNA: vcDNA=SeqID_83173; Strand=+; Position=1-455
MELTDAAGTAKRRSQTKKSGSPFGFLGFGRTEGAVGGFAGAIGGGPTIGGTSTSSLMLPYLLSESAISEDVHSLGSDSANHCHLAERSSAGCGGLSQDGAIGDGVALSGIACHSTAGEMAEEEGGEKAAGASGRHHRRVLLEQNKLILDGK

SEQ ID NO: 156751 - protein, 72 aa, Heterodera glycines
  Coding regions on vcDNA: vcDNA=SeqID_83174; Strand=+; Position=1 -128,176-266
MGSKRRFLLHFSQAHQTFRRAEFDAICQIKGISVVPNSPSDGIHIQSFEFQNDEFDVFRLLERAVLVKAAYE

SEQ ID NO: 156752 - protein, 107 aa, Heterodera glycines
  Coding regions on vcDNA: vcDNA=SeqID_83175; Strand=+; Position=1 -32,306-345,376-627
MPSPSWLGLTRSFCVHNTEKVRIEINIETKRTNRMLPKIWLIMRTVVSNDKTIGTDHESGSRLNPDQSRTFWKNDRDGPRVGIPTESRSIPNILEKRSGRTTSRDPD

SEQ ID NO: 156753 - protein, 174 aa, Heterodera glycines
  Coding regions on vcDNA: vcDNA=SeqID_83176; Strand=+; Position=1 -429,627-722
MLKIIFEIIFFLFIIVLIDGIDEDLFDDLLKNLKPSNSKNIKKPIFGEINTIKEEIVVKNENDEQGNANQIEMEDINPKLLQKIKKEKTLEEQNNNLKIKMPKIEMEQLEEESYENEFDEQADQNVSSTDHNDSVDQAYYNIMCQRAKPGNANEGPGWVMYHNWTEKGTRKRNG

SEQ ID NO: 156754 - protein, 79 aa, Heterodera glycines
  Coding regions on vcDNA: vcDNA=SeqID_83177; Strand=+; Position=1 -157,471-553
MQLIRKFDQMRKEKICGLKYDEKKRSVIEREIANELGINRKKIYKWKKELELEKSLVYYLFVSFFFVMPFWLGLKKALG

SEQ ID NO: 156755 - protein, 134 aa, Heterodera glycines
  Coding regions on vcDNA: vcDNA=SeqID_83178; Strand=+; Position=1 -72,239-317,780-925,994-1100
  Homolog annotation: Hit_ID=CAE63510.1; Match level="QueryCoverage =58%, HitCoverage=3%, E-value=6e-16, Identity=55%"; Hit description =Hypothetical protein CBG07989 [Caenorhabditis briggsae]
MAGSEGVGQQKRQNHHLQHHRLTPDVDGFCAPLRQSVDHRGQTDQQDNFGALPSTTSAGGGAASSSASVLRSSIKDSSGGAANKKDPSDSTQALFLLAENLAELIDSVCKSEDKEKLLPALQAVWNNTLPYSVE

SEQ ID NO: 156756 - protein, 22 aa, Heterodera glycines
  Coding regions on vcDNA: vcDNA=SeqID_83179; Strand=+; Position=1 -24,170-214
MAAQNVDNSQPLKIPTLEDSDI

SEQ ID NO: 156757 - protein, 42 aa, Heterodera glycines
  Coding regions on vcDNA: vcDNA=SeqID_83180; Strand=+; Position=1-131
VAPVLPCVDHAKWHWTKAATHLQWTKAVILGDGQINEKQIDW

SEQ ID NO: 156758 - protein, 109 aa, Heterodera glycines
  Coding regions on vcDNA: vcDNA=SeqID_83181; Strand=+; Position=1 -45,561-845
MMTGLNNSDVGKEFRTFLRATTSSAAARYTIQFDVNKSLPIVPFELVNERTQERLTLWKGRDYEHVRQWVMKRCPIGETAIIQWEAPPNSSATNLNNVNIYLCCVSCTG

SEQ ID NO: 156759 - protein, 106 aa, Heterodera glycines
  Coding regions on vcDNA: vcDNA=SeqID_83182; Strand=+; Position=1 -66,161-301,1134-1247
MEEAKGLEIVGFGLFHKCTPNQFYCSLLSVSKHIEPLFVNVERVAELKKSETEKEENANKGTGRHILLRMEGVIAIDEQKKQPIGYILAYGGRVLQCYADEEKVAG

SEQ ID NO: 156760 - protein, 35 aa, Heterodera glycines
  Coding regions on vcDNA: vcDNA=SeqID_83183; Strand=-; Position=1-108
KNRFFQVSVWGTQTIMGKKNPNAELKVPGYKGRYS

SEQ ID NO: 156761 - protein, 153 aa, Heterodera glycines
  Coding regions on vcDNA: vcDNA=SeqID_83184; Strand=-; Position=1 -93,160-208,345-456,881-1088
  Homolog annotation: Hit_ID=NP_508383.1; Match level="QueryCoverage =95%, HitCoverage=97%, E-value=1e-28, Identity=44%"; Hit description =potassium channel tetramerisation domain containing 3 like family member (16.7 kD) (XC703) [Caenorhabditi
MTDIIEFNVGGQIFASTYQTISFDKESLLYTWYFERKGSAHTMLDKKGRFFIDRDPTSFGIILNYLRLHNAKQLWEVCLPKEPDRLALLTQEAEFFRLPSLRDQAVALLRKCTAEEPSPAEIRGRMMSLKTNGGMKNGRRWRTDEDDHDNEDD

SEQ ID NO: 156762 - protein, 467 aa, Heterodera glycines
  Coding regions on vcDNA: vcDNA=SeqID_83185; Strand=-; Position=1-1402
  Homolog annotation: Hit_ID=XP_318550.1; Match level="QueryCoverage =99%, HitCoverage=46%, E-value=1e-120, Identity=47%"; Hit description= ENSANGP00000020240 [Anopheles gambiae]
MEAIKPIEFSHWAAPILVVKKRNGKTRVCIDFSTGLNDALELHRHPLPRPEDIYNAIAGSKYFSRLDLRDAYLQLELSDESKKLCTINTHRGLFQCQRLPFGVKSAPAIFQSLMDKIITPINGAFVYLDDVIIANTTLDQHVKTITKVFDKIKQFGLRIQLEKCSFLQKETVFLGHIISENGIRPDPSRAEAIRKMPAPHDKSTLRSFLGALTYYGKFIKQMREIRSPLDELLKKDVPWNWEDEQQKSFEKAKEIMLSDLLLTHFDPKLPIIVAADASKGGIGATISHQFPDKSERVIEHASCTFTAAQQNYSQIEKEALGLVFAVQKFHRMLYGRKFTLLTDHKPLLAIFGSKKGIPIYSASRLQRWALILSNYEFDIKYVNTKAFGNADVLSRLIANYPRPSEDILIANICNDTDCCVNFVFEAKIEQLPITAKIIAEESAKDEILQQISAFTKQGWPQKLDDIK

SEQ ID NO: 156763 - protein, 34 aa, Heterodera glycines
  Coding regions on vcDNA: vcDNA=SeqID_83186; Strand=+; Position=1 -76,144-172
MFRVRERPRGFVGGGVQLVGAGRRIDATITYVKC

SEQ ID NO: 156764 - protein, 43 aa, Heterodera glycines
  Coding regions on vcDNA: vcDNA=SeqID_83187; Strand=+; Position=1 -62,494-563
MVLLFLQLALILLCSVFAFIVCGIGPDSTASSTVSNTVGATRW

SEQ ID NO: 156765 - protein, 88 aa, Heterodera glycines
  Coding regions on vcDNA: vcDNA=SeqID_83188; Strand=-; Position=1 -64,665-864
MASTNFSINDLNDSDRFDIVSNLSRICAFAREYKKKYVDGLPILKSLWFMKKEAKTQLDLQIAKTNGKGNCHVWEEKLGKMYWDHILL

SEQ ID NO: 156766 - protein, 142 aa, Heterodera glycines
  Coding regions on vcDNA: vcDNA=SeqID_83189; Strand=-; Position=1-429
MNGIVNVANGMDYKYEKLKEPLLSNEDTDQQSQFEVIEDDTTEEEDMEKAIKILKRFFWRVIMAMNCKNNTIKKPEEIGFKKSYQELVEICEYWKMLSIAAEAYVKSWKRCKKGPKQENEAEVGTSSTRAQDTLKTEENGTK

SEQ ID NO: 156767 - protein, 82 aa, Heterodera glycines
  Coding regions on vcDNA: vcDNA=SeqID_83190; Strand=+; Position=1 -214,1275-1309
MLRWRWRLRMLWLLRLWRWRWQQQRRRTVSSNHRSNRFYHGSTSSTTARHILGQYHATFGTCNSDNNGTKPGNQYFFYGQIW

SEQ ID NO: 156768 - protein, 84 aa, Heterodera glycines
  Coding regions on vcDNA: vcDNA=SeqID_83191; Strand=+; Position=1 -141,468-581
MSSGGVPGIRVVQMPGRRRRRRQIASVQTLIARATRSTPSKPVVPSMPRIIICLNTPKSTTEHMPKFLFKMLRKARRMDVGKKH

SEQ ID NO: 156769 - protein, 131 aa, Heterodera glycines
  Coding regions on vcDNA: vcDNA=SeqID_83192; Strand=+; Position=1-396
MTNHSDKVPKDSGKMTNHSDKVPKDSGKMTNHSDKVPKDSGKMTNHSDKVPKDSGKMPAEIGGEREYLLLEKYGQKILGKTIKHSEQLRKVIEWIYKKQCLLEPVFDKISKVNFKNFVFWDRRCRKKPGNL

SEQ ID NO: 156770 - protein, 63 aa, Heterodera glycines
  Coding regions on vcDNA: vcDNA=SeqID_83193; Strand=+; Position=1 -86,498-603
MNFSEVKALNLFNNYLFWCKTSVPNSAYFENLFKKVQHFQFFPRRRLSAPPEPRPMFPKGFFG

SEQ ID NO: 156771 - protein, 18 aa, Heterodera glycines
  Coding regions on vcDNA: vcDNA=SeqID_83194; Strand=-; Position=1-55
MPIPATDEAGTCCSLRMH

SEQ ID NO: 156772 - protein, 54 aa, Heterodera glycines
  Coding regions on vcDNA: vcDNA=SeqID_83195; Strand=-; Position=1-307
TFLVLFESIRKMLLACKFSKIFIYAQKNLSKKSSNYWVFEFLLAITFLKLNEKF

SEQ ID NO: 156773 - protein, 143 aa, Heterodera glycines
  Coding regions on vcDNA: vcDNA=SeqID_83196; Strand=-; Position=1-429
MASFLIPNPQHQQVSGAQQLVSLVVGGTVCESHRLRVGRCSRVVVDFSDNSSGGSFCAANAGGRAKMKKMFVTGGDGTEQQQDDTITDELQQQEDEDDDDDDDEDEFRILSAHRKQRKEKQNSHLYNVDTTYCIQLVQGGGVL

SEQ ID NO: 156774 - protein, 86 aa, Heterodera glycines
  Coding regions on vcDNA: vcDNA=SeqID_83197; Strand=+; Position=1-261
MAHRNCCWALLILLTVLCCLTVLVPSILACCCDCCCCCGGGGGGGNSANNIATATALATALNGSLLVLPGSSSGNVYCLDFMTKKA

SEQ ID NO: 156775 - protein, 132 aa, Heterodera glycines
  Coding regions on vcDNA: vcDNA=SeqID_83198; Strand=+; Position=1 -119,169-448
MPRNFLLWVNVIEYFVCLALQLPALLLLMAITISVQFRKKNHSQNEKPLCPTLIYYLLFLLISLISAVAYHCYMVSNFVQNGAEKADPYWMFWLALCYECANVAVPVAILGLTIDRYGIGNRVAAESLNRKH

SEQ ID NO: 156776 - protein, 546 aa, Heterodera glycines
  misc_feature (478)..(478): Xaa can be any naturally occurring amino acid
  misc_feature (545)..(545): Xaa can be any naturally occurring amino acid
  Coding regions on vcDNA: vcDNA=SeqID_83199; Strand=+; Position=1 -170,222-301,348-452,497-552,737-899,1006-1119,1171-1248,1299 -1319,1395-1469,1514-1620,1675-2104
  Homolog annotation: Hit_ID=CAE74894.1; Match level="QueryCoverage =94%, HitCoverage=56%, E-value=1e-98, Identity=42%"; Hit description =Hypothetical protein CBG22760 [Caenorhabditis briggsae]
INQCVIKLKLIYWVKKIEVSSIPQMLMGFHLDFLSCYFSDQVMSGFVLGGCVHVFFSQIGDLLGFFSQIGDLLGIQHLLPKRSGRGYLYERILDISFNLRILDISFNLSNTHIPTTIISLSSIAFLMFTQQILEPWLGTAFQFPIPYELLLVRPWLGTAFQFPIPYELLLVRNYLPSFPPPSMVRYELFPFVFFDAIGIAVTAVAMHLTVAKIVENRYHYKINSCQELYSLGLSGICSSAFPVFPITSIFARTLIGDADENSTQMTTCFSTLSLLTVIMTTCFSTLSLLTVILYIGPILEYLPKCILASIVCILASIVMVSICASFTKFRELRELWPLFKIDFVIFLVSFLLTVCYDIAEGLTVIFLVSFLLTVCYDIAEGLTFSALFSAFTIVVRDQWPKWHFLPKWHFLTHDEELGEYKEMPKELLQQIADEGHAFIIRYDAPLIFTSVHKFESKWKKMRKLSEFGCAFRCSSNAXSDGNSELSTKSTRQKRTMRREKAEIGPGANNALIIDCSGFPYVDFLGLKTLKKVLVFRSFEKEQIFXV

SEQ ID NO: 156777 - protein, 27 aa, Heterodera glycines
  Coding regions on vcDNA: vcDNA=SeqID_83200; Strand=+; Position=1 -38,320-365
MKKNTLSFSNVQFATYFLNPLQLHIIN

SEQ ID NO: 156778 - protein, 160 aa, Heterodera glycines
  Coding regions on vcDNA: vcDNA=SeqID_83201; Strand=-; Position=1 -45,94-256,352-517,1135-1243
MTPIGAEQKNSELLEKFQSVREIGEAKVRVAEYLQLILEKYQERVAKDLAEFKADLEAENPGETELIEKNFMQTMLAMSSSSAGQFADLLDNLNIGSDNLEQQIIHPLRPFVSVSAENLNGDEERVRRHLFRQYRLHTQALRSQKLISMAPNWAQLVAPF

SEQ ID NO: 156779 - protein, 267 aa, Heterodera glycines
  Coding regions on vcDNA: vcDNA=SeqID_83202; Strand=+; Position=1 -11,157-252,404-684,818-954,1090-1368
METCARDILQKALRKFPTAPRLWLTYFEIEIRFVEFLHQRRMFLLQQHKSNEMKNKWQKKNNSSKRKSNGQQKNEETAQITDEEAEKFKQFNSSSNNNDDEDEVLGLKLATIVYEMAMKSVEEHPAEKTKLLRDFLRVARDCAHFADVLVQKLTDHLHALGEHAEEEEENAVEGQLIPDEQLFAVDTEGDDDQQQKHNAEDDDMEENEAEEGTKQGISGGNKTDNNGIGIATKSTGDGGGGGNNSVLDGFNPDDPELKLVGLLFSQY

SEQ ID NO: 156780 - protein, 233 aa, Heterodera glycines
  misc_feature (56)..(56): Xaa can be any naturally occurring amino acid
  misc_feature (108)..(108): Xaa can be any naturally occurring amino acid
  Coding regions on vcDNA: vcDNA=SeqID_83203; Strand=+; Position=1 -72,299-409,723-835,1094-1296,1682-1885
  Homolog annotation: Hit_ID=NP_507875.1; Match level="QueryCoverage =90%, HitCoverage=35%, E-value=9e-49, Identity=50%"; Hit description =flavodoxin family (66.4 kD) (5U546) [Caenorhabditis elegans] gb|AAL86012.1| NADPH-dependent flavin reduct
QLGFDFENHYFKSQRMCILNIIIPQYHPISVVANDRLTDQAHFQDTRLITFNTSIXVRAKFGYSPGDVLMVLPENLPQSVRIATDALDQCRHRLDEPLKLFKPVEFAXKFPFFSFGCSATLRDCLCFYFDLQSVPKRSFLRALAKCSPSEMERDRLMELCSAEGIDDFLDYCQHPRRTLAELLRDFPNTASRLGPSELFDFFPVIRPRAFSIASSPTAHPGQIQILVARVEYA

SEQ ID NO: 156781 - protein, 46 aa, Heterodera glycines
  Coding regions on vcDNA: vcDNA=SeqID_83204; Strand=-; Position=1 -55,352-437
MQNMDKKYENMDQNFLKIVKMPKYGSKYGNMDKNLKMEKYGNKNAF

SEQ ID NO: 156782 - protein, 169 aa, Heterodera glycines
  Coding regions on vcDNA: vcDNA=SeqID_83205; Strand=+; Position=1 -129,175-303,710-850,1007-1117
  Homolog annotation: Hit_ID=XP_397141.1; Match level="QueryCoverage =85%, HitCoverage=27%, E-value=3e-38, Identity=52%"; Hit description =similar to NADPH-dependent FMN and FAD containing oxidoreductase -like protein [Apis mellifera]
MIILYGSESGTAQDFAEQTWQTFHRNGTKIVAKCMPFDDFQIAQLSDEKMTIFIVSTSGQGEVPTNMRKNWRYLLSRKLSAQWLSNLHFAVLALGDSSYQKYNFAGKKLYRRLLQLGAKPVMELVLADEQHTLGVDEVFEKWLPELVEIVKKQPVIQQFAILRPFFSSD

SEQ ID NO: 156783 - protein, 118 aa, Heterodera glycines
  Coding regions on vcDNA: vcDNA=SeqID_83206; Strand=-; Position=1 -95,289-461,687-775
MGWGQMDDNRKMVANRQMADNGQMVDKIGAKRKSVKIGDAMAHLGSYDKCERAHPNGAGIGPTHRWQFGRIGEGFLAAPSEHRRENSRNFRLKFSKNPVFLKNNIPSPSLLKNVKNEP

SEQ ID NO: 156784 - protein, 69 aa, Heterodera glycines
  Coding regions on vcDNA: vcDNA=SeqID_83207; Strand=+; Position=1 -35,220-319,372-444
IRSFIHGNLKKAPIWLRFICKDGTESDTYYFRGGGYESLVNCLQRYVFLTRSAKSDNLILISDSRTDAL

SEQ ID NO: 156785 - protein, 243 aa, Heterodera glycines
  Coding regions on vcDNA: vcDNA=SeqID_83208; Strand=+; Position=1 -134,250-514,558-669,730-846,893-993
  Homolog annotation: Hit_ID=AAH76966.1; Match level="QueryCoverage =97%, HitCoverage=34%, E-value=3e-49, Identity=41%"; Hit description =Hypothetical protein MGC76102 [Xenopus tropicalis]
MTLASKVTSSLAPLLDPEAVISENQLRVLSQQQPAADEDESSKLRQFCDSGFEHIFQLDLPHRPQILHRDPPVDKTIFDKFRSLSGNDGRILDSHGLKSLIFRGGISPEMRPILWKYMLGFFKWDRSDAENEHHRKKLEEDYYRMKLQWMSIGEDQESRFGAFRDRKALVEKDVARTDRSHPFFSRTNPENLHLLRDLLMTYCMYDFDLGYVQGMSDFLSVLCVVLEREVDIFWCFVGLMEFV

SEQ ID NO: 156786 - protein, 70 aa, Heterodera glycines
  Coding regions on vcDNA: vcDNA=SeqID_83209; Strand=+; Position=1-213
LNGSNSATSGSDGEVPSSSASKVMPPNTHSQPPQQHHHVTPSQPMPVPISYAASAADFSTMVGTPEFIQV

SEQ ID NO: 156787 - protein, 55 aa, Heterodera glycines
  Coding regions on vcDNA: vcDNA=SeqID_83210; Strand=-; Position=1 -32,372-507
MFLNNNDNETNYLCFKRFVGDKNDAEIYCPLRHHIEGHPRKIKDHEKLASTVHVL

SEQ ID NO: 156788 - protein, 78 aa, Heterodera glycines
  Coding regions on vcDNA: vcDNA=SeqID_83211; Strand=-; Position=1 -106,155-285
MPNQPKPFWASSAEARRKRKEWRQEHGCRVGSTPKMPKQTEAAPTADGEGTSTQAAESKPSTSAQDLRKSTNGCHIRD

SEQ ID NO: 156789 - protein, 67 aa, Heterodera glycines
  Coding regions on vcDNA: vcDNA=SeqID_83212; Strand=+; Position=1 -94,1176-1285
VFGVADHESSIYFDQFGIPDPNSNKKSKIQTVLGYSKFEKVNPEMKDYIDEVSAEDESEEEERDDAE

SEQ ID NO: 156790 - protein, 40 aa, Heterodera glycines
  Coding regions on vcDNA: vcDNA=SeqID_83213; Strand=-; Position=1 -94,523-551
MRTNKGTEKRMASKRRKRKESSPTAEKGAISDNCKIVTVL

SEQ ID NO: 156791 - protein, 237 aa, Heterodera glycines
  Coding regions on vcDNA: vcDNA=SeqID_83214; Strand=+; Position=1 -210,305-461,506-765,1027-1114
WICSDVWMDILPSFDHAQLGLKMALLSDRFDVLVDKHFDGKATELTFWRIIRIGKENGPNANDNGPKPKLILIICDDGPNATADQVLSKWLHTPGKDGQPKRLFRNNYFGPLNLEWVNDFKETFLRSITSVSYTIRFHLFSNTMPIEPFELVNKRTNEKLTLMKDENDDGKFKDWLLKRCPIIGETMAVQHDQNLDHSNRFFSLCGAIGPMSLPPTDQSDEKVFSTPGPSDQQKKEK

SEQ ID NO: 156792 - protein, 390 aa, Heterodera glycines
  Coding regions on vcDNA: vcDNA=SeqID_83215; Strand=-; Position=1-1173
  Homolog annotation: Hit_ID=XP_318162.1; Match level="QueryCoverage =87%, HitCoverage=42%, E-value=6e-95, Identity=50%"; Hit description =ENSANGP00000020700 [Anopheles gambiae]
MINHYQQFVKNMRFLRQPLDELLKQDVSWVWSTDCQNAFNKMIEVLKSDQLLTHYDPEKDIIVSADASNYGIGAVISHRFPDGSLKAIAHASCSLSPAEMNYSQIEKEGLALVFAVQKFHKYLFGRHFVLQTDHKPLLTIFGNKKGIKACTANRLQRWALILLAYDFEIEYQNTADFGQADALSRLIAKAPVPEDEFIVATITESPNLATVNAFTAQFPIVHEDIVNATKADNLLQEVKGFIMNQWPNKMDMSDDILQFHRRREALSFENGCIMYADRIVVPASLQTEVLKMLHRGHPGMKRMKSLARQHVYWPGIDQQIEEVLRKCEPCVTEAKAPKKTELHSWPKAEGPWKRVLMDYAGPFFGKMYLIIVDAHSKWPEVFEMRCCCCY

SEQ ID NO: 156793 - protein, 50 aa, Heterodera glycines
  Coding regions on vcDNA: vcDNA=SeqID_83216; Strand=-; Position=1 -76,1481-1557
MATRKRPSRENGHAKTTPTVEWVEAVLMAYNLFPCNHSHNCLIVVGTDDF

SEQ ID NO: 156794 - protein, 79 aa, Heterodera glycines
  Coding regions on vcDNA: vcDNA=SeqID_83217; Strand=+; Position=1 -129,1041-1148
MGSRTIRPVDNPSVVNPSVMDNPSVDNPSVVNPLDNPSVDNPSIILPAAKWGIALHAVVFLALMVHQRPFAVEVLSTLH

SEQ ID NO: 156795 - protein, 111 aa, Heterodera glycines
  Coding regions on vcDNA: vcDNA=SeqID_83218; Strand=-; Position=1 -277,582-640
MSLNTFIFAECVNWPRILNECPSLRFFNIISDIFPEFPPDDNANATDGQAVVKNSGTKFTFPLEITEPTIFLIPNHSNLNKFRFIFLFQSYRTQLFYETYSNSRKIEVPYT

SEQ ID NO: 156796 - protein, 116 aa, Heterodera glycines
  Coding regions on vcDNA: vcDNA=SeqID_83219; Strand=+; Position=1 -237,347-460
MAEKSDDIAVEVTKIGKSDQKKISMCLHSYVIKISLNPMTLLGTRILWDWQTLPIDIDNFHFIGAIPSLRFQGQAEKAEASSFFDVVPKEPKNGATADQQKRHNVPTENEFGEMNE

SEQ ID NO: 156797 - protein, 29 aa, Heterodera glycines
  Coding regions on vcDNA: vcDNA=SeqID_83220; Strand=-; Position=1 -66,123-146
MAISFFEKFSMQQTLSNMKRSAKNGYLFF

SEQ ID NO: 156798 - protein, 29 aa, Heterodera glycines
  Coding regions on vcDNA: vcDNA=SeqID_83221; Strand=-; Position=1 -66,123-146
MAISFFEKFSMQQTLSNMKRSAKNGYLFF

SEQ ID NO: 156799 - protein, 29 aa, Heterodera glycines
  Coding regions on vcDNA: vcDNA=SeqID_83222; Strand=-; Position=1 -66,123-146
MAISFFEKFSMQQTLSNMKRSAKNGYLFF

SEQ ID NO: 156800 - protein, 29 aa, Heterodera glycines
  Coding regions on vcDNA: vcDNA=SeqID_83223; Strand=-; Position=1 -66,123-146
MAISFFEKFSMQQTLSNMKRSAKNGYLFF

SEQ ID NO: 156801 - protein, 152 aa, Heterodera glycines
  Coding regions on vcDNA: vcDNA=SeqID_83224; Strand=+; Position=1 -136,195-403,449-561
  Homolog annotation: Hit_ID=CAE57231.1; Match level="QueryCoverage =96%, HitCoverage=76%, E-value=6e-29, Identity=40%"; Hit description =Hypothetical protein CBG00101 [Caenorhabditis briggsae]
GQLWTDLVRAKRQLVPSAAGSIVNYGINGQRKRRQAEPRCDCISTALCPAGPPGPPGIPGADGEPGRAGEAGTVGLPGPLPQIQKTVDAESCRVCPPGPPGQPGYTGPPGPPGAVGPSGERGVFGMPGNPGAMGQPGDSGNPGEAGQEVQAT

SEQ ID NO: 156802 - protein, 208 aa, Heterodera glycines
  Coding regions on vcDNA: vcDNA=SeqID_83225; Strand=+; Position=1-6,51- 314,362-594,657-780
  Homolog annotation: Hit_ID=NP_493543.1; Match level="QueryCoverage =98%, HitCoverage=52%, E-value=2e-40, Identity=42%"; Hit description =speckle-type POZ protein (45.5 kD) (1P243) [Caenorhabditis elegans] emb|CAB60850.1| Hypothetical protein
MLFTVRAEYHFYFVDEQGIAKFSNVNTGDFKVKPSKGSHSWGLRNIPRTKVKSCIRPDLSLHIVCQIELVPDFSKVQSQCFRNRRYDQSQLTKEYLDRIHQMFLSGEGSDCVIECGNEQFHVHKFVLMTHSEVFRAMFSHKETMESVESRVRITDCTPIAVHQMLTYMYSGGLPDKFDNDHAQGLIEISEKYGLEPLKIICQDKLISR

SEQ ID NO: 156803 - protein, 94 aa, Heterodera glycines
  Coding regions on vcDNA: vcDNA=SeqID_83226; Strand=+; Position=1 -191,299-356,523-558
  Homolog annotation: Hit_ID=NP_872170.1; Match level="QueryCoverage =98%, HitCoverage=9%, E-value=2e-15, Identity=39%"; Hit description =ankyrin and patatin family member (5V188) [Caenorhabditis elegans] emb|CAD54162.1| Hypothetical protein W0
MVMCLLSYGAGLDGRRTHKMTALHFAVSKRNLQFTRLLLCMGADPNLANAHGDTPRHLAAKLNEVDLLKSLIKCGARRCPLTKVGCVSGCVNEK

SEQ ID NO: 156804 - protein, 292 aa, Heterodera glycines
  Coding regions on vcDNA: vcDNA=SeqID_83227; Strand=+; Position=1-879
  Homolog annotation: Hit_ID=AAQ73457.1; Match level="QueryCoverage =78%, HitCoverage=29%, E-value=2e-28, Identity=30%"; Hit description =erythrocyte binding protein 4 [Plasmodium yoelii yoelii] gb|AAQ73455.1| erythrocyte binding protein 2 [Pla
MANADSPILISDEELSDDEIHLRKLLLSEQQQQQLREQQFNPDRPYSSTVHSLPINQVQIVTPAQGQQLKRDQQLALINQKIKEMEAAKRQIEEEETAEEEARILREKAWKAEEQKKRTKRELDEKVKKREEEKKAEEKAKKDKEEVKAAFKKIGMSTEVGGKEDENKPKKKKSKNNKGKDTENGNLKAEKLNDGHREAKKDAEEKATREAEAKKDAEEKAREKQKRRKMQKKRREKQKRRRMQKKRREKQKRRRMQKKRRGEKQKQRKMQKKRREKQKRRKMQKKRREKQK

SEQ ID NO: 156805 - protein, 174 aa, Heterodera glycines
  Coding regions on vcDNA: vcDNA=SeqID_83228; Strand=+; Position=1-525
METISEKWTPKIVGSIFDPRGEELGDDWTIKKCQENREKEDRLREGKSEERMKAWKEWTQPKNQWESGGTAQGGKRFFENTLKSAVISANETRAIPPEGMGWKRHVPCFQAAPPGPGFKRRHHDVSPIRRMDSTGQGTSAASGTEERIVKIRKLLLQAADLLGEMADELFPYKK

SEQ ID NO: 156806 - protein, 191 aa, Heterodera glycines
  Coding regions on vcDNA: vcDNA=SeqID_83229; Strand=-; Position=1-574
MSTVTSEDQPAPVQKQQSRPVPSNRQQPANSVEYDQPLLVNKQQGRPVPSNRQPQNGTAEDHPSPVKLGNRQNQNGTAEDQPDQPSPVKKQQGRSVPSNRPPQNGTAKDKPDHSPPMKKQQGRPVPSIRQAHYEATEDQTRPMTKQQSRPMPSNRQAQNGVEEDQLLPVKKQQGRSFRMAEDQPAFVKKQQ

SEQ ID NO: 156807 - protein, 31 aa, Heterodera glycines
  Coding regions on vcDNA: vcDNA=SeqID_83230; Strand=+; Position=1-94
MSFQRAQLQKVAVHCEGTIRSCSNSSSSSSD

SEQ ID NO: 156808 - protein, 117 aa, Heterodera glycines
  Coding regions on vcDNA: vcDNA=SeqID_83231; Strand=-; Position=1 -69,827-938,987-1158
  Homolog annotation: Hit_ID=CAE68248.1; Match level="QueryCoverage =70%, HitCoverage=10%, E-value=8e-24, Identity=60%"; Hit description =Hypothetical protein CBG13923 [Caenorhabditis briggsae]
KPPCQLARPHGFLINKAMICRSRIFHFHFWHYGRWTEVIIDDRLPCRTDGRLLYSRPPDDDVFWSVLLEKAYAKVYGGYQELVGGKIRECLSDLTGGITEEWDLKAMSINQKRTLEL

SEQ ID NO: 156809 - protein, 26 aa, Heterodera glycines
  Coding regions on vcDNA: vcDNA=SeqID_83232; Strand=+; Position=1-78
MNGDAIMYDGKWTKDTARRGSTKPQH

SEQ ID NO: 156810 - protein, 77 aa, Heterodera glycines
  Coding regions on vcDNA: vcDNA=SeqID_83233; Strand=-; Position=1 -68,248-277,576-711
MSYIIYSQCYRQDLNDREEPFSGTIDDKFDGGWRAHVQKKGNEEEKKEEGEEEEKKEEIEEEENKEEREEEEKKESG

SEQ ID NO: 156811 - protein, 52 aa, Heterodera glycines
  Coding regions on vcDNA: vcDNA=SeqID_83234; Strand=+; Position=1 -23,578-713
MYITDRQGRAHVQKKGNEEEKKEEGEEEEKKEEIEEEENKEEREEEEKKESG

SEQ ID NO: 156812 - protein, 313 aa, Heterodera glycines
  Coding regions on vcDNA: vcDNA=SeqID_83235; Strand=+; Position=1 -276,352-511,554-1059
MEALHRILREHHKLAVVYESAAETYRQLPIEERVHLRMLLVDTNKIGVERTVEDDAAQAPANLHADDRANVKQIHPGRLGTETVAGSRLVAQFYLDDGSNVIPPSEYDVIFMGRDATKVKHMKWWNRNIDPALYPLLFPYGQYGYEYGIQLKLEKDERFDTTYRQIRDKDNNLLSTADDLGEEEEFLGAEQEQQFHRRDHVSRSQWYRYMAHIRGLNYNWRDGHWLWDWRTLAQHYTISFNNRMEAQKFQFMKQHQGRRRLILPSAIINWLKALRDNKGKNDFVANEMFYYLGYKGDIGRVYMTDEHFRGSRQ

SEQ ID NO: 156813 - protein, 321 aa, Heterodera glycines
  Coding regions on vcDNA: vcDNA=SeqID_83236; Strand=+; Position=1 -42,192-351,393-1156
  Homolog annotation: Hit_ID=XP_315032.1; Match level="QueryCoverage =75%, HitCoverage=31%, E-value=1e-09, Identity=23%"; Hit description =ENSANGP00000010309 [Anopheles gambiae]
MTQRKHLLICMLTTFYLDDGSNVIPPSEYDVIFMGRDATKVKHMKWWNRNIDPALYPLLFPYGQYGYEYGIQLKLEKDERFDTTYRQIRDKDNNLLSTADDLGEEEEFLGAEQEQQFHRRDHVSRSQWYRYMAHIRGLNYNWRDGHWLWDWRTLAQHYTISFNNRMEAQKVQFMKQHQGRRRLILPSAIINWLKALRDNKGKNDFVANEMFYYLGYKGDIGRVYMTDEHFRGSRQYYQKEYANCMTICREVGKPDLLVTFTMDPESPELDECCQWCQRTKGNSGLIGQMWFADFSSTNYVNCTTTSRIKKSWDLFVGGSTH

SEQ ID NO: 156814 - protein, 230 aa, Heterodera glycines
  Coding regions on vcDNA: vcDNA=SeqID_83237; Strand=+; Position=1 -276,320-736
  Homolog annotation: Hit_ID=NP_510742.1; Match level="QueryCoverage =86%, HitCoverage=25%, E-value=1e-12, Identity=27%"; Hit description =ubiquitin thiolesterase, family 2 (XR558) [Caenorhabditis elegans] gb|AAF99971.1| Hypothetical protein F5
MGLKDDEEDLNAICEAAQAEEERRARGEERVTQLTAYFTFNKDNAPLGLTYAKCYKKLWYDIAKKQWKPYVNRVVPKFCRLKTVSPNNRELLAIRMLLLVVCDPTGWEALRTHNNIVHGSFIEAAQARGLLSDNNLWMNTVMEAFQTKKSIRQRIRWLAVFFATTNLSSPTTILDSILKDADNWLVNTSVAKASAEDQKQYVLRALEWFLLANGITPDSEPREDGTFESA

SEQ ID NO: 156815 - protein, 99 aa, Heterodera glycines
  Coding regions on vcDNA: vcDNA=SeqID_83238; Strand=+; Position=1 -276,834-857
MHFLAMASTGIAAELLYEGQTVHKRICRMKHVDSSTSPNVDYESNFAHMLRNIHGMLIDEISMQNKDVLEFVDRLLRSVAPDELKEIPFAGKHYVPIVN

SEQ ID NO: 156816 - protein, 84 aa, Heterodera glycines
  Coding regions on vcDNA: vcDNA=SeqID_83239; Strand=-; Position=1 -142,1035-1147
MGRKFGHEMKNGGQNEQMNKMGGKREIWGFIVLWSRFAKLGTAAKSCAAYILPASTGTGTAQLYFLRSDYPFLTRWPPLGRSHQ

SEQ ID NO: 156817 - protein, 596 aa, Heterodera glycines
  Coding regions on vcDNA: vcDNA=SeqID_83240; Strand=+; Position=1-1791
  Homolog annotation: Hit_ID=CAA82797.1; Match level="QueryCoverage =73%, HitCoverage=58%, E-value=2e-28, Identity=25%"; Hit description =gag protein [Ascaris lumbricoides]
MSGPIQKGIINALKTLDNAKSATSLLLHPDPDLSNWENAINLEAQFDRVVKEIRTTEMQMDSLRDLSNAWIELLARLTGDDKDNGEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPELYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFLMLEKKLTPAFLRNILNKKGEDPTNWTTTKFRDVLNEAVRKEVQIQEVLGEYGHHHQSLDRPARPATQAQSSRTRNFAANFRNRNATPANRERTFMSSTIEEVHKRVNHNKPQQRKSQPKGLRPTQAPSTVPIRNGTANQAGSRKPPSPCLFCNGNHWNEDCQRYNTVQQRSAFVRDKGLCFKCLKSNHRASECPRPIKCYKCKQLHPAVLCQEGTNAATQTQQAAAVMERHPKQDEQKYTSQTAQLMSNAVKSSDTRALLMTTMATIFNPSRPCHSMMQPSSLTREATGHSFQTRQPSNLN

SEQ ID NO: 156818 - protein, 95 aa, Heterodera glycines
  Coding regions on vcDNA: vcDNA=SeqID_83241; Strand=+; Position=1-288
MATIFNPSRPCHSMMATIFIDPGSHRSFNSNTAAKQLELTVLRTEECFLTSFGEREPKRYVSDRVAIGFSCPNGDRLIFNLNALKFLLNNLPVLQ

SEQ ID NO: 156819 - protein, 302 aa, Heterodera glycines
  Coding regions on vcDNA: vcDNA=SeqID_83242; Strand=+; Position=1-906
  Homolog annotation: Hit_ID=NP_508646.1; Match level="QueryCoverage =88%, HitCoverage=12%, E-value=2e-41, Identity=39%"; Hit description =predicted CDS, RNA-directed DNA polymerase  and Integrase, catalytic domain containing protein family mem
MDDSSTLIDRDEVMKNFKENLSFVNNKYQIALPWNDRVAQLPTNYHQAKARLISLIRKLRTINLVDEYQAILDEQQQNSIIELVNSDHSCGPVHYLPHRAVIRTDKSTTKIRIVMDASAKPKSTPSAPSLNECLHTGPLLLKDLTGILLRFRRMEKVILADIEKAFLQLGVREQDRDATRFLWLANPKEANLEQLRQEDFRIFRFCRVSFGLTVSPFLLNATIREHLALHDTDVAQRISDNLYVDNIMMEVKPSESINQLVTEAKIIFKSAGMRIREFFGSQIDELKELDSSELAKDLENTR

SEQ ID NO: 156820 - protein, 123 aa, Heterodera glycines
  Coding regions on vcDNA: vcDNA=SeqID_83243; Strand=-; Position=1 -123,1666-1912
  Homolog annotation: Hit_ID=NP_499647.1; Match level="QueryCoverage =66%, HitCoverage=36%, E-value=6e-16, Identity=45%"; Hit description =TBP-Associated transcription Factor family member (26.4 kD) (taf -7.2) [Caenorhabditis elegans] emb|CAC358
MHSSGTNGLALTIEQPFDVHESNDGTLRGQLGGVEKCADEAIMKTLDNKTVYKIADLCQMIVANAPKYESKKEGVEEGAESKSDRFQWPDGICPPLKNVRRKRFRKIKKKKYMDVADVERELK

SEQ ID NO: 156821 - protein, 533 aa, Heterodera glycines
  Coding regions on vcDNA: vcDNA=SeqID_83244; Strand=+; Position=1 -263,304-373,532-773,1004-1040,1099-1206,1255-1396,1447-1642,2251 -2399,2442-2500,2546-2590,2635-2719
  Homolog annotation: Hit_ID=CAE71262.1; Match level="QueryCoverage =77%, HitCoverage=100%, E-value=1e-123, Identity=57%"; Hit description=Hypothetical protein CBG18144 [Caenorhabditis briggsae]
MGNNNCCVRHTPSISKKKSQENHTASEQTLQKSNIQIRLFVNFDDLKPLFRKLPFSGLVNHFFNGRDSSVNFLPHISEREIPDGWEQDPSTHPSVRPTEQDPSTHPSVRPTFVERSRSELKLRDNRRSFYVLDLNNLHAPVTLKKSNSCSTIYLDDSTISQPHLKNTIICVSLAVFYHIINRKNRGKERLMEIFEERLHPITNEPVAAENFTRDPEHEHRQIYRFIRTLFHAAQLTAECAIITLVYIERLLNYAEIDLCPSNWAEIDLCPSNWRRIVLGAIMLASKVWDDQAVWNVDYCQILQDTNVDDMNELERQNELERQFLESLEFNINVPSSIYAKYYYDLRTLAIANDIQLPLQPLYKERAARLEALSRNYEDKVAGEHKMRAWKGKPKQNRHFEFINKERIVVLNESIDGSGKKVFKRWDERMEKENFVESDVDEELLFENFVESDVDEELLFSVPFTGNVKLSGLCFSGRMDGNVKLSGLCFSGRMDGSFPARVRIFKSFPARVRIFKDRVNVSFSNPPSLAEGQR

SEQ ID NO: 156822 - protein, 780 aa, Heterodera glycines
  misc_feature (1)..(1): Xaa can be any naturally occurring amino acid
  misc_feature (73)..(73): Xaa can be any naturally occurring amino acid
  Coding regions on vcDNA: vcDNA=SeqID_83245; Strand=-; Position=1 -103,221-417,807-934,1080-1169,1231-1344,1751-1870,1919-2020,2068 -2200,2473-2631,2811-2882,2949-3064,3123-3187,3242-3377,3647 -3756,3826-4020,4079-4112,4159-4282,4489-4514
  Homolog annotation: Hit_ID=CAE70087.1; Match level="QueryCoverage =99%, HitCoverage=99%, E-value=1e-117, Identity=33%"; Hit description= Hypothetical protein CBG16528 [Caenorhabditis briggsae]
XKTNFSSFKENADKFMFTKTGRYVRLGLLAATVCAYPVIKVCSSGPLLSTSFKWRVKIDTVNFFPIFALDYSXQIVENVFRLPEHLEKTINEVSEFSTSLDSISLGTSSFSTGAQIALPFYVKFRTADEAKAYAKEHFEVPFKVLGKVACVVWESRVGRQLLSTFVLSDEALAFLVARDLALAFLVARDLFSVKETYMLTRDALTWFCYVIPSFPFKGLLLRSARLFKGSFLSFVLVYPLLAALSVLTAKQWNDLATYANERQADMEAAKMSQLHTRYANERQADMEAAKMSQLHTRGGREFYSKFLLRNRLLRELVDGGDLLRELVDGGDKLFTEVGDYRKAIAEYVLRYDDIGTVRSENEQLSAYVMGVALGLSSCVVSSFCFGSMYVVRFVCLSSGTFIFTAFRLYAKAAIHGMVTFLFTGCPPFQHFAMFGGALWALGNLTAVPIINAIGLGMGNLTAVPIINAIGLGMGILIWGVCGCVVGWAIGRFGLFGVNPNVPNSPILNYAGLVFVVNPNVPNSPILNYAGLVFVIIGGILFALVRPKDNKNNAKNGILFALVRPKDNKNNAKNDDEMPNELMGQQTTTESGAMTEERIGLSLPAFVMEQCDFFVTVNCKFYSFYNLRFTPVIYMQDNSELFDNPPKDAILYVFSHFSGVYLTSTTVLLIYICFTKNRPYMDNRLIFPALLAGVFWAIAMLAWFVANDQLSQAIFVANDQLSQAITFPINSMTFPINSMAPGVIASVWSVLYFKEVDRDLKLLASAMLITVFGAVLVGLSK

SEQ ID NO: 156823 - protein, 67 aa, Heterodera glycines
  Coding regions on vcDNA: vcDNA=SeqID_83246; Strand=-; Position=1 -18,86-271
MPFWRKSSIELGKLLYRLTDGKAPFDANGNCKRHKMKYTDRMKAIESIEKKMAKEGKPKKMQYNSTF

SEQ ID NO: 156824 - protein, 101 aa, Heterodera glycines
  Coding regions on vcDNA: vcDNA=SeqID_83247; Strand=-; Position=1 -37,762-896,1006-1139
MILEYRHFLSFYDLHIFPFIFHHKKMNSKMHRSFFHWTSLLMQGGILCAPIIVNLQRNKLNHDFKLRKMMSADLPNMPDENLLDLVEAEMLAKSNDRLYPI

SEQ ID NO: 156825 - protein, 70 aa, Heterodera glycines
  Coding regions on vcDNA: vcDNA=SeqID_83248; Strand=+; Position=1-212
MLKVILRNFTVLVQKSDSATLAFGFIAGAGLELFKINFSCFGISFYKVFNEKQLSQELTKFEEKLANRNS

SEQ ID NO: 156826 - protein, 78 aa, Heterodera glycines
  Coding regions on vcDNA: vcDNA=SeqID_83249; Strand=-; Position=1-237
EESTVNHQSPKKKAPPNNARVARRPRDLRGLFPRAHRPISSASEQPTTQLKSNRLFARIDESFRSRWLKLRSKSTSMV

SEQ ID NO: 156827 - protein, 375 aa, Heterodera glycines
  Coding regions on vcDNA: vcDNA=SeqID_83250; Strand=+; Position=1 -139,613-691,825-906,956-1102,1152-1377,1428-1609,1676-1948
  Homolog annotation: Hit_ID=NP_499652.1; Match level="QueryCoverage =72%, HitCoverage=80%, E-value=2e-66, Identity=47%"; Hit description =endoplasmic reticulum UDP-Glc UDP-Gal transporter (38.4 kD) (3N803) [Caenorhabditis elegans] emb|CAC35849
MYVDDDDDDDTITHGNNPTANDAAMAQRMQKQLQEQQEEADAELARPYFLFSKKHRPHMAGGTTLQLSSQQACTQRLFGEKKERFVYMQALVFFQCATNLLVAWYVLRRNKQKSLDNVPIHLYSMCSTSYFLAMLFSSYALEWVNYPTQVLGKSCKPIPIMLFGVLFAHKRYGLRKYFYVLLIVTGMAIFLYKPQKGSVGFQFGSGELFLCLSLAMDGFTGAVQDRIRHYHTTDKWTMMFSMNAFSSAFLALILLASGELFQFFRFVAAYPFILQQMLLFSLSGACFIFKTVTDFGPLTCSIITTLRKLFSLVFSIIIFSHPYTNRHVLGIIFVFAALILDAIDSRKSHGKAKGDEKPPAKDGLLQEATAQEKEN

SEQ ID NO: 156828 - protein, 42 aa, Heterodera glycines
  Coding regions on vcDNA: vcDNA=SeqID_83251; Strand=+; Position=1-189
FLKPPTHMIMYINIYIYIYILEVYITIKNLKYICISSDGKIK

SEQ ID NO: 156829 - protein, 86 aa, Heterodera glycines
  Coding regions on vcDNA: vcDNA=SeqID_83252; Strand=-; Position=1-258
MNTSLILLLFTVCFVFLAHFPQNAQAADTKRVYFVYGNPVEVEARCPGLSIELGATTKGAESKQYLDIATSKWPSWVGDNEEITFH

SEQ ID NO: 156830 - protein, 136 aa, Heterodera glycines
  Coding regions on vcDNA: vcDNA=SeqID_83253; Strand=+; Position=1 -93,291-608
ILVDPWQLVQLLQLGQAEFERVVVGLYVVIRKPWSLERIEGVAWNAVPTYKICGQGPLNVLLCFNGFSYKLCKVDYSRPNSNHEILKNETMVSQPSSTILFLGKINLLFNAKMGSRTKRLRRNVAGHNVKRKTKNI

SEQ ID NO: 156831 - protein, 48 aa, Heterodera glycines
  Coding regions on vcDNA: vcDNA=SeqID_83254; Strand=-; Position=1 -37,199-308
MAGRGHQKIESARVTPTKINSVRAEQGFSHKINPAFANAQIFHVHMLL

SEQ ID NO: 156832 - protein, 61 aa, Heterodera glycines
  Coding regions on vcDNA: vcDNA=SeqID_83255; Strand=-; Position=1 -93,163-255
MPDADQILQQLEHHFVNNWLLDSGKIDELKQRQSDQREEHDEFDQTEEETDEISLINVIDW

SEQ ID NO: 156833 - protein, 111 aa, Heterodera glycines
  Coding regions on vcDNA: vcDNA=SeqID_83256; Strand=+; Position=1 -168,1101-1268
DNCALAVRNKGAASKDIKWLIATYKIKATEEDDIIDVVDCPGNVFMGYQTFSCLDDDNCALAVRNKGAASKDIKWLIATYKIKATEEDDIIDVVDCPGNVFMGYQTFSCLD

SEQ ID NO: 156834 - protein, 226 aa, Heterodera glycines
  misc_feature (19)..(19): Xaa can be any naturally occurring amino acid
  Coding regions on vcDNA: vcDNA=SeqID_83257; Strand=+; Position=1 -127,1010-1075,1122-1209,1258-1375,1490-1691
  Homolog annotation: Hit_ID=BAC40627.1; Match level="QueryCoverage =91%, HitCoverage=24%, E-value=7e-46, Identity=47%"; Hit description =unnamed protein product [Mus musculus]
LALSTRISSIIKEESLSYXSRDGQWQWATNTPWEKQKGAKEMIVHCFIVPFFRQSFHLAYSPHCFTDCAHENVIKKLLARPFTDCAHENVIKKLLARPFRVPIPGYTGPCGNRLLGLRMSGVRNRLLGLRMSGVRLSLHDPYAENALVVFAPPELSAHEQLKIDDTKREVHVVVDPLLCAVLRPHQREGVKFMYDCVKRVEGHNGCIMADEMGLGTLQCIALMWTL

SEQ ID NO: 156835 - protein, 593 aa, Heterodera glycines
  Coding regions on vcDNA: vcDNA=SeqID_83258; Strand=+; Position=1 -498,672-1955
  Homolog annotation: Hit_ID=XP_453995.1; Match level="QueryCoverage =99%, HitCoverage=72%, E-value=3e-37, Identity=21%"; Hit description =unnamed protein product [Kluyveromyces lactis] emb|CAG99082.1| unnamed protein product [Kluyveromyces lac
TTVAAEAETTVTSEAETTVTPEAETTVTPEAETTVTPEAETTAKNEDETTATKEAEETTVTKEAEATTETREAEETTVTKEQEETTVTKEAEAATETKEAEETTVTKEAEETTVTKETEESTVTPTAVQSSENATSEESKAAENSNAPSSGGEIGAVPAEEEQQTTGATNGQLTNGTTAEAETATTASTAAPPTEQTTLINAPPETNEQSNGTNTANAMNSAPLTDQANAEQTKGDANQTMTDKAPDGTNATSAGQQMAGEKTENATNSTSAAVQRNSDQTKGNADQLTQPSKEDSANSTATDQQAMLTNSSDGIAANTTNPAQNTDQKTAPGTMQNSENPTNQSASPEAEKTNVNQINPQKSDGNATFTTANQTTMTDQGNANFSISAQNAELSNVGPTPEKSGNNSNANSTQNAADMGNATQKTTSTEKSNGNTNLTNADPQKSNAQQKQNTDQKSNADQMAPTAKAETSVANATTVDQKTAPTKAENSSAATANSAQNNASNNGTSVSGAPAEMQNVDDETKLKMMIMSSLASQTAPHSAPNPSNSSAAEQRQGAPKGAGVTNNSTAPESAEKKPSLPAAKLANERPQKA

SEQ ID NO: 156836 - protein, 521 aa, Heterodera glycines
  Coding regions on vcDNA: vcDNA=SeqID_83259; Strand=+; Position=1 -635,679-727,772-932,975-1065,1113-1304,1352-1472,1518-1834
  Homolog annotation: Hit_ID=NP_001004509.1; Match level="QueryCoverage= 96%, HitCoverage=34%, E-value=1e-65, Identity=30%"; Hit description =si:busm1-180o5.3 [Danio rerio] emb|CAD60788.1| novel protein similar to DNA polymerases [Danio rerio]
EPVPAEDAYGGEDEQGLDVEEIWECQIREQLKRDDEMRDFFDDLGTDRGPIDPRQTFYGGRTGPLQLIAEPKEDEKISVFDIVSLYPWVNYATDYPTGIPTVIHPTVEEMIVDWTRPEHLQYQGIYRVRVIPPKGLRIPVLPLKIDERLLFCCCHRCAAKFRKLNTRRVHKCPHTDEQRAFTGNFTHIELERALETGYRVDRFWRAWHYDEWSDGIFKDYVRLLIKLKVEASGFPDGANTVEQQQQFADEYRRIYSVNLDLENVRRNPGLRFISKLMLNSLWGKFGMRNELGANKVLTRPQEFFSLIMDHKIEVSAVIPLSDTAVRVMYKSKKNFVSEHTSSNIVISLWTTSRARLKLLDFMTQIDRTEGAKLLYTDTDSVAVLHKRDIVPIQTGEYLGQMSEEYLDYEIKTFVCGGAKQYGFRMLNKRTGEVEYVQKIRGITFDVNNSKALQFDHFLQKVKNYGRNTGDDNDDAPAVFSYDKIMPTRDSRIITRELRKKYMPICQKGIINEQYEVYPFGN

SEQ ID NO: 156837 - protein, 188 aa, Heterodera glycines
  Coding regions on vcDNA: vcDNA=SeqID_83260; Strand=-; Position=1 -36,89-619
MLSEEEVRGNSVERTSICGVEGLEDLPGRLAAVSFTPLRTTEQQQQQHEPDRGRVGSDQLLERQRTRKRDYNLVRVLCRFNNCGPYRLTKQLQKQRTENLAYLSQLDIETVHLRKNVKIIPDALCPIGANQVFAYRGFLGITVQQHLYTRHRVMLKYPTLPCVVQFGGGHHRDIFPIELLRVSKTETH

SEQ ID NO: 156838 - protein, 23 aa, Heterodera glycines
  Coding regions on vcDNA: vcDNA=SeqID_83261; Strand=-; Position=1 -49,307-329
MRQPKGIFKKLCLRILRSHSFKG

SEQ ID NO: 156839 - protein, 35 aa, Heterodera glycines
  Coding regions on vcDNA: vcDNA=SeqID_83262; Strand=-; Position=1-105
MALLKMGLSAAECVFIDDLEENCKGAEAVGIRSIW

SEQ ID NO: 156840 - protein, 185 aa, Heterodera glycines
  Coding regions on vcDNA: vcDNA=SeqID_83263; Strand=-; Position=1-558
MKIFFISFIFPLILLDYLEGHKSGFEGFVKNPQAISLVKSYEKKEIKTLDELHGQLMHKGIQISVCTLKRYLHKIKIVFAPTKDNVDSSPKLEVEKCFSKKLTNTIYIIGNGSNWRKYIQINDKKNDIYIPCSSCLYLGEKENNTRSIISTAVLRQGVNRVMLRSEHNSECKPEILEKLNHFGGF

SEQ ID NO: 156841 - protein, 85 aa, Heterodera glycines
  Coding regions on vcDNA: vcDNA=SeqID_83264; Strand=+; Position=1 -81,135-308
MAKRTNRKNQKKKSIDKGRKSRNRRQKQETESSDSDDSGNERDFCDGVAAELLQKICRAVRVKGMKRRNDRTPTPIRDYRKKPDS

SEQ ID NO: 156842 - protein, 144 aa, Heterodera glycines
  Coding regions on vcDNA: vcDNA=SeqID_83265; Strand=+; Position=1 -144,199-257,633-768,816-910
  Homolog annotation: Hit_ID=NP_031636.1; Match level="QueryCoverage =91%, HitCoverage=29%, E-value=2e-16, Identity=33%"; Hit description =caspase 2 [Mus musculus] gb|AAH34262.1| Caspase 2 [Mus musculus] emb|CAA73527.1| caspase-2 [Mus musculus]
GPALLINNIRFGGNEYRHGANVDTTGMLELLEQLGYNPVHMFEDLSSQQMVAKFEWFSRLTALNFADSTVTVVMSHGHLRSVQGIDGNSVPIATLKSKMNGKNCPQMVDKPIVMLFNSCQGALRDYGVESSESPSLPTTKRHAK

SEQ ID NO: 156843 - protein, 73 aa, Heterodera glycines
  Coding regions on vcDNA: vcDNA=SeqID_83266; Strand=+; Position=1 -65,362-444,610-683
MIVGYSTTPNFVSFRNKEFGCCVSYFPIHFGDDYGGTLIFDLLWFENLLVIQISKHISIHCNNMSIFADNWNL

SEQ ID NO: 156844 - protein, 77 aa, Heterodera glycines
  Coding regions on vcDNA: vcDNA=SeqID_83267; Strand=-; Position=1 -43,313-396,501-599,669-676
  Homolog annotation: Hit_ID=CAE73702.1; Match level="QueryCoverage =77%, HitCoverage=22%, E-value=3e-13, Identity=58%"; Hit description =Hypothetical protein CBG21213 [Caenorhabditis briggsae]
MNINGKIGMVLYKFGASADFEKLSAIGLSNYDEPYDYFSIMHYESTEGSKNGNPTITANAPAYTNLMGKSTDFTEAM

SEQ ID NO: 156845 - protein, 17 aa, Heterodera glycines
  Coding regions on vcDNA: vcDNA=SeqID_83268; Strand=-; Position=1-66
HKHLFDLFYHIHNLIKI

SEQ ID NO: 156846 - protein, 77 aa, Heterodera glycines
  Coding regions on vcDNA: vcDNA=SeqID_83269; Strand=+; Position=1 -87,178-324
MAGNYRNHTFSILPSTLDHTYRFMFNDITRRCRCRRLACRLARAEHIAHAAPSGRITWPQGADPCADAAGCTACNRA

SEQ ID NO: 156847 - protein, 76 aa, Heterodera glycines
  Coding regions on vcDNA: vcDNA=SeqID_83270; Strand=-; Position=1 -76,251-405
MAPEILLTALGRKDGYSFEVDWWALGLGHRLHSSRGDARPLALRFDLFSPFNDQSGPGPEDRLLRRFPCPSVHVAH

SEQ ID NO: 156848 - protein, 148 aa, Heterodera glycines
  Coding regions on vcDNA: vcDNA=SeqID_83271; Strand=-; Position=1-444
MIGGWAKKRKQAIGSHPAENWQFDGQIRSQELIGVDTWPLEKRSLISSCKTAETHATVRELELNQAKYDTFYARGERDSRVEIVMRFGTPRELLGWHRSIFSDQHKYTAPPCGEREQILLNIIHMDLFALLHIFQSVPAFMLLELDDQ

SEQ ID NO: 156849 - protein, 94 aa, Heterodera glycines
  Coding regions on vcDNA: vcDNA=SeqID_83272; Strand=-; Position=1-358
FEYPKRTLEKIDFFVFGAVPPNRCAQIYGETESFGNSFPIACTLILRWIFAPHNCLSTPNGHLKKSIFLFSGQSPRTDAPRFMGRPNPSGIASL

SEQ ID NO: 156850 - protein, 763 aa, Heterodera glycines
  Coding regions on vcDNA: vcDNA=SeqID_83273; Strand=+; Position=1-2292
  Homolog annotation: Hit_ID=NP_958796.1; Match level="QueryCoverage =78%, HitCoverage=21%, E-value=3e-15, Identity=23%"; Hit description =plectin 1 isoform 11 [Mus musculus] gb|AAR95676.1| plectin 11 [Mus musculus]
MSVPERSQVSIQLQQLGLEDADVPIILEQLQKASPTPEATLKALQTVQEHLATKHFAEKEAKMWTELGIDQQQQQSQAMLTLSSALEEVAKLEAKAAREEIMELIASLEGPEKRAEIREMKPTQEEVQREERLLRIERQEHVLALVKHVLSESAQRRAVTLSDSQLAQVSEQFRQFGMTEMGTNVALDRLQQTSDITGIAQTILADWNRLEERLLTKSAIEDEAMVQATMYRIDLVKPEAKIKLKSELNEAAKRDLKEAKEELKTFISSLMGTEQWETVLTLQRAQRIGEATAITARAPIELNTETVAELLQLDEQALAGVIRPIELARKAEEIRLQIEKEEYAEEMTRKLMRDEFREVKLGEKEFEKVAEKFKQFGLKETTATAVIEQLQRISKTEKALKLKQEERAELFIKKLEKEVKEFIRIRKGYGNVQKEKERKHDEQQKVMEIVAKLINEEFKEVKLDEKELLQIAEKFKQLGFEEMTITAVLERLQQLAAPALLKVATGEQQKLEVELFLQKLMEEIREFARLRISYANAQRAKYQAQRLRGAVVQVTVPLRERTMPMVDTARPAAAEAEELFIEEQKWERLVYWFVNVTRRYAEERLRRDLHDARQRAEVAQYIAFEGPVSAVQRALFTPTTTAPILHTEMTMDKVAGTEEIVAEVPSLHVPQQIVIKHAEPVGMAEQQISSPTTWHEELKIKESTAAEWHTKTELYKHEIPRQDEETTRVLTAPHEQKAEMRVPEVGTESAQASDPSEQCGACR

SEQ ID NO: 156851 - protein, 18 aa, Heterodera glycines
  Coding regions on vcDNA: vcDNA=SeqID_83274; Strand=-; Position=1-55
MDALWEKDAPGQMDAIRK

SEQ ID NO: 156852 - protein, 55 aa, Heterodera glycines
  Coding regions on vcDNA: vcDNA=SeqID_83275; Strand=+; Position=1 -37,896-1026
MQVVYFIRRHVFGWIYEKTIQSLERRRWLPGVNWIMSPWDDKWKFICQGMAFRRI

SEQ ID NO: 156853 - protein, 69 aa, Heterodera glycines
  Coding regions on vcDNA: vcDNA=SeqID_83276; Strand=+; Position=1 -51,278-435
MSFAVEKSFCRKVLCRKGFHKGLRFDFDPHFVSEFTEENDWPKLDVKASGKFGKDFLRDIVTSLNPYSA

SEQ ID NO: 156854 - protein, 80 aa, Heterodera glycines
  Coding regions on vcDNA: vcDNA=SeqID_83277; Strand=+; Position=1 -77,663-710,751-868
MTNPTIIRIQDQSSKRERADTGESAGCRGTCPFHQQHRQQVGVRRDRDLPGPEKPGPGPRFFSGPGTGTNREFLKIQKFF

SEQ ID NO: 156855 - protein, 854 aa, Heterodera glycines
  Coding regions on vcDNA: vcDNA=SeqID_83278; Strand=+; Position=1 -32,377-1437,1477-1634,1675-2988
  Homolog annotation: Hit_ID=NP_507780.1; Match level="QueryCoverage =82%, HitCoverage=49%, E-value=5e-67, Identity=27%"; Hit description =predicted CDS, DNA polymerase type B, organellar and viral family member (5T899) [Caenorhabditis elegans]
MPTTHLDQQIRDKWRWISDRQTTVLRQKVHLLLREAGIPTTETEYDAEIYIHQVQGLWNIKHPGEYKIFIFNDYQNRPIAKSDVTDYQFPILLYHNNYHFDGIKTLSKFFKKRYYCLSCECIYDRKTTHSMNCTSLCHGCREVGVDYPCEPQQMYFKKCEHCNNKFYNINCYERHLKNDICTKFPRCNDCGVIYNIKYHSTMSHQCGEKFCRLCKQFHVKEEDDENPCSSCFIQPLKQQKIKPYRIIAYDFEAIQDKKVGNSFEHEVNFAAATVICTNCINNEEWKNSLEGKQCAICGPNRTITFSPFDYKETTVDQKIVTQQTLREFVQWLLFEQNKKYPTVAFAHFGGRYDMTMIIKEVIAHGVHDPQIIKQGNRLYELKIKDNEHAPLTIFHDSYNLMPIKLSGLIKSFGLKIQDKQHFPHMFNKSSNYENVLTNLPPCEKYCPNQKKKTDLQKFNEWYNTNYDQHFDLKEKLPEYCCTDVKILTHALVELRREFKQLTQREGNHRGIDILWQAMTKASACVKNVALNHLRSNSLAIVPEKGYTPQQNQSALANKFLDWYSHINNVHVQTASSRYGEYMFKREGQVYQVDGYIKGTNGQRDKIIEVNGCLWHGCEECFDDMDEETRMPNGKTLGEIRLRKQRKYEILRRYVDLEVVWEHEINKQMKRDKEMREYFENWKDCSPIKIREAFHGGRTGPMKLIHTAKPGQKISYKDFTSLYPFTNFSTKYPLGHPKIISFTTNEQTVNWLSPTDNPYKGLLKILLQPPDNNVKVTVMPIKFDERLLFPLCEKCAKVISNKYPNGLKDNEYSCPHFNPNDRAFVSTCTHLEIMQHWRPATPPATFSCPTIRPME

SEQ ID NO: 156856 - protein, 78 aa, Heterodera glycines
  Coding regions on vcDNA: vcDNA=SeqID_83279; Strand=-; Position=1 -145,788-879
MFDDEEIEEEKEDDVWAGLEEEEGDDEKEEEEKLDVKEEEEKEEDKKIFININITIRIIVIKIDNNNNNDDDDDDDDG

SEQ ID NO: 156857 - protein, 36 aa, Heterodera glycines
  Coding regions on vcDNA: vcDNA=SeqID_83280; Strand=-; Position=1-108
MLDDEEIEEEEKEDDVWAGLEEEEGDDEKEEEEKLD

SEQ ID NO: 156858 - protein, 75 aa, Heterodera glycines
  Coding regions on vcDNA: vcDNA=SeqID_83281; Strand=-; Position=1 -65,1305-1467
MIIIMVEEYGKLVVGDIRFRTKIFGHKRPNGARCLMRRLQEVDEEDMSEGMRREEKDDAFSTDEPGEFIGFLKRC

SEQ ID NO: 156859 - protein, 18 aa, Heterodera glycines
  Coding regions on vcDNA: vcDNA=SeqID_83282; Strand=+; Position=1-56
YREAIPEGFGLPINLGAS

SEQ ID NO: 156860 - protein, 267 aa, Heterodera glycines
  Coding regions on vcDNA: vcDNA=SeqID_83283; Strand=-; Position=1 -619,1248-1434
PIIAIPLFAQHPSSLSHFLLSTHHRYPTFCSAFIIAIPLFAKHSSSLSHFLLSIHRRYPTFCSAFIVAIPLFAKHSSSLSHFLLSTHHRYPTFCSAPIIAIPLFAQHPSSLSHFLLSTHHRYPTFCSAPIIAIPLFAQHPSSLSHFLLSTHHRYPTFCSAFIIAIPRFAQHSSSLSHVLLSIHHRYPTFCSAVIIVNPVNIQQRTSQLEARPIRLSAPFRAVALLSARVGRAATVVPGECAAHRMHSPVTRPAADRRTERSAMGGRS

SEQ ID NO: 156861 - protein, 349 aa, Heterodera glycines
  Coding regions on vcDNA: vcDNA=SeqID_83284; Strand=-; Position=1 -184,230-735,1160-1331,1385-1572
MLSSSSSSAPEEGELDEDVAEENQPIIQQQRFDLLKSSSQRDILSANGYEYHFEAYSRTEQGIEYWKCVKRRPYCPGRVHVAGAINRDDDGGQYKVGVICNSRDNHPPVHVSVRRGQMELRRFAEAQNPPPTRQAIDDVRTNIPPDIRATQAQSSSAMGRSFRNYVAQARAEVGDDLLDSPGVIIPDRLRQITIFDGHEEGRRLIVFMSEFGRNLIANYGSHIAMDGTFKVQNLPGLNERFLNPHDPDDTKTLIKSLISLAFTPPGEPLYNYLCVLIRQFPQEEEVEEIVKYFVRSWVGCSRVMQIAAVPIEEEDYGGADAWIRHWIENAGLQNTDAIFPQEMWNMCDR

SEQ ID NO: 156862 - protein, 70 aa, Heterodera glycines
  Coding regions on vcDNA: vcDNA=SeqID_83285; Strand=-; Position=1 -73,159-298
MYNTIKNKLANFRTENFWLLLIVLVPPIGLARRQMSWMEVAQPTIKFFTWALRKTAKFTEFLRKISHNFS

SEQ ID NO: 156863 - protein, 212 aa, Heterodera glycines
  Coding regions on vcDNA: vcDNA=SeqID_83286; Strand=+; Position=1 -196,849-1036,1391-1645
NISECETDGDDGDHSYCDTELVISADQIDQLQKLPDRNIHKNTVIQINETGQSFHGRKLLQQQPPVCPSGYVLFNYMNACNYPLSVTAASREYPPATTSVAANKQVSVCAQAVMSSGRVWASTDCTVQDSCVAAQPPVSLFEMTFNADGSQFMDVSYVDGISDPIGVRVKNCQQGQDQTVTFDPQAVANLRAMFPQMAETDTETGVCLKKYI

SEQ ID NO: 156864 - protein, 222 aa, Heterodera glycines
  Coding regions on vcDNA: vcDNA=SeqID_83287; Strand=-; Position=1-667
MPPGVVPSLASLTLFLPSPPALAPLGPPPLPLAVSSLSVPFSSPRGVVPPFAPFVVFFCPFFLPISSFISFVSFKNCCESCKSLSIVAGVRRFCCFCPPFMPKENAVTSSIVIAAEFFLKFCVCAMLSAEGKKPLIPKFASTNDPFAIRSKRPNKFAVERGEEKGGEEEEERGVVVRGGTIGGGGGRREAFVEEEETQGGGGRVGAGRGGKQEMGKERRGGG

SEQ ID NO: 156865 - protein, 373 aa, Heterodera glycines
  Coding regions on vcDNA: vcDNA=SeqID_83288; Strand=+; Position=1 -124,232-330,381-532,1007-1081,1374-1647,1972-2147,2577-2700,2759-2857
  Homolog annotation: Hit_ID=NP_490840.1; Match level="QueryCoverage =100%, HitCoverage=28%, E-value=4e-28, Identity=46%"; Hit description= death-associated protein kinase 1 (1B801) [Caenorhabditis elegans] gb|AAK18971.1| Temporarily assigned g
CNPNVQDQAGDTPLHIAAERGLGPAAQSLCQLGIPVDVQNAKGLSALHLAARHGHIDIVRCLCLSGASVHLKSNDGMTAEIMALAQEQKQIATLLAKVRPEKARTKFVKQLSTVEGPLKRIKLKVPNFADFVYNQWQFLLNDYGIAFKKRQERKAFGVSNVHPPNNRLCDARELTFGLASKFKVSRGPWANNRIIFIKVVFDLDRLRRVFRVGLLRARALPHLLRPFCGQHGLCAFGCHPMELLYWLNFLKGRVTPSEPIGHCGQISRRSVVAIAGTFMGGECPITKNEAEAMMRTLKMRFETHFDIHGQLFLVDLSAQSDCVGSRELRAFLARQRDSILMRLQHPLRMLDSALAFLEQLREQYAQFPCITWP

SEQ ID NO: 156866 - protein, 169 aa, Heterodera glycines
  Coding regions on vcDNA: vcDNA=SeqID_83289; Strand=+; Position=1 -180,522-701,1521-1670
  Homolog annotation: Hit_ID=NP_490840.1; Match level="QueryCoverage =62%, HitCoverage=7%, E-value=4e-33, Identity=62%"; Hit description =death-associated protein kinase 1 (1B801) [Caenorhabditis elegans] gb|AAK18971.1| Temporarily assigned gen
MEEESETQGKREKWVAVVFVRAQIFVYNFFLCQPNPIILVSFDSPKCPLLACKISNNFLKVCFGSKEAAGLLTLGVDISVSQLQLSARSELAALLDAPNTLGMDWSILAVKLNLTEQIPEVDSSGQSLSRTDQLLTEWALHSPDSASVGKLASILQEMGRNDVKEVAEQ

SEQ ID NO: 156867 - protein, 95 aa, Heterodera glycines; identical to SEQ ID NO: 125597
  Coding regions on vcDNA: vcDNA=SeqID_83290; Strand=+; Position=1-685

SEQ ID NO: 156868 - protein, 176 aa, Heterodera glycines
  Coding regions on vcDNA: vcDNA=SeqID_83291; Strand=+; Position=1 -349,633-814
MLCQLFALIGCPLFLLLIADIDKAIANLFQFLLQGFTELTRKICRKRTAKKSPITNGENGVKCVEDGPQQQKGCAGAENGCHLGTTATDERVSALAAVPFLFAFCALTAFAYAHLEVPLFCSILLASNTSETFIELRERRGENVVGENGKRAAEGNGKGRAEAGRNEEQGEPLSNC

SEQ ID NO: 156869 - protein, 114 aa, Heterodera glycines
  Coding regions on vcDNA: vcDNA=SeqID_83292; Strand=+; Position=1 -181,607-770
MSKISRRNWAIRDFVRLGQITGKIGVKNEWKSEKYEEKVTHQKKGEEKGGLGGVEEGNENALFGHCAYECGDHHRLLPIFPRAQKFKDYGIVQKFGAHLCTGDQRRRKTAGMAE

SEQ ID NO: 156870 - protein, 214 aa, Heterodera glycines
  Coding regions on vcDNA: vcDNA=SeqID_83293; Strand=+; Position=1 -87,447-674,789-1118
  Homolog annotation: Hit_ID=AAN17736.1; Match level="QueryCoverage =95%, HitCoverage=23%, E-value=8e-59, Identity=50%"; Hit description =putative Na+/K+-ATPase alpha subunit [Homarus americanus]
MGTAMDTDTGQVLLRVAALCNRAEFKPGQVSVHYTAANEGNLLVMKGAPERVLCRCDRMLIEGEERPIDEDLRAAFEKAYLELGGMGERVLGFCDCALDKDRYTKQFPFNADEPNFPLEGFRFLGLISMIDPPRAAVPDAVAKCRSAGIKVNSQNLLIRTPTALMCEQVVMVTGDHPITAKAIAKSVGIISEGSETMEDIALRKGITVAEVDPK

SEQ ID NO: 156871 - protein, 54 aa, Heterodera glycines
  misc_feature (45)..(45): Xaa can be any naturally occurring amino acid
  Coding regions on vcDNA: vcDNA=SeqID_83294; Strand=-; Position=1 -104,186-362
TKRAHIGSQFALSFSSSALRVRSGRVATSDLFRLLFLCVFSKCLXGKERLPRVA

SEQ ID NO: 156872 - protein, 150 aa, Heterodera glycines
  Coding regions on vcDNA: vcDNA=SeqID_83295; Strand=+; Position=1 -239,281-494
MSIFTKEMSSALAQKVRDNYEELFPQSKKAAFSRRSQIAWANITSEINAEFGSSISEKQCKEKWHNLKKIAKRENANEQKHPRGTGGGPKRLESKDPALQIITDTMGESASFKGIPGGRSSVKADEAYSDVSTPTSVEKEVGYYCVILVL

SEQ ID NO: 156873 - protein, 25 aa, Heterodera glycines
  Coding regions on vcDNA: vcDNA=SeqID_83296; Strand=-; Position=1 -12,551-616
MLIHKLIAILLNISYRGLISNIFSI

SEQ ID NO: 156874 - protein, 87 aa, Heterodera glycines
  Coding regions on vcDNA: vcDNA=SeqID_83297; Strand=-; Position=1 -117,331-477
MTVIKMLMASYFLFIFFNLATAQNEQLNSSTEEPKAYNNLLLRFCLAVRRAKSCAFAVSAMARAVSRCRFVAFSARWSRAVFVSWTD

SEQ ID NO: 156875 - protein, 162 aa, Heterodera glycines
  Coding regions on vcDNA: vcDNA=SeqID_83298; Strand=+; Position=1 -84,236-314,362-441,534-687,762-853
  Homolog annotation: Hit_ID=AAR06638.1; Match level="QueryCoverage =95%, HitCoverage=95%, E-value=2e-53, Identity=62%"; Hit description =superoxide dismutase [Brugia malayi]
KVMQKRSAVCVLVGDEDPNVKGKINFIQEKDDSPVTIQGEITGLSPGKHGFHVHAFGDLSSGCMSAGPHFNPTNKTHGGPEDETRHVGDLGNVLAGQDGVAKLDFTDKVISLVGPHNIIGRALVVHKLEDDLGRGEGLKKPESMETGNAGPRLACGVIGIAQ

SEQ ID NO: 156876 - protein, 27 aa, Heterodera glycines
  Coding regions on vcDNA: vcDNA=SeqID_83299; Strand=+; Position=1-84
TVNAFRIRFICFCGLSVEGPRKMQENK

SEQ ID NO: 156877 - protein, 70 aa, Heterodera glycines
  Coding regions on vcDNA: vcDNA=SeqID_83300; Strand=-; Position=1 -93,378-497
MGTMGEGSDRTEAVEHGERCDQSSDRHQRLRLSGYSVDILPMVQIICLRNGSDQSLLAQKRPENLGRRPI

SEQ ID NO: 156878 - protein, 22 aa, Heterodera glycines
  Coding regions on vcDNA: vcDNA=SeqID_83301; Strand=-; Position=1 -54,775-789
MPMFKFWYFNGNFRKIAKSFGF

SEQ ID NO: 156879 - protein, 25 aa, Heterodera glycines
  Coding regions on vcDNA: vcDNA=SeqID_83302; Strand=-; Position=1 -68,345-354
MAPPTCGFIEVLPIPPQMLRPSGTI

SEQ ID NO: 156880 - protein, 329 aa, Heterodera glycines
  Coding regions on vcDNA: vcDNA=SeqID_83303; Strand=+; Position=1 -183,504-704,811-1416
MYQNIAVGTVGGDQNAVEASSSSTMMAPKNESIGKTVVERQMSASVSLLDVGKQSVEEQKKQFEVTTFSSVSSSHNQHNQLPNGTIGNNHNNNGANGRKDDDDFGTEHKKVASFGGSPPPVAPKPKTNFTSFAVNAAPHNHKQNGNSGGCTDTTTTTAMMNGGVATIADGTAPETTIGDFSSRLRLFQQQTQQHQQQQPIMPNRTTSSTSLQQMAGAAQPTAAAAAVLPKLKRPLLSSDDLAKLAEDDQMRTKAAEAAAGDGRRRAAASLGAAAGSSGDASSGGEQPFPSPPPPIAAAAGGGAKTTTLMLSPMSPVVDGGTFEHLLNDW

SEQ ID NO: 156881 - protein, 63 aa, Heterodera glycines
  Coding regions on vcDNA: vcDNA=SeqID_83304; Strand=+; Position=1 -72,345-464
MCTKQQQWAAVPVAGQYNSATRLQKISTSNDEKKDGKCDHIFLAVAAQFAFAPKARPPFFIFR

SEQ ID NO: 156882 - protein, 427 aa, Heterodera glycines
  Coding regions on vcDNA: vcDNA=SeqID_83305; Strand=-; Position=1 -290,920-1911
MALLIMLISIVGTFGCQPSIRASGMDPNLPFREGPRVPCTTECAERGVTNVSGREFNKIEIRCDDGCWATMPKSKDVNYGLPAKKLMHGYPCHDKCCAPGQGVALFSSLLFSCFHSPSLHIRSACDQFLQFPRPIAQFDQFVAFIHYSFCFNKFVLKRLGGLGKEGKAPSTLHHIRQILVRGQTEAPIHVLTPSFPGSPRRSPPILPIPVPFPLALENPGVGPERQRISSSSDSRSRSLADRCQSPASRSSRRDGANSRRRRNQVGQRRKEEPSGAKPSTEGQARSSPLIPPAGEARIAGVSLPPAGASTGGDGSRNPCSSSRERTSRSSSSSDSRSRSLAVRSQSPASRSIRRRKRESKPVSSSQERRATPPVRSSSKGRTSPLHNQSCRATPARSELLKGVRQALHQNLVGGAVKQAANRCITSN

SEQ ID NO: 156883 - protein, 169 aa, Heterodera glycines
  Coding regions on vcDNA: vcDNA=SeqID_83306; Strand=-; Position=1 -238,424-695
MLLEDGAGQAQRVQQQQQHQVPSTSGGVVPTVQQQQQQQSAGNKATKNMATASSSSSKSAAAAAALNGGGQRAQKGAAPFFPFLMDFIKKKSFNLLLCNILKVDQPATTARKGSVHQQQQQQQQQNADKSTKTISTTGTSATSNNSGGGNKMPSMAYNEQQAKLKMVLK

SEQ ID NO: 156884 - protein, 59 aa, Heterodera glycines
  Coding regions on vcDNA: vcDNA=SeqID_83307; Strand=-; Position=1 -35,270-414
MPWRRFFYRPSFVWLNSLCDDHCDDSANPKALSLKGFDYSAISLDLIETLHEVSLFLSI

SEQ ID NO: 156885 - protein, 66 aa, Heterodera glycines
  Coding regions on vcDNA: vcDNA=SeqID_83308; Strand=-; Position=1-199
MRLIEAMANSREKIMGTKIEENSSKSVSEDDTSAEEEDEENIENFRPNGTTNRKRAHRNPTSDSAQ

SEQ ID NO: 156886 - protein, 962 aa, Heterodera glycines
  Coding regions on vcDNA: vcDNA=SeqID_83309; Strand=+; Position=1-2889
  Homolog annotation: Hit_ID=XP_314437.1; Match level="QueryCoverage =24%, HitCoverage=62%, E-value=7e-23, Identity=32%"; Hit description =ENSANGP00000025289 [Anopheles gambiae]
METFVEIVIHQHSTPEIVVTDQGRQFTSELFNDMAKIYGFEHCTSTAYHQQSNGQIEGSMRIMANIISQMINEKGNNWDEVLSHALFIYNSSIHTVTKHSPFFLLHLRHPKMPTDRLLKLPNQEEMNSDISIYTRNHVSKAVTAWNAVKEAVTKAQIIQKDENDKIRRAEEKVIEIGDLLLLKKEVLKHKFDQRWVGPFRCVGVDKTKKNVIIQQIDGKGKLKKVHQEKIKKFNGPAVLPLREADEPLNWEKYANDPNLEQEEAEESSESDKDSEILECEESKKDGENKKEIKNSFSKFGFESSDDENEMDQKERIVFVRGTDEREMEERPEILDPQIWDIEQPMPCTITEIFVEGEFKWAYTSWPEENLIPLTSLIPSNFVKDYWEIYENASGNRFLTAWLLGNSFELYLNDETDKIVLGIQVQFALNDIWHSRTEREIESYWEPLGEMDGQTLEIQRFPDLTITHKENLEENEQRNNILDQTNINAICYKNNNNDNKIKNNYQNGRMEQSINVIKEGDLFMSIFDLNEEINQEIYEEKSEKYEQETKNDGDKKAEINRENTDFLTKKLNRESMTSPKAPAMEAFNEEHLIAEEKKLKSEIEELKRRLDETNNRKAEAEKRRTERNERRQIDEIVLDVEEEEEEEEEEEELARQAKRGRLDPLETKKLVEKTINEKWEGQELVTIDPRAAGFKEPPEGTDSRGWEDAIRLQMRGEREKGWREFLSTKTSLDQMKEDRLNVMGRAGLTQSGRRMAENSVKSAEKSIMETECILPEGKGKQTKPWNELEMQRESTEDMERRRKFAVRTPPNSEPFANSGWGEMSNNEGTEKILDKIGEMQKKLNEVNNELNWLAKDVQELSQNKGNEIKKGENGQQDNWEKGNTNIPFWRQHDDNRFRGRGTGGNRGRGRQRPFQYGWRGSDGWKKNDQHQQQQHNDEACTSSSVTTTRYTGEEFTRMAGYRD

SEQ ID NO: 156887 - protein, 26 aa, Heterodera glycines
  Coding regions on vcDNA: vcDNA=SeqID_83310; Strand=-; Position=1-80
MEEKKRSKQFFAQKKKIEPPQYTSKA

SEQ ID NO: 156888 - protein, 46 aa, Heterodera glycines
  Coding regions on vcDNA: vcDNA=SeqID_83311; Strand=-; Position=1 -106,231-265
MPCSPPCTARPCGRQRGTCPSVQSARPTYESSKHIRNSEILVFSNT

SEQ ID NO: 156889 - protein, 138 aa, Heterodera glycines
  Coding regions on vcDNA: vcDNA=SeqID_83312; Strand=+; Position=1 -96,627-796,1167-1314
MPTEETEHELGVEVVVDTQQQHQQVVARRTFTDTTATATEMPTTMTTVVTETAPTTTPSSSGRTTTLVEEQQQQKQSVDGGGDNDEEESTIFPDELDDEPFGTTTDILPALSAVPPNSSEARRAPTAAPLVPLSSSSV

SEQ ID NO: 156890 - protein, 133 aa, Heterodera glycines
  Coding regions on vcDNA: vcDNA=SeqID_83313; Strand=+; Position=1-402
MERHASAYKVNRIYEWLFSTSTNQQGVEPLDDDDLLIAFVTRDSANFGQYCMEMEEHNLLMQVGLLLRRKGKGKYDIDETVRYLEQQYEAYLGAMYLLRKKWNCDGIKDDFLTWAECDRFRSYLISLYQFIFR

SEQ ID NO: 156891 - protein, 48 aa, Heterodera glycines
  Coding regions on vcDNA: vcDNA=SeqID_83314; Strand=-; Position=1 -46,146-246
MHAVSADVHQEDLMTQLDLLKKDLDFLDINTGLGKMQVAENGMGLIPG

SEQ ID NO: 156892 - protein, 75 aa, Heterodera glycines
  Coding regions on vcDNA: vcDNA=SeqID_83315; Strand=-; Position=1 -72,135-290
MKAITALREEKLKMREEQLEQKILKDKEERQNAFAAAAEERRLQAEQELEDQRKEWKKLSMEKDSNNNDGKIDDK

SEQ ID NO: 156893 - protein, 506 aa, Heterodera glycines
  Coding regions on vcDNA: vcDNA=SeqID_83316; Strand=-; Position=1-1523
GTDEAMETEQQTGKANIEEDTISVLGEDEAETPKVISWSTCCTGDQHKDCADLLMADLDAVLDRSGMGLLKIDNPLKALLANFLLKSEAVKSGSAGKKLILQILEAEVSWELATYCSLREDDVKSGAFPSESDVEKTLEVWAEQCQIVNEELKMTGMGPISMEVPEGLSLLPENEREGLKKAMESAGFQLEKIRAASIHRKRLITEERVILGDSGAFQLMKIWPKSEFVGAEAGSVAEVIRNFDEVILSSKVKWLVVMVGKDSILAGEAIDSVMERVKRLRQLCSKFGHVKTFWLLPPFIFSKKNESEEFCGRMRSIFRKKDEIELIAVNEEGRSLLEVFRFGKSFNNETVNHHGWMTEKGLKVMKAWLTAVVPGFPGDRELGIHTIKSQIIVPERGAKVRGGGPADPPQIGHNWSEKNGKRGGPGDLSPSLSDSASEHAQNSVRSVNVRSYGEKSHFGRVGAGHRPGPSFRGQSSSQFHPYQRMRGGPFHHSTPIQRRSEFVPRR

SEQ ID NO: 156894 - protein, 59 aa, Heterodera glycines
  Coding regions on vcDNA: vcDNA=SeqID_83317; Strand=+; Position=1 -58,134-255
MIMVLRKGINNRKYKICEYEMNYDELSIVKEGAVIMINDESLTDQQQLKVEKIKTNKMK

SEQ ID NO: 156895 - protein, 166 aa, Heterodera glycines
  Coding regions on vcDNA: vcDNA=SeqID_83318; Strand=-; Position=1 -84,159-224,300-488,802-963
  Homolog annotation: Hit_ID=NP_701342.1; Match level="QueryCoverage =98%, HitCoverage=11%, E-value=8e-13, Identity=32%"; Hit description =MAEBL, putative [Plasmodium falciparum 3D7] gb|AAL10509.1| erythrocyte binding protein 1 [Plasmodium falc
MNYDELSIVKEGAVIMIDESLTDQQQLKKMSENFEKLELVLKNTKLELKNKGLQEKLKQQKTNALLAKIEAENGKMKNEIEKMQAKMKMDEKEEQLEKKKEQYMNKLEQLHKNAEAENRKLKNEIEKMQEKFDKKEEQLEKNLEELQKKLVEMEHQQNEQQKSIEM

SEQ ID NO: 156896 - protein, 41 aa, Heterodera glycines
  Coding regions on vcDNA: vcDNA=SeqID_83319; Strand=+; Position=1 -44,112-190
MRRCKNNLTDEEYERLFPKSADKYVFPTNTNGICVGLGNQM

SEQ ID NO: 156897 - protein, 439 aa, Heterodera glycines
  Coding regions on vcDNA: vcDNA=SeqID_83320; Strand=-; Position=1 -93,430-699,749-846,935-1124,1184-1389,1442-1599,1645-1677,1956 -2089,2138-2274
  Homolog annotation: Hit_ID=CAE67071.1; Match level="QueryCoverage =61%, HitCoverage=33%, E-value=1e-56, Identity=45%"; Hit description =Hypothetical protein CBG12480 [Caenorhabditis briggsae]
MTEGILLRELLHNCRLNAYSAVIVDEVHERSVFNSPDLNLDDNDYLFNAISTVLDLNDSEPVESGFLVFLTGQEEIDTAMNILRKLKQSKSDHAADCIHAVALYAAVPTAVTQRAFEPPPKGHRKVIFATNIAETSVTIPGIDVVIDSGKVKRRSFAASNRMDLLRVENISKAQAIQRAGRAGREGPGKCYRLYSLEDYGTLADEQVPELQRCRLTTVVLELLQLGVQKVTSFAHLLSPPDIGQVHAAVEELLALRAITLSPKGQLEITDEGTKLTAFPVEPAHAKILLSASELGCLEEACTVVSFLSADPVFQFSGHDLFCLNEKQKYGQESTGLSSNYSDMKFRTNEGILRFQQFESAPHGTGVQHQETVARRMCQAEIALQHLHEQLGDVEKGNLPGTVHEPVPFRHLCPVLRFGPGPQSACAHPSLLLSPQPTAR

SEQ ID NO: 156898 - protein, 159 aa, Heterodera glycines
  Coding regions on vcDNA: vcDNA=SeqID_83321; Strand=+; Position=1 -89,134-379,510-654
MVGKQKVANSPKQNDGKEKEKQLRDKNAPKIPINAYQRYVTHRLKVSPSKKFGTSREAMANFAAEWGAMEPQNKKVKGHKNGEETIVFAFSLFLTNISRREANTAKRWRIINAEVGKKAEIDEGFAFFVFKHFFFGIGSLDDRWAPSSVAFATECQANF

SEQ ID NO: 156899 - protein, 42 aa, Heterodera glycines
  Coding regions on vcDNA: vcDNA=SeqID_83322; Strand=-; Position=1 -76,249-301
MVATVDIKYNISFLNNDLNWLTDTKAADKCTKQLNPVAHPSQ

SEQ ID NO: 156900 - protein, 157 aa, Heterodera glycines
  misc_feature (51)..(51): Xaa can be any naturally occurring amino acid
  misc_feature (65)..(65): Xaa can be any naturally occurring amino acid
  Coding regions on vcDNA: vcDNA=SeqID_83323; Strand=+; Position=1 -30,260-376,440-587,643-757
  Homolog annotation: Hit_ID=XP_312630.1; Match level="QueryCoverage =98%, HitCoverage=67%, E-value=5e-38, Identity=48%"; Hit description =ENSANGP00000015419 [Anopheles gambiae]
FEAKKRASPVHCVRGDFDDDTAFPDVKVIPVGHFRIGITHGHQFIPWGMPXAMELAARQMNVDPXAMELAARQMNVDVLISGHTHECKVYEKEGVFYANPGSATGAFSIVKDDVIPSFIDVIPSFIVMDVQQDLIVSYIYRLLNDEVKVERVQFRKN

SEQ ID NO: 156901 - protein, 47 aa, Heterodera glycines
  Coding regions on vcDNA: vcDNA=SeqID_83324; Strand=-; Position=1 -99,355-399
MRSIRAFAAPPAVATTCACPTCNSPCSDELAKWVCMTKFGDGGWIIA

SEQ ID NO: 156902 - protein, 424 aa, Heterodera glycines
  Coding regions on vcDNA: vcDNA=SeqID_83325; Strand=-; Position=1 -119,457-556,613-753,806-927,1050-1677,1920-2081
MHSARKRPADKEQYEQQLIHYAMRKLFNIFPLLEMDDIGNVLANPTVTLREHFLQELVVSLMYHHYPKEEQTEQALRCFCDAINNIVTRNLQTDQSNIDRSPSYSSNSSRDSLHLNPMAKLDDPIRIRCMSIFTAMLRSGRFMRSSVELDGLYEALVGRIMECFSHCQCLTWRCLFSETEAVTFMPIIWHALQLHQGRGLLSYLDMIGDLVRFYGYAKMANWYVKSLDEVREVDDTFMVEEEQERAVAEGRSVTQMTRSNTSEEDTDADMEEGDGLAADERKMEMLDKYIHCARQAQMVVANWMDCSNLLTLPFSLLQEPQVAFRATEHICGWLLCGGLRIGSAESVKALAHLLLVMFNTESRDRAPEAHTMSLALQEEARQIDTVKMAISVQQFTALSMLAERAVDRHLGTVHSEFAQKVLEM

SEQ ID NO: 156903 - protein, 56 aa, Heterodera glycines
  Coding regions on vcDNA: vcDNA=SeqID_83326; Strand=+; Position=1-168
MTKTREQGRKRKQPKSEDADGDEKKVKNDEQQNNEQQEEGREKEEAIVDPERMKIL

SEQ ID NO: 156904 - protein, 142 aa, Heterodera glycines
  Coding regions on vcDNA: vcDNA=SeqID_83327; Strand=-; Position=1 -66,199-491,1564-1633
  Homolog annotation: Hit_ID=EAA61308.1; Match level="QueryCoverage =29%, HitCoverage=3%, E-value=5e-15, Identity=83%"; Hit description =hypothetical protein AN7103.2 [Aspergillus nidulans FGSC A4] ref|XP _411240.1| hypothetical protein AN7103.2
MSKIGRIWNSAFTSAVAKWLFSLFLPSHGRHNANWQSTNSHRTVQQSCCCLSYISHFNSNNKDPDIFVFLLTTKVGGLGINLTGANRVLIFDPDWNPSTDAQVDLLNFNKLIFPFWVLGPKVHYKGVGGKVAGKMWFAYYFC

SEQ ID NO: 156905 - protein, 90 aa, Heterodera glycines
  Coding regions on vcDNA: vcDNA=SeqID_83328; Strand=-; Position=1 -71,613-814
MGLGIREPEFNPIRSDSRSRPGKHRPKSKLTRTQSFYLPIQSDTATLQQMALQIKPITMRTDQGCRNADFRLAVSDILGSEFPFPMAGFF

SEQ ID NO: 156906 - protein, 151 aa, Heterodera glycines
  misc_feature (20)..(20): Xaa can be any naturally occurring amino acid
  misc_feature (22)..(22): Xaa can be any naturally occurring amino acid
  Coding regions on vcDNA: vcDNA=SeqID_83329; Strand=+; Position=1 -123,1486-1817
  Homolog annotation: Hit_ID=AAO12864.1; Match level="QueryCoverage =73%, HitCoverage=32%, E-value=6e-27, Identity=50%"; Hit description =Ccmar2 transposase [Ceratitis capitata]
STFYGFSDLLFLKRTFYEKXVXMDFNIIKFRQSELRCSEKSPLLLQNRTIQKMDKIRLNVAFSTQQKIEQLRWAVLPHPPYSPGISPCDYYLFRSMEHFLRGKEFADQNEVENALDDFFVSKNDQFYKKGIEMLPERWGRIIDQNGEYIIN

SEQ ID NO: 156907 - protein, 160 aa, Heterodera glycines
  misc_feature (149)..(149): Xaa can be any naturally occurring amino acid
  Coding regions on vcDNA: vcDNA=SeqID_83330; Strand=-; Position=1 -36,272-721
  Homolog annotation: Hit_ID=AAP92584.1; Match level="QueryCoverage =78%, HitCoverage=25%, E-value=2e-36, Identity=63%"; Hit description =Ab2-057 [Rattus norvegicus] gb|AAP85373.1| Aa1262 [Rattus norvegicus] gb|AAP85367.1| Aa1011 [Rattus norveg
RYRPSSDRKRCHAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 156908 - protein, 379 aa, Heterodera glycines
  Coding regions on vcDNA: vcDNA=SeqID_83331; Strand=+; Position=1 -349,396-538,588-808,1136-1562
  Homolog annotation: Hit_ID=ZP_00233175.1; Match level="QueryCoverage =49%, HitCoverage=96%, E-value=1e-24, Identity=41%"; Hit description =Appr-1-p processing enzyme family [Listeria monocytogenes str. 1/2a F6854] gb|EAL06922.1| Appr-1-p proc
MPNEAVFKTPTPSTRAQHPKTTPIELNNTVSKQHLDKLTVVKGDITKQQIWMIVNAANSDLVKGGGVDDAIHRACSPRQKELEQLLNIKILSNGGPIADGGVVDTPAFGDLANNVQYILHAVGPKVSAALNEHHRRSLAKCYTNALDHLVSMHMDIANPQSRSIAFPSISTGAFNFPRVDAAHIAIRAILNWLADQPADAPAIDEVRLVAFSDEDFKLYKEIRERVINKQSCSFLFFSAIVFAIVGRDDVNIAFNLRQQMFTLLRQFLDDPNCFPRGFYANRARFMQFIEALLLGDENTNFDAYIASRVGATAWADASDALLAAVLLGQTIVVVSPVDPDNVRRATSFFDDTVRHTIGVFFPDGNHMVTNNFKAYLILV

SEQ ID NO: 156909 - protein, 71 aa, Heterodera glycines
  Coding regions on vcDNA: vcDNA=SeqID_83332; Strand=-; Position=1 -108,158-251,313-326
LFLGPAANKIEKSNGQFDGLVTNGVLILSPNDNDDEGASVYLSASSSNNDDDENESDSEISPNCWKEELLK

SEQ ID NO: 156910 - protein, 37 aa, Heterodera glycines
  Coding regions on vcDNA: vcDNA=SeqID_83333; Strand=+; Position=1-111
MPILLRWVRIGIGTEILVTERILKIHDFNGETLTIIE

SEQ ID NO: 156911 - protein, 537 aa, Heterodera glycines
  Coding regions on vcDNA: vcDNA=SeqID_83334; Strand=+; Position=1 -106,157-276,328-525,644-738,793-875,922-1143,1264-1387,1449 -1815,2144-2278,2333-2495
  Homolog annotation: Hit_ID=CAE65969.1; Match level="QueryCoverage =93%, HitCoverage=50%, E-value=9e-85, Identity=36%"; Hit description =Hypothetical protein CBG11153 [Caenorhabditis briggsae]
MPYLKLTFLLLSLPFGCPLSFVNHRLDQPQSAVTSADRTCPLNMFLCRATQRCIPRSWVCDQENDCSDGQDEKNCETPQKRCSESEYECKNTQSMQQNANDNSWLNHLARTGFTHTCIPKKWVCDGEADCVEKDDELNCEGKLKCDEKHFECKGFDLHSATSCIPIEWVCDGQADCLDMKDEANCTAKETKPECEKDSEFRCDSGQCIYKSWRCDGDSDCMDGSDENNCKVDTCGSVDKFKVITRRVHLKMQTDSFSANHRLSAFPTNGNAMANRRSVNDIRTKNVFGFVKDCPDHSDETDCEGVTAQQEVHCKDHEFACASRSQCISSFWQCDGDEDCFDGSDEHNCTRIQCKPKEKACADGKSCIDEELWCDRSEDCADGSDEANCPNNDKGTEEKCKLDEFTCPGEKSRCIKYLDLCNGHSSNECAKKGLCNQEIKSCKLTGDQNDPCISRKMATHGMLYYCAKGYNASVIADNQPGFCEDINECEQPGACDQICTNLPGSYHCSCYPGYQLVNSDSDKPVMHKCRAIGPDPLL

SEQ ID NO: 156912 - protein, 104 aa, Heterodera glycines
  Coding regions on vcDNA: vcDNA=SeqID_83335; Strand=-; Position=1 -33,1039-1186,1543-1676
MANPIATKKQKAPPPQIHNLRPEDFMDVTLLLLKCKYREQLFMKIGLNKLLFGYDAIYVLDDDEEPNAGNEVSYGVAAIELTSNGNSQQMNMSQQEQTPMAAVN

SEQ ID NO: 156913 - protein, 62 aa, Heterodera glycines
  Coding regions on vcDNA: vcDNA=SeqID_83336; Strand=+; Position=1-187
FHLQLDIFNYLKNWGHNTVLKIGVYGETNLGAFENKANLTSENLASYVIPVSGGEVAPTPFK

SEQ ID NO: 156914 - protein, 434 aa, Heterodera glycines
  misc_feature (40)..(40): Xaa can be any naturally occurring amino acid
  misc_feature (356)..(356): Xaa can be any naturally occurring amino acid
  Coding regions on vcDNA: vcDNA=SeqID_83337; Strand=+; Position=1 -147,246-353,397-564,618-739,815-959,1027-1150,1223-1395,1664-1875
  Homolog annotation: Hit_ID=CAE65969.1; Match level="QueryCoverage =92%, HitCoverage=40%, E-value=4e-94, Identity=45%"; Hit description =Hypothetical protein CBG11153 [Caenorhabditis briggsae]
INKLESAVALDYRHNQSTLVWSDVSKEQVALISRCNVSVXFLISLMAKKSPNLTVIKDNVTTPDGLAVDWVHGLLFWTDTGLDTINVYDLRRNKRKVLFDKGLINVYDLRRNKRKVLFDKGLDEPRAIAVDPSAGLIFWTDWGSDARIERAGMNGDDRQIIVQGIIVQGNAIKWPNGLALDILDKRVYWADAKTKQINTCDYWGEHVRVILHSHQHVRHPFSLAVFEERLYWTDWDHEGVLSVNKFHGKDFRQVLRGVSGPMVLRGVSGPMTVRVYHKQAQPVLQNKCEGRDCDHLCLPRALYQKPTKPTKNAEIRLKGLPYSCACDIGFRVDLNNSSMCVSTTAVLSESTVFCQXMSHCLVHKAYTFYRRQPRQFSALHFENPIYRRTVEADMDAELEYRRQFPGPNLHFARRWHSQSEWSPFERTVASAGRA

SEQ ID NO: 156915 - protein, 49 aa, Heterodera glycines
  Coding regions on vcDNA: vcDNA=SeqID_83338; Strand=+; Position=1 -26,67-199
ERHLYTFAKMSSDGMTKFWRCEFKKSISHYFGVSPGNFSQLSNEPVNFC

SEQ ID NO: 156916 - protein, 107 aa, Heterodera glycines
  Coding regions on vcDNA: vcDNA=SeqID_83339; Strand=-; Position=1-321
MTGFYTENAQLRARAGPNWLLVRVARDRHRPPARVNTDPKPLHNSPRVNSTPPIRVPDPERLASRPSSRSYSEHLSALRLQMPHSPLNRRTANPSLEASSPTYSNKR

SEQ ID NO: 156917 - protein, 169 aa, Heterodera glycines
  Coding regions on vcDNA: vcDNA=SeqID_83340; Strand=+; Position=1-510
  Homolog annotation: Hit_ID=AAC95573.1; Match level="QueryCoverage =57%, HitCoverage=12%, E-value=4e-09, Identity=36%"; Hit description =orf 48 [Ateline herpesvirus 3] pir||T42963 hypothetical protein 48 - ateline herpesvirus 3 (strain 73) ref
MHPLALIRSANPPLEDDQQQQLMANNIVHRRRSTPNRCEALRFRSSRVRPAIDEEEEGNFEPIEQDEADLDDEFGSDMHSDDTENGQSSMATDADELDSEVGTEQRMETDGGEDSDDEMAEFMADNGQMEAEEEEEEEDEWGEDSTEEDLFMLAKLRQHPEIPFKVGSE

SEQ ID NO: 156918 - protein, 157 aa, Heterodera glycines
  Coding regions on vcDNA: vcDNA=SeqID_83341; Strand=+; Position=1 -291,458-640
MHLSLLKCHRLVVVSALYWSVTACFCSVAQCSSRFARFFYPISLCPQAKRRAEKRTVRPWRFVRFGLRAVVGHAVLPNCAQIWAPPACRQYFAHNYHEGVALSEHSQSDLQIARAIVGQYDPRLIPTHSSLCFRSYAAFDTLERHLISPSFSPSLLI

SEQ ID NO: 156919 - protein, 274 aa, Heterodera glycines
  Coding regions on vcDNA: vcDNA=SeqID_83342; Strand=+; Position=1 -91,350-1082
  Homolog annotation: Hit_ID=NP_920591.1; Match level="QueryCoverage =34%, HitCoverage=6%, E-value=7e-20, Identity=54%"; Hit description =putative retroelement [Oryza sativa (japonica cultivar-group)] gb|AAP52878.1| putative retroelement [Oryza
MFSFCILSHSIVLPRILNSHTVGNQQQKRQAHVKEHFPKEQNFLVKGFSHQYPSIIIGRTLVIPGNSNNVTIQILNAGNTNVKIYEGSHIADLEQIYINALPGDEIHPKDYMPPETKWHENLPKLPTQIVNPPPSEKINLEGTRLSKKGQNDLKKLADKYSEAFVGEDGKIGRYKGQIVHRIDLIPGSLPFHFRPYRYPPETQKEIERQIKLMLDQNIIRESESEFSSPIVMVPKADKISWRFAVDYRALNKMTKKRVFHLPNIQELLDLMGAK

SEQ ID NO: 156920 - protein, 66 aa, Heterodera glycines
  Coding regions on vcDNA: vcDNA=SeqID_83343; Strand=+; Position=1-202
DADVPVTSTAISSPKISVPSTHSKFLYAKILHRNQGAGSPACDTVASELSLSPIRMNTGRAHEYPP

SEQ ID NO: 156921 - protein, 81 aa, Heterodera glycines
  Coding regions on vcDNA: vcDNA=SeqID_83344; Strand=-; Position=1-245
MLSSRQLGMSRNDANGCPQLSAKCTTRPAPNAAFFGISNFLAFRKIDDNLCLLNFMADVIVVVADDDNENEDASSSLLLLS

SEQ ID NO: 156922 - protein, 130 aa, Heterodera glycines
  Coding regions on vcDNA: vcDNA=SeqID_83345; Strand=+; Position=1 -50,105-557
INSISKIFGFFFLIFLQFVHIFHCSTEMLSSRQLGMSRNDANGCPQLSAKCTTRPAPNAAFFGISNFLAFRKIDDNLCLLNFMADVIVVVADDDNENEDASSSLLLLSESELINFICRFCAILDKSLPSL

SEQ ID NO: 156923 - protein, 158 aa, Heterodera glycines
  Coding regions on vcDNA: vcDNA=SeqID_83346; Strand=-; Position=1 -385,900-991
MSLAEQIAPELNDNELFDEITALNETLEKISDEKFREMNAEQKWMKLFEAKLPNLLLLVSKILSIPVSNACVERVFSLCSAQWTDVRNSLKIETVKSLAQIKLNYDLTCPEMYDLLISSPKLLKMIMGVFYFGLYALKIRASLFWCLSFLALKFFNKT

SEQ ID NO: 156924 - protein, 40 aa, Heterodera glycines
  Coding regions on vcDNA: vcDNA=SeqID_83347; Strand=+; Position=1 -72,190-240
MPNPLESAQPGTIYRHMKKFGGFMEKQPVVIAAHFFSFDP

SEQ ID NO: 156925 - protein, 79 aa, Heterodera glycines
  Coding regions on vcDNA: vcDNA=SeqID_83348; Strand=-; Position=1 -12,300-527
MSLFGITKSKTGDEFAHCIPCNFDISLLSIGKAAIPHHLKTEKHKKAAKAANSALAITAFMPSKSARTNLDRQTAAVEG

SEQ ID NO: 156926 - protein, 103 aa, Heterodera glycines
  Coding regions on vcDNA: vcDNA=SeqID_83349; Strand=-; Position=1 -104,292-337,420-581
  Homolog annotation: Hit_ID=CAE73248.1; Match level="QueryCoverage =60%, HitCoverage=35%, E-value=3e-19, Identity=65%"; Hit description =Hypothetical protein CBG20664 [Caenorhabditis briggsae]
MCGFMSTKCLFSVHFYFFILIQLFFQLSSAHVYLRLLQDCCQLVKANSIEGCKLAFTDVVYTMWGNLKKTGDMVTGQVGFHSDKAVKKVMRFIVRRYFKNGPF

SEQ ID NO: 156927 - protein, 80 aa, Heterodera glycines
  Coding regions on vcDNA: vcDNA=SeqID_83350; Strand=-; Position=1-241
MPTFANKCLPLELLYEIVPFIPAENAAPNALSSCSLLHKLLLPRVIKWKEVCRAIGIGLEKQFRWSSTLRTQYGTIVQWA

SEQ ID NO: 156928 - protein, 157 aa, Heterodera glycines
  Coding regions on vcDNA: vcDNA=SeqID_83351; Strand=+; Position=1 -411,555-617
MCAFQVKQAINRRIQSMGFMQLYSSKEPNGLEFQRLVRKIGALQFCPPNYLARSLQLMRHLITRACNYMDIKSRNMAIKYGPKIAKYGHKMAKIAKYGHKWQKCQNMDINFSKLNVKFLQIYWLKLHMRYISKFFDSRKINNKSEIFAFLLIFDIIY

SEQ ID NO: 156929 - protein, 39 aa, Heterodera glycines
  Coding regions on vcDNA: vcDNA=SeqID_83352; Strand=-; Position=1-154
LQIYWLKLHMRYISKFFDSVRRFDKDGFRFAISRSTFGN

SEQ ID NO: 156930 - protein, 201 aa, Heterodera glycines
  Coding regions on vcDNA: vcDNA=SeqID_83353; Strand=-; Position=1 -259,483-528,1005-1305
MTSPELRQFEPLEMSNSEPDDDERSEDGASLGAATARGTRSRSGSAARRRRGSSRHDGHSLARSKSTRHENGMDKFVNSRLLSTRKKILKFKICFDLKGELSLNIKIDRLALINAYQSEQIPFRIKLSFIDLIHNDLCFLDVPMCLSSTLFESLPQFDPTLLKRPFVAKCQFFSHHSDQSISISMYQPLITSFHQKPLQIA

SEQ ID NO: 156931 - protein, 51 aa, Heterodera glycines; identical to SEQ ID NO: 124998
  Coding regions on vcDNA: vcDNA=SeqID_83354; Strand=+; Position=1-155

SEQ ID NO: 156932 - protein, 677 aa, Heterodera glycines
  Coding regions on vcDNA: vcDNA=SeqID_83355; Strand=-; Position=1 -109,586-795,935-1585,1669-2732
  Homolog annotation: Hit_ID=AAP30765.1; Match level="QueryCoverage =71%, HitCoverage=98%, E-value=1e-166, Identity=61%"; Hit description= putative gland protein G15A10 [Heterodera glycines]
MVKKHPLIIDSEKEEHLLINDEDRGVLPPGNDALCIANNAQQQHVRYYAEIDGRKYPTQGLSYDIDVCGTGLLVDGKFYKNAVPTGHINEINRIEERIPVLGSPSKDIPLIAAGDVQRNTARLHTNVVGQQILGSVSFPKIPIGGNTDYINAGHNKHDGKSTFGDTKREEKQKNKQKQQKRGKPMGGNIIHINNQNNENIGGTQDIGRIQIGGMPPGGALHFNTGGNRNVGGTQKIGGIQIGRMPTGGTFGLNIGGNRNVGGTQNIGGIKIGGMPAEGSFHFHTGGNRNVGDTQNVGGIQIEDMPAGTTTEDNHNLDSAHEIGDLVASLRNQLRKNKISINGQNYAVDGPNVNVGVEGHDLSVNGRVYQNRATEQYLEIIQDKNIRNVIVSVPLALFSRENITVGQINAECDGNLYIGQSTGGCLRILCVDIKKRAYTNGPKTRGNLQIKNTTIECVSIGGGDENVIESDGVLQITESPMGNVAMKSGGNLKIKNSGMERVHFESGGQLQIEESPMHNVWVKSGGNLNIKNSGMKRVIIESRGALQIDNIDKLPMGSVWLKSGGAISIDNSKIESYAKMNSGGSFTITNSEIVNDAEMHSGGHFTITNSEIENNAVMTTSGGSFTIMRSEIKNGKFECNGSMTIKESKMESGSIVYSGSFTDWNSQIASKVRKEKKH

SEQ ID NO: 156933 - protein, 66 aa, Heterodera glycines
  Coding regions on vcDNA: vcDNA=SeqID_83356; Strand=-; Position=1-200
RASMAFPRPFIYPWPTFWLIPPFPQIRSPVFSPSLQLYLSWTSAASLLSANGIYHFLKKSQSLGFP

SEQ ID NO: 156934 - protein, 54 aa, Heterodera glycines
  Coding regions on vcDNA: vcDNA=SeqID_83357; Strand=+; Position=1-369
TSSGPKAWKICFLVIVKQLFELLALILSFLFSLNPKKFNKTYFDLFCVLLKIYE

SEQ ID NO: 156935 - protein, 99 aa, Heterodera glycines
  Coding regions on vcDNA: vcDNA=SeqID_83358; Strand=-; Position=1 -133,454-620
MEADINAENNDGYSPFMLAVMNQDTQIVRYFVSKGARVDRTNKDGISRFTSVPAVTTDLSCANCWWRTGPMPTKPMALVVALRLCILPAATALYKMVRK

SEQ ID NO: 156936 - protein, 55 aa, Heterodera glycines
  Coding regions on vcDNA: vcDNA=SeqID_83359; Strand=-; Position=1 -145,192-214
MKIFTPFLLAFIGTHFAVFATLHSLDEWKETCRTIINEIEDTETNLAADPEVSKI

SEQ ID NO: 156937 - protein, 674 aa, Heterodera glycines
  Coding regions on vcDNA: vcDNA=SeqID_83360; Strand=+; Position=1-2025
MANKFLSDGNNMAISDEIQSDLQCPSRANAKRLNCTLRWGSCPMCLPDHDSAKINCQCRDVKLEPALADPEKRLPIQLKNLLLRNERRDIFAEITYAPIQLSIQFEGLRIATEEDLTKCHAMSKGLFGCYSCHTGAHLHLQCHTDFGSALGYVRCSDGTEFTALCHKTPEILNVSLSFNRAEVDINCTIECSGGRNPFVINGHLRYVPKHFQAPNEGSSFASKAKPSNSCLIWCPDWNFDFSDVFWYFFGLQNALRTVGIITLALFIIYVLLRCNPALRSWRAISRVVLLFLALWPTTDSSAAGELSHLLSIQNSAPKLQFEGHSSVSRRVTETLDIFDAQIGTIHLAKNQKSPMDFAIKAVSVPVHSPFLQIPESAFHIQTQAQFPPFPMATLISFLANTMNIEVERFGLAVTTSLSRWNEARTIVEGLHERGYELKTRHLHPRERNVRLHGSELSRSGANRLGAYNGSACGPTVSELYRSRHGITLRHPSAPCLMEPGGNGHHDFFPIEMIRVVAPDQVSTPRGLSTRSLPRPRPSHFELWDRTDHPPRSRELVISVMPHGDSTTRGAAEEYRIGVGRELTISGPLVLRIYAGALLLALFSVALVDGQSSIAGPCPALSFALCSPRPLKISCPCSSLFGPSPSDFVQIVNNLLRWLVHRFPAANTLLKAMPN

SEQ ID NO: 156938 - protein, 95 aa, Heterodera glycines
  Coding regions on vcDNA: vcDNA=SeqID_83361; Strand=-; Position=1 -110,1115-1292
MPAIDCVFYGAAGGAIANNGTERHFLEELFLSVREKHQLASKCVESLRKKAQAEQLKLPQLMEEMLGKGAAGDEAAEAVNGEESGAGGALNFYVH

SEQ ID NO: 156939 - protein, 110 aa, Heterodera glycines
  Coding regions on vcDNA: vcDNA=SeqID_83362; Strand=+; Position=1 -33,1168-1467
MPVPDSDGQWATKPLQGKEDRLQLRSEFDRTVPNAAQMLLAAREREKQMAIASPRNVGMRLPPLQLPNGPKRIEMEECKKGEDGGQGMIATVATRPLPQLQPLRQYQVGE

SEQ ID NO: 156940 - protein, 94 aa, Heterodera glycines
  Coding regions on vcDNA: vcDNA=SeqID_83363; Strand=-; Position=1 -87,233-346,401-484
MCRRTLIQRLVQTIRQRNNNNFNATEKTLEKASVTIEHFYIFLSKIKMDFIAQNANGFDQKNEYLEILLLDGLKRKAMKEFVSTVIEVESSNSG

SEQ ID NO: 156941 - protein, 156 aa, Heterodera glycines
  Coding regions on vcDNA: vcDNA=SeqID_83364; Strand=-; Position=1 -79,432-547,692-871,928-1023
MANYLLIFILFTIISLVKSQTPINKNGSSTETIHKMKVQHEQGLEFLKLLTEIVDEQFSSNKFNRMNYDEQISSVLKYIKIKLEEKIKEIGVQLSEIGHFFLNFCCEQFGFINTTDEPNKSNALSSNLSSKGSKICIFGTFIALAECIKEKLMKNM

SEQ ID NO: 156942 - protein, 47 aa, Heterodera glycines
  Coding regions on vcDNA: vcDNA=SeqID_83365; Strand=+; Position=1-146
KSLARHNSALVLISQKIKPLFLRTHGCSMHPPNFIPKLHGHLQTFLC

SEQ ID NO: 156943 - protein, 251 aa, Heterodera glycines
  Coding regions on vcDNA: vcDNA=SeqID_83366; Strand=-; Position=1 -320,387-539,602-727,929-1087
  Homolog annotation: Hit_ID=CAE69120.1; Match level="QueryCoverage =98%, HitCoverage=64%, E-value=9e-55, Identity=44%"; Hit description =Hypothetical protein CBG15146 [Caenorhabditis briggsae]
QAIDPYIPPETSLFSRGAKDIFPDLKAFATRKYQGIFYGLRRIRKKDGFQNFNLKVRSSTFPFPWFLFWHQDFTKLAEQIYANAYNALALRDKTKLHELITEAAFSKMWPDVEKGTLHWKLVQFSEPSKVLTVRCLDNPTKSGNDIAQIIVRMHSTQILALYDKDGHLLLGSEEEPRQCLEYVVFENHVASVDGMWRLHCRIYPNWLKPKQSPHRQGLIDEEEMEKLPKEPLKISSGNQVKQSKKRSSTAG

SEQ ID NO: 156944 - protein, 113 aa, Heterodera glycines
  Coding regions on vcDNA: vcDNA=SeqID_83367; Strand=+; Position=1 -105,150-254,441-476,539-631
  Homolog annotation: Hit_ID=CAB58173.1; Match level="QueryCoverage =78%, HitCoverage=26%, E-value=5e-10, Identity=36%"; Hit description =putative nucleosome binding protein [Anisakis simplex]
MTSTKNNSKLNELLQAGGYDASDGIDSLIPSHLKQLSRPVIRRVRMLKKIQAQSLEIESQFYKELHELEMKYQPLYDAVNAKRTAIVRGEMELTDADGELPPLVSELEPQTLE

SEQ ID NO: 156945 - protein, 70 aa, Heterodera glycines
  Coding regions on vcDNA: vcDNA=SeqID_83368; Strand=+; Position=1-236
MPFLTLNAMRSLCRLPPSLFSTGIMQLRFVHHHKELEEPGGFERFMGWRRSNPAKANRNTHINERYMRRV

SEQ ID NO: 156946 - protein, 323 aa, Heterodera glycines
  Coding regions on vcDNA: vcDNA=SeqID_83369; Strand=-; Position=1 -108,215-682,918-1313
MVTAGQNPTDSGGDKSAFFPKALAVLSSGVLAFSDQAIAAIRQIEHSPRIQFDAVAKVYRVNSTETGELLEFDEWGRHLSTLATDRSGGGTERRILLRRSISYGEEAENGQTMLSILEEKEGQKSTEVKVIKGQGGGRGGAEGTDKQRLWTIETEGGQTVVEEEEGEEEKGGATTEAEVGAGRAGDNIVRQNISVTSSADPIRLQFTRDGLLKRVSNGTDRTFFSYDDETRLPIWAKFPDGTEFEMAANEWKAKGEKRRGKSERRSRALWTLGKYSDDRAARVFMGDGEGRSIQSETDHPPKALNPEFVTFWSNLYIEKNGIW

SEQ ID NO: 156947 - protein, 732 aa, Heterodera glycines
  misc_feature (229)..(229): Xaa can be any naturally occurring amino acid
  Coding regions on vcDNA: vcDNA=SeqID_83370; Strand=-; Position=1 -183,444-526,634-996,1310-1589,1701-1791,1926-2075,2221-2446,2540 -2640,2677-2737,2896-3121,3187-3450,3840-3887
  Homolog annotation: Hit_ID=XP_371717.2; Match level="QueryCoverage =98%, HitCoverage=24%, E-value=1e-112, Identity=33%"; Hit description= PREDICTED: odz, odd Oz/ten-m homolog 3 [Homo sapiens]
PPLSQNSRLLINLTVSPKARIVLLARHSVRPTPGAHDWQKIVSGDRMHPLTTDRNGRDTVGTFLRHTMISHFLTAGRWHFGFLNDREQVLALSLALSSSSSSSSDDAPCQFDCFGKGLCRAGRCVCYPGYGGVFCEETACPVLCSGNGMFSNGKCQCYAGFKGVECQMPIGETMGGNSRERGQSISGPSDCKLGPKTIGRGTADKIGIFKDSKNTPGNNKSHLIGKGSXIQQILRRCEDPSCAGHGKCDSSDGKCHCREGWTGPNCAERQCPGRNDCAGRGICHGGKCFCALGWTGEGCERKACPHGCTEHGTCTADGQCQCQAGWNGENCQIETCARNCSNGGQCELFSDGWRCQCDTAHFGDHCQFAKGERSCDDGHDNDGDGLTDCEDSVECCAHPFCASDSLCLAMPFPSEAVDRRSLSISDRLASPFFDRVKFLLGRTFGAAIRGHSPFGQKRISVLRGRRISVLRGRVFSSRGGPLTGVRISDSENPHHGFSLTTTAGTFELALNGGGMVSVQHHGFSLTTTAGTFELALNGGGMVSVQFVRQPFGRVPLTFYLPPNRIVSIGTVWMDRPFSTSTRSGFSPLLRPRRIALRLSPIGTFVRPSPARSPPLPDSRAISLSVLIPDSRAISLSVLIPGTDQFLFYSSNCADGARSVLRVQLLGDRLPAGLLRVELALQIDGVRHQRTFAPRESLSHEFVWDRQNAFGQHEYGLSDAVVLVSLFRPSASS

SEQ ID NO: 156948 - protein, 27 aa, Heterodera glycines
  Coding regions on vcDNA: vcDNA=SeqID_83371; Strand=-; Position=1-81
TSRPRSIQWYIAYMHFPTHSSECSLVS

SEQ ID NO: 156949 - protein, 172 aa, Heterodera glycines
  Coding regions on vcDNA: vcDNA=SeqID_83372; Strand=+; Position=1 -41,678-771,877-948,1108-1236,1770-1952
  Homolog annotation: Hit_ID=CAE64682.1; Match level="QueryCoverage =99%, HitCoverage=32%, E-value=8e-46, Identity=50%"; Hit description =Hypothetical protein CBG09460 [Caenorhabditis briggsae]
FINKGVHWNRRRKNFGFALWSALQGNITWQETGIFPRVTWCDFDVREMGQTVNHTVQCVLTLNVFMEKVFLILWAWYAVLAALTLANITAWLYGYLSVASADHFIFNHLEMCSFIFFVAQICNSVRRFVAEYLRSDGMFILRLIGQHADVVFTTDLVHRLWTSHYEIEKQRA

SEQ ID NO: 156950 - protein, 97 aa, Heterodera glycines
  Coding regions on vcDNA: vcDNA=SeqID_83373; Strand=+; Position=1-294
MHLLIIVLVFFFIKNSIDKTLSVNLYEKNGKLRPTFAEIFGQKWDNEKMECENETDQNANYLQNDQNELNSVDSISSDQNNQLDDQQKFEIVHKFTQ

SEQ ID NO: 156951 - protein, 97 aa, Heterodera glycines
  Coding regions on vcDNA: vcDNA=SeqID_83374; Strand=-; Position=1-291
MNLDDLTSWPAVKEAFCSGMENPKKLERCHKMAEKLHFIEEEDNEADHDEEEDDEDKNEVGLSTRSNFVDSQFGNNEQIHPIMSGDAEDGEAESRES

SEQ ID NO: 156952 - protein, 184 aa, Heterodera glycines
  Coding regions on vcDNA: vcDNA=SeqID_83375; Strand=-; Position=1 -201,272-625
MIFFLIIVIITLIISDSFAAIEEFRFSRRQSAGDVLRRAMSARNYTFNEPLIVINHMVNDGQESNEQTNSSFSLSTLIVAKELSDEERRIKSAKEIQQELLANLRKIRENIPRPKGVKHFFKRFIESRKTKSFEKKLAKNPDLETEISETVLDETKGGPCEKLLPARDENGKLFTDYELRMKAR

SEQ ID NO: 156953 - protein, 189 aa, Heterodera glycines
  Coding regions on vcDNA: vcDNA=SeqID_83376; Strand=-; Position=1-569
  Homolog annotation: Hit_ID=NP_001004509.1; Match level="QueryCoverage= 85%, HitCoverage=10%, E-value=5e-16, Identity=31%"; Hit description =si:busm1-180o5.3 [Danio rerio] emb|CAD60788.1| novel protein similar to DNA polymerases [Danio rerio]
MANGKTAQRIREDDARRMAFITSQVQQVLVFWECEINAEKRNNNEMKRSFAQYKDSGPIRLKDCYHGGRVGPQRLHYEVPEGWRMKYYDVRSLYPHTNAVTAYPVGHPTRVNIIGEAEQAVDWRRADQVPVRGILKVFVVPAHHVDVPVLPVKFDQRLLFPLCRTCALQHPHGAVNEDYECTHREDDER

SEQ ID NO: 156954 - protein, 280 aa, Heterodera glycines
  Coding regions on vcDNA: vcDNA=SeqID_83377; Strand=-; Position=1-843
  Homolog annotation: Hit_ID=NP_507780.1; Match level="QueryCoverage =94%, HitCoverage=15%, E-value=6e-25, Identity=30%"; Hit description =predicted CDS, DNA polymerase type B, organellar and viral family member (5T899) [Caenorhabditis elegans]
MLFAHFGGRFDNIMLFRQFFLNGFCPQMIRRGNKLYEMKIARGEKNPEIIVRDSWNLMPVPLGALPGAFGLNVQDKEFFPHLAIVAANYGHILQSLPPKADYLYGGMTPDRQRRFDQWYAEHHHQHFDLCEQLAAYCTNDTRILIEALVAFRTEFLTISDPLERHGCLDDDNDDEEEEEEEEEDNAFEVIGGGIDITWEPMTIASASMRHFRLNHLKRDQLAIVPECGYDTTNTQSLVALKFMDWYAKKNGVSIQTAHSPGGEKKLASTLWTDTSRRPTP

SEQ ID NO: 156955 - protein, 175 aa, Heterodera glycines
  Coding regions on vcDNA: vcDNA=SeqID_83378; Strand=-; Position=1 -159,255-326,470-688,744-821
  Homolog annotation: Hit_ID=CAE68878.1; Match level="QueryCoverage =87%, HitCoverage=23%, E-value=2e-36, Identity=50%"; Hit description =Hypothetical protein CBG14841 [Caenorhabditis briggsae]
MEKVVKFEEHRHNRWRRAPAVWGEPAPDYSAVSLGIPSTAFFLYALLFVDLKTSDHYRREHEVVKREVMRLRNEANTYFFQINIRLLVVDILETFRDDLSASLYSFEQYRNQRVAQLPFHNVAVLISHRHAGGLAFIGGLCSGRNVMMAGFYPHNPEAMASIFFHEVAHLIGPSQ

SEQ ID NO: 156956 - protein, 213 aa, Heterodera glycines
  misc_feature (7)..(7): Xaa can be any naturally occurring amino acid
  misc_feature (198)..(198): Xaa can be any naturally occurring amino acid
  Coding regions on vcDNA: vcDNA=SeqID_83379; Strand=+; Position=1 -143,203-275,365-419,469-516,563-733
  Homolog annotation: Hit_ID=CAE66640.1; Match level="QueryCoverage =95%, HitCoverage=35%, E-value=1e-39, Identity=45%"; Hit description =Hypothetical protein CBG11977 [Caenorhabditis briggsae]
NRQLISXLHLACNEIGQIWLESGVSENAVSGHVQLMEPGKTACFACLPPLVVASQIDERTLKKDGCLPPLVVASQIDERTLKKDGVCAASLPTTMLPTTMAIIAGLLVQNALKFLLSFGEVTPFFLLSFGEVTPFLGYSALVDFFPKHEIRPNPQCDDCFLVDFFPKHEIRPNPQCDDCFCRKRQREHRVKLARDDLXMGWRMTHGESILGGG

SEQ ID NO: 156957 - protein, 248 aa, Heterodera glycines
  Coding regions on vcDNA: vcDNA=SeqID_83380; Strand=-; Position=1 -121,178-390,496-639,690-816,870-946
  Homolog annotation: Hit_ID=CAE60408.1; Match level="QueryCoverage =99%, HitCoverage=67%, E-value=2e-75, Identity=56%"; Hit description =Hypothetical protein CBG04013 [Caenorhabditis briggsae]
RMSFEVKAGQTVALVGYSGCGKSTVMALLERFYLPTRGSILILIDGIPIEEINIHRLRNQIAMVSQEPTLFDCTIRENITYGNRERITHEQIVRAAEQANVHNFVLGLPEGYETRVGERGAQLSGGQKQRIAIARALIREPTVLLLDEATSALDTENEKAVKKALENARKAVKKALENARKGRTCLVIAHRLSTIQNSDIIFVIKDGRVVEQGGHDELMSRGGGHDELMSRGGIYTTLCETQILKEEA

SEQ ID NO: 156958 - protein, 296 aa, Heterodera glycines
  Coding regions on vcDNA: vcDNA=SeqID_83381; Strand=+; Position=1 -61,208-1035
  Homolog annotation: Hit_ID=NP_493794.1; Match level="QueryCoverage =95%, HitCoverage=89%, E-value=2e-19, Identity=18%"; Hit description =elicitor-like mating protein M81 (2A987) [Caenorhabditis elegans] gb|AAF39963.1| Hypothetical protein T02
MRNFAFIFIWFLIQLGNHLLKNVRAFPTAENGSGMVSGVFVEEELAVEIEKPNEANQNVNPEHDQTKREGAVSEGNMNSNHGHAETVYEGNMNANHEHAETVHEGNMNANHEHAETVHEGNMNANHEHAETLHEGNMNANHEHAETVHEGNMNSNHQHVESAHEGNMNANHEHAETVHEGNMNANHEHAETLHEGNMNANHEHAETVHEGNMNSNHEHAETLHEGNMNANHEHAETLHEGNMNANHEHAEIVHEGNMNSNHQHAETVHEGNMNANHEHAETLHEGNMNANHRHAET

SEQ ID NO: 156959 - protein, 142 aa, Heterodera glycines
  Coding regions on vcDNA: vcDNA=SeqID_83382; Strand=-; Position=1 -302,405-531
MFMIGIHVPLVYGLSMFMIGIHVPLVCSLNMLMIGIHVSLVNYLSMFMIGIHVPLVYGLSMLMIGIHVSLVNNLSMFMIGIHVPLVYGLSMFMIGIHVLLVMFMIGIHVPLVYGLSMLMIGIHVSLVNNLSMFMIGIHVPLV

SEQ ID NO: 156960 - protein, 152 aa, Heterodera glycines
  Coding regions on vcDNA: vcDNA=SeqID_83383; Strand=+; Position=1 -181,539-649,1421-1587
  Homolog annotation: Hit_ID=NP_503600.1; Match level="QueryCoverage =46%, HitCoverage=20%, E-value=4e-09, Identity=33%"; Hit description =predicted CDS, putative protein family member, with at least 5 transmembrane domains (5C684) [Caenorhabdi
MYSIWKHLRENSCYRLLFFIGITDLSILWILGFLRAWFNLHGYVFCSFPTLIYFVGIATTSLWMAESTADLVGIINIQLLNNEQILKKELLIFSLTHLPTGVAHFPQHYGGSAKPEHLSGLYHKTVVRHTNKSQTAECCCHRIERCAEKGGI

SEQ ID NO: 156961 - protein, 191 aa, Heterodera glycines
  Coding regions on vcDNA: vcDNA=SeqID_83384; Strand=+; Position=1 -23,731-800,918-970,1080-1223,1317-1595
  Homolog annotation: Hit_ID=NP_493755.1; Match level="QueryCoverage =99%, HitCoverage=27%, E-value=4e-51, Identity=53%"; Hit description =endoplasmic reticulum membrane protein family member with at least 5 transmembrane coiled coil domains of
IRVRRDRDIISKFFLFTPILFTNISLRPSFLVLSPLVFSPAILSPSILGPLIMFNWTIIFWIISPRIMAPIVLSPLVFSSIILSPILMEPFILSPGIFIFLSQILSPAILTPLIMSPQLLHPAILSPLVLTPAILHPTVMSPTVLSPFVLTPQIFSPKFLGGLFLSPYALSPVFKSPLFVYSIVLSPSWLS

SEQ ID NO: 156962 - protein, 428 aa, Heterodera glycines
  Coding regions on vcDNA: vcDNA=SeqID_83385; Strand=-; Position=1-1286
  Homolog annotation: Hit_ID=AAT85232.1; Match level="QueryCoverage =74%, HitCoverage=22%, E-value=1e-23, Identity=29%"; Hit description =hypothetical protein [Oryza sativa (japonica cultivar-group)]
MSDDGSCETESIDASDAESVASTESLIDRIDKTRKFISLRDYCKYHLAIRDENLEWQYHHILSCGGGLGQRWVLDQAAKIDWQIATFLRRPDMDLRISTPKNLLHYLVNQYNKQQARQNPNAQQKSVDDIGSVVRLSEKNVNSLQYWKKRYEDCNTIFARCHNPKKARLFITFTNNREWPEFKENIYKNGQMFTDRFDMWMRVWSSKIAVFHQELYEKSFFGTILGSGESMEFQGRGGPHAHIVAQTDLDAVPEVIQEYIWAHIPPLPDKGDDSPIAQMHREIRELMHMQLHRCSDSWCGPRDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAHMPNELPWSYGSFC

SEQ ID NO: 156963 - protein, 113 aa, Heterodera glycines
  Coding regions on vcDNA: vcDNA=SeqID_83386; Strand=+; Position=1 -133,176-384
MDKRLIPTKDLWTKDSYRQKTYGQKTHTDKRPTDKRTTPTKNHSRLRLPDRVRPGYPDFPRPGPDLFKIQYVVPDPAGPDPKKCTAKNGSRVKFEGKKNLEKLIYYINTFTFF

SEQ ID NO: 156964 - protein, 119 aa, Heterodera glycines
  Coding regions on vcDNA: vcDNA=SeqID_83387; Strand=-; Position=1 -151,317-525
MLRCGVSSESDSYINASPLHLPFAHRNYILTQGPLPNTTCDFWQMIFEQEGVTLISLQKMRKKLHLTIGNANLSMRNQSRITSFAVFDSLGWKIRGKSSATHLQRNKRQTMREKSEIAE

SEQ ID NO: 156965 - protein, 57 aa, Heterodera glycines
  Coding regions on vcDNA: vcDNA=SeqID_83388; Strand=+; Position=1 -162,227-238
MAWAYQHTRALFVQKLFRVRRTIAKGTDKNKPRKTERSSSAAASWACAVALLTVRSI

SEQ ID NO: 156966 - protein, 100 aa, Heterodera glycines
  Coding regions on vcDNA: vcDNA=SeqID_83389; Strand=-; Position=1 -146,200-313,1003-1045
  Homolog annotation: Hit_ID=NP_498782.1; Match level="QueryCoverage =82%, HitCoverage=18%, E-value=2e-16, Identity=53%"; Hit description =putative nuclear protein of bilaterial origin (3J246) [Caenorhabditis elegans] gb|AAA27996.1| Hypothetica
MVQAVVQARMGKMLSHPCTPNPEQADYFNIVIDEIGEISAYLKSTVGKNYPPNSTVMTLEFILYTDDGDTLPLEAWFCNLNDSFCIMKMSFGDCCAARGQ

SEQ ID NO: 156967 - protein, 69 aa, Heterodera glycines
  Coding regions on vcDNA: vcDNA=SeqID_83390; Strand=+; Position=1-212
RNCNHHLRASPPLPPPIHRHFFVLPLAASKAAEPIGRHGQSAEQWQHQPTLVDLAAQPHKCAVVIDIRK

SEQ ID NO: 156968 - protein, 134 aa, Heterodera glycines
  Coding regions on vcDNA: vcDNA=SeqID_83391; Strand=-; Position=1 -294,354-461
MSHQPFANFEIVRLEAMIIGLEIDKDQLQRDVYHLKNRKTQIHNKKIELLQQKEQLIREISVLRETKATLVNETKDLREEILELRDMDGSNDDDPLCARNYACIPCGHRALCNRCAETVSIDGRCPFCREELIG

SEQ ID NO: 156969 - protein, 664 aa, Heterodera glycines
  Coding regions on vcDNA: vcDNA=SeqID_83392; Strand=+; Position=1 -594,1001-1297,1555-1668,2028-3017
  Homolog annotation: Hit_ID=NP_502797.1; Match level="QueryCoverage =51%, HitCoverage=94%, E-value=9e-56, Identity=37%"; Hit description =HASI (4P602) [Caenorhabditis elegans] emb|CAB16520.1| Hypothetical protein Y57G11C.19 [Caenorhabditis ele
MFIAPFTLILSGATGSGKTQWLMKLLRNYKELIDPPPAKILYCYSEMNESVLDLMKRGIETHNGLPDQALIQSQPKPLLLVLDDLMLNVGSDFLDLLFTRGSHNWNVSVIFVTQSLYGRNIRTARANSHYLVLTRNPSGQLQVRTVGSQLFPKRLNYFMEAYNEATSQPFSYLVINMHPNAPENERLTSKIFPGESRELNSWSRKLLQLHQHNNNKMKHTKKMLLVPESEYLALINLLKGGAGGTDSLQAEKAAIDASIQKNLNDNKTGADVKMKRHSWLYKQRHQIKDMIENKPQKLKTGPEHYDKLHEMIERNPEKYGVDKSSGEILTNFKKPEAKKRNPSITLRDVDHFLHKQRTYTLFKPRKNRFRRLKTVPSGLHTDWQCDLCIMDALKEHNDGFRYILVCIDVLSRKIFTAEVESKKSEHMIAAFEKIFNKAGVLPNKLYSDAGLEFQAKKMMDYWKQKEIIKHVMYSPHLHAGVVERANRTLKERLYKYFSEKNTKRWVDVLDSIVRNLNSSANRTTGVRPMDVNFKNAAALRNRLYKQGESSPKTPKFKVGDIVRISKEKGDFSKGYFPNFTDELFRISKVNPTDPPSYRIRDQDGEDIKGIFYEQELVKTVAETAHRAEVLKTRRRNGVKEHFVRWIGYSDKHNRWIRDEDIVQN

SEQ ID NO: 156970 - protein, 379 aa, Heterodera glycines
  Coding regions on vcDNA: vcDNA=SeqID_83393; Strand=+; Position=66-1205
MSFFYFLLIAFILFHFLHLSAGEWINVELSVDPPNSFDRSFRTISKNSPAQHWFGYNRDTACHVELERNINRLYTNPDTWNIALTDVDNLMSLGRTTIEIPSTALPWACFGHGGHSFVIFNLQNAAGEVTVLRGHQQKIARQLSAYGRILFDHIAARLYIVDKSERRINELLIADLERWWTLNNTDDALNRTSAHVLRSNFVGFLPEQKTDYFIAADHVYLIWRRRVYKFRIGHYFNDPSSQLQFLTNSSDIRFNFLLFEAGAERLGEGGDRRNSRSAVVVPAVSSNGIERLLLALTYLFDLVVILIAICAFRQFRRLGGGAAARNGDDAIELNEYDLFHSLSLQNNNNGGGAYDVSAAYNPTNTAPRTAHQLRSCATI

SEQ ID NO: 156971 - protein, 101 aa, Heterodera glycines
  Coding regions on vcDNA: vcDNA=SeqID_83394; Strand=-; Position=1-306
MSTAELQSSEKPIEKAGKADKKSSKPTLLDQQRFFWKLARPKFAVINFLCPGCRRLNYKHKDQFKLMGDSEFHFTQVMCPGCVKYNMMQTDIYNKHTKNPH

SEQ ID NO: 156972 - protein, 137 aa, Heterodera glycines
  Coding regions on vcDNA: vcDNA=SeqID_83395; Strand=-; Position=1-414
MSMDNWARTWATSQTEYPGHELLEFVSGGCKQYALRMRSKRTGAEDTVLKVRGITLSADACRLLHFNTFKQAVLRYATAEEEEDAFEEIIIDYPNQLRPNIREGAVQSVSISKRYRPVVTKGIVSENFIVRDFGFKL

SEQ ID NO: 156973 - protein, 327 aa, Heterodera glycines
  Coding regions on vcDNA: vcDNA=SeqID_83396; Strand=-; Position=1 -398,535-873,927-1171
  Homolog annotation: Hit_ID=NP_507780.1; Match level="QueryCoverage =100%, HitCoverage=22%, E-value=1e-23, Identity=25%"; Hit description= predicted CDS, DNA polymerase type B, organellar and viral family member (5T899) [Caenorhabditis elegans
MTSEKQRRFDGWYNEHCNAPFNLCEQLASYCTNDTRILIEALIAFRAEFLAVTDPIENHNAEEDAEEEDEEDAIDLAGNNGIDIVNGPMTIASASMQHFQMNHLKKEQLAIVPERGYDSANNQSLLALKFMECYIAETDTVIEVNGCVWHACSAPHHRFDPQAVMPNGKTAQKIREDDAQRLQFISGRCREVKVFWECEISEMLKRDQRMRESFNSYVDKGPINLKDCYHGGRVAPLRLRYKVPEGWKIKYYDVRSLYPYTTAVTSYPIGHPTAVHIMQGDDSIVDWRRPTDVPILGILKVFVVPPRRVDVPVLPAKFDQRLLFPLC

SEQ ID NO: 156974 - protein, 204 aa, Heterodera glycines
  Coding regions on vcDNA: vcDNA=SeqID_83397; Strand=+; Position=1-615
MDNTAPKKFLTSLDQLQIPPEIDNDSAIPDYAKLLIKQLHSLLATASSLVQSQVAATDAIEEDRRQRTVVITNVPEFQSGKASERGEADSALVNLILDTVDLDQTPMVFRVGMRTPNRARPLKMEFPTKHAARQVLRMKGKALSLNALHGARIRESMTKEQLAERRKLIEECAKKRKEDAGDWIVYANQVILRSEIDTIRKKNF

SEQ ID NO: 156975 - protein, 933 aa, Heterodera glycines
  Coding regions on vcDNA: vcDNA=SeqID_83398; Strand=+; Position=1 -2791,3030-3040
  Homolog annotation: Hit_ID=NP_502915.1; Match level="QueryCoverage =66%, HitCoverage=64%, E-value=7e-62, Identity=28%"; Hit description =predicted CDS, integrase, catalytic domain containing protein family member (4Q923) [Caenorhabditis elega
MSELKYNKLWWNGPKWLKLEKENWPPHSFYSPDQEEAPYLDNTEEIINTQINLIKNEYNGIIEWDKFSSWLKITRICQTLLKFIFFKLQNSKKFKEKFICSKFKNALQLKIMAQKILIRIIQKEMEPNKEEERQLRIYLDNDMILKCEGRLKNAQIQGVNPIFLPRKHYGTHLLIMDYHTRNLHAGTMTTLSEIRKTYWIPKGRRIVDQIRKQCYHCRRYNTKPFQQPQMPPLPKSRVEITEPFQNIGLDYMGPIQIKNFNEKCWIILFTCLTTRGIHLELVTSLSVQHFLNAFRRFISRRGTPKHVWSDNAAQIKLASKILPEVLKLREILKDESIKSYFLNENINWTFSIELAPWQNGAIERLNQNVKTAMRKVIGKRFIEFDSFQTLTCEIEALVNSRPITFIYDEINSYQILRPIDFILPHKNLCIPPILENQETKDPTYYPKKTSYEQTIELWKKTTKLLDDYWKIWTDEYIPSLRERYKIENKNPRNCMKSFPELNEIVIIHDQTPRAMWKTGIVKNVITGSDGIVRGANIELPNKTVLNRPLKLIYPLEINSNDDKEQETLSNLIINQKPNYFNRKRKMDNPLVPIKMNRLFQNSLTIISLLTLISLCSSYSYECPKEPKIWKTRYTTLCIENGFTIRQNKITKEFCYKQLVCKDKHIIKRRPPYCGKKCNCPEGFKFCSFASYNKIKNESVGRINYQKIISFYKPNICSLNKTEKCPNMQRKLFNSIVLHDNSIHMVKTLNLLFSQIDSINNFRCFGEGNLTIGTPIYCREHDCFKNNSFKQIYGTKFCFYDPYEKIYLVKSDEELIQIKAWGTIEKIFYLPNNLNQPFIENRRNKREENSSITEESTIECLKGGIIIKAINDIQELQISIENYTIIKKNPQKEEIIYLPPKLTSFEYKPVIKFISNPDKTNEKQITCQSSPQPR

SEQ ID NO: 156976 - protein, 343 aa, Heterodera glycines
  Coding regions on vcDNA: vcDNA=SeqID_83399; Strand=+; Position=1 -77,562-1514
  Homolog annotation: Hit_ID=AAL27282.1; Match level="QueryCoverage =88%, HitCoverage=65%, E-value=2e-29, Identity=34%"; Hit description =spore wall protein 2 precursor [Encephalitozoon intestinalis]
EHTCCEYVSALSSIEHEAPSPGGVPGEGFEVTICRPRCSNLEEAETVKREKGWGKTRANRLISARRKEEEEKESKIQKEKEQKREEETNKKRGKDRRERKKEEANVREIHIKIINENEEKENNGTEKGGKGEKEEKTKGLKTGRNTEGEGKDKSHTGRNTVEEGKDNSGKNTAEEGKDKIGTGRNTTEEGKDKIGIGKNTAELGKDQIGNGRNTAEEGKGNSGRNTTEEGKDKIGTGRNTIEEEKDKIGTRRNTAEERKDKIGTGRNTAEEGKDNSERNTTEEGKDKIGTGRNTTEEGKDKIGIGKNTAELGKDQIGNGRNTAEEGKGNSGRNTTEEGKDKIG

SEQ ID NO: 156977 - protein, 67 aa, Heterodera glycines
  Coding regions on vcDNA: vcDNA=SeqID_83400; Strand=+; Position=1 -64,485-624
MSIEVFKFYYYQKKIFVEGTKALLKGKQQAFLHDLIAGNTSLKYELDLIAGNTSLKYELINVNIKAM

SEQ ID NO: 156978 - protein, 48 aa, Heterodera glycines
  Coding regions on vcDNA: vcDNA=SeqID_83401; Strand=+; Position=1 -87,788-847
MIFAFIFSFISSKFNTFAFALFWCFLVNKEFFGNFCYMYHNLLSWIYI

SEQ ID NO: 156979 - protein, 48 aa, Heterodera glycines
  Coding regions on vcDNA: vcDNA=SeqID_83402; Strand=-; Position=1 -31,382-497
MPKLQFDFLKVARLDFLVALLFLEQCDDHLPLPFPHFTIPLDHFPSDG

SEQ ID NO: 156980 - protein, 139 aa, Heterodera glycines
  Coding regions on vcDNA: vcDNA=SeqID_83403; Strand=-; Position=1-417
MIIFVIIIIVPPIINGMNDHHLLSRIENKRDQEHMQNLNKLIKADQDKFNAVQSQSKRKDKHSIECDQSKNITQNDGQELISEETREWAKQLIKFIDKLIAKGRIDLEENDQSDQKSYAIDFRETKKELVKKLRNPKTE

SEQ ID NO: 156981 - protein, 341 aa, Heterodera glycines
  Coding regions on vcDNA: vcDNA=SeqID_83404; Strand=+; Position=1-1026
  Homolog annotation: Hit_ID=XP_318550.1; Match level="QueryCoverage =87%, HitCoverage=31%, E-value=2e-82, Identity=49%"; Hit description =ENSANGP00000020240 [Anopheles gambiae]
MVSELLLTHYDPTLAIVVAADASKDGIGATISHIFPDKKEKVIEHASTVLTNAQQNYSQIEKEALALVFAVQKFHRMLFGRKFTLLTDHKPLLAIFGSKKCIPIYAASRLQRWALIMANYDFEIRYINTASFGQADVLSRLIANYPRPEEDILIANICTETECYISTILQTKTEQLPVTADEIAEATPKDEILKKILAFTQSNWPKKCSDPDIAPYFPKRENILEIEGCLLYQNRVVVPQSLRNRMLKSLHMAHPGIVRMKALARQHVYWPGMDSEIERIVRQCEECQKAQKAPIKAPLTPWTPTDKVFQRVHIDFADHAKTVTSISFWWTHSPNGRRSTK

SEQ ID NO: 156982 - protein, 689 aa, Heterodera glycines
  Coding regions on vcDNA: vcDNA=SeqID_83405; Strand=-; Position=1-2070
  Homolog annotation: Hit_ID=S08405; Match level="QueryCoverage=98%, HitCoverage=57%, E-value=1e-101, Identity=33%"; Hit description =hypothetical protein 2 - silkworm transposon mag
MDKILRGIANVPVYIDDILIHTETLEEHLESLSSVFVRLQKNGLKLKAEKCKLFQRKCVYLGHILSEIGYQPSLNNREVIEKFPQPKNVKEVKRFLGMVSFFRKFIPNFATIAHPLNSLTRGNQLKIEWGQAEESAMSELKKHLLKSPCLRAPNYNLAFYLFTDASAVAYGAALMQSVDGKELYAIAYWSRTLSATESKLPATHGELAAIVNAIQNFRPILYGAELIILTDHRPLTFLFQKASINPKINRWLMALQEFEPKVVYLEGRANKVADALSRVPIKWESIEIKFKEEIPYFLTLEEFNLDREKVEKETKNDKTLSKIMAKIKDNWVEPIENELEPFFKNRDSLYLEGNLIRKHPQGQIVIPDVLKVPILKLVHKAHFGMVKGKAKARRFVWWPKISEDIEEFTGECEICQRNAPAPPRSCPEYKWPEAKYPFERVHVDLAGPIWGTNFLITVDAYSKFPFVHQMNSTNSSALITAYREIFAVFGSPRTLVSDNGPQFVSAEFNIFLSEEGINHLTSPPYHPPSNGEAERFVRTFKEGIKKLLDSGKTLQLAQFILLQEYRSTPCQMLGGETPAQKFLKREMRTEMDKIKIMPPMGKNRKGSLSENPKALEPMAHVPTKEVQSRNEFYPGDAVWVRDQATKKWIPSILLQPMGERLWKAEMEGGGERVAHSDLIKRRKLVSRHI

SEQ ID NO: 156983 - protein, 40 aa, Heterodera glycines
  Coding regions on vcDNA: vcDNA=SeqID_83406; Strand=-; Position=1 -24,182-280
MSHTLPMVPLLFLCWFTLRNGSVSPVIFPDSVRRSNRTNE

SEQ ID NO: 156984 - protein, 39 aa, Heterodera glycines
  Coding regions on vcDNA: vcDNA=SeqID_83407; Strand=-; Position=1-119
SCSHYRNSPSTSANTPCAHPVTRAVPKCCPLETHSRQRP

SEQ ID NO: 156985 - protein, 30 aa, Heterodera glycines
  Coding regions on vcDNA: vcDNA=SeqID_83408; Strand=-; Position=1-95
RGLGEKEDESKKTGNAGARLACGIIGLAKP

SEQ ID NO: 156986 - protein, 148 aa, Heterodera glycines
  Coding regions on vcDNA: vcDNA=SeqID_83409; Strand=+; Position=1 -195,252-503
MSASNTTSTTDFETFLLFLCGVVELLIHFVGIPLSIVNLILVARTSVIHPNMKFILLFQSFAVLLRGFCRFVICLFKFILWDPISAEMGLFFPAILKIGYFGIYSRNYVPHILIIERILATVFVRTYEQHRGFLFTIIWLPFAVKFKF

SEQ ID NO: 156987 - protein, 79 aa, Heterodera glycines
  Coding regions on vcDNA: vcDNA=SeqID_83410; Strand=-; Position=1 -46,95-240,388-435
  Homolog annotation: Hit_ID=NP_491559.1; Match level="QueryCoverage =82%, HitCoverage=11%, E-value=3e-22, Identity=75%"; Hit description =ezrin, Radixin and Moesin family, Ezrin/Radixin/Moesin (66.0 kD) (erm-1) [Caenorhabditis elegans] gb|AAB3
MSSKSVNVKVVMMDAELEFAIPPSTVGKQLFDQVVKTINLREIWYFGLQYTDTKGISSWLKLNKRHGQKMENLPATFIV

SEQ ID NO: 156988 - protein, 182 aa, Heterodera glycines
  Coding regions on vcDNA: vcDNA=SeqID_83411; Strand=+; Position=1 -118,166-594
MTTSDEKQLQVVVASNEKKQIKKSEVDFPVVLKRGVQGRVKWYSPEDAYGFIHRYDVDEDIFVHGSSIVRFNIRNKNQHPVLSIQQEVLTLNQQIVILKDHHFPILYRFDLFIWLTVSLTSSVVQVEFDVIKVRKGLEARCVSGPGGRLVGRFFNIPRRSVSGAKKQVSKKNIKRVPRNTAD

SEQ ID NO: 156989 - protein, 30 aa, Heterodera glycines
  Coding regions on vcDNA: vcDNA=SeqID_83412; Strand=-; Position=1 -69,167-190
MGSWENLMIEEKIDKKIKSTVVKRENFVMD

SEQ ID NO: 156990 - protein, 24 aa, Heterodera glycines
  Coding regions on vcDNA: vcDNA=SeqID_83413; Strand=+; Position=1 -62,312-324
MARCHLMLCCLPFVPAACSAPRTL

SEQ ID NO: 156991 - protein, 49 aa, Heterodera glycines
  Coding regions on vcDNA: vcDNA=SeqID_83414; Strand=+; Position=1-148
MTALTAPLCLVAPCLIESWGRRPLFLLITALSTLELTLLTVAQLLYDVL

SEQ ID NO: 156992 - protein, 92 aa, Heterodera glycines
  Coding regions on vcDNA: vcDNA=SeqID_83415; Strand=-; Position=1-276
MDSNLRNSKHWDSTHQLSMTFQSLKINPTAFQSLGLNYQTFQSLGLNPPAFQSLGLKSPAFQTMDSNLRHSKHWDSTHQLSMTFQSLGLNPP

SEQ ID NO: 156993 - protein, 68 aa, Heterodera glycines; identical to SEQ ID NO: 127362
  Coding regions on vcDNA: vcDNA=SeqID_83416; Strand=+; Position=1-370

SEQ ID NO: 156994 - protein, 423 aa, Heterodera glycines
  Coding regions on vcDNA: vcDNA=SeqID_83417; Strand=-; Position=1 -489,548-844,892-1377
  Homolog annotation: Hit_ID=EAL49477.1; Match level="QueryCoverage =78%, HitCoverage=44%, E-value=2e-37, Identity=32%"; Hit description =hypothetical protein 42.t00003 [Entamoeba histolytica HM-1:IMSS]
EKKRQEEEKEKRKKEEHEEHKKRREQEKKREEEDELKKREEEEKEKRRKEELEEQKKRREQEKKREEEDEQKKREEEEKEKRRKEELEEQKKRREQEEEKQRKEEEEEKKKREEREANELPTEEDDEEEMEAELLRRMEERNEEEAAVASLGLQTKADLRQPQDTNQPQIDAIGHDIGWKVLERPSEKEVKLEKVTEMVEEEKEKNMEEKVEECAVEKQIKREQVEEETVSREKDKTANEEPPVDKSVGFKFETVERRASNESVDSHMAGVGNGFVEVDAEHLRQQKREQDALERLAEERRRTEETVKRMDETVDAVATNSALLQHQNQESTALIMQQIASPNLAQQQLTIDLFQRANQQQNAHQITTTTNGTFPQQREGVVVECDYYYPTNMAMSGQAQNQQQPQREAVVQTVPVNAPITIQ

SEQ ID NO: 156995 - protein, 490 aa, Heterodera glycines
  Coding regions on vcDNA: vcDNA=SeqID_83418; Strand=-; Position=1 -177,249-758,879-1061,1112-1459,1522-1773
  Homolog annotation: Hit_ID=AAH73328.1; Match level="QueryCoverage =90%, HitCoverage=66%, E-value=4e-16, Identity=23%"; Hit description =XNopp180 protein [Xenopus laevis]
MFNGIDMREQKRMMKMIKSGIGFGLSMYDRVKRRSSQRPDDEQKKKTALEVLNTKHAKKRKEFSRVRLSSTSTDSEGNEYAQATTTQLKMAERSPKPKSAEEDESDTSDEENGEQNAEENDDAMTRTEKPKTHLDTSGDMSTKSSADEKLEKTTAILTIRRPEIAPRKPFMDDRPTKEEGANSSPSSVEEESANGSESESEAEDGELDAGDRAIKKVTNTSNEKPINQNKLTKVISIATEGCQTRSSDSHSEKSDSSSDSSSSSESVTDSEPKKERPKLSAGMSKKLPSQKKVKHLSMEDVFGADSSEESSGERAIPLPPPPLRQNKVELSSSITKHKGVVNETIKKGIVVPKIKVGNKHEEAIKIRTEKAQNKSLLTTNEQGKRTRVSSVSSVSSVEQKRFKKVKSKPNTEKETVTSPPATTTTTTTSVRDRSKSDATALKTAHFQQKQMTSNKSGTIDTVERVVEKTAELDKKMKQQKPSKTTVGTTK

SEQ ID NO: 156996 - protein, 445 aa, Heterodera glycines
  Coding regions on vcDNA: vcDNA=SeqID_83419; Strand=+; Position=1 -88,196-461,522-782,835-987,1103-1179,1267-1654,1787-1847
  Homolog annotation: Hit_ID=CAE72644.1; Match level="QueryCoverage =99%, HitCoverage=73%, E-value=1e-129, Identity=54%"; Hit description= Hypothetical protein CBG19850 [Caenorhabditis briggsae]
MDEAKNMALLFFVDHLMQKGGQRTIHDLSCQFGARGFTDEMRQAVGTTQEGLYEFLSQYPSLFTLQDGDKVQLKGYGDGDEGRTPHIPPSGRQRDYVAEAVQFFVAKLEKFGPEMQVKSLLGHRSQVKSLLGHRSQAAPEVRLVSGRHLKEFADFLANQTNHFTVEGDRVKLKHMPEPNGTDAKQFLDEEGRPLVGHRAKLAAVDFMRGVLEQNEEMPINEEMPIPLDIFYRRFCDRFPHSIRQEVATNPKELLLFLKLNRHVFFIRSNKVQLVRNRPGDEHGSESGRSTGEDGGSNNALFPLNRDNLHRVQIVQTLQQAQEAVRCLRVDLDSVPSSVLALDFKLLSFGSVPSADLPLVVLAVVASPLRLVVFDLAQSDKVLSESGLRTLLEDDSVLKVTHDVQRIAPLLANRWDIRIGRLFDTQIAHSVIQHDKFSKPLGDLRA

SEQ ID NO: 156997 - protein, 173 aa, Heterodera glycines
  Coding regions on vcDNA: vcDNA=SeqID_83420; Strand=+; Position=1 -63,170-425,872-1061,1480-1492
  Homolog annotation: Hit_ID=XP_455036.1; Match level="QueryCoverage =80%, HitCoverage=37%, E-value=1e-21, Identity=34%"; Hit description =unnamed protein product [Kluyveromyces lactis] emb|CAH00123.1| unnamed protein product [Kluyveromyces lac
MSQALTDALIAGPVNLKQKTLVSKVERSETTGKLTVHMTDESKLEDVDKLIWAIGRDPLTAELNLADVGVKLIAGDYIKVDDYQNTTKEGIYAVGDVCTPKFELTPEEAVERFGRDQVKTYNAGFTNMYFAMTQHKEKTHMVVSTIEFIRIIILAFFPFRKSCATERMRRNVY

SEQ ID NO: 156998 - protein, 70 aa, Heterodera glycines
  Coding regions on vcDNA: vcDNA=SeqID_83421; Strand=-; Position=1 -57,116-271
  Homolog annotation: Hit_ID=NP_598698.1; Match level="QueryCoverage =95%, HitCoverage=89%, E-value=4e-15, Identity=49%"; Hit description =RIKEN cDNA 6720456B07 [Mus musculus] gb|AAH10582.1| RIKEN cDNA 6720456B07 [Mus musculus] dbj|BAC25616.1|
MSIQRQMKEDWDNRELNSIISDNIRQISEFLSHFDETCKAKLATLNDTITSMERKVEFLESTVTRGETLN

SEQ ID NO: 156999 - protein, 269 aa, Heterodera glycines
  Coding regions on vcDNA: vcDNA=SeqID_83422; Strand=+; Position=1 -3,203-401,471-602,1860-2023,2169-2285,2773-2927,3001-3040
  Homolog annotation: Hit_ID=NP_497787.1; Match level="QueryCoverage =75%, HitCoverage=40%, E-value=2e-26, Identity=60%"; Hit description =beta integrin, Paralysed Arrest at Two-fold PAT-3 (pat-3) [Caenorhabditis elegans] emb|CAA84677.1| Hypoth
MSFNNLAQYSRCDSAQILLEHGCAPDQIVNPQSSLRNLLNEPFTDGTEEGEHTVQLRPQEVEIRIRPKSKARFNVRFRQPHDYPVDLYYLMDLSYSMKDDKEKLSQLGDLLEVDRTRLSVHCTAPSENQREKGNKNKEIKGFPIPRICQVNVIFAVTRSNQRLYQQLTDALPDVSTAVGVLANDSSNIVTLIEEEYGKIAEKIIMIVYNAPECNGHGNLVCGICQCAEGYVGTHCECESGGESAVALEAKCKKDNDRWALDLRFKAFYA

SEQ ID NO: 157000 - protein, 80 aa, Heterodera glycines
  Coding regions on vcDNA: vcDNA=SeqID_83423; Strand=-; Position=1 -172,1141-1211
MGAGFEDGRVGSARKKTPEELAAEMAAEEDSIIGQLGLTEQVEVSLPWKFFEICRKWNKVRSTQRKAKGEGRENRLRSIG

SEQ ID NO: 157001 - protein, 57 aa, Heterodera glycines
  Coding regions on vcDNA: vcDNA=SeqID_83424; Strand=+; Position=1 -30,195-338
MSAARRNRQPAAGQRRADGAIEKGEEPVYDEVPLDTVVQMRDEENGEEDEEEDDSYF

SEQ ID NO: 157002 - protein, 111 aa, Heterodera glycines
  Coding regions on vcDNA: vcDNA=SeqID_83425; Strand=+; Position=1 -241,397-491
MVTKDGITLWCTRIEKAQFVPFDVVYALPGHCFFRVKNKARVFSVPYSKLPSSDKCAQPPPPPSSKHQRTPDDEEEKNLRPTTTTLTASAIVKRGGEEGGMHKQQQCWSNN

SEQ ID NO: 157003 - protein, 57 aa, Heterodera glycines
  Coding regions on vcDNA: vcDNA=SeqID_83426; Strand=+; Position=1-171
MERYKRKQQQQQQQAKVSQLIKENANWLCALSKAKCVKRCGRLIRKANTDKLLSLRE

SEQ ID NO: 157004 - protein, 67 aa, Heterodera glycines
  Coding regions on vcDNA: vcDNA=SeqID_83427; Strand=-; Position=1 -104,154-254
KPSKKLSLHNANTWTNKETKSSTKSTNPQVSFIRRKMSVKKNAFLRFNQFAQEAWNLIVNLALDLDR

SEQ ID NO: 157005 - protein, 101 aa, Heterodera glycines
  Coding regions on vcDNA: vcDNA=SeqID_83428; Strand=-; Position=1 -90,254-370,421-516
NIPMVTHILSSIEESAQHRDKKAEKQRHFEGKEQLLSLIYNLGGQERFVDLLELRKLYEHNYFKELNKAALKEFFPTGQLKGIMDKYLYQDIELATDQNKN

SEQ ID NO: 157006 - protein, 88 aa, Heterodera glycines
  Coding regions on vcDNA: vcDNA=SeqID_83429; Strand=-; Position=1 -143,359-482
MKKHLTQKFEAHLGVMYLMQKNWHCDKIADQLTEYKLGLSGTGTGTGRLSGDIKANMDQLFLAPSTEPDAEEKELEIDYLEINDDDFC

SEQ ID NO: 157007 - protein, 110 aa, Heterodera glycines
  Coding regions on vcDNA: vcDNA=SeqID_83430; Strand=-; Position=1-333
MSEKFCAYGLTFVRRRFSTANCARLRWHANFREDIDGQNDHFGGGELGHCGQCEDEDPRQGGRSAGSATADLRRQTARGRTNVGRLQHTEGVHAPLGPPSPGRKWEEKHG

SEQ ID NO: 157008 - protein, 61 aa, Heterodera glycines
  Coding regions on vcDNA: vcDNA=SeqID_83431; Strand=-; Position=1 -84,181-282
MFDGHFPSFVHAHLDLKLALLSLRFDALIEFEFKNRKMETFFLELKKIFIYEIVYFKQEIN

SEQ ID NO: 157009 - protein, 62 aa, Heterodera glycines
  Coding regions on vcDNA: vcDNA=SeqID_83432; Strand=-; Position=1-245
SLIGQLAVPLAFLSSSSSKSIISCSIPMHAWRLRRVELKLRKNLDTRRPNSSESSSSCVGPS

SEQ ID NO: 157010 - protein, 74 aa, Heterodera glycines
  Coding regions on vcDNA: vcDNA=SeqID_83433; Strand=-; Position=1-225
MKVRFNCPWHRSGYTPNFFGFKVKRKLKMRTVERLSQTEGSRHILMRRVLSEKHFVAWNWPSKKPRNDRLNYPL

SEQ ID NO: 157011 - protein, 42 aa, Heterodera glycines
  Coding regions on vcDNA: vcDNA=SeqID_83434; Strand=+; Position=1-127
MLVISGWQTLVQGRQDGEESVWSTDRCPPPRSGSSQATRDQP

SEQ ID NO: 157012 - protein, 44 aa, Heterodera glycines; identical to SEQ ID NO: 136949
  Coding regions on vcDNA: vcDNA=SeqID_83435; Strand=+; Position=1-189

SEQ ID NO: 157013 - protein, 34 aa, Heterodera glycines
  Coding regions on vcDNA: vcDNA=SeqID_83436; Strand=-; Position=1-101
VGIKHHSPACLLFVPISILPKFLPGRICICLVPT

SEQ ID NO: 157014 - protein, 238 aa, Heterodera glycines
  Coding regions on vcDNA: vcDNA=SeqID_83437; Strand=-; Position=1 -98,167-238,1166-1364,1705-1797,1876-1967,2049-2145
  Homolog annotation: Hit_ID=AAN32888.1; Match level="QueryCoverage =98%, HitCoverage=64%, E-value=2e-46, Identity=49%"; Hit description =annexin 4C10 [Heterodera glycines]
QRQKLSEVYKKIFEKEMIAMLHREFTGDFRELIFYLMQTPIVFYLMQTPIVYDTNQMHNALSGFNMPVLAEILITRTNGQIAELIDTYNHVFDGLENDIKAKKRPISKFVALIAQTSRDETELVDEQLAKEDAMKLIKEGEGQKSINESVFNEVIATRNLVQLRLTFDFYHEVADQLRLTFDFYHEVADQDIETGIKQEFGGDDEAGFLALIKCVRNSSEYFADLLQKSIKGICTSKY

SEQ ID NO: 157015 - protein, 35 aa, Heterodera glycines
  Coding regions on vcDNA: vcDNA=SeqID_83438; Strand=+; Position=1 -8,187-286
MSISSPFTMGIFGPSFAVPKCAAKPSSTTSQLDWL

SEQ ID NO: 157016 - protein, 32 aa, Heterodera glycines
  Coding regions on vcDNA: vcDNA=SeqID_83439; Strand=+; Position=1-100
SSPFTMGIFGPSFAVPKCAAKPSSTTSQLDWL

SEQ ID NO: 157017 - protein, 74 aa, Heterodera glycines
  Coding regions on vcDNA: vcDNA=SeqID_83440; Strand=-; Position=1 -84,946-1086
MPFRTGEWPSPGNWFWPNPTEDGGGGQGHLFVLSFYGHSILIISIGPTTAKTLAQQPNQIFVPPPQRVPLKGKT

SEQ ID NO: 157018 - protein, 270 aa, Heterodera glycines
  Coding regions on vcDNA: vcDNA=SeqID_83441; Strand=-; Position=1 -290,416-938
MTTIKTISTTTPKPKVAETKAKKALPNKNAILSKISKKNSKNSGREPMKTETIEIKNESGEKDSQFQKLSEVDEKESDEVIFQKAKDNLENAIKSDEEKTAQKAGLKIEPLETDKTNLAAANDSKILILGKTKANIRIEDPLTGKSGEWEATLLVSVDKHCPGPLLIGLPILTELKGVIAFGERKVKIGEIWTNIISVIGTESEKPMRVTMKNTEILEPRTETILTANVNGNFKNDQNFLVEGIAHQYPGVIVGRTLVSPGTAKMLQFKF

SEQ ID NO: 157019 - protein, 328 aa, Heterodera glycines
  Coding regions on vcDNA: vcDNA=SeqID_83442; Strand=+; Position=1 -327,541-942,1040-1135,1180-1341
MNLFKVIFIIPLFLFIISVFYKNAKAEKLKLRVIYGQLDANWKVQLDLMIVSHYHEYGNYHTKEMVHRNIENGKNFEVNLENGEQTEKLTLGFGFSIQLSSSRRSQFETLGNASDTESSDDASPFHQPTSIGTQLNAERFRKVVRVDLYRPNFAKRHRIELGNVEVPMPPNGTALFWNRRVIFEANKDTGNYHAFLYANVGKNGRSNRNSTKMFMGYAPLLRIGQHGEGGEAPTIAAAEQQHGTSEYQVTIPVKFGEFFKHKLWNLKVFIYQFKELPSAGQNRNATENDQNEEETCPICLDSLQLENRQIIKLHGKRTNYEANFFAIF

SEQ ID NO: 157020 - protein, 81 aa, Heterodera glycines
  Coding regions on vcDNA: vcDNA=SeqID_83443; Strand=+; Position=1-243
MYVNPTAQLFKMANSEGNDRFSHGQALHAFANIRRKMEQAERAVKRSLATMEVPLLMDKLFGETFFEVGFNGFGEKQSIEN

SEQ ID NO: 157021 - protein, 263 aa, Heterodera glycines
  Coding regions on vcDNA: vcDNA=SeqID_83444; Strand=+; Position=1 -450,1121-1462
MGSGENVASAKVRIDVRVVQNYMNISEEERNKIRNEACGNAKATKKVGVKITTKNHFTYYRRFIERKQSASFMNVRTLQGLAQNDCRALWITLRARSAAPESPFYDELLMRYLDDDLAIFASPRQLQLLKKSAVIVSDGTFKQAPKGIYQEVNHAEEESAVSIEEGRQPPSQQLAVTAEIDASIAREKADILAFLDSDYEDEQFTETMSRYYGRIGHLIGFNVPPRLEIEEQMEEAAAMEEAEASLNESGIYVVPNDENLDPC

SEQ ID NO: 157022 - protein, 60 aa, Heterodera glycines
  Coding regions on vcDNA: vcDNA=SeqID_83445; Strand=-; Position=1 -9,527-700
MVKMTASASRMAFSSDAARHTKATMSARPGDPNTAEHLSRVLKFAMVIMSILVIENCKRN

SEQ ID NO: 157023 - protein, 136 aa, Heterodera glycines
  Coding regions on vcDNA: vcDNA=SeqID_83446; Strand=-; Position=1-411
MAGNGNESMRTEVDENSVNFMNLFENLELTDSEKLASLREIEKIFADTSPPPAGPSPIESSVLGFVFISHPILWALVQPDILGEQNELLDRKNLSLESDQLVFQSTPSYVTTITLDPNNNWPHFTQISLIGINNLY

SEQ ID NO: 157024 - protein, 41 aa, Heterodera glycines
  Coding regions on vcDNA: vcDNA=SeqID_83447; Strand=-; Position=1 -66,213-272
MTGDDFLTILINLASVSSPNTFVNKFISLAHHFQLKVNHSF

SEQ ID NO: 157025 - protein, 75 aa, Heterodera glycines
  Coding regions on vcDNA: vcDNA=SeqID_83448; Strand=-; Position=1 -116,201-312
MNSEPWLMPEKSALFGSNALLSPMAYSWNKGQKIYTILRQNLCTLCQKELNQGDTLTKDPSPRKATPAHGARTLK

SEQ ID NO: 157026 - protein, 19 aa, Heterodera glycines
  Coding regions on vcDNA: vcDNA=SeqID_83449; Strand=-; Position=1-58
GLLGSWVRVPPGELPFMVY

SEQ ID NO: 157027 - protein, 132 aa, Heterodera glycines
  Coding regions on vcDNA: vcDNA=SeqID_83450; Strand=+; Position=1 -70,240-568
MLGPALFNIHFPLLSNVEFAKDIVPTNVLSKDEVLAVYQFKSIPNCHGISDGFFPMQFPTNERFMNTGTLLLDIEKVSEFGQEPEDSSRCSKKMYINGLSWKIRAEIRTKMESDDRKVGIYLLCDAPKEGAN

SEQ ID NO: 157028 - protein, 310 aa, Heterodera glycines
  Coding regions on vcDNA: vcDNA=SeqID_83451; Strand=-; Position=1 -76,141-286,340-661,721-866,1633-1875
  Homolog annotation: Hit_ID=AAQ74888.1; Match level="QueryCoverage =52%, HitCoverage=13%, E-value=6e-15, Identity=28%"; Hit description =UBP [Gallus gallus] ref|NP_989802.1| UBP [Gallus gallus]
MDFHGKLKQKLRKALMRRNIWDFTYGGPWNCVISATYRIVSEKTEAENSIGTLCDRVINRSNIGRGFGFFITFAELMDSNKSFYNKAEDKLALAIDVITVDEPKMEKFISDPNKSNGTLSMEIEKVSEFAREIIGSQRKSETVHIKGLPWKIWTQINPKIGSTDKNEKWLSIYLWCDAPKEAETWSCKCSATLRIVSLKSGVSDFGMEFDDHVIDNKENSWGFPNFISFAELMDQSNGFYNREEDRVTLAIDVTVKDDKKEKCISDPDKSNGIISMEIEKLSEFAREIDRSERKSESFTYINGLPWKILA

SEQ ID NO: 157029 - protein, 94 aa, Heterodera glycines
  Coding regions on vcDNA: vcDNA=SeqID_83452; Strand=-; Position=1 -136,272-420
MVIFVVFLKFHPLKLVPAHKLILKHASDVFEAMFRFDAKKEKAEFASADCPVEVPDVEAAAFKVMLSFIYTEELNELNGENAMAVLYAGGFNFM

SEQ ID NO: 157030 - protein, 19 aa, Heterodera glycines
  Coding regions on vcDNA: vcDNA=SeqID_83453; Strand=+; Position=1 -47,797-809
MKICLIKNKSCEKKQGAKL

SEQ ID NO: 157031 - protein, 19 aa, Heterodera glycines
  Coding regions on vcDNA: vcDNA=SeqID_83454; Strand=+; Position=1 -47,647-659
MKICLIKNKSCEKKQGAKL

SEQ ID NO: 157032 - protein, 150 aa, Heterodera glycines
  Coding regions on vcDNA: vcDNA=SeqID_83455; Strand=-; Position=1 -323,533-662
MPFPSLLAFCFASFVVVFAKVANPNNSSNFSLNEAAEAFGVQSSKNAPTRKSFMDILHSEVIKNGKHGEQQQQKQELEEMLSDVSEYEKVIETALGDNSAQVIAPNRRPAMSQEYEAIKALNENDKPMANLLHKLYNEITELKNSIDKGN

SEQ ID NO: 157033 - protein, 592 aa, Heterodera glycines
  Coding regions on vcDNA: vcDNA=SeqID_83456; Strand=-; Position=1-1779
  Homolog annotation: Hit_ID=CAE64508.1; Match level="QueryCoverage =99%, HitCoverage=96%, E-value=1e-115, Identity=40%"; Hit description= Hypothetical protein CBG09238 [Caenorhabditis briggsae]
MKKQKAKPEEKPEAPAEGVAVVPEAKKAEETKEKLKQEEKPMEVPPSPAEKKRKEAEEKKDQKCAEAKAKKDAEEKAKKDAEAKAKKDAEEKAQKDAEAKAKKDAEEKAKKDAEAKAKKDAEAKKKEEEMKKQKAKPEEKPEAPAEGVAVVPEAKKAEETKERLKQEEKPVEVPPSPAEKKRKEAEEKKAQKDAEAKAKKDAEEKAQKDAEAKAKKDAEEKAKKDAEAKAKKDAEEKAKKDAEAKAKKDAEAKPKKDAEAQAKKVAEDKAKKDAETKAKKDAEEKSKKDAEVKAMKDAEAKKNEEEMKKQKAKPEEKPEAPAEGVAVVPEAKKAEETKERLKQEEKPVEVPPSPAEKKRKEAEEKKAQKDAEAKAKKDAEAKKKEEEMKKQKAKPEEKPEAPAEGVAVVPEAKKAEETKERLKQEEKLDAEAKAKKDAEEKAKKDAEVKAKKDAEAKKKEEEMKKQKAKPEEKPEAPAEGVAVVPEAKKAEETKERLKQEEKPVEVPPSPAEKKRKEAEEKKAQKDAEAKAKKDAEEKAKKDAEAKAKKKDAEAKAKKDAEEKAKTDAEAKAKKDAEEKAKTDAEVKEMPRI

SEQ ID NO: 157034 - protein, 101 aa, Heterodera glycines
  Coding regions on vcDNA: vcDNA=SeqID_83457; Strand=+; Position=1-306
MKNEFKQKRKYSSKEWEQNYVEICKKIGVSDFTIMKWKKQFGICCKITEDEKMEKMKIYWEIKRENPKMSDNQIAKTLRISLNSIYNWKKQFGEEMAEEEE

SEQ ID NO: 157035 - protein, 93 aa, Heterodera glycines
  Coding regions on vcDNA: vcDNA=SeqID_83458; Strand=-; Position=1 -125,457-613
MIELLISGSTSGSAATTAATGNNKSKQYTNSSWTMIKPDEKRIDRRASDRSSTRPNGCCLATTPIGYDVFLSCSSSSELDWITQKAVPELQYA

SEQ ID NO: 157036 - protein, 155 aa, Heterodera glycines
  Coding regions on vcDNA: vcDNA=SeqID_83459; Strand=-; Position=1 -244,492-717
NLLEAILQRHSVLMLTSISQALDFVDAKIIGGKRWLHALLTPAQRVPFIKLQTQRCAMRCSERWHSVARLCRLRLLTHLKRFALLLMFEALIVMSFGFLLSTNTLPLAVPMWAIVLPLLALNYLLLLGLIIYCRFKVYCIILLEYCTGTGNTVIS

SEQ ID NO: 157037 - protein, 25 aa, Heterodera glycines
  Coding regions on vcDNA: vcDNA=SeqID_83460; Strand=+; Position=1 -3,148-222
MVFGKNPNPVHARSGPKLWDPDQEP

SEQ ID NO: 157038 - protein, 36 aa, Heterodera glycines
  Coding regions on vcDNA: vcDNA=SeqID_83461; Strand=+; Position=1 -51,116-175
MSSSRTNWQLLMVEEEEQEIAQTFTLISNNMMRTVT

SEQ ID NO: 157039 - protein, 42 aa, Heterodera glycines
  Coding regions on vcDNA: vcDNA=SeqID_83462; Strand=+; Position=1 -115,157-192
AWIYLQIIRKLKMQFFVGSKLPLAFLLLLLLSFVFSNAKNQK

SEQ ID NO: 157040 - protein, 55 aa, Heterodera glycines
  Coding regions on vcDNA: vcDNA=SeqID_83463; Strand=+; Position=1 -88,217-296
MAKAEKRAKPTQRGKFATAKCVGIRKGTRPKIDNLQKNAKIIQKENEEFGRRRTI

SEQ ID NO: 157041 - protein, 182 aa, Heterodera glycines
  Coding regions on vcDNA: vcDNA=SeqID_83464; Strand=-; Position=1-549
  Homolog annotation: Hit_ID=EAL47145.1; Match level="QueryCoverage =95%, HitCoverage=82%, E-value=7e-22, Identity=34%"; Hit description =transcription initiation factor TFIID, putative [Entamoeba histolytica HM-1:IMSS]
MQKLIIVNIIAFANLGTGIKLNSLTITECEFKYNPRKFNAAVIKCTTPIKAPALLWESGKMICLGTKSLIDCENAIKKFIEIIKGSGCPGASYTGHTVENIVSTFKFGHEIELNEFRKNRRAFYEPEIFCGLNFKRGKSMTALIFWTGKVVITGTKNNSGIDEMYHYILPYLKMAQKKLGRR

SEQ ID NO: 157042 - protein, 267 aa, Heterodera glycines
  Coding regions on vcDNA: vcDNA=SeqID_83465; Strand=+; Position=1-804
MKFAKKMLMIPEAEYLALRSAMNSGDYLQNEKASLDAKISQNLQEPGISEDLKAKRHDWLYKERRTVKGILENRPQKVVIENHVPGPNVAPYLGLNTQSKPQETDEPRKIIIPRKRLEEQTPDPESDNDTINELTPEPQTTSTLKTPIPIKTIIHPTLLNGLFRYVKENKDLFKITAAGKVQSNMNLPIENSNYRDVLLYLAGKKDETPRGAKFLKDRLLKDPTVKDMVDKSKVIWGRGRKKAIKSIKTPGIVREKKPFKPLIWARL

SEQ ID NO: 157043 - protein, 409 aa, Heterodera glycines
  Coding regions on vcDNA: vcDNA=SeqID_83466; Strand=+; Position=1 -331,359-1257
  Homolog annotation: Hit_ID=XP_320617.1; Match level="QueryCoverage =52%, HitCoverage=25%, E-value=3e-24, Identity=34%"; Hit description =ENSANGP00000024791 [Anopheles gambiae]
MSPVLLPAKLILQEVQNLNPKWDDELPANINKDWLKLMAQWLDRGEAITIEFPRHIQAIDSVEFHCFCDASKYGMGIAVYQKAKTIIRKDECNLIYAKSLVKPIKVAAHDALTLGVKAVKFIQAQIKFADHQVIMWTDSQCSVERLRENKRQDRFVANRLQKIREANFQVRHVRTDSNPADMASRGADPQCLRTSLLWRFGPIWLSKADKWPESNVIYRPRDEFKEVEKPPIVDIPEQPIQAVHSFIASVMDDSVSLAGSNDESQQPRPKKFKIPKRRSALLRPIGQQQSPLQGQHKRRKQLQDSGLRKLFQAISDQQGSSKATTKAIEESREMQKAPRHEQIEHEQRMVKKSQQEANRHLQPEKRQQKIQEVPHSTTEEQQRETKRQQIERQQNDEQHAINQQTRSKA

SEQ ID NO: 157044 - protein, 162 aa, Heterodera glycines
  Coding regions on vcDNA: vcDNA=SeqID_83467; Strand=-; Position=1-487
  Homolog annotation: Hit_ID=XP_318284.1; Match level="QueryCoverage =100%, HitCoverage=20%, E-value=2e-22, Identity=38%"; Hit description= ENSANGP00000021965 [Anopheles gambiae]
EDNKVLGIRWKPKHNRLIFKLPIFEGKITKRTILSQIAKVYDPLGLMSPVLLPAKLILQEVQNLNPKWDDELPANINKDWLKLMAQWLDRGEAITIEFPRHIQAIDSVEFHCFCDASKYGMGIAVYQKAKTIIRKDECNLIYAKSLVKPIKVAAHDGTIPKL

SEQ ID NO: 157045 - protein, 137 aa, Heterodera glycines
  Coding regions on vcDNA: vcDNA=SeqID_83468; Strand=-; Position=1 -72,188-576
  Homolog annotation: Hit_ID=CAE63953.1; Match level="QueryCoverage =75%, HitCoverage=18%, E-value=2e-09, Identity=39%"; Hit description =Hypothetical protein CBG08535 [Caenorhabditis briggsae]
SAQGQPIRQKKFAEVKTWHGGYISNFLNLFTERDKRTATKHSPYVQRYIDKVLALNRSLSQTTTPPAPTNPPQTTPPAPTNPPWTTTTNPTTATITKTRSTIWSTKTTTRPNAWTTTTTPMSRIMDYRTTTAAHSGN

SEQ ID NO: 157046 - protein, 805 aa, Heterodera glycines
  Coding regions on vcDNA: vcDNA=SeqID_83469; Strand=+; Position=1-2418
  Homolog annotation: Hit_ID=CAE56861.1; Match level="QueryCoverage =28%, HitCoverage=16%, E-value=2e-14, Identity=26%"; Hit description =Hypothetical protein CBG24691 [Caenorhabditis briggsae]
MLISLLCLLFTSSAQGQPIRQKKFAEVKTWHGGYISNFLNLFTERDKRTATKHSPYVQRYIDKVLALNRSLSQTTTPPAPTNPPQTTPPAPTNPPWTTTTNPTTATITKTRSTIWSTKTTTRPNAWTTTTTPMSRIMDYRTTTVYRSRPQQQPRPGIKLIRWPKSPITTEEGRDVFWCSNHGSTLWELKGPENSPFCRPPPALTAQWTPLTITLYTKIHRPEPIATAWHCFIKTTTENYYTNIVGDKFVEINKEFPLVSKRLCQRMAHQQECPLAKTEMHHVGNHIWATNDQLQVDFPGPITGLFKGKQTSSVTNCFAQPATLFVKWHSLQLLSPIHRADHCNYASEYCQLQDNSSLIWTSACPNDNCFMCDFQEAEEIHGEFTKLNGQTTAFWISDDRQKALTFTETHAVQACDGRQIVLSEQNFGIPKEQFDIIMSDHTRAKRNVQPEQLASQLSAAQLATTMALSQLYLKECQRNVSVSNPTLQARKLLKRENLQARWISETTIEVFPCVPISLSNISYRKTKDCYKFIPVTIHLPNTTQDAFLDPEMRILSLISRSASCSQFRYHHLQVQQKPNLWVRIDSKNGNVQRLAQTAIHELYETILNKTDNDLDLHPLIFHQWQLDNDTDFATFPHIDEFEDSEEFKNKLEQHTTQRAEALGALPGGIEGWTVRWLQERLQEIIQWWIRLASAYSTFLLCRDVILPCLIAYFLNPIRITLMTLIGFRPKKQPTPQIQAQHEDMPLKEMPSTPIRRKRRQLPEQSTPPIRLDTTTATASFRTRARAHSATEDTPFGRLRPMKLADD

SEQ ID NO: 157047 - protein, 502 aa, Heterodera glycines
  Coding regions on vcDNA: vcDNA=SeqID_83470; Strand=+; Position=1-1509
  Homolog annotation: Hit_ID=NP_001004509.1; Match level="QueryCoverage= 89%, HitCoverage=30%, E-value=2e-53, Identity=30%"; Hit description =si:busm1-180o5.3 [Danio rerio] emb|CAD60788.1| novel protein similar to DNA polymerases [Danio rerio]
MANGKTAQRIREDDARRMAFITSQAQQVLVFWECEINAEKRDNDEMKRAFAQYKDSGPIRLKDCYHGGRVGPQRLHYEVPEGWRMKYYDVRSLYPHTNAVTAYPVGHPTRVNIIGEAEQAVDWRRADQLPVRGILKVFVVPPHHVDVPVLPVKFNQRLLFPLCRMCALQHPHGAVNEDYECTHREDDERGWVSTVTSIELEEALRNGYRCTAYYRSVEWDDTRWSDRVFRGYVAEFMAMKTHASGFPDEIGTTEEDQQQFIEECEEKFGIRIEREKMVHNKAKRTIAKLCNNSLWGRFSLRNGLSKTIVTDSPAELRALLDNPAVEVSSVDPLTDECVLVTYAAGNEWVEEHECSNIVLSLWTTSVARLHLLRLMQKVACAPNSVLIYTDTDSVCFAHREADGCPLETGPHLGDLSDEWPDHELVEFVSGGCKQYALRMRHRHSGEEKTVLKVRGITLSADACQLLHFATSRGVSYATQCVIQMRMMMMMMMMMMTKTFVQF

SEQ ID NO: 157048 - protein, 317 aa, Heterodera glycines
  Coding regions on vcDNA: vcDNA=SeqID_83471; Strand=+; Position=1 -748,799-1003
  Homolog annotation: Hit_ID=NP_002448.1; Match level="QueryCoverage =75%, HitCoverage=7%, E-value=1e-12, Identity=26%"; Hit description =mucin 2 [Homo sapiens] gb|AAB95295.1| mucin [Homo sapiens] sp|Q02817|MUC2_HUMAN Mucin 2 precursor (Intesti
ISDKASPGSSPSRHQTPSSPTPPPTAETTQKAIAGSSASTSPAAPSAVDTTTVTAARPAARRRGFGGFAAGSTVPPPTIVQALPAPPATTDPTPHATTTAPAAVFAAASNAVQQNVLTPPGIFQPLPPPSLAPSLVMPKLHQQTSASMAQQSPGNTVALPLPASAPAADTTATVASPTTAITSMAPAEVPEKPVIAPQPPKKAKKEKRNILDRIGDKAHIGTFDASKPATFAPLDPHVAPRDPNAVDSDDEQGDTLAIGGPDSWYALALRDTGTVLKKDTGGTGKGKKQGKERDPNAPKRRRTKKPKLSSGPKARDK

SEQ ID NO: 157049 - protein, 87 aa, Heterodera glycines
  Coding regions on vcDNA: vcDNA=SeqID_83472; Strand=+; Position=1 -128,1826-1961
MRRCAVNNCLMGIAICDICTMSTYLVYILYFEVYAKVYETNIRKRKENGIGSDDGWATTGRTNWPNDGHPSVKVKKHQGKETYYCKN

SEQ ID NO: 157050 - protein, 76 aa, Heterodera glycines
  Coding regions on vcDNA: vcDNA=SeqID_83473; Strand=-; Position=1-229
MPKLSSFGLCCLSNKNETDNVKFLTHGGDKSCGGEDIYKLSIKTEFFGISKTDSGFSGMENEEKKQQQNEKQMEHP

SEQ ID NO: 157051 - protein, 302 aa, Heterodera glycines
  misc_feature (105)..(105): Xaa can be any naturally occurring amino acid
  Coding regions on vcDNA: vcDNA=SeqID_83474; Strand=+; Position=1 -30,1786-2080,2169-2314,2367-2776
  Homolog annotation: Hit_ID=NP_506047.2; Match level="QueryCoverage =98%, HitCoverage=20%, E-value=1e-67, Identity=46%"; Hit description =abnormal CHEmotaxis CHE-11, putative protein, with a coiled coil-4 domain, of eukaryotic origin (che-11)
HFEVAIDSNTIFERLFVWEAENDSVGYFSFHEGITDQQKYEADSMGVNGESGTAARPKTAAIRKIESEQSRFRMPNHLPGNHFWDQMDPRLLICEANSVGTGDKXKKRLTIFVTAEHGLQMHDLHKKPPKADSLLFVSVPHLFFLRNIEVEEEDDPQERCLSRLILERCLSRLILRRTMREFVGIDPREEKAVRAMLDFAFFLCIGQMDSAFKAIKFIKSESVWEHMARMCIKTRRVDVARVCLGQMGNARAARAIRRTVESGEGTEEQIAHLAVELGMAEEAIGLFQKKEGWDEVNRLLQA

SEQ ID NO: 157052 - protein, 246 aa, Heterodera glycines
  Coding regions on vcDNA: vcDNA=SeqID_83475; Strand=-; Position=1-742
  Homolog annotation: Hit_ID=BAD46471.1; Match level="QueryCoverage =82%, HitCoverage=18%, E-value=7e-10, Identity=25%"; Hit description =hypothetical protein [Oryza sativa (japonica cultivar-group)]
NQGLFVELCNSIRDTVIPEIPDTPTPDQWNYNGNLANTTDRCYSNQGLFVELCNSIRDTVIPEIPDTPTPDKWNYDGNLANTTDRCYSNQGLFVELCNSIRDTVIPEIPDTPTPNQWNYNGNLANTTDRCYSNQGLFVELCNSIRDTVIPEIPDTPTPDKWNYDGNLANTTDRCYSNQGLFVELCNSIRDTVIPEIPDTPTPDQWNYNGNLANTTDRCYSNQGLFVELCNSIRDTVIPRDTGHSNA

SEQ ID NO: 157053 - protein, 176 aa, Heterodera glycines
  Coding regions on vcDNA: vcDNA=SeqID_83476; Strand=+; Position=1 -80,137-334,629-778,1282-1358
  Homolog annotation: Hit_ID=CAE71617.1; Match level="QueryCoverage =100%, HitCoverage=5%, E-value=2e-59, Identity=59%"; Hit description =Hypothetical protein CBG18580 [Caenorhabditis briggsae]
YDSVICANQYGVSAAHYSNQTTLDGTLNFRYSTELNFRYSTEKLWFQRVNFTHNSEAVIWVHSPDHAVLDGTQFAEIGWHIDNCSIVENQGPILDTHRDLFASANVFHWNFWSNTFANNSNGGVQVHLPDPWDLQNRRHHSFWMTENRFERNYDFMVQLSGYFTFANISSNNFTDN

SEQ ID NO: 157054 - protein, 24 aa, Heterodera glycines
  Coding regions on vcDNA: vcDNA=SeqID_83477; Strand=-; Position=1 -37,660-697
MRNNKIISASYKYITHQKSDHKST

SEQ ID NO: 157055 - protein, 20 aa, Heterodera glycines
  Coding regions on vcDNA: vcDNA=SeqID_83478; Strand=-; Position=1 -30,318-350
MLKDKFAISLNLFLQNFNIY

SEQ ID NO: 157056 - protein, 66 aa, Heterodera glycines
  Coding regions on vcDNA: vcDNA=SeqID_83479; Strand=-; Position=1 -6,474-668
MKARKIVAFADLESICINLCKIHFSDFVRVHYESTFNSIRDDMAMLVREQQNRETKLMGHLRNVRK

SEQ ID NO: 157057 - protein, 185 aa, Heterodera glycines
  Coding regions on vcDNA: vcDNA=SeqID_83480; Strand=+; Position=1 -49,104-331,622-899
MQLIILISTTAERSAAVDGFYWPTTTKTTAAENSNNNFWANNYNNNNNNNNDFNVGDQQQQQQFGAVQQPASGGGGGKENGDKEGDRETGLCYSSFNTLSSLLFASAGLGTVPAASAVVAPGAPIGIVPLSRGVGGGTDLSPIFGNFDRNGRNNFNFGGATGAEETTDDTGEQFTPFPTLIPADK

SEQ ID NO: 157058 - protein, 129 aa, Heterodera glycines
  Coding regions on vcDNA: vcDNA=SeqID_83481; Strand=+; Position=1 -149,390-628
MSSASMVGGAGSFYVGDGDGGAYEYPLVDETDAFGGAPGRRHQQGQTFGGYMRGSAEMRGGQMPSPSYPNFGGFGGGGGRGGAYGGGGREESPEEWEDEMVGGGEGGTEMGQIERGGGMPFWMGGTMAA

SEQ ID NO: 157059 - protein, 167 aa, Heterodera glycines
  Coding regions on vcDNA: vcDNA=SeqID_83482; Strand=-; Position=1 -141,220-502,614-693
  Homolog annotation: Hit_ID=AAH08592.1; Match level="QueryCoverage =61%, HitCoverage=9%, E-value=3e-09, Identity=41%"; Hit description =2810406C15Rik protein [Mus musculus]
MCTHLLLKDQLKVSACVADIAYSLKRDANPPQIVTVATGLFCELSKKHNALYNNVPAIIDRLLTNEEALEPDGEAQVEEILQFLLQLVDNDQQKREKLVDKLVERHGDRLAGWRCVTQVLKAKEAAAEREQQQIQLQQQQQAAAQKAGSSRAGGSRGRPTGKTPKRC

SEQ ID NO: 157060 - protein, 51 aa, Heterodera glycines
  Coding regions on vcDNA: vcDNA=SeqID_83483; Strand=-; Position=1-155
PSLNRIQNDFERTCNFVGRLIFSKRLPFGQQMNSLVKMLASLKQPFGINYF

SEQ ID NO: 157061 - protein, 39 aa, Heterodera glycines
  Coding regions on vcDNA: vcDNA=SeqID_83484; Strand=-; Position=1-117
MLRNSVLFVFTEILLHCFDCQQLDQTMSDQRDMLFAHLL

SEQ ID NO: 157062 - protein, 85 aa, Heterodera glycines
  Coding regions on vcDNA: vcDNA=SeqID_83485; Strand=-; Position=1 -67,133-174,1686-1834
MRFTSVFCLFFAMALGLIQLDRANGMDVDVCEKKEDCQTMKITKNKLEEDADNLDNYLNSSQSGQLAAKIKEAISAINGILDEYG

SEQ ID NO: 157063 - protein, 78 aa, Heterodera glycines
  Coding regions on vcDNA: vcDNA=SeqID_83486; Strand=-; Position=1 -23,527-740
MHLFAKAFKNLGSESEETLCQQYHEYAPPDPAPPTSGQYVNLAGGDGPTKRRRPMAQKPMAKCGNKLMKSVFYFPIVK

SEQ ID NO: 157064 - protein, 494 aa, Heterodera glycines
  misc_feature (491)..(491): Xaa can be any naturally occurring amino acid
  Coding regions on vcDNA: vcDNA=SeqID_83487; Strand=-; Position=1 -155,204-270,313-388,500-566,615-725,767-818,878-959,1004-1104,1146 -1268,1309-1409,1461-1608
  Homolog annotation: Hit_ID=CAE71845.1; Match level="QueryCoverage =95%, HitCoverage=56%, E-value=1e-147, Identity=63%"; Hit description= Hypothetical protein CBG18887 [Caenorhabditis briggsae]
IMFSWLGKNTTKKKDQDVLETVSEGLKKIYKQKLYPLEDFYRFHEFHSPALDDPDFNAKPMILLDPDFNAKPMILLVGQYSTGKTTFIRYLLEQNFPGIRIGFIRYLLEQNFPGIRIGPEPTTDRFIVVMYGEEEAVIPGNALVVDSTKQFRALTKFGNAFLNRFQCSMLKFGNAFLNRFQCSMLKNEVLNGVTIIDTPGILSGEKQRIDRGYDFSGVLEWFAERQRIDRGYDFSGVLEWFAERVDRIILLFVDRIILLFDAHKLDISDEFKRCIEALSGNEDKINEDKIRIVLNKSDMVDHQQLMRVYGALMWSLGKVFKTPEVARVYIGTFWDHPVFKTPEVARVYIGTFWDHPLHYDINRRLFQDEQHDLFVDLQSLPRNAVLRKLNDLIKRARLAKVHLQSLPRNAVLRKLNDLIKRARLAKVHAFIIAELRKQMPMIGKEKKKEMPMIGKEKKKELIQKLDKIFEQLQVVGRLIYFNINLLPLKSXKPL

SEQ ID NO: 157065 - protein, 42 aa, Heterodera glycines
  Coding regions on vcDNA: vcDNA=SeqID_83488; Strand=+; Position=1-129
DITFVFHQKSHDGETNRSNSPPADNGKGRRDGAEEEDRESEG

SEQ ID NO: 157066 - protein, 346 aa, Heterodera glycines
  Coding regions on vcDNA: vcDNA=SeqID_83489; Strand=-; Position=1 -217,259-317,639-770,816-971,1129-1214,1378-1690,1740-1817
MALLRSHLKNHHQPKLKELEEKDKAAESLKNKEANPRQPTLKRIFATSSPVIKKIARAESANSSQLTIEKTFSQWTPDGEMTKKIDKAINDLTLNAYQITDKKLHLILRDDEGAMKLATNLLGYNSMQCFAHKIQLAVGDGLKLLGGIFDVKERMKKAIRRIRKSRIIADDFKALQIENDLPLKTLQKYRVDNDENVMQNTPTNLTRNNAHSESEKRIDWERNKDLLLATILDPAYKVQYFDHIYMEIFKDMLLQEVERVAISGIDEQQETTDGTTNLEFTEENDDPFKAFLIEQSTSNFVFRSIPSPTPSLIDTKAKAAGQVADYLNSALFEGTSAVFWRQPTIW

SEQ ID NO: 157067 - protein, 135 aa, Heterodera glycines
  Coding regions on vcDNA: vcDNA=SeqID_83490; Strand=+; Position=1-653
MVSKVNFWVKLKMYVCVFKTLNAYQITDKKLHLILRDDEGAMKLATNLLGYNSMQCFAHKIQLVNKIHLILCIFGYFKAVGDGLKLLGGIFDVKERMKKAIRRIRKSRIIADDFKALQIENDLPLKTLQKVIKFK

SEQ ID NO: 157068 - protein, 308 aa, Heterodera glycines
  Coding regions on vcDNA: vcDNA=SeqID_83491; Strand=+; Position=1 -108,167-229,517-627,760-880,993-1087,1136-1271,1325-1461
  Homolog annotation: Hit_ID=CAE59544.1; Match level="QueryCoverage =100%, HitCoverage=63%, E-value=1e-80, Identity=43%"; Hit description= Hypothetical protein CBG02940 [Caenorhabditis briggsae]
LTSFIDGSAIYGSTQCEAAALRAFEGGRLNTTNLGSSEALPQGDQEQDCRGKVGKGSEALPQGDQEQDCRGKVGKGLFPCFLAGDERNSHQPGLTSMHNVFLREHNRIARQLQKMNSAWNDEKLYQETRRIIGAIFQHIVFREYLPKLIGQREVDRHDLAPLSAGYFARYDPTCDASISHPFATAAFRFGHTLIRQMFPRLNPAFRFGHTLIRQMFPRLNPSNFANFTDPVDLVEHFNNMESVYDQRRGGIDTILMGLLGARAGIDTILMGLLGARAMAFDRHITDAVRNHLFGFRGQPLSGLDLIAL

SEQ ID NO: 157069 - protein, 58 aa, Heterodera glycines
  Coding regions on vcDNA: vcDNA=SeqID_83492; Strand=+; Position=1 -33,131-274
MRLEQLEEIRKNVKSLSKIQPDVFSVPDLLANSQIPCADFPRMNLAKWMERRLAPFEL

SEQ ID NO: 157070 - protein, 81 aa, Heterodera glycines
  Coding regions on vcDNA: vcDNA=SeqID_83493; Strand=-; Position=1 -119,168-294
MEAQNVRIKLEAELRTAQLGMVQQSRRIMNLYEGLVGQLKILLRKLQTPGESTETKRQQANDLIKRIEGTKLVSAEAPMIN

SEQ ID NO: 157071 - protein, 75 aa, Heterodera glycines
  Coding regions on vcDNA: vcDNA=SeqID_83494; Strand=-; Position=1 -19,215-331,491-582
MTNKLIRNKCRFNHGLNPIVVDDSERFKVPATVNPNPPPPGMEEKAKTTSFVDLLLTPAVGRETVTDRPMFVPFY

SEQ ID NO: 157072 - protein, 37 aa, Heterodera glycines
  Coding regions on vcDNA: vcDNA=SeqID_83495; Strand=+; Position=1-111
MQIDRYYEDYASITVNQAVNDINAMDQDGRFAESEDC

SEQ ID NO: 157073 - protein, 150 aa, Heterodera glycines
  Coding regions on vcDNA: vcDNA=SeqID_83496; Strand=+; Position=1 -108,812-1156
  Homolog annotation: Hit_ID=CAE74540.1; Match level="QueryCoverage =86%, HitCoverage=3%, E-value=1e-14, Identity=34%"; Hit description =Hypothetical protein CBG22297 [Caenorhabditis briggsae]
MHPDHKQQQDEKKTAAATGDSNSRYHQGWAALPEYNPPFICVDASFQRHLHRHSNKILNRIQQLHFLHTIIVTSTPTSATPTESKEAGAELSHKDDKKESAKVAANNSSSSSGYELKVELPDALDKWQIMPNWDRDCDRDLLIGVHKHGK

SEQ ID NO: 157074 - protein, 54 aa, Heterodera glycines; identical to SEQ ID NO: 127631
  Coding regions on vcDNA: vcDNA=SeqID_83497; Strand=+; Position=1 -116,1139-1187

SEQ ID NO: 157075 - protein, 190 aa, Heterodera glycines
  misc_feature (5)..(5): Xaa can be any naturally occurring amino acid
  misc_feature (14)..(14): Xaa can be any naturally occurring amino acid
  Coding regions on vcDNA: vcDNA=SeqID_83498; Strand=-; Position=1 -73,324-421,476-499,731-769,974-1052,1160-1194,2407-2604
  Homolog annotation: Hit_ID=AAB51667.1; Match level="QueryCoverage =87%, HitCoverage=30%, E-value=3e-57, Identity=62%"; Hit description =acetylcholine receptor alpha subunit precursor [Haemonchus contortus]
GNKFXILKSFAKFXHELDQIMTIPVWLKQSWTDRKLAWDPDDYGGVSVLYVPYEMIWVPDIVLINVPDIVLINNAKGTFNITIDTKATLHPNGRVVWEPPAIYKSLCQAKTFWFPFDEQNCLLKFGSWTYPSGLLHLSLMDAVNETQMEVTNERGELEQLALVEDGIDLDDYYPSVEWDIMYGILFWHSD

SEQ ID NO: 157076 - protein, 269 aa, Heterodera glycines
  Coding regions on vcDNA: vcDNA=SeqID_83499; Strand=-; Position=1 -65,430-537,1052-1151,1291-1448,1509-1614,1667-1738,1939-2071,2121 -2185
  Homolog annotation: Hit_ID=CAE63596.1; Match level="QueryCoverage =80%, HitCoverage=41%, E-value=1e-61, Identity=54%"; Hit description =Hypothetical protein CBG08087 [Caenorhabditis briggsae]
MAIHPHFWPGVVVRPLGGRLDGKLSEWQGRRNALIINGFVNVFAALLEYLSKSMASPDEHAKAMEDLKKLVDEDEAEFMYESLQSEAALMQDGSCCTFRQIFFERQFRLPLLITIVVMVTQQFTGCSAVFAYSTDMFIDAGLDPRTARFSTLAVGVAYFLFACSAPILIEQVGRRILLIGQLAMCSVSLFFLSIFVALQHAVWQNFASYATIAALIVYMCAYGVGCAIPWLISSEIFPTKFRAAAVTVAVTVAWSLSFVVSTCYLPFQQ

SEQ ID NO: 157077 - protein, 48 aa, Heterodera glycines
  Coding regions on vcDNA: vcDNA=SeqID_83500; Strand=+; Position=1 -92,333-384
MAPMAMLETTKDQYRFISVRFSPGPPPFLRIIKDQQTISQNIWGEKRK

SEQ ID NO: 157078 - protein, 34 aa, Heterodera glycines
  Coding regions on vcDNA: vcDNA=SeqID_83501; Strand=+; Position=1 -71,251-284
MTYENGKVSKVRFDSFVLFNSQKSVVVFCIIFIY

SEQ ID NO: 157079 - protein, 113 aa, Heterodera glycines
  Coding regions on vcDNA: vcDNA=SeqID_83502; Strand=-; Position=1 -111,183-413
  Homolog annotation: Hit_ID=CAE59405.1; Match level="QueryCoverage =67%, HitCoverage=16%, E-value=3e-13, Identity=50%"; Hit description =Hypothetical protein CBG02769 [Caenorhabditis briggsae]
MVCPSFALRPPIFFSPLLPTQNGTWKQANCWALHSRHSTASTDLIANTLADQLRAFMSDFGCPNGLAKMGFDRRDTDSLANAALNSFRSNPISPRETNFDSIASIYEQSLNVY

SEQ ID NO: 157080 - protein, 108 aa, Heterodera glycines
  Coding regions on vcDNA: vcDNA=SeqID_83503; Strand=-; Position=1 -149,199-274,784-884
  Homolog annotation: Hit_ID=CAE59405.1; Match level="QueryCoverage =87%, HitCoverage=20%, E-value=2e-40, Identity=78%"; Hit description =Hypothetical protein CBG02769 [Caenorhabditis briggsae]
MTYWHFGLIILPGAAIIDIPEKQCKAGIRLRCIKPFLAIIDPLNVKSMPRNVAVYSGFDVLCHALESYTAKPYKMRSPRPLRPDARPLYQGSNPVSDVWVREALRVIE

SEQ ID NO: 157081 - protein, 111 aa, Heterodera glycines
  Coding regions on vcDNA: vcDNA=SeqID_83504; Strand=-; Position=1 -172,277-440
  Homolog annotation: Hit_ID=NP_496764.1; Match level="QueryCoverage =72%, HitCoverage=16%, E-value=5e-12, Identity=49%"; Hit description =alcohol dehydrogenase 8 (50.5 kD) (2N286) [Caenorhabditis elegans] emb|CAA21631.2| Hypothetical protein Y
MASIANSTKLTIGSFKTVPLMISPFVTRFGVGGFCAPNLAIANLTVRKSFASCAFPPAECEDVDYAFEMMSSTLRCGNGVTSEIGFDVQNLGSKNALIVTDKNVTKTRAFK

SEQ ID NO: 157082 - protein, 22 aa, Heterodera glycines
  Coding regions on vcDNA: vcDNA=SeqID_83505; Strand=+; Position=1-66
MNFLCFYFCVLFTFLVFMVFYE

SEQ ID NO: 157083 - protein, 325 aa, Heterodera glycines
  Coding regions on vcDNA: vcDNA=SeqID_83506; Strand=-; Position=1 -201,306-524,577-1134
MLRKIFVYFLILIITFLGQIAMKNEAFSITYAGEVTPPGNYKIVIWDEISKNTAAKCYFILKNITTKAYKFNYITQRYAVKEIKVPFFKYENGIVLENLSDCFVHFYTIQTNGDGEFEIKMSSNVQDLINVHIFPLDKQVNLISSTNESGTILQNKMKREKWKHLYGHKEVLFMFHFLEYQQRVNEWLDNWLIQNAVPTEEEAFFIKAFFRYVTEIFVERFTKLSTIYRNQLNVLGYYGTTLLNYLLTNGEMNLAQKLAQINGMPNLVKYFCQFLGYGLMKDADPSENDIKIELPAEWKIFCKKYMDKNVRAKSLFISEFRAETE

SEQ ID NO: 157084 - protein, 197 aa, Heterodera glycines
  Coding regions on vcDNA: vcDNA=SeqID_83507; Strand=-; Position=1 -264,294-619,708-713
  Homolog annotation: Hit_ID=XP_522969.1; Match level="QueryCoverage =99%, HitCoverage=87%, E-value=5e-25, Identity=34%"; Hit description =PREDICTED: similar to putative protein family member (XC187) [Pan troglodytes]
IRRGTTVIRRGTTVIRRGTTVIRIGTKVIKRGTTVIKRGTKVIRRSTKAIRKGTTVIKRGTKVIRRGTTVIRRGTKVIKRGTTVIKRVIRRGTKVIRRGTTVIRRGTKVIRRSTKAIRKGTTVIKRSTKAIRKGTTVIRRGTKVIKRGTTVIRKGTTVIKRGTKVIRRGTTVIRRGTKVIKRGTTVIKRGTKVIRKN

SEQ ID NO: 157085 - protein, 276 aa, Heterodera glycines
  Coding regions on vcDNA: vcDNA=SeqID_83508; Strand=-; Position=1 -64,377-672,707-1177
  Homolog annotation: Hit_ID=NP_608540.1; Match level="QueryCoverage =98%, HitCoverage=59%, E-value=2e-21, Identity=32%"; Hit description =CG2839-PA [Drosophila melanogaster] gb|AAF51469.2| CG2839-PA [Drosophila melanogaster]
MPKKKESEKEIKRRQATRWSSGLDESGYLGKTGSGYFRVQQSRVRVQVFKPGTGGTESGRGTESGKEQKVEEKVEEEQKWKRNRTWKRNRTWKRKCKRNRKWKRKWKRNRKRKRRRGTESRKRRRGTESGRETESGRETESGRGTESGRESGRGTESGRGTESGRGPESGRETERGRESVSGTESGRESGRGTESGRESGRGTENGRESVRGTESGRESGRGTESGREEEEQKVEEKQKVEEKQKVEEKVEEEQKVEEKVEEEQNVEEKQNVEEKV

SEQ ID NO: 157086 - protein, 43 aa, Heterodera glycines
  Coding regions on vcDNA: vcDNA=SeqID_83509; Strand=+; Position=1-377
VKHPISALLCREPVCNGWLSICKKLDWQYVVVKNFWVMNYFLK

SEQ ID NO: 157087 - protein, 22 aa, Heterodera glycines
  Coding regions on vcDNA: vcDNA=SeqID_83510; Strand=+; Position=1 -56,335-347
MVLVLEKHFGILLLCRRRELQN

SEQ ID NO: 157088 - protein, 225 aa, Heterodera glycines
  Coding regions on vcDNA: vcDNA=SeqID_83511; Strand=+; Position=1 -78,431-622,937-1194,1295-1444
  Homolog annotation: Hit_ID=CAE73768.1; Match level="QueryCoverage =82%, HitCoverage=39%, E-value=4e-34, Identity=40%"; Hit description =Hypothetical protein CBG21312 [Caenorhabditis briggsae]
MEEGQMETGENAAVKLVDQKKSAKKKADRAKDNELLVLRLSNLHANEKTLENAKKMAQGKGDESESSSSEDDEEEEETEGGAKSARMHAACQTIGASNVCAVWNDQQKVQLWNLDPAIETVKSIGTESPSKVQKMEKDAVKQNLLFTFAGHSAEGFALAWSPIRLGTLASGDLRNKIFLWRMSEGGQWLVDQRPLAEHQSSVEDLGNSPSVAKQKNSFIPLFLLI

SEQ ID NO: 157089 - protein, 29 aa, Heterodera glycines
  Coding regions on vcDNA: vcDNA=SeqID_83512; Strand=-; Position=1-91
EVKEVHWHKQCPGLAFSTALDGFHVFKTI

SEQ ID NO: 157090 - protein, 132 aa, Heterodera glycines
  Coding regions on vcDNA: vcDNA=SeqID_83513; Strand=-; Position=1 -85,133-446
MSWLKIIEEEEERARELQNDQMELEQVKDNIELPKHPQPQNKCSCNEKQKSVPLIDFLCKHYKCSMNELHVLLQTLSKRREISEMLRSNLHLRTNHLRPAWKNIRVHCNELTIHPAQTAYAMRGYLGITVCL

SEQ ID NO: 157091 - protein, 229 aa, Heterodera glycines
  Coding regions on vcDNA: vcDNA=SeqID_83514; Strand=+; Position=1-690
MADNFQKFDEKHLQLRHPFTLTISGSTGSGKSEWVLRMLRNVNALVSEPISEIFYCYGELNPNIIQLQKSGHIGGCRVIVHAGSPTEEQVNRRAKECDGKLLMVLDDLMVGLGQQFLDTVFTRGSHNWGVSVVLVTQHLFAKELRVARNNSHYLVLMRNPAGALQVRTLASQLFPTKSNYFTEAYRDATEKQFGYLLIDMQPESPELLRLKTNIYGEQGGLPPLVYVAK

SEQ ID NO: 157092 - protein, 302 aa, Heterodera glycines
  Coding regions on vcDNA: vcDNA=SeqID_83515; Strand=+; Position=1-908
MRHAMRMFLVPEDVFQSVFVQPQAAAAESDGADGTPIGLLRSRIQQIERSRELNEEQKAAQYHQEFKRLNKLVREQEEQPINVRLQHEKEKEKNSATPPPPPPQTIDHSTPKRLEKNIVPSAFGLRRQRHHYTQKAGALSNRRPAQKQQRKAAAAAETPNSSGNGETEKEEGDVDDGEQWDDAQSSSSTASTGGAAAKRVLRARDGEAGKGGGGETADRLQTKHNYQMTKNALITHIRKKGHSLGVSDQGKVLRADGSEFKTSNVEAIVSHLLNRDKRSEFKGPPVGYKEFAEKAREDPLLK

SEQ ID NO: 157093 - protein, 255 aa, Heterodera glycines
  Coding regions on vcDNA: vcDNA=SeqID_83516; Strand=-; Position=1 -47,97-372,434-878
  Homolog annotation: Hit_ID=AAL78214.1; Match level="QueryCoverage =59%, HitCoverage=80%, E-value=2e-13, Identity=32%"; Hit description =putative esophageal gland cell protein Hgg-20 [Heterodera glycines]
MSDNPKEANKEMEKAIFIAADCWLEVFDLLPPSQLGLGIAMISHRFDYFVDEHFKTRKWKLGKMKIRRKIGQNGANEMKIVNSDGKELPIPQNPLPNKVIGFGSIFILFIDQNVLTFLGHFHRFFAICATSLTIGTENVRISEFLLLTIWPMLKHTIRDMILNPITLRQIRQLVPSMLNDCPALRIVGLAGVGILPEFPPDDSANASDGQAVAKWLFSPRPDNLMKVLYVRIENSAVDQWLSMVERIKAVLLIDY

SEQ ID NO: 157094 - protein, 193 aa, Heterodera glycines
  Coding regions on vcDNA: vcDNA=SeqID_83517; Strand=+; Position=1 -283,341-639
MTLYSSVIFLLPVQFLLVVIGAVFIILSQCCGGGSKKKKVPVFDPSLFTNETLPFFQKAGAAPTPTPSISASVGSEAPSSLKTQEKSASASSKTAPPAKKGAVAQKKGPTEAKAGKATDEKTVTTKKKEKSSKSAKGKPTSKPKPERTEPSVKEDSKPVAAEKGVEVPHSMMSKGDSVVDEEDEVGYTTTTDV

SEQ ID NO: 157095 - protein, 250 aa, Heterodera glycines
  Coding regions on vcDNA: vcDNA=SeqID_83518; Strand=+; Position=1-751
MPKKYKKAKKDKVGPALPPAPPPSVEPPAAAIQYEDLTSDEDLDSKDAGGTATSHLVDQQMESLLALSPENSGVLLALSPDSVDRLLEDQNAGEVKQNPEKIMKIIVKSVPITAESNEKALESTVLNEEDEFVQANSGENDKTNLEIVKIVSPLETMGALIGVISQKDDESVEKGPQGSSEKANAGEMEVEGNEKALGSSVLSVEVQMDPKPMANSDQVENENEKADKGENEQFSKENSRESDEEENFGG

SEQ ID NO: 157096 - protein, 157 aa, Heterodera glycines
  Coding regions on vcDNA: vcDNA=SeqID_83519; Strand=+; Position=1 -263,315-465,519-578
MAKEKISTKKRTLRLTTPLAKERLQRLRFEPFPDQYDLIGLSKKIYDALRGAFFTDLPHVKVVTFKLLDASAPASKEIWALSSWDKIPIVIEIHPEQGDCEQLVAMLAHEMCHGVTSKESRENRPYSAKEKAERFDQWAKLVHQTLGIDPWRKCDKP

SEQ ID NO: 157097 - protein, 706 aa, Heterodera glycines
  Coding regions on vcDNA: vcDNA=SeqID_83520; Strand=-; Position=1 -212,399-1542,1628-2392
  Homolog annotation: Hit_ID=DAA04499.1; Match level="QueryCoverage =76%, HitCoverage=38%, E-value=7e-40, Identity=24%"; Hit description =TPA: pol polyprotein [Schistosoma mansoni]
MNFLGFTLTNAGYKPSLSRIEIVQNEPIPRNVKEVKRFLGKAGFYRRHIENFSTIAEPLLSLSRQSVKFECRTLSAPERRWPAVQIEMCAIIYDLREFRPFIFMSDIELHTDHKPLAFLLKKSETHPHLARWLIELQNYQIKIVHVAGKQNSLADALSRAAEDSPIQEIENLSEMEDIIEFPVCLSLRAHPRLVLDEFVNTMTLRHEDGNSYQIDLSKEQKNDPEILAFIEFLTNGNMPPDFSENEKDRFSALCLNLVYESEVLYFKTPSSSTRIFVPISLRALIFESFHTSPLGGGHMNIKKTLRKCKKYFWPKMHSDIVSWTRQCITCQLRHNPTPAYRAEMQLAPSNTLFAKVGLDLAGPFPTTSRGNKHILNIICWFSKYVISVPIPDAKAKTIAKAFLSNCYLKFGGCTELISDNATAFTSEFFKEFCSMLYINKTYAIPHWSQGNATLHPFVITLLVIHPHPNPRFFLVFGRDPIFCVDQILDARIHSQVQQAEETDFKQKLVSSLRKAWKSAADANEAAQQKIKEQYDRTVRQPQICVGDRVLLRNYAGKVGTSKKFHLPWKGIFRVIEIDGIYATIVSCISPQQNPKRVHLNQIKKCFENFGPNCTLPKLPIDEEESLDKMHATNLDNFPGHNHFPRTNRQPSKNPEQENDSQNLAEKTDCQEEDGNNSLDESIKPKKRPEYALRDRKRLNLPSRFRE

SEQ ID NO: 157098 - protein, 893 aa, Heterodera glycines
  Coding regions on vcDNA: vcDNA=SeqID_83521; Strand=-; Position=1-2680
  Homolog annotation: Hit_ID=CAE61412.1; Match level="QueryCoverage =25%, HitCoverage=27%, E-value=2e-22, Identity=25%"; Hit description =Hypothetical protein CBG05276 [Caenorhabditis briggsae]
MAGEVNTNMGVLNAKIDTLAEIVKPKITPNQTSHVRFNSCNNANLSQDNEEYLDPFAEDSFELGRVNTLTGMIGHLEVFGEDSVIAFDEWAEWFTDYVGAVGRNWNEDEKVARFKMSLIGTPRQLFKQLIQAEAAALNSAITGIRQKLDSPQRRQLTKRTLALCKQRENETVSEFLKRLTPLVEMTNPTLNDNQRKERTCEEFLDRIKPNIGFLLRLVGLNSTKDLDRIKAQAEELEALLLTEKGQISDNLAHTVHALSGQRFGNRQTEQNRESNYRGPPFVSEANATPLNDRFAPRNFDNNNRNNNGNNNNRTQFRRNQRPNDRRPNSQQIQSQRRWSNRPICNFCGKLGHIANFCRNRRSQFINNRPDPQPNRGRNGRNANYGTVNSVDAIPSNVSVLDSDQLYQQPLGNSVKREDANALNAITTVKSKPKIEPKGVMNDSENCEIPVIDSKNIKPPSPQLKASSWEGIGPKLTKFLMLLFFIVIIKCVPVSVEASFDVPIPKNPMMCQTQIEGTVWSLPSPTQCPTPLFNQPKGSRKQTIWLYKPNAFQYEVEAWACRKVRKNIQKHTSLTNIPIIEKLDSEMLSMDREECQQMINHQKCSFGTLKQEGELFHTDNKIDMSPRVWLFGSFSWMKASSENCYLFKTRIINKFGSPSIQNSIGDSNHCSFEKGQCFLEDKTLLLWNSSISKKCEYLPLGPFKGQMLGTIFIADNDPILLTFEEKPKIIKACNTNLTLSHQGYAFINKTTKRKRTRRAQESIVTDSQLQTELSYLSWQMTEALRFSFVQAFFAICEHIHEMKLWALSSALSEPTILARILFNTSLVYAKNLGPGIIKVWPCVELKKDDFNFVPLGDASQENKCFENVPIAFKSDGVEHMAFIAARNMEVVAHS

SEQ ID NO: 157099 - protein, 214 aa, Heterodera glycines
  Coding regions on vcDNA: vcDNA=SeqID_83522; Strand=+; Position=1-644
  Homolog annotation: Hit_ID=CAE56152.1; Match level="QueryCoverage =89%, HitCoverage=23%, E-value=2e-20, Identity=25%"; Hit description =Hypothetical protein CBG23765 [Caenorhabditis briggsae]
PTQCPTPLFNQPKGSRKQTIWLYKPNAFQYEVEAWACRKVRKNIQKHTSLTNIPIIEKLDSEMLSMDREECQQMINHQKCSFGTLKQEGELFHTDNKIDMSPRVWLFGSFSWMKASSENCYLFKTRIINKFGSPSIQNSIGDSNHCSFEKGQCFLEDKTLLLWNSSISKKCEYLPLGPFKGQMLGTIFIADNDPILLTFEEKPKIIKACNTNLT

SEQ ID NO: 157100 - protein, 203 aa, Heterodera glycines
  Coding regions on vcDNA: vcDNA=SeqID_83523; Strand=+; Position=1-612
SNQCTFSWLMSHSKKTGSRATSQERDEEINITIIDRNFWNGKTSVKVPDLERAHIEVLRLEEAVNRSFRIVNRRAYANTRALNKMAGEVNTNMGVLNAKIDTLAEIVKPKITPNQTSHVRFNSCNNANLSQDNEEYLDPFAEDSFELGRVNTLTGMIGHLEVFGEDSVIAFDEWAEWFTDYVGAVGRNWNEDEKVARFKMSLI

SEQ ID NO: 157101 - protein, 48 aa, Heterodera glycines
  Coding regions on vcDNA: vcDNA=SeqID_83524; Strand=-; Position=1-144
MDKSVPCNERAKGYGKDQKQQQQQNAKKGKNSKRKQKGAKKEHRRTRI

SEQ ID NO: 157102 - protein, 43 aa, Heterodera glycines
  Coding regions on vcDNA: vcDNA=SeqID_83525; Strand=-; Position=1 -15,304-420
MWLFVCKELDKKAVGDFLGILRRMDKIRSIIGIERADWLPQYV

SEQ ID NO: 157103 - protein, 47 aa, Heterodera glycines
  Coding regions on vcDNA: vcDNA=SeqID_83526; Strand=-; Position=1 -21,905-1027
MMILVKKKFSSEKIAIFRELEEEQILAEERGARVFCRMIRITNDFDM

SEQ ID NO: 157104 - protein, 28 aa, Heterodera glycines
  Coding regions on vcDNA: vcDNA=SeqID_83527; Strand=-; Position=1 -67,816-835
MVFKGITLICEVVAQSVTGQSDKKYPKE

SEQ ID NO: 157105 - protein, 167 aa, Heterodera glycines
  Coding regions on vcDNA: vcDNA=SeqID_83528; Strand=+; Position=1 -56,388-835
MAEFRAADNFDGLRVGNGRFLDNYMGRMRFNVPMAAPLFHPHEWNVHQRTLDGAVRTNNFAEAFHRKLQRQFSCTHPTIWRFIDTIRCEQKAIDADISRCVMGESAPQKKKKYREADARILRLVHRYNEINNIHLPQNDHNYANANVNPENIINFLTGVSRNYEMRP

SEQ ID NO: 157106 - protein, 44 aa, Heterodera glycines
  Coding regions on vcDNA: vcDNA=SeqID_83529; Strand=-; Position=1-134
MPEALFGPHRPLPTRSPSKLSAARNSAIVPKEAVTYAYKLRHTS

SEQ ID NO: 157107 - protein, 33 aa, Heterodera glycines
  Coding regions on vcDNA: vcDNA=SeqID_83530; Strand=-; Position=1-103
LDFLIFLFLAASIFYNNLSVWSDVHQTEKIIKI

SEQ ID NO: 157108 - protein, 18 aa, Heterodera glycines
  Coding regions on vcDNA: vcDNA=SeqID_83531; Strand=+; Position=1-55
IVLKKGAQKTHFCVKIFS

SEQ ID NO: 157109 - protein, 37 aa, Heterodera glycines
  Coding regions on vcDNA: vcDNA=SeqID_83532; Strand=-; Position=1-111
MAHWQRHRSARKHHRFAEGPIEFCPKCRNAFSDMPFK

SEQ ID NO: 157110 - protein, 44 aa, Heterodera glycines
  Coding regions on vcDNA: vcDNA=SeqID_83533; Strand=+; Position=1 -115,185-204
MLAMFDLINAIDNQQAIQKNERNNSRQNPKRKNKELGHTLTIKL

SEQ ID NO: 157111 - protein, 68 aa, Heterodera glycines
  Coding regions on vcDNA: vcDNA=SeqID_83534; Strand=-; Position=1 -133,396-469
MSSPSPRFHILLLLVICCFSAFLCLALAHVVGESQIDTTGIRARRQYYDQWGNYWSGGNTNWWNWRKK

SEQ ID NO: 157112 - protein, 82 aa, Heterodera glycines
  Coding regions on vcDNA: vcDNA=SeqID_83535; Strand=+; Position=1 -129,933-1052
MEEVADKLRQSALQSSNAKRRHLSLAEQAMENEAEMEMNEQPSSDDSLSQSVVFECQSCDNGKGRDEDEMGIPPPSKHGRTE

SEQ ID NO: 157113 - protein, 187 aa, Heterodera glycines
  Coding regions on vcDNA: vcDNA=SeqID_83536; Strand=-; Position=1 -173,732-823,1824-1914,1968-2031,2085-2145,2357-2438
  Homolog annotation: Hit_ID=CAE63255.1; Match level="QueryCoverage =54%, HitCoverage=19%, E-value=1e-42, Identity=75%"; Hit description =Hypothetical protein CBG07625 [Caenorhabditis briggsae]
MTVVDHVQLRAKHLLDPNGGGHSPGGLFPAQPTDWILSMGTVFLPSGDSTPKLFGQLSLLNHILGSRDFTYGFTLLRDIVNEIEWEKTGMFPRVTLCDFEVRVLGNIHRHTVQCVLMINMFNEKIFLFLWFWFLTVGSVTVTNCLYWVYVMLYPKKVLLWASDDLNACRRTDDFGTDFSTLERLQQH

SEQ ID NO: 157114 - protein, 795 aa, Heterodera glycines
  Coding regions on vcDNA: vcDNA=SeqID_83537; Strand=-; Position=1-2385
  Homolog annotation: Hit_ID=DAA04499.1; Match level="QueryCoverage =99%, HitCoverage=55%, E-value=1e-98, Identity=30%"; Hit description =TPA: pol polyprotein [Schistosoma mansoni]
MGSKKFYTAMDMQSGFMQIPMAPEDIEKTAFISHLGINEFITMPFGLTAAPDTFQRVMNSLRRRLTAAMLIYLDDIIIGSENEEIHLIDIENFLKLLKEVGLKLKIEKCHWGMAEIRYLGFLLSEKGIRMDPKQVQAVQNFRPPKSLTELKSLLGALTYFRRFIKNFAHIARPLQTLTQDKFEGKIEENWGNEQEEALETLKKMLTSAPVLQSPRFGKPFIIECDASKKAIGAVLLQANGPVAYASRALNRHETNYPSIEREALALVYAVKEFSPYIVGSGVTKTITDCSALTSMMKAKELKGRLEKYQITLQSFDLEIVYRPGSKNKAADFLSRYNIPGNESEDTNKKGKKENKIKISSTENKPNSDKNSTRNGQTDESRISLMQIIDAQRKVKELVKIFYILKTGQYPKEIFKWKGVMTDYCLLNGAIYFQKGKENAENPKLVIPYELRQKIFNEIHNEGHFGFEKTWFEIKNRFHWIGMKEDIKLLIDTCEACQKRKIQPGNVKSAPSVPIKIAKGPFQRIHCDLMGPLKKSENGNSYIFLAIDSFTKWIMGKAIPNQKAETIVETFVEIMVHQHSTPEIVVTDQGRLFTSELFSDLSKIYGFEHQTSTAYHQQSNGQIEGCMRIMANIISQLVNEKGNDWDKALPHAIFVYNSSIHTVTKYSPFFLLYLRHPKMPTDRLLKLPSQNEVTSDISIYTRKHAENASRAWETARENILKSQITQKEENDKSRKAEEKEFEIGELLLLKKEVLKHKFDQRWSGPLRCVGIDKDRKNVILQQIEGKGKLKKVHHEK

SEQ ID NO: 157115 - protein, 158 aa, Heterodera glycines
  Coding regions on vcDNA: vcDNA=SeqID_83538; Strand=-; Position=1 -45,372-626,1056-1232
  Homolog annotation: Hit_ID=CAE58717.1; Match level="QueryCoverage =98%, HitCoverage=14%, E-value=2e-11, Identity=29%"; Hit description =Hypothetical protein CBG01902 [Caenorhabditis briggsae]
MKMDLRKLIWDVTVMMKEHPLLRMAHIAILCQRVDIFTDDGLAYLQRFNYSVTDLVKVTCSPEGFYPLMLAVQTNQDSIVRFLLKHGADLTAHDHVGNNALHYAARVSTQMLETLLEKEAGKALINSRNNAGETPSMVALRAASPLCMKTLFNHGASC

SEQ ID NO: 157116 - protein, 85 aa, Heterodera glycines
  Coding regions on vcDNA: vcDNA=SeqID_83539; Strand=+; Position=1-422
IPKNPTYSRRAALVGLDEFDEWVFVRRFVQQLAPWLNSVFMHNGLAARSATIDGVSPALFRELINALPASFSSSVSNIWVDTRAA

SEQ ID NO: 157117 - protein, 80 aa, Heterodera glycines
  Coding regions on vcDNA: vcDNA=SeqID_83540; Strand=-; Position=1 -200,1168-1210
MAQLATAPKGVLFTALCRPLRTTVFTTVRDAAAAAVRITVVDERSTDPDTFRLWFSPALQIVQQCTKLIFYADYESDVYF

SEQ ID NO: 157118 - protein, 131 aa, Heterodera glycines
  Coding regions on vcDNA: vcDNA=SeqID_83541; Strand=-; Position=1 -270,609-734
MALCCVWIRKHHALNGTSMHLAKLAKMKFYFLFFCKVLPSLKPKVPSVVNHHLAALLADLLHDRFLLVTTDHGKLITLSDNFHSDPTFSTDEFVAQGDSLYDLVDPRDHQTLSHTLIEAQNAKPAVAFVRN

SEQ ID NO: 157119 - protein, 152 aa, Heterodera glycines
  Coding regions on vcDNA: vcDNA=SeqID_83542; Strand=+; Position=1 -213,807-1052
  Homolog annotation: Hit_ID=CAE68449.1; Match level="QueryCoverage =81%, HitCoverage=13%, E-value=3e-31, Identity=50%"; Hit description =Hypothetical protein CBG14239 [Caenorhabditis briggsae]
MYHTVILLIICHLLHTVISLASVLVSSPFDNFRIECPQSSGAQRLSIRMVESQGQKRQDTVFVLSCQHIVELYPWLDLPQEIADQEREDCRYTKQFDILLEQKFDLTCKEHEYLAGIARLADTRSIQQRDLLIDFVQIMTKFCDYEFFFKES

SEQ ID NO: 157120 - protein, 28 aa, Heterodera glycines
  Coding regions on vcDNA: vcDNA=SeqID_83543; Strand=+; Position=1 -79,149-156
MAKTTTRLTTTAQTTTFGWWLNKNDEDL

SEQ ID NO: 157121 - protein, 102 aa, Heterodera glycines
  Coding regions on vcDNA: vcDNA=SeqID_83544; Strand=-; Position=1-306
MSVLLLSSQFSVAVLLIAFASSMGLSNARTIIAADGSFGDENGQFSTPNSLIDSYERNIPSLVALMREFTESKERTKQKAIGKAQEKEEKRMEEGKVKAGDE

SEQ ID NO: 157122 - protein, 84 aa, Heterodera glycines
  Coding regions on vcDNA: vcDNA=SeqID_83545; Strand=+; Position=1 -55,116-315
MFNYFLLFLLLSIAFISLISFSEQKSFFTKVGDGFKKTANKIGKGSHKTWNKAKGTVKRGPKKAWEKAKGTMKKGWRNVKRKVG

SEQ ID NO: 157123 - protein, 61 aa, Heterodera glycines
  Coding regions on vcDNA: vcDNA=SeqID_83546; Strand=-; Position=1 -152,385-418
MSDLSPNVRNSIFQFNTVTICAIPRALWCIFWPAREALLGQNSDPTHLKCKKLITKFTIFS

SEQ ID NO: 157124 - protein, 229 aa, Heterodera glycines
  misc_feature (214)..(214): Xaa can be any naturally occurring amino acid
  Coding regions on vcDNA: vcDNA=SeqID_83547; Strand=+; Position=1 -54,893-1081,1128-1205,1249-1290,1352-1530
  Homolog annotation: Hit_ID=AAS66238.1; Match level="QueryCoverage =82%, HitCoverage=14%, E-value=4e-38, Identity=44%"; Hit description =LRRGT00147 [Rattus norvegicus]
CIFELDPKTVYAEKFKLEDCLTESQKALEDLDKVQTELDTLNETASDEILKVEQKYNQMRKPFFEKRTHFIKQIPNFWVTVFINHPQISNILEEEEEECLHYLTKVFINHPQISNILEEEEEECLHYLTKVEIEENEDIKAGYKLKVEIEENEDIKAGYKLKFSFDPNPFFFSFDPNPFFENSEIVKEFNTAAEPNSVTTEIKWKQGKNKVSIXKLAKNNKCSFLDKTS

SEQ ID NO: 157125 - protein, 224 aa, Heterodera glycines
  Coding regions on vcDNA: vcDNA=SeqID_83548; Strand=-; Position=1 -215,442-571,616-945
MDSDSMDISTSSSSYSPSPSHLSDVPFSSLAVKTISTTNKISKNSFQDINGKSPRLQFTASPPHYHKENQSSVPSTAPNPLAVSRTMISTSCKKDITERHSPSVNANRQNQMQKEHSVAAEMFLATDPILMDLQKANKKSEKRKLNDEEQDNTRQMKKLKKSGTKKTDCDQNAMSGKKMEHSVLTGHKSDNSNAQRPNGNTSNCNKSDKKSDATSNSVHPQVIN

SEQ ID NO: 157126 - protein, 364 aa, Heterodera glycines
  Coding regions on vcDNA: vcDNA=SeqID_83549; Strand=-; Position=1 -58,153-256,476-556,659-773,850-930,1128-1229,1859-1923,1970 -2081,2284-2562,3127-3224
MSSNFIGSPNCFFRPTADQAAAEEVDKYEVFSWHGDLSDQLAAQFLVSDQQLLKECREKLASAELRETKLLCKNGELNAENKALKAELEKQKLMSENSELKAKVDKMDQEKQQQLDKKYVSVDVFNSLVERIKQLENRQNKEEGRKAEEKQQKESVGQQNKNTEQKLDGKYAVVDKNNVLVALVTSSGDHSPPAVVSAKVAKEVPNSQQQNDWDAKVCHKDIEIIGEKQLTINCKGNRFVLLRLEVPLDGSIGQILNSYGYRSDGSFGCNGINRPCKMPMSLFGSSFSPVAMQSADVEMAYKSSEFSTGDVVGCGIFLDTRLIFLTKNGQRMESADVHLLLLQFVISFSFVHSFTNSNVTIDGA

SEQ ID NO: 157127 - protein, 82 aa, Heterodera glycines
  Coding regions on vcDNA: vcDNA=SeqID_83550; Strand=-; Position=1 -107,855-996
MSEMITHNQHQLIKWVKKWGQTQMINKKEKSFENLKDRHFEKSLDLDSMLDLDFLDKNLGKSRSRKNPGSSGPGSRPGPGFF

SEQ ID NO: 157128 - protein, 105 aa, Heterodera glycines
  Coding regions on vcDNA: vcDNA=SeqID_83551; Strand=+; Position=1-378
LRISNFIFENFAVDNCCYNHDVCYINKYQKRYDCDIKFCNCLNEYPNCFLTKVCSPTHILNILFFRIYYAGQFILLENVLKKDKNNYFILPSIDMHMYFKFFIVM

SEQ ID NO: 157129 - protein, 180 aa, Heterodera glycines
  Coding regions on vcDNA: vcDNA=SeqID_83552; Strand=+; Position=1 -78,389-461,524-639,713-799,1007-1076,2191-2309
  Homolog annotation: Hit_ID=CAE61872.1; Match level="QueryCoverage =70%, HitCoverage=43%, E-value=4e-54, Identity=75%"; Hit description =Hypothetical protein CBG05852 [Caenorhabditis briggsae]
MSGGPRYEYLWQDGAQYKKPTRLPAKDYMHLLMDWIEERINDEKIFPTATDVPFPNDFRQTCKKILSRLFRIFVHVYIHHFDRLVQIGAEPHANMLYKHFYYFVTEHNMVSQRELDALKDLTARLITSQHNQQHTAIDAKNVMCASSASLSDDDDAMNSSDAGDGRSVCRRVVVVGVDEK

SEQ ID NO: 157130 - protein, 356 aa, Heterodera glycines
  Coding regions on vcDNA: vcDNA=SeqID_83553; Strand=+; Position=1 -132,184-385,717-814,966-1126,1204-1321,1385-1516,1626-1853
MTSSQNSIMDGANLLGNLEFLNSLNEGRNLLHTQLAQKQQQQHHSSTFCQSPFPLKQPKMEHKLDIFAQLQQLVSSSSSSSTNGCSNSTDHQHLASSFPKQHIASMHNKMLSREKKKFSSDVSDFLVLEVLKRKELLVENNTSRDLSFSECKRNAWNDVRELLVSRFPGFDLNIEAIKSHWRYRKRKVTDAFSEMCKGSEAEQKLKLRLAAVDFEIYSQLKDSNLLERTRLEKDASPDQCDDGHFESISSSNSPATRAINAESSAAASTMSLAPTLPMISQAPFFLGQLGPQQQQHIGTTNPTMLLERLTASLLEQQLKQQQQQQHFTKKDVEEEENDQQQQEQRGRETVQHRIND

SEQ ID NO: 157131 - protein, 18 aa, Heterodera glycines
  Coding regions on vcDNA: vcDNA=SeqID_83554; Strand=-; Position=1-56
PYRDRDLSFSKSGTGNRD

SEQ ID NO: 157132 - protein, 100 aa, Heterodera glycines
  Coding regions on vcDNA: vcDNA=SeqID_83555; Strand=+; Position=1 -189,520-633
MSNLSSTIMPTAAEYHHVGNAAKENGGGTGAGPEPPAPKRLRLGSAENEEEREMALLKREAYMAQASAFDEIRSLVTEVRSTLLPQMLTALQNYNSQFNS

SEQ ID NO: 157133 - protein, 56 aa, Heterodera glycines
  Coding regions on vcDNA: vcDNA=SeqID_83556; Strand=+; Position=1-168
MSASFDDELQLEMQSIEAIFPNEIHIESARQISVQCASNVQLNLNIPADYPRSYDA

SEQ ID NO: 157134 - protein, 72 aa, Heterodera glycines
  Coding regions on vcDNA: vcDNA=SeqID_83557; Strand=-; Position=1 -45,214-387
MNKYITNSSTHWQQQPYLHLVNKVAHLVRRNAGLHCILKNCLNCLNGGGHFHQPNGTKSVDESKKKSWRRIN

SEQ ID NO: 157135 - protein, 199 aa, Heterodera glycines
  Coding regions on vcDNA: vcDNA=SeqID_83558; Strand=+; Position=1 -252,435-639,685-827
  Homolog annotation: Hit_ID=NP_476652.1; Match level="QueryCoverage =95%, HitCoverage=24%, E-value=8e-28, Identity=40%"; Hit description =CG11988-PA, isoform A [Drosophila melanogaster] gb|AAF54330.1| CG11988-PA, isoform A [Drosophila melanoga
PSEVQLQSKRTSSKNRAGLTGSARGAIQPPSKESAESSPAPSSLATHHQSVASMTLSISANNLLNFNINSPRSSSSRASPMANVSKLRFHSTKGVNVYLQHDETVAVRKHGEYYQGYVFTERPIKVGEKLVILVSQIEDSFSGSLAFGLTSCDPSKVLASRLPVDSDELLERTEYWVCIKDVAATPQVGDTLSFQVDAE

SEQ ID NO: 157136 - protein, 121 aa, Heterodera glycines
  Coding regions on vcDNA: vcDNA=SeqID_83559; Strand=-; Position=1-366
MANLSLFFALLTPPPLFSFRLSPPSAAHLPPTARFAGRPLELSVPSNAIFTASEKQIIVVRREKANWRRKCWETDKQRAENAIDRSTKVKTTANAIGIFFAQRIVGRMALIRQTITTLMPQ

SEQ ID NO: 157137 - protein, 67 aa, Heterodera glycines; identical to SEQ ID NO: 138863
  Coding regions on vcDNA: vcDNA=SeqID_83560; Strand=-; Position=1-204

SEQ ID NO: 157138 - protein, 22 aa, Heterodera glycines
  Coding regions on vcDNA: vcDNA=SeqID_83561; Strand=+; Position=1 -36,129-161
MLDSSMPYSLAAKRIRKNDKLK

SEQ ID NO: 157139 - protein, 164 aa, Heterodera glycines
  Coding regions on vcDNA: vcDNA=SeqID_83562; Strand=-; Position=1 -68,351-777
MSSAAVRIGIIYTEFRILAKNLLILIGLSTKEVPLDHWVGNGRVSYGYANFGEIISTNANGNEISIRDNVPSFRTGDVVGCGLNWATRCVFHEEWTTLEFVFMMAIHINKLANCLIKTSPICTLTRERLTFTRPLHCLITWPRSRPTLVPTSNTNCQRNLRLCK

SEQ ID NO: 157140 - protein, 41 aa, Heterodera glycines
  Coding regions on vcDNA: vcDNA=SeqID_83563; Strand=-; Position=1-163
KQKMGKIIKLIAWLKFNQINISGYHSIALIVLFQNIIFLYF

SEQ ID NO: 157141 - protein, 26 aa, Heterodera glycines
  Coding regions on vcDNA: vcDNA=SeqID_83564; Strand=-; Position=1 -6,238-312
MECPKSIGSEPTLAPNRRHRIVLFGN

SEQ ID NO: 157142 - protein, 32 aa, Heterodera glycines
  Coding regions on vcDNA: vcDNA=SeqID_83565; Strand=+; Position=1-97
KPKKFFTLLNKLTYFAMELIRGVTDRMSAMFS

SEQ ID NO: 157143 - protein, 36 aa, Heterodera glycines
  Coding regions on vcDNA: vcDNA=SeqID_83566; Strand=-; Position=1 -64,280-323
MDGAVVRSIKDLPIDELTPWNSCYYCKHPIFNLVKK

SEQ ID NO: 157144 - protein, 138 aa, Heterodera glycines
  Coding regions on vcDNA: vcDNA=SeqID_83567; Strand=+; Position=1 -115,159-295,454-616
  Homolog annotation: Hit_ID=AAK92156.1; Match level="QueryCoverage =98%, HitCoverage=66%, E-value=4e-52, Identity=66%"; Hit description =ribosomal protein L13A [Spodoptera frugiperda] sp|Q962U0|R13A_SPOFR 60S ribosomal protein L13A
MGFSTKPIIIDGKDHLLGRLAAVTSKQLLLGQKIVIVRCESINISGNFHRSKLKFLAFLRKRCNVKPSRGPFHYRAPSRIFWRTVRGMLPHKTARGMEALKKLKCFDGCPQPYDTKKKFVLPNSLRHIALKPRRKYCT

SEQ ID NO: 157145 - protein, 133 aa, Heterodera glycines
  Coding regions on vcDNA: vcDNA=SeqID_83568; Strand=-; Position=1 -108,622-915
MKRRVPYYKQFFLDLIANDWSPNAPTIDDKPLQKEATSLLLNNIILTAVFNKTFYSCVNCPNAETLTLPSGFSPIFLGTFNVAIRVFCESIKCFKEINLSMEEFVLLRGMILLQHGHNSFKNNIIFISNFSTI

SEQ ID NO: 157146 - protein, 39 aa, Heterodera glycines
  Coding regions on vcDNA: vcDNA=SeqID_83569; Strand=-; Position=1 -55,363-427
MEDFKQKMRKQIDEFKSEKKISLIIIMGLCKYTCITIIT

SEQ ID NO: 157147 - protein, 74 aa, Heterodera glycines
  Coding regions on vcDNA: vcDNA=SeqID_83570; Strand=-; Position=1 -43,95-169,319-425
MTNQLQERKKLLDAEIEQLQKELNEIEADNAEKQKQLSDEQNLLTEVRTEEGIQQHKLRQLKESLECHEKALEE

SEQ ID NO: 157148 - protein, 25 aa, Heterodera glycines
  Coding regions on vcDNA: vcDNA=SeqID_83571; Strand=+; Position=1-75
HLVFEKRYAPRRWIVCYCQRKRQCL

SEQ ID NO: 157149 - protein, 60 aa, Heterodera glycines
  Coding regions on vcDNA: vcDNA=SeqID_83572; Strand=-; Position=1 -48,1095-1227
MAPEIPEDLYHLIKKAVSDLNFALKKRLNIPDTPAMAMSPEMFAAAGMFGAQAGGAAGAQ

SEQ ID NO: 157150 - protein, 55 aa, Heterodera glycines
  Coding regions on vcDNA: vcDNA=SeqID_83573; Strand=+; Position=1-166
FNDVGHSADAKKMADDYLVGELKEDEGQTTAGVSLPEEAKRDEPTESWRQILSSP

SEQ ID NO: 157151 - protein, 239 aa, Heterodera glycines
  Coding regions on vcDNA: vcDNA=SeqID_83574; Strand=-; Position=1 -44,131-350,631-741,788-894,1034-1063,1125-1329
  Homolog annotation: Hit_ID=AAB62657.1; Match level="QueryCoverage =97%, HitCoverage=20%, E-value=1e-09, Identity=20%"; Hit description =ORF 73, contains large complex repeat CR 73 [Human herpesvirus 8]
MQAVREQLEKDLASSNRTIEALRNELASKEMEFLEQAKTLSETVNKSEDERSKYEQQQMTLEKTGHEAQLKVAQCQAEIEKLQLDCEQQILEQEKLRLNDEIKEFMKRDEENVQKQGVYLDEIQKLVQQNSFMERLNQTIASPTSSSSLNASFIAGTPNTSRLSTTVNQGSYMAEQQQQQHSDRMNVIIGYMRAEKQKETEMRMNAELELQRIRTQANIDQHKIVHMEAEVAKLRKEAE

SEQ ID NO: 157152 - protein, 40 aa, Heterodera glycines
  Coding regions on vcDNA: vcDNA=SeqID_83575; Strand=-; Position=251-372
MQKRRESIDTLQSELYMWRSKAERLQETLSYVNDDRQTNE

SEQ ID NO: 157153 - protein, 437 aa, Heterodera glycines
  Coding regions on vcDNA: vcDNA=SeqID_83576; Strand=-; Position=1-1314
  Homolog annotation: Hit_ID=NP_921817.1; Match level="QueryCoverage =98%, HitCoverage=22%, E-value=9e-11, Identity=22%"; Hit description =hypothetical protein [Oryza sativa (japonica cultivar-group)] gb|AAP54104.1| hypothetical protein [Oryza
MAVILNGEFHRRISSMQAGTTQIPGFGQLYILDPVEAMEQRRNNPRFTGEKITNEDEFVQGHQLNEQTLEILEQMIQVHHPAAQAYKQAREQLSELLQQQTPEELRFFRMTLLNERRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFHSEAESDNESCETQSIASSDAGSVANSDAESVASVSSQHRRIDKSKQFISLRDYCKYYLAIRDENMELQYHHILSCGGGLGQRWILDQAAKIDWQIATFLRRPDMDLRISTPKNLLQYLVNQYNRQQARQNPNAQQKTVDDIGSVVRLSEHNVNSLQYWKKMYEDCNTVFARCHDAKKARLFITFTNNREWPEFKENIYKNGQVFTDRFDMWMRVWTSKNR

SEQ ID NO: 157154 - protein, 337 aa, Heterodera glycines
  Coding regions on vcDNA: vcDNA=SeqID_83577; Strand=+; Position=1-1014
  Homolog annotation: Hit_ID=XP_318162.1; Match level="QueryCoverage =56%, HitCoverage=22%, E-value=4e-15, Identity=27%"; Hit description =ENSANGP00000020700 [Anopheles gambiae]
MSSKNVFALKKKHKTRKNSESSKGSSESSASQKSHRSQPKCWRCGKWHSPKRCSHGKSTCRKCNETGHLERMCDQHKAWLKRNREKKDGKAVNTFRLGGLFLPDSESRRKLIEVLLKMNGTEVEFIADFGTERTVVTKDAHRQIGSPWLSRCTERAKYHDGSTRPLLGKGQAKFSIGDRSCDGQFYVAKGTKNLLGIDMLHSLGLLDSFRKSLEGNVQVAEANTKSDSTDAQSENPKKKHHGNKPKFALGAKVIASLGLQPWRAGYVVNRQGTMYEIRFPDGTTGKFPEKGVEACVLDSDEEIFDGLDLREAPSDGKTSKGLVGIDCDQRKRENVIA

SEQ ID NO: 157155 - protein, 85 aa, Heterodera glycines
  Coding regions on vcDNA: vcDNA=SeqID_83578; Strand=+; Position=1 -126,2971-3101
MANKVYVKKGIRVKNAFKKKIEENYGGRMETVDFEDIEGTAEKCPGICLDLTVTTKTVPFNTMPTNATKYTATAGTIKSADGPAK

SEQ ID NO: 157156 - protein, 161 aa, Heterodera glycines
  Coding regions on vcDNA: vcDNA=SeqID_83579; Strand=-; Position=1 -83,192-314,371-507,563-705
MIFAVNCGLMAMFCAAFDRLFAVALPFKHSSIFTKYKFSYLLGHLLICVIYGAFTLNYVLAFAFENAGNPTTGVVAETLLGPVGYKFFAGTFIISLGSTCCYVSIFVIIRCKNAVTQQTNTRVLRSLIIILSINIGGYLTNLAIYQLLYAFGSILGYFKLI

SEQ ID NO: 157157 - protein, 69 aa, Heterodera glycines
  Coding regions on vcDNA: vcDNA=SeqID_83580; Strand=+; Position=1 -119,623-713
ATHHFQLEAGNYVIIPSTFGRNEEGEFLLRIFTTGTIGMYNPNSGQKTLEILNSLPSLLVSVTKYEMGY

SEQ ID NO: 157158 - protein, 257 aa, Heterodera glycines
  misc_feature (15)..(16): Xaa can be any naturally occurring amino acid
  misc_feature (183)..(183): Xaa can be any naturally occurring amino acid
  Coding regions on vcDNA: vcDNA=SeqID_83581; Strand=-; Position=1 -81,289-341,443-510,591-658,713-792,864-941,1095-1248,1342-1411,1531 -1557
  Homolog annotation: Hit_ID=CAE60355.1; Match level="QueryCoverage =98%, HitCoverage=57%, E-value=5e-53, Identity=44%"; Hit description =Hypothetical protein CBG03951 [Caenorhabditis briggsae]
LTTIFSEPPDYRTNXXLIRLPFTFLPVFVIALFGNLLVIAVLIRNQCIKNQCIKKRRVNTILFHMTIAQLLVTLVYIPKEIVHNLTIAWLWGDFLCRFCKFFDVFGVTLSLCRFCKFFDVFGVTLSAGILICLSMDRFYSILFYSILFPLYVINAKRSVQWMLSVAWCVRFFSSSLSDFLSAXAHHPCFVHFTQCVSADVIGMVSPSVVYWFSVLNIVQVYFIPLVYFIPLLVIVVCYGSILVSISLKKQFDGDGEN

SEQ ID NO: 157159 - protein, 24 aa, Heterodera glycines
  Coding regions on vcDNA: vcDNA=SeqID_83582; Strand=-; Position=1 -52,295-317
MEKACKIWRDYIDFSALELLELAS

SEQ ID NO: 157160 - protein, 159 aa, Heterodera glycines
  Coding regions on vcDNA: vcDNA=SeqID_83583; Strand=-; Position=1 -396,439-521
MDAEDGLLLLAQLGIQKAYKRMKAILRPLFVHHCCRPSMLSRCCWLRSMSSKASENALIKELEAGENAEVAQKFFRRIGPRREAFRKRDMTGNSIRKILVHADQMEALFETEWGKTICQTMAHLGKIQIFTKAQLLSPGDLDGLEQQLSSSRHFSTNNQ

SEQ ID NO: 157161 - protein, 25 aa, Heterodera glycines
  Coding regions on vcDNA: vcDNA=SeqID_83584; Strand=+; Position=1-77
NTPSEKTRCVPINRECQRKTLLFFS

SEQ ID NO: 157162 - protein, 173 aa, Heterodera glycines
  Coding regions on vcDNA: vcDNA=SeqID_83585; Strand=-; Position=1-520
  Homolog annotation: Hit_ID=NP_608540.1; Match level="QueryCoverage =99%, HitCoverage=65%, E-value=4e-12, Identity=27%"; Hit description =CG2839-PA [Drosophila melanogaster] gb|AAF51469.2| CG2839-PA [Drosophila melanogaster]
MKKREKKKKLMKPYKRRGMTKRKKEERKKEPTKRKEKKRHPGGKRKEKEKEVRDTEPELSGEETPKKQTDRGGRGVERKRERRPMIVQQKKEEEEREEEEEGEAYQPLKHGGDKELLGMSPKSILKGSKRKKGMEEAADPKPQQWRRRDKWKKPTEEDGEGHSRGNNGTGRDG

SEQ ID NO: 157163 - protein, 592 aa, Heterodera glycines
  Coding regions on vcDNA: vcDNA=SeqID_83586; Strand=+; Position=1 -126,180-356,405-738,786-897,942-1223,1331-1613,2090-2273,2633 -2853,2899-2958
  Homolog annotation: Hit_ID=XP_326403.1; Match level="QueryCoverage =15%, HitCoverage=7%, E-value=2e-20, Identity=52%"; Hit description =predicted protein [Neurospora crassa] gb|EAA33019.1| predicted protein [Neurospora crassa]
LSVISQLAHFDDVSPLGQFLHKAATQTERSNSFGFIKIVPKTTFSLKLGHPKVRDIILQQLPMNNATHFIMSACYGSIVAGIVTFNERSAIGKTDISNAKRIVRKFLAGPGLSPSDKSFISHLNKSISCSVFVDPSIGNCLTDLVRFKRIVFILKQFQSDFVQDFVKGLNSFADKWAAAKDTKHPTPISFSLVPLSSIGDKTRFNPVSTHMIADEHQFEWFCGHVKTVNEYDWLLRKVRQSLNECSAMLTNNELDDAQEFFEQLEERKNIFYDSLKDFIVDLRMCKAESQKEAIVQRAVDDYVHFCQRIVGHYEELVKEKKEMVNELKQKGKFFGKISHPITFLNSSVPPVQNQHTSFLLCLGKLYELVSRGKCTFVDLDVLRDGEEAQADEGLPEDIRSLNGYPSFGMRLIKMRGNKLLSNDYMAEEERKLQYPIAREQAQITHFFCACGKTPVDGFSFRCSDVAKHGTEFKHFCSKVSLEKELDRLNNKGMLTFLLLDGHKVRIIDAPGIGDTNGINEDNINFDKTLNFISTLPELHAVCILLRPNSPRATPAIRYCIEGLLTYLHKNATNNIVFVFTNARGSSYDMGKF

SEQ ID NO: 157164 - protein, 127 aa, Heterodera glycines
  Coding regions on vcDNA: vcDNA=SeqID_83587; Strand=-; Position=1 -122,355-616
MLVTVLHVQRDITSKCTMDGSATGLNEHEHILKCNSNEKQSDKCQRFGQIDDRSTRFVDRHGFPRAVRFQIGHMFEQSPKFLLCMGPTPRKIVLLFLVVFNAALFDQTQCLIRFVVHTVNSVPMEWN

SEQ ID NO: 157165 - protein, 207 aa, Heterodera glycines
  Coding regions on vcDNA: vcDNA=SeqID_83588; Strand=+; Position=1 -185,742-1006,1155-1328
  Homolog annotation: Hit_ID=NP_524786.1; Match level="QueryCoverage =73%, HitCoverage=6%, E-value=2e-09, Identity=34%"; Hit description =CG8491-PA [Drosophila melanogaster] gb|AAF49103.2| CG8491-PA [Drosophila melanogaster] gb|AAG48328.1| tran
MDGFGGTASGAIGSPNSDAGSIYWMSPDPNSPDLQAWTGASGGSAVGAGAPVPQQQQQPTGGAASVPGQAVGGGASSPMMNAAAVAYGIQQQQLQQAQQSLSAPQMPSQQAQASAQQQQQPIGMALAQPQQQQVQQQQQQPMSMMPYQPQLKDCIFPKGGGAGVYGYGGQQGGYGMGGGYGSSSAGGGQMPVSPYSSYLEKQISTYP

SEQ ID NO: 157166 - protein, 486 aa, Heterodera glycines
  misc_feature (226)..(226): Xaa can be any naturally occurring amino acid
  Coding regions on vcDNA: vcDNA=SeqID_83589; Strand=+; Position=1 -1431,1611-1647
  Homolog annotation: Hit_ID=NP_498959.1; Match level="QueryCoverage =92%, HitCoverage=21%, E-value=3e-86, Identity=37%"; Hit description =zn-finger, CCHC type and RNA-directed DNA polymerase  and Integrase, catalytic domain containing protein
IEKLKNIIRQNESAFVKPGEVGLFRQTIHRIDLIDGARPVQQRPYRYPVALQPEIERQVKELLRQNVIRPSTSAWSSPIVLVRKPDASYRFCVDYRKLNQLTKRSTYYLPRIQSILDEVSGKKYFSVADCSSGFFHIKLAKGHEERSAFICHMGLFEWLRCPFGLAGAPTTFQRAMEEVQMCSATFLVYLDDCIIGSMTEDEHLRDINTFLRTMTEVGFRLKPEKXRFALIEIRYLGHLISANGVRIDPKDLEPIHKLRKPKNITELRSLIGMLSYFRKFVYGFAEILQPIYELTKNESTTEWGPPHEKALEELKTKLMTAPVLAPPKFGQPFVVETDASIKAIAGCLLQENREGEVHPICYFSRVLTKHEKRYSVVELEALAICASLKNFRPYLEGAESTVITDNSALTSLFRRKDLEGRLSRYQLAIMAFDVEIIHRPGKRNQFCDHLSRYLDDNDTQINWLKIEPKISQSEVMKEYHSDPFPR

SEQ ID NO: 157167 - protein, 539 aa, Heterodera glycines
  Coding regions on vcDNA: vcDNA=SeqID_83590; Strand=+; Position=1-1620
  Homolog annotation: Hit_ID=NP_508324.1; Match level="QueryCoverage =79%, HitCoverage=15%, E-value=8e-47, Identity=29%"; Hit description =predicted CDS, peptidase family A16 and RNA-directed DNA polymerase and Integrase, catalytic domain and Z
MAIVLKVSKYWLKKIGKVAISSHIRNISEEQFINPQDFEKAEILVIKQGQMNWQNYAGKDQIRTFIDNDDLIRLDSRIKNCEMQYSFKFPIVFPKGAAILELLAWRSHIKVKHGKVDATLNEFMSEFWAPNIRATIKKVIKMCVNCKKLSGPAFSLPIMPSHPQERVKISQPFNSVAIDYLGPSLVKNEGKTIKFWIVLITCLVTRAVYLEPVLDLSAYSFLQILRRFASRRGTPKRIISDNAQTFRLSAKVAGAYEARGGKGKDELEKYLVKNKIIWRFIALAPWANSLAERLVKVCKDAFKASLGKMVLNLDELRTFITEVEWTMNNRPITHVSIEPEGERALRPIDFINPGLELGINLQNADDDKNDEEFTLEPEKLENKLKIQWNKTNKVLECFWKRWQKEYLTILRDRTQWHHKGPKSQEKREPKEGEIVLIEDEFHPRNTWKMGKIICLNGQKGSIRSAQIKLASKGNETKGRIIERPVNKLYSLEVNKAINEETKPSQNSKSEKSLEENKIIQNKNTHPMVTRAKTQKTFTL

SEQ ID NO: 157168 - protein, 124 aa, Heterodera glycines
  Coding regions on vcDNA: vcDNA=SeqID_83591; Strand=+; Position=1 -60,152-277,450-563,774-845
MPTGEWTLRGMCWTSPAATFIFVPQLKMEAAKTGGNSKKSRAMSSSTDPAEAGGKKRRNMHPQIVDITQQQQQNVAEFCPVSTGSVHQQQQQSDPRAIMNQIVDTPQQQQQQQQNVAQFRPAST

SEQ ID NO: 157169 - protein, 154 aa, Heterodera glycines
  Coding regions on vcDNA: vcDNA=SeqID_83592; Strand=+; Position=1 -153,236-403,1306-1446
MLENESRLVNSPLTKLQTNNSNNNNGQQLHQTKTTFPSILLLPDRNNEQIINMESHYHSQIERLSSLTEVEMAELVSSNTNLNNVQALEILDGLFCAFLIESQNSSKHLSEPDSGTMRAEIIRHIWAHLKQEEQSADCCEARAWLIGWLLRSSK

SEQ ID NO: 157170 - protein, 250 aa, Heterodera glycines
  Coding regions on vcDNA: vcDNA=SeqID_83593; Strand=+; Position=1 -11,74-364,423-870
  Homolog annotation: Hit_ID=AAL78214.1; Match level="QueryCoverage =46%, HitCoverage=58%, E-value=3e-09, Identity=34%"; Hit description =putative esophageal gland cell protein Hgg-20 [Heterodera glycines]
MNRRWICNDVWMDIFPCFDHAQLGLKLALLSPRFNALVDKHFNGKSELTIWRSIEIRRKNSVTTAAPESSVFINFDNSVPFPLPDYRPLPSKIRFKRLQIDYIDHSVINFLRLNRQIFDKRGTNLQLFWISSPHTTDGQLILDIFVREIWPIFASNIRHLRFLGGYHLDNLRRLISPTFLTDLNQLNSIDSVDLLPDAIGDFDRPNATISAGQALSKWLHSPRKDGQPKQLHCTLLNQQAYFDWVNNFKE

SEQ ID NO: 157171 - protein, 255 aa, Heterodera glycines
  Coding regions on vcDNA: vcDNA=SeqID_83594; Strand=+; Position=1-766
  Homolog annotation: Hit_ID=EAK89729.1; Match level="QueryCoverage =99%, HitCoverage=91%, E-value=6e-28, Identity=28%"; Hit description =uncharacterized glycine-rich low complexity protein [Cryptosporidium parvum]
IPITGTQFPPAFQSLGLNPPAFQSLGLNPTAFQSLGLNSPAFQSLGLNPPAFQSLGLNPTAFQSLGLNPPAFQSLGLNPPAFQSLGLNPTAFQSLGLNPTAFQSLGLNPPAFQSLGLNPTAFQSLGLNPPAFQSLGLNPPAFQSLGLNPPAFQSLGLNPTAFQSLGLNPTAFQSLGLNPPAFQSLGLNPPAFQSLGLNPPAFQSLGLNPTAFQSLGLNPPAFQSLGLNPTAFQSLGLNPPAFQSLGLNPTAFQSL

SEQ ID NO: 157172 - protein, 36 aa, Heterodera glycines; identical to SEQ ID NO: 151070
  Coding regions on vcDNA: vcDNA=SeqID_83595; Strand=-; Position=1-130

SEQ ID NO: 157173 - protein, 79 aa, Heterodera glycines
  Coding regions on vcDNA: vcDNA=SeqID_83596; Strand=+; Position=1 -51,94-274,702-709
MLHCHSVALRVGDRIVAVDGMSVIGYAWEQVVTEMICGGPEKTELELTVERTLPDGSDQAEEQTLTVTLDKTQNGAIAH

SEQ ID NO: 157174 - protein, 157 aa, Heterodera glycines
  Coding regions on vcDNA: vcDNA=SeqID_83597; Strand=+; Position=1 -111,225-350,399-498,745-866
  Homolog annotation: Hit_ID=CAE72881.1; Match level="QueryCoverage =90%, HitCoverage=32%, E-value=2e-32, Identity=45%"; Hit description =Hypothetical protein CBG20194 [Caenorhabditis briggsae]
FIALHSFLSESVHFDLLPRIIPTDFPSALGWWDEQQPTEVANFLPPYLFSRYNTPSKFMLRGDVERVKKPTEIGHGKSLRIERKLRIERKALTITVNANDPFPEAPSEKAVHDVNLRCKNPEMHQMLVELFAERPLWSRIAISYRTRLTENALKSVN

SEQ ID NO: 157175 - protein, 137 aa, Heterodera glycines
  Coding regions on vcDNA: vcDNA=SeqID_83598; Strand=+; Position=1 -132,175-456
MLPSLRQMWYCVCDVQLPIAQKICRKDFLETLKECDPANGWLPAGRIDAIRSAIKKDVEKSSARMGDDEFDEDVGGPMGAGGGAAEDESVALGDEDREDMMLLDELAMEEEETEEDETVDTGEEDELMLFEGAKKYR

SEQ ID NO: 157176 - protein, 77 aa, Heterodera glycines
  Coding regions on vcDNA: vcDNA=SeqID_83599; Strand=+; Position=1 -132,188-310,362-404
MTLTMDELRNKVQNGQISTVVVGSVDLHGRLIGKRLTARHFVEMAQKKDKMSMCYYFLAMTIEGHVAEGFEVARWEK

SEQ ID NO: 157177 - protein, 248 aa, Heterodera glycines
  Coding regions on vcDNA: vcDNA=SeqID_83600; Strand=+; Position=1 -546,995-1192
  Homolog annotation: Hit_ID=CAE65694.1; Match level="QueryCoverage =73%, HitCoverage=30%, E-value=2e-13, Identity=30%"; Hit description =Hypothetical protein CBG10769 [Caenorhabditis briggsae]
MHSFSVRLRNSLFHALISLVRFLQRQMIARFFASLEIFYGHRGVRLEQAEAAHLFYAGRAEFIAEPIRPISNRIKHFGCAKCQSETRKMGQSKGRGIGTKKSEQSEKGQKLSWPNPTTKAAAWRGEAAFGCKNATNSDGQRAKLDRNLVSVSPNIRQQFPRIDWEEIERSPFVLVSFGSIAKGDQPSNLQRLVDLGMAVQLDIGQVWAGQLNAKMALIEHNYVAFSRRAQQISAMVRTYRNGIGAVQQ

SEQ ID NO: 157178 - protein, 183 aa, Heterodera glycines
  Coding regions on vcDNA: vcDNA=SeqID_83601; Strand=+; Position=1 -29,93-265,318-446,492-595
  Homolog annotation: Hit_ID=NP_104265.1; Match level="QueryCoverage =99%, HitCoverage=30%, E-value=1e-35, Identity=46%"; Hit description =glutamine synthetase [Mesorhizobium loti MAFF303099] dbj|BAB50051.1| glutamine synthetase [Mesorhizobium
NSYKRLQPNSWAPTKICWTWAPTKICWTVDNRTSSFRLCGHSSNVHIECRIGGADLNPYLAFAALIAAGIAGIEEGLELPKAVACNVYASLELPKAVACNVYASADAIPELPKSLRIAAELMANSEMLKRALGENVLRHYKNSARIELEENVLRHYKNSARIELEDFEKEVTDWELRRAFDRC

SEQ ID NO: 157179 - protein, 609 aa, Heterodera glycines
  Coding regions on vcDNA: vcDNA=SeqID_83602; Strand=+; Position=1 -97,140-233,281-325,414-439,484-567,620-722,787-892,1003-1143,1197 -1287,1352-1411,1469-1631,1721-1854,1947-2138,2298-2486
  Homolog annotation: Hit_ID=NP_509745.1; Match level="QueryCoverage =94%, HitCoverage=91%, E-value=1e-151, Identity=49%"; Hit description= acetylcholine receptor (acr-8) [Caenorhabditis elegans]
LSHCFAFRFFMLYPFSAKGNRRSEDQLYEDLLYFYNKNVRPVKNSTQILEVKFGADLLYFYNKNVRPVKNSTQILEVKFGASLIRIIDVDEVNQVLTTSLWLEMDEVNQVLTTSLWLEMQWFDYKLVWNPAKFNGIKNPAKFNGIKKLYIPSDQIWTPDILLYNNADGADGEPHISIVSDAIVYYTGLVVWKPPSIYKSFCAIEIEYFPFIEIEYFPFDTQECMMKFGGWTYNGFLMNISQIPVTSWTCPPITRTFWHSHEKSLDFERSLEWDLMSVTSRRHEQLYPGCCGQDKYIDITFALDKYIDITFALGLRRKTLFYAVNLVTPCMLIAILTVFVFYIPACEHKMTILTVFVFYIPACEHKMTYSISVLVTLTVFYLILIELIPSVLVTLTVFYLILIELIPPTSMVIPLIGRYLLFTMFLVSFSIAISVVTLNFHRRDGTLHTMPRWIYRVFIRFLPKLLLMTPPVDDDAQSDNDESTSISGPFLPKQRPFPFVSLSTKHSRRGHPSVAKVKGMSAEVLRRMADNVYFVAEYFRAKQQRDKVSENWSYVAMVLDRLLLIVFSTSLFIGTLLILSSSPPAKSEWGEPLSTMPTTKPLSGDTFEFE

SEQ ID NO: 157180 - protein, 81 aa, Heterodera glycines
  Coding regions on vcDNA: vcDNA=SeqID_83603; Strand=+; Position=1 -109,160-294
MDCFRPESPNLPNICSDGNLILDDQLTQHHSSPFKTDAVNIIRESFELAQQMDTPNPITFDCVESETLAEEGIQQRIAVKE

SEQ ID NO: 157181 - protein, 148 aa, Heterodera glycines
  Coding regions on vcDNA: vcDNA=SeqID_83604; Strand=+; Position=1-447
MQQKNAKTCRAAEDEPKKAAIGGTGDELDLLSLLIKGDRSKTIGEDGFDLELFDQDDNNNNDGEEQGVNKGKTTTAPQKAKRTPSQPKESSLSKAMKEVFTGNFEFFKISLETPRASKNEPKNSRLRLFKNRDPKNPRLSRVETLEQH

SEQ ID NO: 157182 - protein, 117 aa, Heterodera glycines
  Coding regions on vcDNA: vcDNA=SeqID_83605; Strand=-; Position=1 -49,102-406
MEIDKEIAELEQEISKSINEVAKDLELKYRDFVPSYIGLADCQDKIQMALQNGKENVIKMEEKLTNAEKEIVKLKVCFITWKSIFAANFRKMRHTKSWELSRIWWTVWPSSTKWSSV

SEQ ID NO: 157183 - protein, 38 aa, Heterodera glycines
  Coding regions on vcDNA: vcDNA=SeqID_83606; Strand=+; Position=1-5,53- 164
MRIIILKQQNGKNTIMNKYKVNNMIKWKKDHQNLNGEY

SEQ ID NO: 157184 - protein, 73 aa, Heterodera glycines
  Coding regions on vcDNA: vcDNA=SeqID_83607; Strand=-; Position=1 -96,246-371
MDDAKMNEKCLKTRVERDRDQNTDGQLSTEIPSFHAALHPWAFIETNHFLAPNRQFSYLNNGFLIFCHLDCCW

SEQ ID NO: 157185 - protein, 28 aa, Heterodera glycines
  Coding regions on vcDNA: vcDNA=SeqID_83608; Strand=-; Position=1 -17,159-228
MSLQIFSKRIFEQDKKILQNFFEKSGVP

SEQ ID NO: 157186 - protein, 93 aa, Heterodera glycines
  Coding regions on vcDNA: vcDNA=SeqID_83609; Strand=-; Position=1-279
MLLIIRVTTIICFLIPPNLSIEICVRPNTVLNYIGELMCIDKNGMSYYLDKDTPKRSNNDLYSCIRLDMNFTKCDQNDPGATIKISDANTKKG

SEQ ID NO: 157187 - protein, 30 aa, Heterodera glycines
  Coding regions on vcDNA: vcDNA=SeqID_83610; Strand=-; Position=1 -12,103-183
MTFLRAIFGENTDQDQDYGLGIHTDYRLMD

SEQ ID NO: 157188 - protein, 267 aa, Heterodera glycines
  Coding regions on vcDNA: vcDNA=SeqID_83611; Strand=-; Position=1 -181,1063-1685
MSKECETAKNIGAFGLRRQSERIENQWFSALLTTRQSTRRTVKSLNLDERRSRKRHCTIAVFLCEMSGQQKAEGLFPVDECFGTNIGRPIAELVDENGFGRESREELVSFEEFVRGGDKKRGKKEKDEGEKGTMGVEAAKRQLIVEGFGFRPIDNRRGGEDDDRFFDIALNSGGTVPEDPMSSADRMPKGRGRSELYAVKQHEDDDNGTIHQFNSQNLASLKMVKTNGAVWTIGRAKGTTTQCSQAQRPRRNCVIRCVRPSGKAADG

SEQ ID NO: 157189 - protein, 141 aa, Heterodera glycines
  Coding regions on vcDNA: vcDNA=SeqID_83612; Strand=-; Position=1 -11,593-653,1858-2211
MSTSKKGLRIARLATAKKLDGLRCRVWVFQCDNGKVNDSIFEQSFGLIHFICLSPKLVQGSQFRAGQTPPDRDILRKILVFFKCFAKIFYENITVFAFSEWNFDTAALFVRLIGTHNCPWMAMDIPRIQMFSDSAFVMENF

SEQ ID NO: 157190 - protein, 52 aa, Heterodera glycines
  Coding regions on vcDNA: vcDNA=SeqID_83613; Strand=-; Position=1-197
NLTKIFEILQINNKHIDYRTTPTILNLIDSEQSYGSKSLPTTFRPTTFWGAP

SEQ ID NO: 157191 - protein, 44 aa, Heterodera glycines
  Coding regions on vcDNA: vcDNA=SeqID_83614; Strand=-; Position=1-133
MINEYEMDEDKMYEACEQLGEMHANYAQYGLKPHFMDLFQQQLL

SEQ ID NO: 157192 - protein, 83 aa, Heterodera glycines
  Coding regions on vcDNA: vcDNA=SeqID_83615; Strand=-; Position=1 -53,394-592
MPFLETTFSLGSPIIQFLIFLCWRNDIATSRRDLFHKTMLKCIQSSPKMNEVIACGYYCYRDLTKWPKLNRIWSERKLMGLIR

SEQ ID NO: 157193 - protein, 79 aa, Heterodera glycines
  Coding regions on vcDNA: vcDNA=SeqID_83616; Strand=-; Position=1-237
SSRRKDPMPSCTSAAAPLSLCRHRPFLCHFRAAVSAPLVSASNGCKSDVRNFLLLLNGTQKRPCSAGRSRKWPTFGCPA

SEQ ID NO: 157194 - protein, 72 aa, Heterodera glycines
  Coding regions on vcDNA: vcDNA=SeqID_83617; Strand=+; Position=1 -55,605-768
MIFCIWEFFGHSNHCFLKELPFTLKKMALEKVVPTPLMLTEFDLCMQFKKEISAGHHEDFAVFFSVSIFLSA

SEQ ID NO: 157195 - protein, 536 aa, Heterodera glycines
  Coding regions on vcDNA: vcDNA=SeqID_83618; Strand=+; Position=1-1610
  Homolog annotation: Hit_ID=BAC82601.1; Match level="QueryCoverage =95%, HitCoverage=33%, E-value=2e-53, Identity=28%"; Hit description =reverse transcriptase [Ciona intestinalis]
MWSVAFNRVSSSQKGFMPVDGCAEHNFVLQSIIQDAKRAKKRCSIAWLDLTNAFGSIPHQTIFTALKWSGLSDQSISVVRQLYATNSTQIRHSNGLTPEIPIRAGVKQGCPLSPIIFNLGIEPILRTIGQLRTGYKLQEKRIDVLAYADDLVLVAESPEELQKMLDATSTIATWAGLSFNARKCATLDIDGRRKTALNTKFSIQNAHPPILTIYQFYDHLGVPTGYGSAQSATKILEKMNDHVQKIDASLLTPWQKFDAINTFVLPCIGFHLKNGVVQKNPLNALDKKIRNYGKKWLNLPQRASTEPLYLSHAMGGMGMIPLNLLADISQIVHAYRLITSRDLSSLSMDLIKTVVNKRIRQQPTHQQIAEYLNGSMKGLFRQFESTDISSNWTRVRQATARLNSKLKIEWKWSTNEERLALELNNDPLNPKTAEYCLRAAIRDFFRRRLLSKPDQGKVFSITSATTASNHFMKAGNFTRFADWRFVHRARLDCVPLNATRRFGHGDKHCPPLSRWTIGNPPTCPLPLLATSWKGNH

SEQ ID NO: 157196 - protein, 45 aa, Heterodera glycines
  Coding regions on vcDNA: vcDNA=SeqID_83619; Strand=-; Position=1 -3,284-418
MIRPELGKQSEGLNVLIFKIRPKLDKVNPRDQVYANFSFINILTS

SEQ ID NO: 157197 - protein, 83 aa, Heterodera glycines
  Coding regions on vcDNA: vcDNA=SeqID_83620; Strand=-; Position=1 -77,479-653
MVETVANELALSTSQTHALLNKAIRRLSEYFDSICREALEQQQHNTNDRQQHIATEAEGKLGAKTKSDECPAIKKLKISHFVK

SEQ ID NO: 157198 - protein, 114 aa, Heterodera glycines
  Coding regions on vcDNA: vcDNA=SeqID_83621; Strand=-; Position=1 -91,145-157,372-612
MAIKYGPKIAKYGHKMAKMSKYGHKFFKIEYFLTRKFKFIQLKNFSGFGLKKANLAAGGRSNRGFFEKCQNMDIKYGPKCQNMEKYGNMDINREIWKNMENMDIEILPRSFKPS

SEQ ID NO: 157199 - protein, 50 aa, Heterodera glycines
  Coding regions on vcDNA: vcDNA=SeqID_83622; Strand=+; Position=1-154
LQIYWLKLHMRYISRFFDSVRRFDKDGFRFAISRSTFGNWSRIFSAITCN

SEQ ID NO: 157200 - protein, 105 aa, Heterodera glycines
  Coding regions on vcDNA: vcDNA=SeqID_83623; Strand=+; Position=1 -123,360-554
MTPPSFYGCANNKNPRKEGKFESENRCFCPEAELYAVECKKVVCNKMNRRNLLIEKCWMAIGFIVRKVLPTNLLLLVAPLYPFFARLVCGHGKLWPYWITNLALV

SEQ ID NO: 157201 - protein, 37 aa, Heterodera glycines
  Coding regions on vcDNA: vcDNA=SeqID_83624; Strand=+; Position=1-113
INRAPIFRQKPIFFLSSPWPETHEKHVFFGLLLSYFL

SEQ ID NO: 157202 - protein, 138 aa, Heterodera glycines
  Coding regions on vcDNA: vcDNA=SeqID_83625; Strand=-; Position=1 -67,913-1262
MTKIFIENAKMTTKTQIVRVLWDIILHDDEQLDIINRGSFFGHLTNIVVPFVHRSFVRYFPYVSSTDALHQFVGPHSAVMEHMYVALAHGAEFFLNVVVIGLLEHHFRLAQICVASPFAESVAKAPAELFLNGKQNIK

SEQ ID NO: 157203 - protein, 47 aa, Heterodera glycines
  Coding regions on vcDNA: vcDNA=SeqID_83626; Strand=+; Position=1-147
KIEFFFQKMIYQKLICKIFKCDSKPILVIFMAFCAYFTFYEEFFSKK

SEQ ID NO: 157204 - protein, 219 aa, Heterodera glycines
  Coding regions on vcDNA: vcDNA=SeqID_83627; Strand=+; Position=1 -232,629-751,821-931,978-1172
  Homolog annotation: Hit_ID=CAE67085.1; Match level="QueryCoverage =89%, HitCoverage=26%, E-value=1e-13, Identity=33%"; Hit description =Hypothetical protein CBG12496 [Caenorhabditis briggsae]
ISMFRKPKSKKVGADIRNIRRRADDSEGEENNSGPRRSPSTWADEMDDYQQQQQQPNIGAESQQHGEGQMTTTAARPVKQEVLPSSEWEKPKQGKMEDSQQQQDGKQQPKFREPTGEKTDDNGATVRAAFPATMTDIPDAKAVYEARKKREMMRQGGLPASQDYIPLDDTISLKSGRQSGERARLVREDENDMSDEEEMGRLKRNGIWRIFLLHHFCIF

SEQ ID NO: 157205 - protein, 145 aa, Heterodera glycines
  Coding regions on vcDNA: vcDNA=SeqID_83628; Strand=+; Position=1 -228,283-492
MEQGSSEEDEAMEEGAKSKSRMGETVRGRYNGKAAAGRQHKLVQYNNGNGEDEEEDDDALQRWEREQIRKGVSSHKVMQMQEQLNATSLNYRGRPLNMLDSGEADMDIEVDILAMDQQQNARGANALPPGVKQKRKQKQTNQMTL

SEQ ID NO: 157206 - protein, 107 aa, Heterodera glycines
  Coding regions on vcDNA: vcDNA=SeqID_83629; Strand=+; Position=1 -185,234-410,749-874
PLHSRLRLLATKTKDLPHQFECCKYEEPSFGCIHLSSPPLFNVRKSLTTSFLSELRTYDVWRCEDGNECASGCCECELGRHWGQWERRVIGGKGNRLAKWRRIYTKL

SEQ ID NO: 157207 - protein, 133 aa, Heterodera glycines
  Coding regions on vcDNA: vcDNA=SeqID_83630; Strand=+; Position=1 -75,125-334,801-868,925-973
  Homolog annotation: Hit_ID=NP_510115.1; Match level="QueryCoverage =99%, HitCoverage=54%, E-value=6e-24, Identity=57%"; Hit description =nuclear Hormone Receptor (nhr-17) [Caenorhabditis elegans] emb|CAA90291.1| Hypothetical protein C02B4.2 [
MNFSYWRAKILSTSIEWAKSFEEIERMDDSDKEAMVVNSAFSILVFSEAFHTPERFTDRIMFPDGLSGFRNFSANIIKERSGLIPTVVAVINNILKVAAFKRETLCTIETFNLMSPHPLTMEISKKYADVSFF

SEQ ID NO: 157208 - protein, 131 aa, Heterodera glycines
  Coding regions on vcDNA: vcDNA=SeqID_83631; Strand=-; Position=1 -139,1544-1753,1846-1892
MPKAAKSNAVLNRHWISKFPEGTYSTDGKINPGLYKLIDIAKIFIGELGNRARDRINSAGILNRSRDQYHYFGTGPGKDYRCRDFEHQIRIRIWEIFKDVLFSGNPSFTGNLKTILGCGIGANEIVVIPLS

SEQ ID NO: 157209 - protein, 93 aa, Heterodera glycines
  Coding regions on vcDNA: vcDNA=SeqID_83632; Strand=+; Position=1 -96,418-603
MENAEIKSQRKNKKLEHEGCLYVFHLFNADGDLVKRVRHEIELPPPVPLTLQELELPEQYRIYKRTEEAQELFLLADSGTYTENGRDGQQRCV

SEQ ID NO: 157210 - protein, 62 aa, Heterodera glycines
  Coding regions on vcDNA: vcDNA=SeqID_83633; Strand=+; Position=1-188
AELNIASLKRFEDMELERRKRHQKPTKRLALDGPRVRELWTRDGKHFITFVPEPPPAEQCFP

SEQ ID NO: 157211 - protein, 28 aa, Heterodera glycines
  Coding regions on vcDNA: vcDNA=SeqID_83634; Strand=-; Position=1 -72,339-353
MTNLIICRRLLPLMFMRSMLNMVKVKAS

SEQ ID NO: 157212 - protein, 172 aa, Heterodera glycines
  Coding regions on vcDNA: vcDNA=SeqID_83635; Strand=-; Position=1 -193,456-618,854-1015
  Homolog annotation: Hit_ID=CAE67204.1; Match level="QueryCoverage =51%, HitCoverage=30%, E-value=1e-13, Identity=45%"; Hit description =Hypothetical protein CBG12640 [Caenorhabditis briggsae]
MDCFQAVLPHIAGFMDGISQKSNAPLEGIKKHSTDDRLVQLVVRGLLYEYALTFCQEQAMEGRNAATHCERHFNDLLSHKEKLSSADLSLISWLEMLGSEQFALPFKQKELFLRVNPHKPRFAFQYSFFNLAVQADAIPPKPVAANRCLRALCRPSVPFPSIRHQVDPTWTV

SEQ ID NO: 157213 - protein, 76 aa, Heterodera glycines
  Coding regions on vcDNA: vcDNA=SeqID_83636; Strand=-; Position=1 -51,105-328
  Homolog annotation: Hit_ID=CAE74693.1; Match level="QueryCoverage =92%, HitCoverage=46%, E-value=1e-18, Identity=58%"; Hit description =Hypothetical protein CBG22507 [Caenorhabditis briggsae]
MHVCECNLHRFPQVAAFVRSEMKDQWGGKLKVKQVRGVLPTILLKSGDGQTHKTLSIEKWDTDTMTEFLNGALSLG

SEQ ID NO: 157214 - protein, 47 aa, Heterodera glycines; identical to SEQ ID NO: 127360
  Coding regions on vcDNA: vcDNA=SeqID_83637; Strand=+; Position=1 -272,580-806

SEQ ID NO: 157215 - protein, 159 aa, Heterodera glycines
  misc_feature (95)..(95): Xaa can be any naturally occurring amino acid
  misc_feature (115)..(115): Xaa can be any naturally occurring amino acid
  Coding regions on vcDNA: vcDNA=SeqID_83638; Strand=+; Position=1-1170
  Homolog annotation: Hit_ID=EAA16552.1; Match level="QueryCoverage =59%, HitCoverage=87%, E-value=7e-16, Identity=55%"; Hit description =hypothetical protein [Plasmodium yoelii yoelii]
PKSSSIILPGNIQAKRLFEALLFVHSKLASPPTPTGKGQRRGKTGRKANQTSNTHSVHRTASTDPTTSFLTASIILCILRAGITAAAGTRLALSXYSLKGLNCTHSDDRPHKRSXLVISRHYLLALRVVAISQAPSPESNPYPPLPVITMVVRYTTIES

SEQ ID NO: 157216 - protein, 44 aa, Heterodera glycines
  Coding regions on vcDNA: vcDNA=SeqID_83639; Strand=+; Position=1 -101,176-209
MPKLIILAQNFNNSTKTRGNKFTYISHAPLTPIRFLSFGITQPL

SEQ ID NO: 157217 - protein, 425 aa, Heterodera glycines
  Coding regions on vcDNA: vcDNA=SeqID_83640; Strand=+; Position=1 -58,410-725,1018-1156,1449-2036,2303-2479
MSTARPFYKIEEETGKIVKVSHPLFPTSARHFPSLRSKFLAPTKPHQPHKQLAPPALLHNALPADATHALLIPLIVQAPQQQQQQQVAATAGAVEKASFESSTTTTSSSIIMGRERNVEKPQHERSKCECEEEFVPSKISDEEKFGKNCCERKRDLCDKLTRSMNAKNSMEHFLRNFMAKHGNPAGSDLIDDHLVKHPADRDSFDNLMDRLAEISAKLDNWKHTMRAKFNFHDEPLVVSKNQPSSPQPLPLQQQQQQFPMVSFSSYKKNQNANARNSGAKFEHEISANGTMNINNSTLVDQIIPENNTATTVTTTIGAIITTTVMEETTTSTTKPQIEKIISIQERLKNEFATLLGIVEENDRKNANSYEKNAAKQRALPNVQTEEFGAFKNMNDSQVSKLPDEKNVFSRWLKCKDRSKVLSLCL

SEQ ID NO: 157218 - protein, 167 aa, Heterodera glycines
  misc_feature (3)..(3): Xaa can be any naturally occurring amino acid
  misc_feature (7)..(7): Xaa can be any naturally occurring amino acid
  misc_feature (100)..(100): Xaa can be any naturally occurring amino acid
  misc_feature (155)..(155): Xaa can be any naturally occurring amino acid
  misc_feature (158)..(158): Xaa can be any naturally occurring amino acid
  Coding regions on vcDNA: vcDNA=SeqID_83641; Strand=+; Position=1 -154,252-468,524-555,947-1033
  Homolog annotation: Hit_ID=CAE75515.1; Match level="QueryCoverage =93%, HitCoverage=48%, E-value=3e-40, Identity=52%"; Hit description =Hypothetical protein CBG23530 [Caenorhabditis briggsae]
QKXAIAXNMKFMLLLLLLVFCALAHMGDAFGFGGMQMCCPPPCPPPCPPPCGGGGGGGGGCGGGGGGGPPIIINCGGGGQSGGGGCGGRAIHNFSGIPIXFKLYLNYLGGCGGGGGGCGGGGGGCGGGGGGCNGGCGGGGGGCNGGGGGCGGCGXNSXNDCTRRRMH

SEQ ID NO: 157219 - protein, 44 aa, Heterodera glycines
  Coding regions on vcDNA: vcDNA=SeqID_83642; Strand=+; Position=1-136
KIRPNFDEIFGEEWDKNENEENAIKIEQKEENSEENGTESIKQT

SEQ ID NO: 157220 - protein, 128 aa, Heterodera glycines; identical to SEQ ID NO: 129962
  Coding regions on vcDNA: vcDNA=SeqID_83643; Strand=+; Position=1 -289,381-478
  Homolog annotation: Hit_ID=NP_035604.1; Match level="QueryCoverage =53%, HitCoverage=88%, E-value=4e-20, Identity=62%"; Hit description =small proline-rich protein 2H [Mus musculus] gb|AAN86829.1| SPRR2H [Mus musculus] sp|O70559|SP2H_MOUSE Sm

SEQ ID NO: 157221 - protein, 93 aa, Heterodera glycines
  Coding regions on vcDNA: vcDNA=SeqID_83644; Strand=+; Position=1 -172,306-415
MHSNFRIGEKWDKNETEEKRIEIEKNNTSLSPVDSGEEMGTDPIDQTSKYSNQNVIKTQIQYSNENKIKKMKHKINFYDSFMKELLNMFFSNY

SEQ ID NO: 157222 - protein, 100 aa, Heterodera glycines
  Coding regions on vcDNA: vcDNA=SeqID_83645; Strand=-; Position=1 -125,164-341
MFIVPNLFHEDPIKCWTITMFVAILTVNVSAASNGPVLYVTSTEYRKAFVHEFGLIRRFFCFPNNASSSANQLQANHLPINVVKVTPILSPKTKVVTTAF

SEQ ID NO: 157223 - protein, 207 aa, Heterodera glycines
  Coding regions on vcDNA: vcDNA=SeqID_83646; Strand=+; Position=1-624
MDIKYWTQEYWKFLSDLDQLQIPKEIDSDNSIPDYAKLLIKQLHSLLSTASVLIHSQAAAVDAVEEERRLRTVVVTNVPESKSDKATERAREDRAVVDEILNATDVDQAPIVFRVGKRIDGRPRPLKMEFPSKHAARHVIRMRGKVQALNGLHNVRVRESMTKDQLSERRKLIEECGKKRQADNGDWVIYANQVVLRQDIDHIRKNF

SEQ ID NO: 157224 - protein, 179 aa, Heterodera glycines
  Coding regions on vcDNA: vcDNA=SeqID_83647; Strand=+; Position=1 -302,894-1129
  Homolog annotation: Hit_ID=NP_505981.1; Match level="QueryCoverage =98%, HitCoverage=73%, E-value=2e-29, Identity=34%"; Hit description =COLlagen structural gene (33.2 kD) (col-158) [Caenorhabditis elegans] emb|CAB02874.1| Hypothetical protei
MALEKAAGVAIAMAVCTVLLCVAGIGFVQREVQSIWAELDTEMDRFKLDTDDLWHDMLAMGAGTAANRQRRNAYGGASYQAAGQQAAVGGYGVLVKTVCSKRGQRGSPGMPGRDGIPGLPGEQGHPGENGKEGGTGVTGEKGIDAEKRIGRKGFRGVPGEHGPEGPLGEPGKPGPVGPK

SEQ ID NO: 157225 - protein, 177 aa, Heterodera glycines
  Coding regions on vcDNA: vcDNA=SeqID_83648; Strand=-; Position=1 -42,89-160,276-383,465-542,729-863,1634-1674
  Homolog annotation: Hit_ID=NP_501399.1; Match level="QueryCoverage =84%, HitCoverage=16%, E-value=2e-40, Identity=52%"; Hit description =vacuolar proton ATPase, Vacuolar proton ATPase VHA-5 (99.3 kD) (vha -5) [Caenorhabditis elegans] gb|AAA816
RHAEIDELLEHLESGEDIKESVFIVFGEDIKESVFIVFYNGERLRHIIDKVCEGFKAKQFNQCPKTSADRQTALQQVHTNIHDMRMVMSQTREVMSQTREHRMRVLNEVAANHRKWLKQVRIHKSIYHTLNTFTFDGIGKFFVAECWVPLSDVNDVRMALETGVWINPAGSRPVKNF

SEQ ID NO: 157226 - protein, 128 aa, Heterodera glycines
  Coding regions on vcDNA: vcDNA=SeqID_83649; Strand=-; Position=1 -117,397-489,547-675,727-774
  Homolog annotation: Hit_ID=CAE58454.1; Match level="QueryCoverage =96%, HitCoverage=17%, E-value=8e-29, Identity=45%"; Hit description =Hypothetical protein CBG01592 [Caenorhabditis briggsae]
MGSLYRSEEMRFCQLIVERDAAFSCVAELGKHPFVQFKDVQIRKENQPIVDNTWGEAVDVMSHGEINEVEQKLIDKERDIISMNDSDQQLKKNFLELKEWQYVLSKTDEFFQGGITDAAVQEMRDKLS

SEQ ID NO: 157227 - protein, 170 aa, Heterodera glycines
  Coding regions on vcDNA: vcDNA=SeqID_83650; Strand=-; Position=1 -96,146-218,527-654,1101-1316
  Homolog annotation: Hit_ID=NP_493982.1; Match level="QueryCoverage =83%, HitCoverage=28%, E-value=6e-35, Identity=50%"; Hit description =solute carrier family 2 member 3 (2B799) [Caenorhabditis elegans] gb|AAK31540.1| Hypothetical protein H17
VERLGRRTLHITGLVGLLLSSAFIAISMLISKSVQWFSYFSILFVLLFVISAAIGPGSIPWFFVNEIFPLNARGNANSIAVLSNWGSNAIVGFFFPMLNSVLDEYVFFVFTALSVLFIAFAAKFMPETKNKSLEDIQAEIDRRRGKMPISRMNNAKAKRAKNGKENCEKV

SEQ ID NO: 157228 - protein, 452 aa, Heterodera glycines
  Coding regions on vcDNA: vcDNA=SeqID_83651; Strand=+; Position=1 -105,148-290,687-791,1061-1126,1177-1241,1790-1888,2036-2095,2140 -2216,2516-2593,2685-2833,2880-3059,3113-3265,3508-3585
  Homolog annotation: Hit_ID=EAA06300.2; Match level="QueryCoverage =63%, HitCoverage=51%, E-value=3e-85, Identity=48%"; Hit description =ENSANGP00000017298 [Anopheles gambiae str. PEST]
DGTNGFWQPWNASDDYSEIKKRLLRPPNDFSELREIIRKDIERMAQIKEENVKKRKGTTKGKKQMTDEQKEAREEEGQEEDEVSNVHLKVSRGPERRISKKALVTVMPGARWPDGKMLPRMFFVNVPDIGRVEQEIRKAEVDAGLAPEHWSNIQWMQPGPIINGTEFVEMIGGLGASRIRQLFKAAKSRAPCIMHGNDEQEHTLNQLLVEMDGMDTAKGIVVIGSTNRPDMLDKVLHLSRADIANVINEAAIHAATIQKKMVDIDDVDYALQKILAGPEKRSKVLVKEEREIVAYHESGHALVGWLLEHTEALLKVTIIPRTSAALGFAQYSPKDRKLFTREELIDRICMMLGGRAAENVTFGRITTGAQNDLEKVTKQAQAMVKMYGMSDVLGPISFTPEPGVDPQSVQFQPKPYSKKLGNIIDQEVSRLVSDAYFVTEKLLRENRNMLEM

SEQ ID NO: 157229 - protein, 104 aa, Heterodera glycines
  Coding regions on vcDNA: vcDNA=SeqID_83652; Strand=+; Position=1 -63,121-372
MGIFKKSEIFYNFFVHYRLLFVSLANLSIALSQVGNDQRNDLQVDNGTVCNLPFLNHPSMPKSPDRFVSLVLMVVSVFVSHKLFVVAFLGFSSVGVKSMGGLNH

SEQ ID NO: 157230 - protein, 19 aa, Heterodera glycines
  Coding regions on vcDNA: vcDNA=SeqID_83653; Strand=-; Position=1 -34,869-894
MIAVCLLLLIADIILNKYL

SEQ ID NO: 157231 - protein, 157 aa, Heterodera glycines
  Coding regions on vcDNA: vcDNA=SeqID_83654; Strand=-; Position=1 -166,440-662,883-967
MPLDKFKTVIQGLGMCEKEVIWKYAKQEDHGRMSLLQKHAPNVHLVEHYDQATVIGNKKTELVISECDIRIVMDALSSGKALLCLPMFAEQFYVSEKLRRMGAAVVLDPRSGSFTPEGISKSIGEALTKRYDVSFPSNESLKQTILNAFKELGLFKN

SEQ ID NO: 157232 - protein, 172 aa, Heterodera glycines
  Coding regions on vcDNA: vcDNA=SeqID_83655; Strand=+; Position=1 -15,92-206,278-663
  Homolog annotation: Hit_ID=AAM50139.1; Match level="QueryCoverage =69%, HitCoverage=14%, E-value=3e-12, Identity=37%"; Hit description =GH07623p [Drosophila melanogaster]
MPPKKKLSEVLPKPVMVTRSATKRETEVPKRQMAIRGAGPPKHPLFPPPAAAASTFSTFTPPTPPPFSTPFHKHVSFLTPSPPPPADDLEYGPAPPPPPATVDLDQIPLPPTPPPATFSVEFWLQPAPPPPAAATVHLDMNPTSSSKAAAADEIEREKKRKKRRGNRWSKTK

SEQ ID NO: 157233 - protein, 257 aa, Heterodera glycines
  Coding regions on vcDNA: vcDNA=SeqID_83656; Strand=+; Position=1 -115,199-596,912-1077,1133-1224
  Homolog annotation: Hit_ID=AAG51656.1; Match level="QueryCoverage =56%, HitCoverage=25%, E-value=2e-14, Identity=37%"; Hit description =hypothetical protein; 92104-88279 [Arabidopsis thaliana] pir||E96636 hypothetical protein T7P1.21 [importe
KLSEVLPKPVMVTRSAAKRATEMPKKQMAIRSGGPPKHPLFPPPVAAAVQLDVGLETPPPPPPPAAAAAASTFTPPTPPPFPTPFHRHFSFLTPSPPPPATVDLDQIPLPPTPPATFSLDFWLPPAPPPPPPAATVHLDMNPTSSSKAAAADEIEREKRGKSGEAIGGAAQRGQESWILSTCNDALEITGEHLEDSAVDAAYDAVYGEPVADHLARKIVMRPKYHDLRRRMVGVNAAPICRQHFAFHTCVTKDQFDK

SEQ ID NO: 157234 - protein, 73 aa, Heterodera glycines
  Coding regions on vcDNA: vcDNA=SeqID_83657; Strand=+; Position=1-222
MAKLTAVNSAKGKFCDGYCYHKHKMTKNKTWWKCELYQQGCKGRGFESNVEFFGIRMHNHPPDQILLQIEIEQ

SEQ ID NO: 157235 - protein, 138 aa, Heterodera glycines
  Coding regions on vcDNA: vcDNA=SeqID_83658; Strand=-; Position=1-415
MNDKTTTGTEIFGIPNTGTQSSSIPVTWTQISGIPNTGTQSSSILIAGTQPSGIPISGTQPSSILITGTQPCGITITGTQPSGIPSTGTQPQQISSAFFTFECFAILNRWGGLGRFAASLPNIYFYARSFAAVPADFV

SEQ ID NO: 157236 - protein, 197 aa, Heterodera glycines
  Coding regions on vcDNA: vcDNA=SeqID_83659; Strand=-; Position=1 -153,701-971,1219-1388
MDLYFTNVQPFLDFPVVEQEIERERQIKKENRVNFIGGITMPKGVVPKLNGDTKQIFKSANSENENGGVVLLSFGSVVEMNDGEAHAVALKNIVVEVFKQYPQMNMIIKWGKRAPIGTGEQYKKLADNVYAKSWLEQSAILDIRSKTLKNDFADAFNEMLTNYTEYKQKMDELSTKMNAVEPEKEFIEKFRQLRKSI

SEQ ID NO: 157237 - protein, 111 aa, Heterodera glycines; identical to SEQ ID NO: 126899
  Coding regions on vcDNA: vcDNA=SeqID_83660; Strand=-; Position=1 -103,150-192,241-326,368-557

SEQ ID NO: 157238 - protein, 76 aa, Heterodera glycines
  Coding regions on vcDNA: vcDNA=SeqID_83661; Strand=+; Position=1-404
PTNSLLTLAEPRPNMAIVVATLDALRSAASAGGRSLGLSLPMALLLLTLLFWHWHRGRRAHRHTFPPGPTPLPLIG

SEQ ID NO: 157239 - protein, 197 aa, Heterodera glycines
  Coding regions on vcDNA: vcDNA=SeqID_83662; Strand=-; Position=1 -159,509-940
  Homolog annotation: Hit_ID=NP_497917.1; Match level="QueryCoverage =59%, HitCoverage=2%, E-value=3e-11, Identity=38%"; Hit description =CaDHerin family member (cdh-4) [Caenorhabditis elegans] emb|CAA84721.1| Hypothetical protein F25F2.2 [Caen
MPGGVEFSIIPASSEQPQQQQQLPFFVRRDTGELIAFAEIDREEQAQYQFRVMAFDPAKNRSAETHVTVHILDVNDNFPQFVEPLPRVIALGRLSPPGTLLARFSAVDMDDGAHGTVRFQISSVAAAATDRVDGDQQHQRHDQQENNEQDDAGPGADGHRLFSMEPDGRLMFRGLPSLLAAEQHHQDGAVQQQQQQQ

SEQ ID NO: 157240 - protein, 37 aa, Heterodera glycines
  Coding regions on vcDNA: vcDNA=SeqID_83663; Strand=+; Position=1 -89,531-555
MDRDGTRDRDSRFKRDSRPGGLSKKTGPGPIFIDVNY

SEQ ID NO: 157241 - protein, 53 aa, Heterodera glycines
  Coding regions on vcDNA: vcDNA=SeqID_83664; Strand=+; Position=1 -106,384-424,526-540
MPICRCHHYLYAKKRIRVCSSVEEADLKKREAYISGEHIEKKNDVKILQLLLS

SEQ ID NO: 157242 - protein, 286 aa, Heterodera glycines
  Coding regions on vcDNA: vcDNA=SeqID_83665; Strand=-; Position=1 -47,103-378,439-862,1037-1150
  Homolog annotation: Hit_ID=AAL78214.1; Match level="QueryCoverage =51%, HitCoverage=77%, E-value=4e-12, Identity=28%"; Hit description =putative esophageal gland cell protein Hgg-20 [Heterodera glycines]
MSDNRKEAEEKMAKSIFISGDGWLSVFDLLEPSQLGLGIALISHRFNFYVDEHLKTRKWTFGIIRIGSKIRENGTNEMEIVNCYRNPLPIAQKPVPKKVVGFKAISIEYIDNNSIAFLHRFCPLFASFCPINLAICTTKHRILAFILRNIWPMIAKNICGMFLFENVFSPLHKFVPSFLNECPSLRIVSFIFDDIFAEFPFDDSAITSDGQAVVKWLFTPLQNAVPKVLICTLDMADENLASKIEAFKAAFASASSPVNFIVVICFIPSSFADPVVPFVLTNGIDP

SEQ ID NO: 157243 - protein, 44 aa, Heterodera glycines
  Coding regions on vcDNA: vcDNA=SeqID_83666; Strand=+; Position=1 -81,329-382
MKELNDEIKEREKEEKDDRKLAYKLAKMSLSVTKNHYFGASSLK

SEQ ID NO: 157244 - protein, 361 aa, Heterodera glycines
  Coding regions on vcDNA: vcDNA=SeqID_83667; Strand=+; Position=1-1083
  Homolog annotation: Hit_ID=NP_502080.1; Match level="QueryCoverage =67%, HitCoverage=45%, E-value=2e-30, Identity=32%"; Hit description =endoplasmin (87.1 kD) (4L887) [Caenorhabditis elegans] emb|CAA92973.1| Hypothetical protein T05E11.3 [Cae
MRTSSTNLHPLRYESYEVLKKHANDIDNRLHYSLQRLDNFTRLNFLVEVERKGKTKMQEGNEEDAYILYSRAMTIYLMMSESIDDKFKRSCGGQLFYETSQRLCVAFDKVAVSLQQRFMEGQGDEPEFCDPVELRWVEIVEKPIPENLHCSKDSNSSDDQDKIRSLSPANATELVATEKFSTKIKADKENHILHIKDKTDRGIGMIRHAVTNNLATVGQSGTSEFISKLFDSSISSKQNQDLVTQSLHLNEEARNFLELDRLKKSEKMEKPVKVSKENKKGEEKSKEVNNEENEYNEFCKSTTKNIDEPLVHVQFFAEFESSFKSIFYVPETLTTDEFQNQNLAFSSGTMKNSREAKKLAA

SEQ ID NO: 157245 - protein, 120 aa, Heterodera glycines
  Coding regions on vcDNA: vcDNA=SeqID_83668; Strand=-; Position=1 -175,1215-1402
MQQMLGSTTGGGSGGSGGTTTTAALDLNIAGGAAGLIDATAMPTFHFSHTHGHHQHVSTPAMLSIVEGLKSSNEIRQSEAASELADILLLGNEVGQTDTLIKRRQIFLAIINGVSTKKNV

SEQ ID NO: 157246 - protein, 34 aa, Heterodera glycines
  Coding regions on vcDNA: vcDNA=SeqID_83669; Strand=+; Position=1 -56,212-260
MRFLNIAIFLPFRHCGYKSDFGIGSEADWELKPE

SEQ ID NO: 157247 - protein, 113 aa, Heterodera glycines
  Coding regions on vcDNA: vcDNA=SeqID_83670; Strand=+; Position=1 -229,903-1015
MVVPLAMVHAAVAPTPQDAVGARVAKAGTAQVGAALATHGQLQRVLTAQCQNGTLSVHAAGEHTPFFAARVADIYSEKCKMLTARGEKVAAAGEEGEGGEEGLLSRSVGNGWL

SEQ ID NO: 157248 - protein, 27 aa, Heterodera glycines
  Coding regions on vcDNA: vcDNA=SeqID_83671; Strand=-; Position=1 -29,114-168
MPKVNVTNSRHPNHIRNCFSLKKAIIF

SEQ ID NO: 157249 - protein, 61 aa, Heterodera glycines
  Coding regions on vcDNA: vcDNA=SeqID_83672; Strand=-; Position=1 -24,61-222
MCTLRAYDYAKFIVCTFARLRCECHFDGAQCGHHCADQDDGPRVLDDKACPLGVQGVDEAD

SEQ ID NO: 157250 - protein, 213 aa, Heterodera glycines
  Coding regions on vcDNA: vcDNA=SeqID_83673; Strand=+; Position=1 -214,923-989,2297-2448,2777-2985
  Homolog annotation: Hit_ID=NP_493603.1; Match level="QueryCoverage =30%, HitCoverage=6%, E-value=4e-13, Identity=50%"; Hit description =PaTched Related (111.8 kD) (ptr-23) [Caenorhabditis elegans] emb|CAB04167.1| Hypothetical protein ZK270.1
DPSSSSSTTGSLSLRSVPSSATAHKQPPPLIRFVHSLYTKWACFIVKNAWAVILVCTVVTTLCTVKVALTPQKNDITGYTPYGARSRHELAIQEGFQLQWDMLVANETLNDAIHLNYPISSILGQKFNIQVGDRHIGTRDVSGIQISSASNFVLPPLPQQQQQQIQQQAVPATQQQHSAAAAVCPSPTCAAWKWWCSLIRRNASARGQTTKSR

SEQ ID NO: 157251 - protein, 115 aa, Heterodera glycines
  Coding regions on vcDNA: vcDNA=SeqID_83674; Strand=-; Position=1-599
HSDQQHLANCNQFCHFSKEHFFNAQGLGHPFGVFVLLLPRRADDNFLRPQMLAEAARVDELVSTRFPLFNHRTNRTENFAQFCRDFCQLNEPMRRFAVREIKIIKLNLKIKIFFI

SEQ ID NO: 157252 - protein, 114 aa, Heterodera glycines
  Coding regions on vcDNA: vcDNA=SeqID_83675; Strand=-; Position=1-345
MSGFGIQDSYRDDPNFLAGIPGPKKCRDSAFEIWTQAGMPFQIFLSGMRDSKMWRFLTHSRNIPGANMPVTDLDVEFLAQNAADWIVEMNGIVQCLIGNQHIPLQLKAFLKCGK

SEQ ID NO: 157253 - protein, 137 aa, Heterodera glycines
  Coding regions on vcDNA: vcDNA=SeqID_83676; Strand=+; Position=1 -167,212-295,347-509
  Homolog annotation: Hit_ID=AAN34361.1; Match level="QueryCoverage =83%, HitCoverage=24%, E-value=9e-17, Identity=37%"; Hit description =putative RNA methylase [Gallus gallus] ref|NP_989699.1| putative RNA methylase [Gallus gallus]
MVGNRGPNSTFSRRRDSREKQKYAMSNVFLDLMDLSARLLRPGGRLAFWFPVCRSEYSERILPRMDCMRLVCNCEQTLAKDSSRRLLVYEKLRRPLTDGQTKPSERAFFELDCYAEKTFHQKVFGSIEKNEAKECAD

SEQ ID NO: 157254 - protein, 228 aa, Heterodera glycines
  Coding regions on vcDNA: vcDNA=SeqID_83677; Strand=-; Position=1 -143,353-489,543-633,690-1005
  Homolog annotation: Hit_ID=CAE74320.1; Match level="QueryCoverage =76%, HitCoverage=48%, E-value=3e-29, Identity=36%"; Hit description =Hypothetical protein CBG22031 [Caenorhabditis briggsae]
MSQGSLSSAPSSQDQLLVKLGRHQLLHWMISNIPDECDGVQTGDELMPSDSLVARSFSTNAFYKQFEDKMSPSALRFCQIKWDKSCDQTLHRLGLKTPRYWYEWNEQMGPEQKEFPMKPMPFHQYLNMFRNPETVRREVQRKRLEKLVKLKPDEKLEPEYPDINYQANWLKKPLFEHQRLMKENSGEGVWAAMYYDYENPMEQHEMEKYQRKMDERRDEESAEEAIGI

SEQ ID NO: 157255 - protein, 84 aa, Heterodera glycines
  Coding regions on vcDNA: vcDNA=SeqID_83678; Strand=-; Position=1 -34,78-185,292-401
MTSADGSNMSEAIMQMVRPAIERMDEQVKNTRKSQLFLANHIDQTSEKLKNLVDEQLLPYDLDAYVRKLDESRKRINGISQKLQ

SEQ ID NO: 157256 - protein, 258 aa, Heterodera glycines
  misc_feature (31)..(31): Xaa can be any naturally occurring amino acid
  Coding regions on vcDNA: vcDNA=SeqID_83679; Strand=-; Position=1 -225,280-434,486-603,653-851
  Homolog annotation: Hit_ID=NP_493623.1; Match level="QueryCoverage =77%, HitCoverage=21%, E-value=4e-31, Identity=40%"; Hit description =PAP/25A-associated domain containing protein family member (90.5 kD) (1P631) [Caenorhabditis elegans] emb
WHLLFLSVPNFLPFSTYIFSSLITPGTIFPXLQLGRLFPFRIDDRFPAICLLVKHWAKVKGISDASGGYLNSYSLILMVLHFLQCGYSLILMVLHFLQCGVDPPVLPNLQQLYPDLFSLRRPFTDLVYFEDLPTPLPEIQQNDIQQNDRTVGELLIAFFDYFNRFDFNRFAISVRRGCVFPRTELPPNTERFTELPPNTERFRLFIEEPFDHQNTARCVTNDDQWMIILDTIGKAAKALSPNSKQAPDLLKLGIRIKP

SEQ ID NO: 157257 - protein, 135 aa, Heterodera glycines
  Coding regions on vcDNA: vcDNA=SeqID_83680; Strand=+; Position=1 -274,591-725
PIQLFVSSLDFREAQLTPNGPMRVCNAILINGEGKTVEVSAWRLQADVLASAMRGYLYIFVNCRAKPPRERTNCWFRLNIDAMSSYMVQVQSNPLAHDQNLVPSGANSHHTDEIVEVFFIQIIIIIIMAFKTILD

SEQ ID NO: 157258 - protein, 245 aa, Heterodera glycines
  Coding regions on vcDNA: vcDNA=SeqID_83681; Strand=+; Position=1 -313,357-781
MPLEEADRPDLVLEALIQHLLDRVLTGHPRPLMVGLQLHPPGFDRPYIIRLRPPEQNNAAALAAAIERLNEQSAAGIDLLSGTMVTKVLAVWPLDPIRADPQRGGGCDLNDEHNVSHNVQSIVRVENPDDRLCLARAVLIGLRDSESRMPNGGGLDALRAYVGHQNQHGPEAVSLLRRTVNPHNKDMYTLRDVEQLQRWLNNAHGIGQTRLVVFEKEHNTGSSSRERREPWFLQLEIFCIKCGTV

SEQ ID NO: 157259 - protein, 46 aa, Heterodera glycines
  Coding regions on vcDNA: vcDNA=SeqID_83682; Strand=-; Position=1 -36,240-344
MCMGRRVDSQKQVYAGLLSYAETVTDSGLRHRYEKDGICQLATDLK

SEQ ID NO: 157260 - protein, 44 aa, Heterodera glycines
  Coding regions on vcDNA: vcDNA=SeqID_83683; Strand=+; Position=1 -92,466-508
MNDYLCIALKNKDRNQGFAIYQLPRLNFKISYLQNYMIILKIKK

SEQ ID NO: 157261 - protein, 397 aa, Heterodera glycines
  Coding regions on vcDNA: vcDNA=SeqID_83684; Strand=+; Position=1 -1105,1680-1768
  Homolog annotation: Hit_ID=CAE73289.1; Match level="QueryCoverage =42%, HitCoverage=20%, E-value=2e-11, Identity=25%"; Hit description =Hypothetical protein CBG20708 [Caenorhabditis briggsae]
MAIYKKCEFGVLSGEIGQIHTNKKLIIEQSWWKIGFQKTESENCFLSKISLFGTPGSEIIHSPVDDTKNCKYSDGQCQLENGVYLLWEIKKNIKNLFDEKTCVYKKETKINGTYVPGIWMSNDNNRALVFDQNSKRVESCGEKLRVSAQGFAIIEEQFKELMKNEQNSLDKNTRNGIKRFKRWNTAFSSEIENAPLDGEVRASQLAMQLQAGAFYQNKEIKNSFHKLIEMVCKTLDDNIFNGYSHLNPSLFIRQKTGQAFLEGRWISDEILEFWGCSAINFSFVPSLDGKCYEFIPLNFSLDHTEKLLIGFLDPMTMIVKENSEIQTCNEGQFKTLLLNNKLIKINQLTGKYTFIGEPTIYKIDQKIWAFAFAITLFIYGKVVGDKKKKSDREFHRV

SEQ ID NO: 157262 - protein, 99 aa, Heterodera glycines
  Coding regions on vcDNA: vcDNA=SeqID_83685; Strand=+; Position=1-297
MPINPTNVIRLLQEHYLNKAPPPTPLTAEEKLLAEDFLKTLEFGAKQGVELEISDELVFDEFSTVHQREDLHIQTKNLTLTLNVKLKVMTVANFSHRQQ

SEQ ID NO: 157263 - protein, 65 aa, Heterodera glycines
  Coding regions on vcDNA: vcDNA=SeqID_83686; Strand=-; Position=1 -43,269-423
MSWQTMEGTERQIRDLLTTCTIVHVSEFGIAADDDRRQCCDSAETELAKAYDAYMQVCCILQVFF

SEQ ID NO: 157264 - protein, 92 aa, Heterodera glycines
  Coding regions on vcDNA: vcDNA=SeqID_83687; Strand=-; Position=1 -97,257-337,1226-1324
RANWALHSTCQLWQQLVDDAKEEARQRSIGADCREIGVLAQSEVVRVLHELHTAMKTYQCTDLGMDWWLSLLLQNMITARKSACQVEMNGTM

SEQ ID NO: 157265 - protein, 26 aa, Heterodera glycines
  Coding regions on vcDNA: vcDNA=SeqID_83688; Strand=+; Position=1-78
MDAVKIFGEFFREDKFLCQSIWICAI

SEQ ID NO: 157266 - protein, 108 aa, Heterodera glycines
  Coding regions on vcDNA: vcDNA=SeqID_83689; Strand=+; Position=1 -120,1697-1903
MANWKGVLIAAFSIRILLLQNFICDAATEKWVVNHNEKGSIIKLKMVLSDLSNAVNNGGTLSLQELRRRRRTAIVVLAPDLAARQRQLWRERHRSSNAIEQQDVIELD

SEQ ID NO: 157267 - protein, 170 aa, Heterodera glycines
  Coding regions on vcDNA: vcDNA=SeqID_83690; Strand=+; Position=1 -30,246-479,734-835,1185-1331
MFYFIFTRLIARESEYSYKVLKPLDKFPVLMRRFSSEGLPFTTIDPYTANLYFKLDETSEGPGSPNRLLKFQVLVLLAKSSIPDKARHKVLLCQRLNSKGAKSVMLEDYGVDHFRAVSDPANEYVMIEVGFVRNFADPPFYELGAVCATMKNLLGFLTSYVDSKFPCPLK

SEQ ID NO: 157268 - protein, 170 aa, Heterodera glycines
  Coding regions on vcDNA: vcDNA=SeqID_83691; Strand=+; Position=1 -30,249-482,739-840,1189-1335
MFYFIFTRLIARESEYSYKVLKPLDKFPVLMRRFSSEGLPFTTIDPYIANSYFKLDETSEGPGSPNRLLKFQVLVLLDKSSIPDKARHKVLLCQRLNSKGAKSVMLEDYGVDHFRAVSDPANEYVMIEVGFVRNFADPPFYELGAVCATMKNLLGFLTSYVDSKFPCPLK

SEQ ID NO: 157269 - protein, 504 aa, Heterodera glycines
  Coding regions on vcDNA: vcDNA=SeqID_83692; Strand=-; Position=1-1515
  Homolog annotation: Hit_ID=NP_494149.1; Match level="QueryCoverage =76%, HitCoverage=25%, E-value=2e-44, Identity=30%"; Hit description =predicted CDS, putative protein of ancient origin (2C297) [Caenorhabditis elegans] gb|AAF39854.1| Hypothe
MVRNKQKFLSDIPCSSSALQCNDGLKAPEKSGKVVIEPVQSSGNQKRNETFFKRTKKNDSDMLINLDEIDDFIDISYNTNILSKSYMAERKLKQRKMMSITENRIEEEREANRKRISQKRAQLTEEEVESERKANRISYTLKKIHMINEELEYARESHSQNVEISRKRSKMDYDQLYGIAAKPKKAIFYELGPFKIFCSKCSSLHFPEESLRQNQNDENSFANCCKGGKLLNLDEKIEQYPEELKILFDTEHPYYKNFITNIRRYNSAFACASISCFKFKFPTPGPPCYKIQGQIYHRFNSNAIPLSEHEIPTNGQLYFIDSDEATDIRCGMNEGCNVNIMKYIDAFIRKNNKFAQSYKLMKTVYEQEKEKCQNEGNKIPQIKLLFSLKENCDQRRYNLPHINEVCAIMVCDANDDIPPAKIVVYPKGEKKLKEIYPLDKCVEPMCYPLLYPVSNEGFNYEVKDLNGKKISLCDYTKFLLFIKENGKFMPHFHAKKLFQQWVVD

SEQ ID NO: 157270 - protein, 35 aa, Heterodera glycines
  Coding regions on vcDNA: vcDNA=SeqID_83693; Strand=+; Position=1 -45,419-481
MECQFRAQYPPWLVTVNRGQIGLSNDSKITLFCSF

SEQ ID NO: 157271 - protein, 40 aa, Heterodera glycines
  Coding regions on vcDNA: vcDNA=SeqID_83694; Strand=+; Position=1 -83,149-188
MAEWSKALDSSDDWLARYAGSSSGRMPANLRELLIIGYIN

SEQ ID NO: 157272 - protein, 118 aa, Heterodera glycines
  Coding regions on vcDNA: vcDNA=SeqID_83695; Strand=-; Position=1 -122,283-388,444-572
MENYDQKTSQFGDQQHFDADAYVSALAVLSLPVLLDTSLLFYTDLLSLTLLALALSLSDRPFPMFSVFALALFVRQTNIVWLFFSAFPIVWHSLRSFLQGQMSLYQTAIFLVNIHIHG

SEQ ID NO: 157273 - protein, 149 aa, Heterodera glycines
  Coding regions on vcDNA: vcDNA=SeqID_83696; Strand=+; Position=1 -65,297-386,549-748,1125-1219
MNNPPCKAIVLLDPEMIMCCRIKLDQLRAVFVAASRNSVRILLHQMITDKLIEVGVKAKPYMTLLDEFVAAGAVERMEPHQCDKSGLVLRELLACSIEMAARERRNHGNPKLRVLFLSAMIGPKSDDATKLGNSQIELVNAGQFVEQFK

SEQ ID NO: 157274 - protein, 72 aa, Heterodera glycines
  Coding regions on vcDNA: vcDNA=SeqID_83697; Strand=-; Position=1 -57,263-424
MSGFRTFIFGIRSNPWPIQAFLNAHSPVSYTKNGWTLLLAVEEGPIWWDKSNWTESERAVRGLSRNYLNETN

SEQ ID NO: 157275 - protein, 85 aa, Heterodera glycines
  Coding regions on vcDNA: vcDNA=SeqID_83698; Strand=-; Position=1 -172,343-428
MPKILFTIIAFVNISQILFATAMYNGEDICGKTKEDCQAALIAFMNGRGNNQNYHPSENGPRKVDNEWCIWVQSYVTSGAPRSKW

SEQ ID NO: 157276 - protein, 317 aa, Heterodera glycines
  Coding regions on vcDNA: vcDNA=SeqID_83699; Strand=-; Position=1 -169,214-845,920-1072
MDAMEISSQSAVSSGELSFSNGLLPPPPAPPPILDGTDCEASSFIVPPPPPPPPLHEENASFLLQSSSLNQNHFKSSPPSQIMAKVSPPNIQSSPHPNPIRSSENLNTYAFITDQEHFPAVVRQFKRHSRRSKINRGKQFPLRFPKPTKASSRKGNVGERIGPHQKMVATTSTMDTTRPVPLLSLNLTEPTPETALRKTDEMPNNTVGTSVPRQQQTNCVKKVNDNDSQQPKPSREVPIMVDLEFIRNTPPPPIPDIIKRRTTSDNRVAAMRMIPPQILITSQPPKIPPQPLLRMDLPTPPIFLKGRPPPTFRQPNF

SEQ ID NO: 157277 - protein, 300 aa, Heterodera glycines
  Coding regions on vcDNA: vcDNA=SeqID_83700; Strand=-; Position=1 -153,205-338,386-501,561-826,871-1101
MISRKSFTQKQIQVTTQKTKKETAETQQQNGNETARKKTDTEGQNDGKRQKKPTSLLKRKTNTTDELEQTNERKQKLMPKGQIEKMVQNQSKTEEKKFNNKPATIEQQTINGVNPLDTILDEIEAFDTANKKKKVESEEDEADNAPCSSRQLPPTPMPGSYRSLNRMELARQDQDHGMVHTFLERNDLMQRILAYKMLKGRVESYSTIRIKIDLDNCTIPDYELSPTEFDMDFPAMPSAATIDDVAVGTKPEVNSSETPEQSALKRGPMTPPGSPGTNLSSAPEAEAKPTGSILPNRNIV

SEQ ID NO: 157278 - protein, 66 aa, Heterodera glycines
  Coding regions on vcDNA: vcDNA=SeqID_83701; Strand=+; Position=1 -196,323-327
MSGYVVSFAYSVENYGPRELCEILIEDVEGMKHDLRAMVNCSKGGGERIVDGIDAKLDRKTAIAED

SEQ ID NO: 157279 - protein, 27 aa, Heterodera glycines
  Coding regions on vcDNA: vcDNA=SeqID_83702; Strand=+; Position=1-83
MNNVRTKSLVEHAEAKGIDTNTIILAI

SEQ ID NO: 157280 - protein, 117 aa, Heterodera glycines
  Coding regions on vcDNA: vcDNA=SeqID_83703; Strand=+; Position=1 -73,183-326,377-513
MAASDVFEAMFRFDSANATTSTSKPPLDLASSSNPVVVSDVDADVFRAMLGFIYADDLSGMNGDNLFDVLYAAKKYNIAGLVKACAEFPISELGNVFHTLDEARLFGEKVTFSRNTN

SEQ ID NO: 157281 - protein, 65 aa, Heterodera glycines
  Coding regions on vcDNA: vcDNA=SeqID_83704; Strand=+; Position=1-197
MDGDGFGSFQKRALDSLEGDDFMGLKKKKALTTADGDGFTDLGKRALDVLDGDDFVGFKKRSEMQ

SEQ ID NO: 157282 - protein, 35 aa, Heterodera glycines
  Coding regions on vcDNA: vcDNA=SeqID_83705; Strand=+; Position=1 -80,1618-1645
MFYLFWCEHATFDQVGNLDSHPWAKAKSPTLMELS

SEQ ID NO: 157283 - protein, 36 aa, Heterodera glycines
  Coding regions on vcDNA: vcDNA=SeqID_83706; Strand=-; Position=1-147
  Homolog annotation: Hit_ID=CAE65236.1; Match level="QueryCoverage =100%, HitCoverage=22%, E-value=9e-12, Identity=83%"; Hit description= Hypothetical protein CBG10119 [Caenorhabditis briggsae]
RNVPKFGIAHAFSLGLGPWMAVEIPDLIERGVLTPK

SEQ ID NO: 157284 - protein, 154 aa, Heterodera glycines
  Coding regions on vcDNA: vcDNA=SeqID_83707; Strand=+; Position=1-463
RVIAEVDLTISTGGITLSGPRLSVPRFIPFEENGRCRACKGTEAEVDTMVTKEGITLWCTRIEKAQFVPFDVVYELPGHCFFRVKNKARVFSVPYSELSSSDKCVQPLPPPPPPPKPQRTPDDEEEKNLRRKAKVALDLVEAGLMADAMMQDGT

SEQ ID NO: 157285 - protein, 68 aa, Heterodera glycines
  Coding regions on vcDNA: vcDNA=SeqID_83708; Strand=+; Position=1 -43,136-299
MNKQKNAGGWVKNDEPGNFKFADPAAGLVLKILCGTGSRGINPANPAFKICGIPRGIAGFWKIRKNFN

SEQ ID NO: 157286 - protein, 20 aa, Heterodera glycines
  Coding regions on vcDNA: vcDNA=SeqID_83709; Strand=+; Position=1 -51,279-290
MPITLKKRKNGEENSFFKSE

SEQ ID NO: 157287 - protein, 301 aa, Heterodera glycines
  Coding regions on vcDNA: vcDNA=SeqID_83710; Strand=-; Position=1-912
  Homolog annotation: Hit_ID=CAD26968.1; Match level="QueryCoverage =97%, HitCoverage=97%, E-value=2e-48, Identity=33%"; Hit description =transposase [Meloidogyne chitwoodi]
IRRIGTFAHKLLHQQFKKGEKAAPAARKVNEFLGADVISPRQAQKWFQQFRAGRNSTTQRHPESSCAELSVGCHKTTTWRWLRKSGRRPMRSKWVAHRPTDQQKQRRLNLCLSNIARHRRGYVLNRLVTCDESYICYDGTAQKIVWRKKEEDPILVPRLNLHQKKRMLCIFWSVHGPLYWELLAPGTILDSNRYINQLRAVDIAYRSGARANTQYISQTLNWNLLPHPPYSPDLAPSDYHLFLSLKNFLRGRRFTEDAEVEEAVGQYLTSKIGTDFFRRGIRKLPSRWRKVVRVQGNYFVE

SEQ ID NO: 157288 - protein, 183 aa, Heterodera glycines
  Coding regions on vcDNA: vcDNA=SeqID_83711; Strand=+; Position=1-554
  Homolog annotation: Hit_ID=NP_741698.1; Match level="QueryCoverage =96%, HitCoverage=42%, E-value=9e-17, Identity=33%"; Hit description =putative protein (80.3 kD) (5T676) [Caenorhabditis elegans] emb|CAC51077.1| Hypothetical protein Y39B6A.1
EKLTKTKDDDNSWSSSSLYSSSSSPSASKSSSSEAMEETKKEKSKTKRKKKNGRKRKHKQKTKKESAVEKKEKRGNNDDDDDGSAASSGSSSSSSSSSADSDELDDKKKNKQLAKVKEEQKQGSKGKNKAKRKQKKGEKKGKKDYEDKGEEEESHSSSSSSSSSSEEPKREEKKKRRKRKRSH

SEQ ID NO: 157289 - protein, 174 aa, Heterodera glycines
  Coding regions on vcDNA: vcDNA=SeqID_83712; Strand=+; Position=1 -34,116-246,300-475,534-717
MSEFKKCDCENKCEILSFVTKRGFFSLPQKISSFSYKNGAAPLHIKIQSPTAGEKVFVGYFTAADGAIRCVAVKLVNRTEAASSLFKNSIRLMDKIYEKFEKEQRKHLVEIIDTGYTTPYMEGIVIMELGDESLRQRLKSGRHPALGANDRDLMSAVEKLAQPLVEFHESPALI

SEQ ID NO: 157290 - protein, 272 aa, Heterodera glycines
  Coding regions on vcDNA: vcDNA=SeqID_83713; Strand=+; Position=1 -189,370-468,584-784,920-1249
MDVNPRNYLYVSENGNLLLKLIDFEGSQLLRNKLDKNECVPIGEHAFTPEYTGPEYYGEHGREISTKFDIWSVGIIVFEILLGHLRAEQGKGPMEEDEQKSMLFAIGNLFLGFTRNNLFRSPGEFKNMPIDYSKREWFEQNTNAMETVLQLWQKFPKTALLVTNMLNVDRKTRLTAKGILNYIKGSCQIGEFREVKSSKDLRIFNSVKFGEFLNKLRIIKLKNKAKCLIEKYRELNGTYKKIKIMVKKVIEEQQMEIEEKKNPEKLDDCETN

SEQ ID NO: 157291 - protein, 150 aa, Heterodera glycines
  Coding regions on vcDNA: vcDNA=SeqID_83714; Strand=-; Position=1 -287,328-493
MASHSDEYEIDEFWLDNIAYDDGEPRPKSKKCEIIAGIDLQSPRQRREWAESRIFRQYYDIILDGNGNLTNYVICKSCVPPAKPVTFNYAGFHNLRRHLENWHGIKFGTNDKYDKMELALVEFCVADGRPFSIIKGEGFKHFMDAYAELM

SEQ ID NO: 157292 - protein, 244 aa, Heterodera glycines
  Coding regions on vcDNA: vcDNA=SeqID_83715; Strand=+; Position=1-735
MHVDFDPLGVDWTPMFTCAQNDAIVHSGPADAGHGLNSITTPMGTAEAAAAAHNYLMIGGGHTTYPVFSGLPYQRGAGLGSMFRSFLRFLLPIGRQAGAAIGRQGLESGARVLSNVLDGQNLKESLVSEGRTGLKNLLDKAADTVAKSRQNGGGNFDFKRYRQNAAELKEGIKSGKKGLFSTMGPPTAPAKQHKKELQTLERILRRQQPGSTPRKRSRTVKTPANSDDKKRPRRAPRFDTLGAY

SEQ ID NO: 157293 - protein, 222 aa, Heterodera glycines
  Coding regions on vcDNA: vcDNA=SeqID_83716; Strand=+; Position=1 -114,660-795,1346-1579,2096-2141,2220-2358
  Homolog annotation: Hit_ID=AAA19072.1; Match level="QueryCoverage =92%, HitCoverage=33%, E-value=9e-26, Identity=38%"; Hit description =Hypothetical protein F42A10.1 [Caenorhabditis elegans] ref|NP _498339.1| ABC transporter protein (80.3 kD)
MREKLTLQQREYEAQQQLRQHIQEFIDKFRYNAKRASMTGAATRRVRLGRGVPLQRLRQVGQPGAAAGRSGLPLLQGNAVHFPEGLHRFSLRLAHLHCGRKRGRQNDAAQTVAGRPQPHQWHTECQPSAEHWLLHAAPRGPIGLGRLTAGTARPTLSRPWPGGQKSRLAFTCLSLQQPNYLVMDEPTNHLDIETVDALGKALNDFKVRYFTSLKFFNQNLTI

SEQ ID NO: 157294 - protein, 96 aa, Heterodera glycines
  Coding regions on vcDNA: vcDNA=SeqID_83717; Strand=+; Position=1 -153,554-691
MFLKFNSIICAFAFIIRNYGFFVHGGSMGFNSMCESTIYSKQFENLKAQSYTFFIGNYFNGALVTAPNTINGLYSGVNKNGIYCIGNASSKTENLF

SEQ ID NO: 157295 - protein, 134 aa, Heterodera glycines
  Coding regions on vcDNA: vcDNA=SeqID_83718; Strand=-; Position=1 -86,266-386,516-608,883-985
  Homolog annotation: Hit_ID=CAE63782.1; Match level="QueryCoverage =99%, HitCoverage=35%, E-value=7e-49, Identity=66%"; Hit description =Hypothetical protein CBG08323 [Caenorhabditis briggsae]
EHKLCHKDDSSNINEYNPWPLYQFSGTLRPAPQSARRAVPEHIPRPDYALHPEGVSLEERNARNSGQIRVLNEEEQLGMRLAAKLGREVLDEAARAIEPGVTTDEIDRVVHEACIERECYPNPLGYYKFPKSCC

SEQ ID NO: 157296 - protein, 121 aa, Heterodera glycines
  Coding regions on vcDNA: vcDNA=SeqID_83719; Strand=+; Position=1 -165,322-522
MPTVPPPTDTFKKETFEAIIPEKSVNDRPLQLFNPGSAAQLISEISALPSEGRPREPTPFVVATTPSFFRPNQQFQRFGQNSGGLQRIIAFHRSKHVQLAVTRLRLAIAYNGSNFVRQIRG

SEQ ID NO: 157297 - protein, 29 aa, Heterodera glycines
  Coding regions on vcDNA: vcDNA=SeqID_83720; Strand=+; Position=1-131
MNRPLWVSDSLSLSPPPTLQSLFPFSLSL

SEQ ID NO: 157298 - protein, 45 aa, Heterodera glycines; identical to SEQ ID NO: 124814
  Coding regions on vcDNA: vcDNA=SeqID_83721; Strand=+; Position=1-438

SEQ ID NO: 157299 - protein, 1934 aa, Heterodera glycines
  Coding regions on vcDNA: vcDNA=SeqID_83722; Strand=-; Position=1-5802
  Homolog annotation: Hit_ID=NP_920205.1; Match level="QueryCoverage =74%, HitCoverage=92%, E-value=1e-140, Identity=29%"; Hit description= putative DNA helicase homolog [Oryza sativa (japonica cultivar -group)] gb|AAP52492.1| putative DNA helic
MPSKKKKERAARRGRNDFAAETTPINQMSILAISTPQSCLSTFSQLSSASPIVRPRKRLYNATATPSSNSTLIHTNSCSETPKRNRGRPKKRTRIAGPGRGHRSSSSSCHNTPAPVSNLQALPPNEEMPHTESNSEPLMIEEGPLMSSDGHVAQPELFASRNELLNLWNNQNEMCDDRVIYAYMRYLASINNDKRVAVVAPSYTDPNVHYGPGAIHLELNDHCYNHSVDYDVLLVPVVFPGHFTLMIFDRSNREELRCWFIDSLPPTRNLTADFNNRLNDSRFPGFDQNRIILLNQIICQLTQGLEPSAFEIQILPPNQYTYQLDGINCGFFTILYAESYLMNNRCLFLPNLDINTERKRIISQLAKLLLSDTVEYFPRNTNGQQNLGQRNIFLRGAQIPHQRCSTPIMETHFNSREPSTNSVSSSRRSSRIASHQSSRESSIVDESTTISINQLTRRCHVRHKGIPCADIRANHYQPYYDSGNIGDKICAFCKAKLFNSEATAKHGKTSSAICCNFGKICLPKLSDLPAELYALSTENSAEAKEFRKNQNAYNSLLAFASVSVGYKENSVGGDVCFMLNGMFVRRISSLFSGQMAPNFAQLFVLDPEQALEHRKKNTRYGGDRVNPNTLKKLDAILRQHHPLANQLMNFHQQYQSKLAEGGPDAVHNFRLTLLEARMAPTGIRDPNLHPRQTNLPTEGTLFAVWTESDRPPMERGIWITTEQGQLQQFPPYHPSTDTLCYPLVFPSGDDGYHKKLYKSTLHIEERHNEQREGETILDIDVDVESNYESTNDTESQSDRTSLASHESDGEVRPFRKMSLREYVRYRLAIRVDETYHHIWIVAGGLSQKIVLDYAARIDADVAEYLRRPEFDLRGTMPEHLLRWFARNAGLTSPEEIGSIVLFRKTQPGTLAYFQNKYYDATTIMARIRKPDRACFMLTWTCNPRWPEIKRNFMRADQKMVDRFDILCRVYEDKRRHLHHLLEDKKILGTQIGYGEGREFQKRIGGPHLHRLFQSDILAIPECVENLIWAHIPAEPNAQDQSSWANFIRKVRNLLPKYQFHDCGIHCQNARGRCSKGFPKPFSKFTILFDDKPAVYKRLQPTDGGETLTVKRGLSEITYDNSRVIPYNPFILVLYETHHNLEFAYGKSTNMKYPLKYPLKGPSYSYIRSEHTNKTNIDEPASYARVLYRSPVEAFSRIMSYRYTFMSHTVMALSIHLPGQQKMYLRPGQNAQELAQQILAGQMELPVTPLSAYWQQWRNDPALKNILFENMPEKYYFDKQKKVWKPRIRNAQRKQILGRIYPILPRSHEKFALFILTKHFAGDPEHLKLVNGHQCESFLEAARLRGLIKDSNVWIRTLQEGANYLNPAQMRQLFASILLFGNTEDCLIDALALWNQFLPHMYDIRCSDAERPIRIDQALALLERLLVRQGKTCEDFGLPAPMNSIVNDPTRGVNDFFFPGHLADDDVDETVDTRQFDSARMNPEQEKFFQMVRKIASTRPTTAENRLFFLSGDGGTGKTFLLNYLLYQLRRIGKKVIATASTGMASTRFYAGGTTVHSAFRLGIQVEAGKIPSIPMESYFGRRIIEAEVIIIDEITMLEKTVLENVDLLCRQMVPRFGQLPFAGKVVILSGDWKQSLPVVTEAYGTEPQVAACIQSSPLYQLFTKIRLVQNMRVNSQDIEFIEWLKKVGTGAFGDTVPIPKEWVVYSRDEVVSSVFDQGFLQPANEMLKRLMLATTNRIVDMNNDAILRNINSDYTDYFSDDRPIDANPMALNAADQDVAHLNLLNPAGIPAHHLRLKVGSIIVLLINLNTAKSLCNGTRLIVKKLTDYLIVAEAITGATAQSGIEVAIPKVAATYKDKQPNGVNFERFQFPVRVAFTMTVTKAQGQTCERLGIDFTEEAFAHGQTYTAFSRATSSDSIRVYAPNKPVDADGNVL

SEQ ID NO: 157300 - protein, 99 aa, Heterodera glycines
  Coding regions on vcDNA: vcDNA=SeqID_83723; Strand=-; Position=1 -33,691-957
MMTGRDLINGTAFLRATTSVSYNMRITFYKKTRPIPFELVNERTNEKLTLTKEKECGDEICDFLMKRCPIIEETAALQWENDENLDHLNGVFFRHTIIR

SEQ ID NO: 157301 - protein, 518 aa, Heterodera glycines
  Coding regions on vcDNA: vcDNA=SeqID_83724; Strand=+; Position=1-1557
  Homolog annotation: Hit_ID=XP_378156.2; Match level="QueryCoverage =99%, HitCoverage=89%, E-value=5e-17, Identity=18%"; Hit description =PREDICTED: similar to trophinin; melanoma antigen, family D, 3; trophinin-2; magphinin-alpha; magphinin-g
MALHFTQWHSITANGTSFLSMALHFTQWHSILASGTLLHSIALHFCQWHFTSLNGTQFQRVALYFTQWHFISVNGTSFHSMALNYSEWHFTSLNDTSFQSVALHFTQWHFISLNGTSFLSMVLHFTQWHFTSLNGTSFLSMALHFTQWHSMSASGTLLHSMALHFCQWHFTSWNGTSLHSMALHFCQWHFTSLNGTSLHSMALHFCQWHFFTQWHSISASGTLLHSMTLHFCQWHFTSWNGTSLHSMALHFTKWHFISLNGTSFHSMALNYSEWHFISLNGTQLQRMALHFTQWHSITANGTSFLSMALHFTQWHSILASGTLLHSIALHFCQWHFTSLNGTQFQRVALYFTQWHFISVNGTSLHGMALHFTQLHFISVNGTSLHSMALHFTQWHFISVNALHFTQWHFISVNGTSFHSMALNYSEWHFTSLNGTSFQSMALHFTQCHFISLNGTSSLSMALHFTQWHSISASGTLLHSMALHFCQWHFTSLNDTSFLSMALHFMEWHFTSLNVTSLH

SEQ ID NO: 157302 - protein, 102 aa, Heterodera glycines
  Coding regions on vcDNA: vcDNA=SeqID_83725; Strand=+; Position=1 -221,741-828
MKGHRPHQTDYLAGPSDRCDTRRAQEGTWFHPSRPQPWIPAQKDQWKANAHAHPTGKKTQYQAGLHGFHGWPPGHKQEKTAHVMSEHLFLQGNKWKNTNAHV

SEQ ID NO: 157303 - protein, 52 aa, Heterodera glycines
  Coding regions on vcDNA: vcDNA=SeqID_83726; Strand=-; Position=1-267
NAQKNNVTPSGSEPAPSPLKMMPQNPQSHRDSEVLSMLKVKSDHVFVISVIK

SEQ ID NO: 157304 - protein, 2758 aa, Heterodera glycines
  Coding regions on vcDNA: vcDNA=SeqID_83727; Strand=-; Position=1 -7761,8053-8565
  Homolog annotation: Hit_ID=NP_508324.1; Match level="QueryCoverage =72%, HitCoverage=71%, E-value=1e-148, Identity=28%"; Hit description= predicted CDS, peptidase family A16 and RNA-directed DNA polymerase and Integrase, catalytic domain and
MSELLRISIAPMVVRLKMYIETAQENLGKELADQSVRADLIAERQNLCKTISLLEKYNGKWEAIFLRVKGQALQDEEQNYRDFKPEGKAFMHWVDQARGLVDTIEGALGLSELGDAIPQPNQPAQVVQQAPVVHQRHDVTLPPITLPKFSGEPREWPLFWKLFETSVESLQIEDFKKHIYLLGCLPEKSVARRAIDLYPPSDENYPRVVEILKKRFGDEKTMVESLQAELLHLAKPAESVQSLRQFSESIERICHQLLDYGENEQNKFMASTIKSKLPYHLLTQVVEKEMRAGGAFNCTELRRAITSIVEVKEEVQRCTQVFRGEEKPRNFPPHPNGGRANQGRGTPFRFSQPFRQERQWRPMERNEPVRRMSPQPNRSFSAINKPQTPISDRGSKRLCSLCETKGHAPSRCTKYTTPGARRKRLTDQDRCINCLMMGHNTKNCTSPRRCSHCGERHHFMVCFGEKSREGTSRGQPNNQMKREARKSSQSHLTMSKHAHKSVPSSECSPITTNVMTSVMAKKPHAFLMTRKILVRSKNNRRVWMEVPFLFDPGSQTSYASDPLIERLKPPKVTSEEMEVYGFGGERNGPMRFHSPVYSIQIRRTDGKWEEILLNRTERISTPFKMAEWNSEEFPLKGMDMADAMSFSREEPEILIGARHFWQFFQGKEEVSPGLFVIQTTLGPLVNGESDFGPELPNPGLSMMAIDESNQGQMPTVKEIEYFFNLESLGIKDDPNENDDQTAMSLFNKSIRREKDGRYSVKWPWKEEVPDLPSNYRMAFSRLMSTFGKLRNSPDLMEQYDATIRDQLEKGIIEEARKAPGTLEHYIPHQGVLAKGKKLRVVYDASAHTRGTNSLNACLYRGPVILPDLIGMLMRFRCPRFPLLSDIQAAFLQIALEPEDREVTKFLWVKDVSKPLTPANLITYRFCRVAFGVISSPFILAATLQHHLKGYHSPVANELAQSLYVDNTLLECESAEEALHKYAESKAILKEGLFNLREFVTNSPEVMKAIPEEDRLNKPKVKVLGLIWDTDKDEIVFEFPTHGLEKLATRRLVLSFLASLFDPLGLMGPCIQPLKLFFQTLWEEKKGWDDVLSEKEQIQWASFQENWKDQTLKIPRRAMLQGNPSLELHAFVDASIHTFAAAIYLRAVKDNQISVWLIFSKNRLKPKNASKALTIPRMELMAILIGIRGLKFVADQIRRPISELHLWGDSQIALSWIASKEAQPKFIERRVKEIRTLNECAFHFVRTAENPADIATRGAKPGELKDKSLWWNGPSWLKEDHDQWPKEMEFQIKDPPENLEEGSLDNEEKVFFVNTRTEELIDSPLIDPKRFSSWTKIVQVTLFVLRFLRLKLIQRGNPHQLFESHRKEIAKVSEKGPFSAEDVLLAENLLIRMDQMKKAEDSLSYPSLKDSEGILRLKTRLGRCDQPFGFSHPIILGGQSSIRDLIILKCHQKRHHFGVEGTLTEFLLEYWTPRARTKVKKALKGCLRCKRMQAYQFALPKMPPLPDERVCRQAPFKAIGIDFLGPTETRLAGEKVKAWILLMTCLVTRAVHLEAMLDTTAESFLNVLRRFISRRGKPDLIWSDNATSFKLAQKTIEHLTTPGVDQNTQEFFALNKIKWRFIPQISPWAGGVYERLVQLCKNCFKRTLGRKVLSYDQLITFVAEVEATLNHRPITSVSEGMDEILPLRPVDFLQPEVQIHWDTNGEEFDPSDRNLSSHQKLVALFQATKESHEFFWEMWQKEYLLLLRERGKWDHKSPRLQDKTEPKEGMIVLIHEEFTPRNQWSLGKIIELNGRPGAIRSVQLELPIHGIKSKRYGTMPRKIIITRPVNKIFPLEVGLDNHTENEEKFEESSNGTPQITNEKEISHLEAPMDEKETETLQLVDQPIDQNRHGMITRSKAKMGTVLNCLSILFAMFALVGAYPTNHCNECKLLCFNKGVKAKIPKEINKVELCCAENCYIHENVKKLTYELPKEILLNDFKCEGHFWMDSKHMFKKDILCPAVDECELIECYFCIEQLANPTCYPLISSMLAGGLCLSFISISFVAFSILKVLFSGLYMVIWLIIQFIRPIIYLAGPNRPPKDRRPRATASQNWTSRRVYRTMAFVVLMANSLQNLTGAETIAVMAKSEKCIKNATSMKCIVESSATLTLLPVGQTNTLLLKTEEGVLLGSINVVLKALALECQSFTKAWQRSYAINVLAGKRCPKMGSCEGKYCGEVRHNTSIPELKDANEFPGNSFCLDSTAFWGNKCLLGGSACLFYRWYAQEKSKTVYEIMGCNSWEFIVYAIIRLETLGEKPKSTQVFLYPGRTLKWNNISLTPIGVTFPPAPVLNSDFVFDGNNMALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCYRCSTGAQFRYVCSTNFGNSLAEINCADGTHFSTKCDSNASIYQTILAFDKARIDTKCQTKCLAGSTSFVLSGTLHYVQPEQIEDYSPNHSGKVMDSQSSWHNWNFDWKATLWSLIGLQSSLAFIMIICRTPFSDITNRSSRNEHGGEPRRLAPSGRENIDPEDFLFTEEVDPLTTEEEIPLEHPWNWEQVSELGSDPPGSDSSLEREVSPISADSDWSWTPPRSIWPQGNRERLSSWFPRILGNHWYQRGRRSAEALLRDFLRSGAFLRTNHLSTNRELTIDGLTRGGAERTLIYPGMS

SEQ ID NO: 157305 - protein, 211 aa, Heterodera glycines
  Coding regions on vcDNA: vcDNA=SeqID_83728; Strand=+; Position=1-633
  Homolog annotation: Hit_ID=NP_504186.1; Match level="QueryCoverage =100%, HitCoverage=25%, E-value=3e-13, Identity=25%"; Hit description= vglm uuk m polyprotein like family member (5E780) [Caenorhabditis elegans] gb|AAB63927.1| Hypothetical p
CLLGGSACLFYRWYAQEKSKTVYEIMGCNSWEFIVYAIIRLETLGEKPKSTQVFLYPGRTLKWNNISLTPIGVTFPPAPVLNSDFVFDGNNMALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 157306 - protein, 194 aa, Heterodera glycines
  Coding regions on vcDNA: vcDNA=SeqID_83729; Strand=+; Position=1-586
  Homolog annotation: Hit_ID=DAA04499.1; Match level="QueryCoverage =87%, HitCoverage=12%, E-value=4e-38, Identity=47%"; Hit description =TPA: pol polyprotein [Schistosoma mansoni]
VEQRPVCQLICDFEEIFAFEDQELTQTDLVMHHVETGTAPPLRMRVRPVLYAFREKVATMLQDYLDRGLIRPSWSPYASPIVLVPKKDGTIRFCVDYRGLNAITVKDAFPLPNIDNTLMMLGNKKVFSTMDFMSGYWQIKMHPDSVSKSAFTTEFGLYEYLVMPFGMSNAVATFQRFMTRLFDGILNDFVFIYI

SEQ ID NO: 157307 - protein, 57 aa, Heterodera glycines
  Coding regions on vcDNA: vcDNA=SeqID_83730; Strand=+; Position=1 -47,465-591
MAMLMKQFKKGQSAKRLCLRKDMTDFSRKFCKLAVLRNANVGSFYGTTQHESILWRV

SEQ ID NO: 157308 - protein, 48 aa, Heterodera glycines
  Coding regions on vcDNA: vcDNA=SeqID_83731; Strand=-; Position=1-145
MHSFLVLTILFANLASNAFGQQWPKATSEETDEATIKVSGGVKDLKSS

SEQ ID NO: 157309 - protein, 34 aa, Heterodera glycines
  Coding regions on vcDNA: vcDNA=SeqID_83732; Strand=-; Position=1-104
QKIDSGELAKPEQTQLDKLARRGELERDIEQLNE

SEQ ID NO: 157310 - protein, 123 aa, Heterodera glycines
  Coding regions on vcDNA: vcDNA=SeqID_83733; Strand=-; Position=1 -106,415-450,829-1055
  Homolog annotation: Hit_ID=CAE64973.1; Match level="QueryCoverage =69%, HitCoverage=54%, E-value=6e-16, Identity=50%"; Hit description =Hypothetical protein CBG09807 [Caenorhabditis briggsae]
MSKTSQPQQQRRLSHGGDGTETTPNGGDVRVKTVSGETFIAATQRADGSWRKPRRVKAGYVPQDEQPRFECRAQAELRQRSGGAEDSGAKVPLGWDPVAMVKGTPTKQEQMPSKQQQKQPQQR

SEQ ID NO: 157311 - protein, 301 aa, Heterodera glycines
  Coding regions on vcDNA: vcDNA=SeqID_83734; Strand=+; Position=1 -19,319-1028,1094-1270
MFMYFWAFDHAQLGLKLALISPRFNALVDKHFDGKSELALSSHFTIGRMRTRAKLFVKKSNATTETVPFLLHDRLRCTTKFALRTFGLSKSNNQRIINGFPFRHIDHSVSTFLRSNQQIFDKGTNLDLHVSLSKDVQLIWNAFAREIWPIFAPNIRHLNFMYGHDLQNLCRHTTPTILSELDIISIHSHDLLPGLIADDGPNATAAQALSKWLHIPTKDGRLKQLICSGATSKLNALVNNFKEAFPRATTSSASYKIRLETFESTEIGPFELLNERTNEKLVLEKEETNYKYYNIIDLLLK

SEQ ID NO: 157312 - protein, 17 aa, Heterodera glycines
  Coding regions on vcDNA: vcDNA=SeqID_83735; Strand=-; Position=1 -7,571-617
MVDQFPFIMIDLSFISQ

SEQ ID NO: 157313 - protein, 73 aa, Heterodera glycines
  Coding regions on vcDNA: vcDNA=SeqID_83736; Strand=-; Position=1 -166,650-705
MAMVGGTVCPRGRHLWRWWQQILLYGINHWAAACADRGTLLHVFQRRTARKYARKETALKRDPKFIYKLNKAL

SEQ ID NO: 157314 - protein, 39 aa, Heterodera glycines
  Coding regions on vcDNA: vcDNA=SeqID_83737; Strand=-; Position=1-118
ASRHSTGASRPFFKCCFALTGASRPFFKFVKLRRALRAR

SEQ ID NO: 157315 - protein, 205 aa, Heterodera glycines
  Coding regions on vcDNA: vcDNA=SeqID_83738; Strand=-; Position=1-615
  Homolog annotation: Hit_ID=AAO85452.1; Match level="QueryCoverage =95%, HitCoverage=39%, E-value=2e-20, Identity=35%"; Hit description =putative gland protein G12H04 [Heterodera glycines]
MSLAQDLLSPASMSYSNVEQFSVPLSDECVRSDIGAVNSAISALNPWKSPAEIMAQISSQLSIAQAALLVKMNWECLETNQNRMEATAPEQFDLALFVEALEATVEMDDVGKEVKLRRDKLNEWATKTGGKADKEGDKVEQEEDNAEKGDKVEEMRDKAEKEGDKAEKARNKAEKEAQKDGKETETFRKAEDHGDKEEKKDPGGE

SEQ ID NO: 157316 - protein, 65 aa, Heterodera glycines
  Coding regions on vcDNA: vcDNA=SeqID_83739; Strand=-; Position=1 -86,329-440
MSPEMLTNNNDVFFLIKTIHYDQYLPFPRERESAKGNRKFAILNHMTCVNVNAMEMCAYGEEIMG

SEQ ID NO: 157317 - protein, 218 aa, Heterodera glycines
  Coding regions on vcDNA: vcDNA=SeqID_83740; Strand=-; Position=1-657
  Homolog annotation: Hit_ID=AAU84949.1; Match level="QueryCoverage =44%, HitCoverage=67%, E-value=2e-25, Identity=58%"; Hit description =reverse transcriptase [Schistosoma mansoni]
PHDNRTFEEWYERFGPFVEQEGKPMSEQSKVRLIVSKLGTDVYKRYTESIQPQTPDVNAMAEKAKLDLTKDQIKSLIFITGLGEHNAELRHRCLKLLDGNAKTHSVQIKGTECTPTQLKEELQAQFPNVMIELGVLQKVDYSKWAAPIVAVRKANGKVRLCFDFSTGLNNALEPHHHPLPRPDELFAKLSGAKFFSQIDFKDAYLQICVDEQSRSFWA

SEQ ID NO: 157318 - protein, 121 aa, Heterodera glycines
  Coding regions on vcDNA: vcDNA=SeqID_83741; Strand=+; Position=1-364
MDMMDRLGLSDTIRNDLKDNFQTETAKLNGASPKKDKKFFRKDGRGKKQNFFAVGANVIASLGDEPWRAGRVISQKRGLYNVQFSDGTTGEFPAKSVQPYMPDEDENLNFLDGFGLKRSSS

SEQ ID NO: 157319 - protein, 121 aa, Heterodera glycines
  Coding regions on vcDNA: vcDNA=SeqID_83742; Strand=+; Position=1 -113,176-254,306-393,621-706
  Homolog annotation: Hit_ID=XP_313568.1; Match level="QueryCoverage =82%, HitCoverage=16%, E-value=3e-15, Identity=46%"; Hit description =ENSANGP00000013457 [Anopheles gambiae]
MFQNLGGMAGLFGGMANAASQAQPPTSAGATEAGPQPSAPPGQNIPSGFAELLGSLMNLSTTVNSSQPPEERFRAQLEQLTAMGFTDQQANIQALLASFGDLSGAIERLLGGGGQGNADTF

SEQ ID NO: 157320 - protein, 81 aa, Heterodera glycines
  Coding regions on vcDNA: vcDNA=SeqID_83743; Strand=+; Position=1 -63,457-639
MVLLLGLVLVLCHWLWVLLLLHHGEICCDEEDDDDVDHHQQQYYWAEVEDNSSQHVADGCDAGVGRCHMSTVAAAVAGGGG

SEQ ID NO: 157321 - protein, 157 aa, Heterodera glycines
  misc_feature (143)..(143): Xaa can be any naturally occurring amino acid
  Coding regions on vcDNA: vcDNA=SeqID_83744; Strand=-; Position=1 -75,170-202,612-702,763-878,1116-1241,3238-3264
  Homolog annotation: Hit_ID=NP_501127.2; Match level="QueryCoverage =96%, HitCoverage=10%, E-value=3e-49, Identity=67%"; Hit description =RNA Polymerase, Class III (C), rna polymerase (rpc-1) [Caenorhabditis elegans] gb|AAA83341.2| Rna polymer
SLGQMHQFLDICALGKSRATAEPSTVVGAIAATSIGEPSTQMTLKTFHFAGVASMNITQGVPRIKEIIIINAVRSISTPIITVALADERDEKLARRVKARIEKTTLGDIIDYVEQVFLPDGLYVLVKLNTRRIREMELEVFYXKNKFISSTVKMCGT

SEQ ID NO: 157322 - protein, 133 aa, Heterodera glycines
  Coding regions on vcDNA: vcDNA=SeqID_83745; Strand=+; Position=1 -57,1909-2216,2537-2577
  Homolog annotation: Hit_ID=CAE71853.1; Match level="QueryCoverage =100%, HitCoverage=8%, E-value=1e-47, Identity=66%"; Hit description =Hypothetical protein CBG18897 [Caenorhabditis briggsae]
IIPLGRREWETFRNFKFFYLIMDYYVGGDLLTLLSKFEEEHGHVPEHMAKFYVAEMILAIDSVHRLGYVHRDIKPDNVLLDITGHIKLGDFGSCLRRQPDGTARTTAVGTPDYISPETLRAVEDGRGRYGAEC

SEQ ID NO: 157323 - protein, 63 aa, Heterodera glycines
  Coding regions on vcDNA: vcDNA=SeqID_83746; Strand=-; Position=1 -112,369-447
MPTFGNNAQHRPSTVGAAMALDKLPPSPSARIASSPPCKPKAIDHQLKQQRQHQISAIDDLLG

SEQ ID NO: 157324 - protein, 40 aa, Heterodera glycines
  Coding regions on vcDNA: vcDNA=SeqID_83747; Strand=-; Position=1-173
FALILTYYIEKTAILINFTSTFETFSPLFSPLFREFFAPI

SEQ ID NO: 157325 - protein, 134 aa, Heterodera glycines
  Coding regions on vcDNA: vcDNA=SeqID_83748; Strand=+; Position=1-701
KADICAPFLADHFYPIHLPCHLIHCVFLPGKSNGRHNTSKVNVQNFHCNQTKIISGHHRNGDTMSDYTKLAAGITENDERLWKINDKKNEGTIQKHFVLCVGYGILLIMIRCKHRRRKKKIKNERQKEEKKEIL

SEQ ID NO: 157326 - protein, 76 aa, Heterodera glycines
  Coding regions on vcDNA: vcDNA=SeqID_83749; Strand=+; Position=1 -24,90-293
MYEAEFETMDTADSPIVSKTMLIPPMEYSCCGLNEEEMEMKWGRHLTRVYRDGEVPITAERAKMICVMKGADQRKK

SEQ ID NO: 157327 - protein, 86 aa, Heterodera glycines
  Coding regions on vcDNA: vcDNA=SeqID_83750; Strand=-; Position=1 -152,563-671
  Homolog annotation: Hit_ID=CAG03496.1; Match level="QueryCoverage =63%, HitCoverage=14%, E-value=4e-09, Identity=45%"; Hit description =unnamed protein product [Tetraodon nigroviridis]
MKVLCEIVAVMLSKSFLDELFEPREMYTRQGLRQHFEQIAHSSVMRLNEASQIPIFAVQRAVRNCTGDNEPFGRDEDNFQGPPGHH

SEQ ID NO: 157328 - protein, 109 aa, Heterodera glycines
  Coding regions on vcDNA: vcDNA=SeqID_83751; Strand=+; Position=1 -9,299-619
MANVSAIKDGLCSGPTNSSPSSSSSADDGMHYSLEGSWSDLFKLDEFGGMLCIKKGLHLEQHGQKIQLKAIAKHNGDNNIRSFNTTFFAYGKKILLRKIFKNTSDFVGS

SEQ ID NO: 157329 - protein, 89 aa, Heterodera glycines
  Coding regions on vcDNA: vcDNA=SeqID_83752; Strand=-; Position=1 -210,261-317
MALILGSVVTSPLPIMCQILLTVQLKLNKLRFLVLDEADKLIFDSIFFKSVLKIKDLMLTHHKMQREFDKSAVSLPPRTLMLSATYGDS

SEQ ID NO: 157330 - protein, 84 aa, Heterodera glycines
  Coding regions on vcDNA: vcDNA=SeqID_83753; Strand=+; Position=1 -54,106-175,224-354
MHLTQKLQKIAKPLQPRKYPFVELVPLMGKNHLDTVSERVRGIHPCVEERHNLFACLKKWDYDDMKCTKFSDSLFVCLANFESI

SEQ ID NO: 157331 - protein, 49 aa, Heterodera glycines
  Coding regions on vcDNA: vcDNA=SeqID_83754; Strand=-; Position=1 -46,592-695
MPEGTHLLATVSCAKEFNRCEYSTNFIDDVQGLLSLNSLLIVCSDNFFV

SEQ ID NO: 157332 - protein, 152 aa, Heterodera glycines
  Coding regions on vcDNA: vcDNA=SeqID_83755; Strand=+; Position=1 -144,222-536
MASVQSLGAEAEDLGGDLVANGARMEGTDASKRFAKGRTEETRQSNRTRQEQSIGQSDFHLKAISGQCDFQWQPIGWDDVFQREIARGNSFVTSFGRIDEERAEKPQQSVRGRGGGRGRSANGGRGRRGNGAGRGWSRGASRNFDQGGRTDH

SEQ ID NO: 157333 - protein, 57 aa, Heterodera glycines
  Coding regions on vcDNA: vcDNA=SeqID_83756; Strand=-; Position=1-172
MRRIKITVFSDRDFEKTTSYGPEGIFRVDVPGTERLAKESFEFWAKTEKDELAHKTG

SEQ ID NO: 157334 - protein, 80 aa, Heterodera glycines
  Coding regions on vcDNA: vcDNA=SeqID_83757; Strand=+; Position=1-243
MGKRAFDRLDASSLGLSGYNAYWPEEEPLNRLAFGQRQFADAETEQEKPTGSKKHRRWSRPLAGTKRRVNGFGLFGQLRL

SEQ ID NO: 157335 - protein, 54 aa, Heterodera glycines
  Coding regions on vcDNA: vcDNA=SeqID_83758; Strand=+; Position=1 -63,120-221
MPIMFTFIIITQLLFVQQFFVVVARNVNGHYPETYSSQNLLFDDGDSMPTEIKT

SEQ ID NO: 157336 - protein, 20 aa, Heterodera glycines
  Coding regions on vcDNA: vcDNA=SeqID_83759; Strand=+; Position=1 -19,431-474
MTITLYGHIHQSIKRDTPKK

SEQ ID NO: 157337 - protein, 147 aa, Heterodera glycines
  Coding regions on vcDNA: vcDNA=SeqID_83760; Strand=+; Position=1 -237,455-661
MPSFFAIFSFSLLFILCHHCSFAAFLITNYPNPLNNASLWKCGISSPGPLCDPDSLLNETARHEALELLKQFQDQTDIDDNGDGSCKGKGVIVGLALTKQPIIARVLIFNLMTKLPWKSILIQSSDLFGPFRFITPLHCRTKSKSIF

SEQ ID NO: 157338 - protein, 39 aa, Heterodera glycines
  Coding regions on vcDNA: vcDNA=SeqID_83761; Strand=-; Position=1 -54,147-212
MKPKPIYDRLIELLFILKHIFMLISRVIFYLHVLDLRFV

SEQ ID NO: 157339 - protein, 49 aa, Heterodera glycines
  Coding regions on vcDNA: vcDNA=SeqID_83762; Strand=+; Position=1 -10,59-198
MGVHGMRQLFNPAPTPPVLYVFRGPARNGVAIFNPTIPPPPPVLRAPGT

SEQ ID NO: 157340 - protein, 206 aa, Heterodera glycines
  Coding regions on vcDNA: vcDNA=SeqID_83763; Strand=+; Position=1 -190,230-301,344-585,628-741
MSVNLYCKGITDPVVIPIRPKEQISADTILNEFIKLQQSYSEINLLDQEISVIFTTYSTPAGSGRKSNKLMEKNDLSRIRISNADNFCLFYALELTRHYQLINNGITYKKYLCVINNQKKQKTIVRDLMNEADINQKEKSYGLDHIKIIQNFWDQKYSKLYRIVAFDYKCGLKPIFKAEGGRRFEVAVLLQNGHWCGLKRIRRFFN

SEQ ID NO: 157341 - protein, 67 aa, Heterodera glycines
  Coding regions on vcDNA: vcDNA=SeqID_83764; Strand=-; Position=1 -65,395-533
MPIRFPKGFRSLAKWTSERFFSKIRPSLSPLPFSHQTFVLPPNFDGNLLYNIFVWHSLEMFKKKKPF

SEQ ID NO: 157342 - protein, 102 aa, Heterodera glycines
  Coding regions on vcDNA: vcDNA=SeqID_83765; Strand=+; Position=1 -175,227-360
  Homolog annotation: Hit_ID=CAE63460.1; Match level="QueryCoverage =94%, HitCoverage=83%, E-value=4e-19, Identity=52%"; Hit description =Hypothetical protein CBG07924 [Caenorhabditis briggsae]
LNPGFDKRSFDSFTGPGFTGLDKRAAFDTGFTNYDKRAFDSFTGPGFTGLDKRFEPFDGYGFNGFEKRSFDSFMGPGFTGMDKKKRAFDSFTGPGFTGMDRK

SEQ ID NO: 157343 - protein, 304 aa, Heterodera glycines
  Coding regions on vcDNA: vcDNA=SeqID_83766; Strand=-; Position=64-978
  Homolog annotation: Hit_ID=AAO51148.1; Match level="QueryCoverage =75%, HitCoverage=32%, E-value=2e-11, Identity=23%"; Hit description =similar to Y55B1BR.3.p [Caenorhabditis elegans] [Dictyostelium discoideum]
MGSAHFLGPILLVAFAALILGQRSSPNHSSGSPSQREKSHGLSQQGKGHGAKEAPGQQIKNKDNSMPTIKKGTSTKSQKKGKGRHAKNNDGIGTLGKSKRQKRFLTEIFGNSLDKSKNNAEESERKREGFGIVPEKVKGKAEKTNERAAEKAGEKNGNGGRQKRFDERILGNNSFEPPVLNLGPNWPPPQYRHISFSDASNKRGQQKDEAEKRNKRSTSQENEAEKRKKRSISQENEAEKRKKRSISQEDEAEKRKKRSISQEDEAEKRKKQSISQEDEAEKRKKRNIAATGKSGRPRGPILPE

SEQ ID NO: 157344 - protein, 234 aa, Heterodera glycines
  Coding regions on vcDNA: vcDNA=SeqID_83767; Strand=+; Position=1 -97,328-549,851-1236
  Homolog annotation: Hit_ID=AAQ96507.1; Match level="QueryCoverage =81%, HitCoverage=54%, E-value=2e-13, Identity=34%"; Hit description =hypothetical protein [Vibrio parahaemolyticus phage VP16T]
MARLLLRLFGLAFVFAVLAFGTAQPPPPFQGSGGHYGNGNGYGNGNGYGNGGFGGGGAEGGQGMDIDVDVQQSSEEGKRRRKRHSGFGQLIDKIKNFVGGKESMERGSMYGSPYQSNSAYGNNQQFGYPNNQQNQFGYSNDQQNSNYQMRYQQQQGFNPQLLQQNSNDPNDFYQQQQQYNSNQQYGANLAQQYDPNQQQQQQRMMMAMMGQQQQQQPFQQMMAPQQQQQNYGMY

SEQ ID NO: 157345 - protein, 70 aa, Heterodera glycines
  Coding regions on vcDNA: vcDNA=SeqID_83768; Strand=+; Position=1 -72,652-792
MIKKSAVIPSLLLCAILVAQFIEQVNFLVSKWNMTEGELTNPDKRHWFTEIDVNRNEKLEPEEIDEAMTK

SEQ ID NO: 157346 - protein, 55 aa, Heterodera glycines
  Coding regions on vcDNA: vcDNA=SeqID_83769; Strand=-; Position=1 -141,646-672
MGNVQSYSTAECNFNCDPEAAHIVLKEMQCPVTIVPWETFMAKSDRKEIKCICKK

SEQ ID NO: 157347 - protein, 78 aa, Heterodera glycines
  Coding regions on vcDNA: vcDNA=SeqID_83770; Strand=+; Position=1 -183,353-406
MSVFTFFPSDPSLEKLYQQLVVDQDLDGWQNVRGPRDEEDNAEFEVVKARRKAEMDAKREQNISSREWEFPGLGKMEI

SEQ ID NO: 157348 - protein, 374 aa, Heterodera glycines
  misc_feature (347)..(347): Xaa can be any naturally occurring amino acid
  Coding regions on vcDNA: vcDNA=SeqID_83771; Strand=-; Position=1 -98,144-362,406-489,608-692,825-907,969-1023,1121-1482
  Homolog annotation: Hit_ID=CAE73155.1; Match level="QueryCoverage =100%, HitCoverage=79%, E-value=3e-55, Identity=37%"; Hit description= Hypothetical protein CBG20548 [Caenorhabditis briggsae]
SLFSSLSLFRLFYFNAKVHLRSIANWASAVAIWCVIAVCTDCVIAVCTDRLIGIRNPLFARGHVPRRKMALLMGFILAVPALLTAHQHFSHKCLIRAFCNGTQIHSICLPVTQEEWPKKANPYSVAFRRFIVSPPVTQEEWPKKANPYSVAFRRFIVSPPRERTWQIVIFPIILLTVLNVLLLCALRRRQRELAIKSTSSEGLSQQMVHSKTEQRVTWTVTLIVSMFTFTNGPSIVSMFTFTNGPSAVINLILILINYHHKLAYLLSTLVILGKVSNFILFCLSSKHFRRRLFALAQKRANGRLGESPAGIPSLNSPSSACSASFPNRHRSSYTAMDNTTRRGTPKXMFNERLRGRAYRFENACANGTLRKGDV

SEQ ID NO: 157349 - protein, 58 aa, Heterodera glycines
  Coding regions on vcDNA: vcDNA=SeqID_83772; Strand=+; Position=1 -149,202-229
MERMVTFPSTCVATYRLEERPMRLVRNCNLVDQKIRLYRDQVEKEINFICFSANSEKW

SEQ ID NO: 157350 - protein, 33 aa, Heterodera glycines
  Coding regions on vcDNA: vcDNA=SeqID_83773; Strand=+; Position=1-104
SVVVLTQSWGAIIHRRIKVQTIGKLFRKDSVSP

SEQ ID NO: 157351 - protein, 61 aa, Heterodera glycines
  Coding regions on vcDNA: vcDNA=SeqID_83774; Strand=+; Position=1 -73,302-414
MVDQFLEEIYQEICQENEQKKCQEINGTDNWPTQEDNPPTEDSVPHVPKLIHGSAIPKPMD

SEQ ID NO: 157352 - protein, 315 aa, Heterodera glycines
  Coding regions on vcDNA: vcDNA=SeqID_83775; Strand=-; Position=1-950
  Homolog annotation: Hit_ID=AAG23159.1; Match level="QueryCoverage =54%, HitCoverage=73%, E-value=2e-69, Identity=74%"; Hit description =polyprotein [Heterodera glycines]
HAQNHPAPCKESTSTNAGPFFGKEYVIIVDAFSKYPEVFEMATKSTAATIEKLRYLFSRHGIPEILVSDNGTQFTSNEFAKFMAINGVNHLFSAPYNPMSNGQAERFVDTFKRTFRKLKGEGAPSKEIIETFLVSYRTTPNDSLPNSKTPAEMFLGRKPRTTLDLLRPPPAQPIERDVEMARRFNKRFGTKLREFSIGNKVFARHRISQNWQQGKISKRTGVIYDVTFADGKSGRYHANQLRPRNTSDSDEQLSVMLEVFDIPRPVAVEEQRAIPVEMPLEDPLGEQENLGGQIDQGQQRRYPQRNRRPPQRFSP

SEQ ID NO: 157353 - protein, 106 aa, Heterodera glycines
  Coding regions on vcDNA: vcDNA=SeqID_83776; Strand=+; Position=1 -130,913-1103
MSSWYPILKIKDIGNASSKPNVPVIPLAQIVRWDWDTNGAQQINRCVRPLAVVRFPGDQSHAQRGDEGEAAANDHFGRIGRGHGPIHGVFGGHQLSVNERNFSAKP

SEQ ID NO: 157354 - protein, 75 aa, Heterodera glycines
  Coding regions on vcDNA: vcDNA=SeqID_83777; Strand=-; Position=1 -155,450-522
MTARQKWMANATETERGMEENVTKIVENEKDWHYWLGIGGRMPLIRGREAAELIEHVKSFRMIPRLLVWMPKKKA

SEQ ID NO: 157355 - protein, 165 aa, Heterodera glycines
  Coding regions on vcDNA: vcDNA=SeqID_83778; Strand=+; Position=1 -113,272-407,815-921,982-1080
  Homolog annotation: Hit_ID=NP_508186.1; Match level="QueryCoverage =94%, HitCoverage=74%, E-value=3e-32, Identity=45%"; Hit description =neuronal Calcium Sensor (22.0 kD) (ncs-1) [Caenorhabditis elegans] gb|AAA82363.2| Neuronal calcium sensor
CAEQCLFGFQKIYKQLFPQGDPIDFSNVVFKTYDDDQDGAIEFDQFVHGLLITGRGTLEQKLAWVFRLYDQDKDGAITRQETECLIRHIYKLSGDDSETADTKMVPNRVAMIWTKLNKESDAKINSAEFVENESDAKINSAEFVENVKTDKAIVNVLSLYEGLGK

SEQ ID NO: 157356 - protein, 362 aa, Heterodera glycines
  Coding regions on vcDNA: vcDNA=SeqID_83779; Strand=-; Position=1 -302,366-496,548-636,685-843,908-1055,1097-1182
  Homolog annotation: Hit_ID=NP_510647.1; Match level="QueryCoverage =73%, HitCoverage=52%, E-value=8e-70, Identity=51%"; Hit description =serum and Glucocorticoid inducible kinase homolog (sgk-1) [Caenorhabditis elegans] emb|CAB03485.1| Hypoth
KIKIANSINFYCSSFPFVLFPVSPLFSFLSGFASFPSHPFRFCPSLSLSPSLSLPFLSLSLFLLFHLLKERSFAEARARFYTTEVTRALAYLNAKDIIYRDLDLKPENLLLDRNGHVVLTDFGLCKEHVKMRQTTSTFCGTPEYLAPEVIQKKPYDRTVDWWCLGCVLAPEVIQKKPYDRTVDWWCLGCVLFEMLFGLPPFYSKNQNEMYHKTLPPFYSKNQNEMYHKTLTQPLCVPSSASTLVRKLLVEILHKDRSERLGAKSDFEEIEIRSHPFFAPIDWEKLLNKEVKAPFVPKVRAETDTLNIAREFTDIEPNPASLVPLQTFVRETEFAGSLVPLQTFVRETEFAGFTYNQKPNLHI

SEQ ID NO: 157357 - protein, 58 aa, Heterodera glycines
  Coding regions on vcDNA: vcDNA=SeqID_83780; Strand=-; Position=1 -51,457-582
MSYSWSATLKTPETCFKNCHAFVTGEHSLDDLALHYTLSPVELQRLLAENGNFRFIAR

SEQ ID NO: 157358 - protein, 99 aa, Heterodera glycines
  Coding regions on vcDNA: vcDNA=SeqID_83781; Strand=+; Position=1 -45,97-264,308-360,432-465
MGSDSPAARNYAYTYIINQRLKLPKIEVIPLPPADQIHPADLNAMNVLLQNLYIEVKTELGKCRMLWKGMRLKNRLIIKKTMSGTEVTAVIGNIRRPKG

SEQ ID NO: 157359 - protein, 15 aa, Heterodera glycines
  Coding regions on vcDNA: vcDNA=SeqID_83782; Strand=-; Position=1 -10,113-150
MFLIKTDVIFMVSDP

SEQ ID NO: 157360 - protein, 215 aa, Heterodera glycines
  Coding regions on vcDNA: vcDNA=SeqID_83783; Strand=+; Position=1 -45,97-264,308-390,626-723,854-1107
MGSDSPAARNYAYTYIINQRLKLPKIEVIPLPPADQIHPADLNAMNVLLQNLYIEVKTELGKCRILWKGMRLKNRLIIKKTMSGTEQRTVTYNGQSKIRLKTLMEDLFKHDKLKYLSFDRRRRTRRNSLCHKNTCKKNTAGREVKRNVPLSEVLSLGIVRQAPLPNLRHPQLCLKFLKNGASSGFFVDFLAYYGTFSRSSIKNSEVKKAHILSEF

SEQ ID NO: 157361 - protein, 316 aa, Heterodera glycines
  Coding regions on vcDNA: vcDNA=SeqID_83784; Strand=+; Position=1 -417,519-879,1189-1361
  Homolog annotation: Hit_ID=CAH93874.1; Match level="QueryCoverage =80%, HitCoverage=55%, E-value=5e-09, Identity=28%"; Hit description =conserved hypothetical protein [Plasmodium berghei]
MMKINFVIIVFFFLIILIDAVNEALFDDLWDNLKPPTSKNFKKQKFGENIAINEEIVDKNENYEQQNANKKMIKYENCNEKEMEDTKPKILQKTLEEQNDNLMSKIKVPKIEFDKLSEDSFENKFNKLTTSNDSDYNNMAERRNEMETLNRFNMMKKELRKENFYKNLTNFLFECEIAKKLGTNRTKICKLKRKLKQERKRAEESEEIKMELIRKFDQMRKEKIYGFNYAEKKRSKIEIAIGNELGISRNKIYKWKREFRKIRNYTNAEKLEYVKTSEEMRKRNSMMSEAKIAEKLGIPITNLRRWTKELGTKLNS

SEQ ID NO: 157362 - protein, 119 aa, Heterodera glycines
  Coding regions on vcDNA: vcDNA=SeqID_83785; Strand=-; Position=1 -93,248-514
MDENRITTTSGKSVNKQQKLIRQGMGFLLQQNTASEEITSKEQIVSLPNKNLIHSAVVEKRENKELPNDSSFFANLKPAQVISNCFNEGTTPDFGLHIHRFIGENNYVRSCRWSDLLKG

SEQ ID NO: 157363 - protein, 95 aa, Heterodera glycines
  Coding regions on vcDNA: vcDNA=SeqID_83786; Strand=+; Position=1 -62,688-911
MSKKKAIVEKELAPKRERRNAFILFGFAVKQQTQLNGTFQYENGTFAYEGDGELWTDGKQKGANAQHSYGNGDTVGIGVNSATRQIIFTKNGLRL

SEQ ID NO: 157364 - protein, 589 aa, Heterodera glycines
  Coding regions on vcDNA: vcDNA=SeqID_83787; Strand=-; Position=1-1767
MQEQNPENDTEIINQLLTESEEINENEENEESTEDFEESENSADFFEADRKKRTTVTTPDARWLKKIGKSKSRKGGQENKNLNTRVNYALYKLNEERKRQYDHIFTQACLNSNFQLQLAKAILQINPNEGVRKIFNRDDLVARWNGEEMEVGFCVPIIPEKVIWDKRIGEECYEWTPIFAENTTFFIKPGTRELSILGKTIECESLQNENIFNATQKEIIDKLTKNLENLRPKYRNMQNPLILKAGTLFESDNVRIEDAMLEYRKKINNLPSSTLRIVHKTNVSEVIRLIKEEANETLSAILGKTGNWIDIMKNIPKKAQEAVNYLKGLSILLIIIPLILLIAIIIFILTKYWTIISGGFRAGTLAARVVRRIIGMKKRGTRVAAVPTAPERESIDQEAYLLEYLPPRRVAIITNDPRRLPSIRVHINGLHTSALVDSCASVSYCRETTAKKAGLQIQELDGGNPNLTAANDSFIQILGKAQGKIRIYDNSTGKFGEWSVTLLVSPDKHCPGPLLLGLPILTELKGIIAFGEKKVRLDEIWTNIISVIEVEMPKSTKVIMGKTEIIEPRTENIISAHVKEHFPKEQNFL

SEQ ID NO: 157365 - protein, 179 aa, Heterodera glycines
  Coding regions on vcDNA: vcDNA=SeqID_83788; Strand=-; Position=1 -134,657-728,969-1094,1201-1256,1464-1551,1648-1711
  Homolog annotation: Hit_ID=AAM54183.1; Match level="QueryCoverage =97%, HitCoverage=18%, E-value=2e-74, Identity=75%"; Hit description =Hypothetical protein F35H12.2b [Caenorhabditis elegans] ref|NP _508178.2| rab6 GTPase activating protein (1
LFFCQECPQDAVILRDIHRTFPAHEYYKESNEVGQKSLYRISKAYSLYDEEVGYCQGLSFLAASLLLHMPEERAFCVLVRIMFDYGLRELFKTGFDALHLRFHQLQRLVEDYVHDLFSHFYQMGIETHMYASQWFLTLFTAKFPLQMVFFIVDLFLTEGINTIFHISLALLQDSKKVII

SEQ ID NO: 157366 - protein, 28 aa, Heterodera glycines
  Coding regions on vcDNA: vcDNA=SeqID_83789; Strand=+; Position=1-85
VGMDSDEVTKELNELHMLISGEEEKFRN

SEQ ID NO: 157367 - protein, 391 aa, Heterodera glycines
  Coding regions on vcDNA: vcDNA=SeqID_83790; Strand=-; Position=1 -256,400-657,1583-2244
MPKALRMDTHKTQFQFRTNSENAIAELRRIIFRKLLADPKLAEDEQDIGQSAQNGSEIGQHIINKAKVVKMEALESDRIGTAGGIWVSILKSIDKWWPSECEQREEAQSVVETQRIYMTKGNRELYSDFMIVWGQLATLRGGPTRLHKFLCMNEAEIEFEIANNERYTDPGVFRSADLLQKHYLDAFTTISPEPRQALKLATDIFCWVLWLENDVLKLWDDKKKEKGKVMPRFTMAWKQNRWYYEMVYDQMFDIEEANGKVEVPKKKRQIGILLQMSKHLVEQKLKMPDEKLRVELRNKKLERLKKGRQYGTASPPPNGTVDREWHEIRRKSEEGKEDEKQSSAIEEWLKQRHFATIKGFLCNSEKFNREFEQSALLIMPFIASFCHKYGY

SEQ ID NO: 157368 - protein, 207 aa, Heterodera glycines
  Coding regions on vcDNA: vcDNA=SeqID_83791; Strand=+; Position=1 -568,612-667
MNLWHLLFIIFFFIFLIKSGKIQPNFEEIFGQRWDKNESEEIVIIKIEQNDQNEQNETTGIDQIGGENGTDPNDQQKRQIILKFEAIKEKLKEKIIYKRKDYGKIERKIAKLLGANRQLIQKWKNELNLNKNKIKKEFMRRKSANSLNDLMNLKNYMAKANRKNLRRNWAFVKETFRKWKKELLPKYNKTLIKPSNYDKLKKDEAIF

SEQ ID NO: 157369 - protein, 104 aa, Heterodera glycines
  Coding regions on vcDNA: vcDNA=SeqID_83792; Strand=+; Position=1 -160,206-360
MRRKSAKFIEQFDEFKELYGQGKQKEFAKELGISERTFWKWKKELVPKYHKSQKQYTNEAKLRKMRKYYEIKEKNQKLSDVLIARKLEIGSSTLKNLKTNLLQH

SEQ ID NO: 157370 - protein, 207 aa, Heterodera glycines
  Coding regions on vcDNA: vcDNA=SeqID_83793; Strand=-; Position=1 -67,114-278,541-932
  Homolog annotation: Hit_ID=XP_331323.1; Match level="QueryCoverage =96%, HitCoverage=47%, E-value=5e-15, Identity=26%"; Hit description =hypothetical protein [Neurospora crassa] emb|CAD70992.1| conserved hypothetical protein [Neurospora crass
MHKKFDTFEEAKHYLEKYYEGKADEKKSPRKSRTSTDAKMKEEKSKQTTDEETDEATAEKERDEQTKGEDETGAKPVARKRTYGTKLNDEHDGDEETKLGSSEGHKALREEDIPRGEENADAEMREGDEANRTEGQPKKEGDSMESEATADNDDEQQIAKEAAKAEEKMEQGGEEEAQKKAETTEDEGVAKKAKLDDSDSTEKSSQK

SEQ ID NO: 157371 - protein, 27 aa, Heterodera glycines
  Coding regions on vcDNA: vcDNA=SeqID_83794; Strand=+; Position=1-81
MPTTRPRATAKNFVKESSTDTENEVSE

SEQ ID NO: 157372 - protein, 54 aa, Heterodera glycines
  Coding regions on vcDNA: vcDNA=SeqID_83795; Strand=+; Position=1-167
KYPFILSLKMSDHQPKAPSTPSVFYAVAWGHQRGVFGSYQEAQAATKGFPSPTM

SEQ ID NO: 157373 - protein, 158 aa, Heterodera glycines
  Coding regions on vcDNA: vcDNA=SeqID_83796; Strand=+; Position=1-477
MDKLNLEESVQEIGRRTELAKVPNWRCLIRPKFASVAFASPSLYPLDECPQTLQRPVANARQKVTALEQKAKRDALLCQKARHIAEAGGGHFHLPLGVADSCVEAAGHEDKSGTPLVDDWKDNAVEESGVFGVPTTDGIQWHIYGVRIFRKNIAVGLT

SEQ ID NO: 157374 - protein, 359 aa, Heterodera glycines
  Coding regions on vcDNA: vcDNA=SeqID_83797; Strand=-; Position=1 -90,186-424,474-775,895-1306
  Homolog annotation: Hit_ID=CAE73261.1; Match level="QueryCoverage =85%, HitCoverage=57%, E-value=6e-60, Identity=41%"; Hit description =Hypothetical protein CBG20677 [Caenorhabditis briggsae]
KGAKCSYPFPSILFSEAPNAFVAIRPPGHHASQNDPCGFCLLNNVAICARKARSLGVERVLIVDWDVHAAQGTQYCVEGDPEGILLLSIHRFERGTFWPELPESAIVHQYPNTINVPLNSVGCGDPNTINVPLNSVGCGDAEYAAFFHCIVLPIIHQWRPGLVLVSCGFDAGIGDPQGQMEVSPAGFGYMTGLLAQQGVPLCLLLEGGYFLPSVCHGALQSLRALLPNSICPSSQMAILRALASNSERFEGKKKVAANRRKKGEQYESKGFHLTETDQVPQSEYFGQRQKPLAVPQPTRGQYPPREKEEERKFELRIQTMLNKYENRESEEARKRGGRERRIERVPDSERGRKIEGRGG

SEQ ID NO: 157375 - protein, 98 aa, Heterodera glycines
  Coding regions on vcDNA: vcDNA=SeqID_83798; Strand=+; Position=1-296
MGQNLEKSNLYQMVKIGKDLYEGFAKLGEMKEQVDEISDHAKGRQQNLDRIDFHEKLKMGGKGERFKEETRESSKMGLTICTADRKDFVNAPYLCQCL

SEQ ID NO: 157376 - protein, 59 aa, Heterodera glycines
  Coding regions on vcDNA: vcDNA=SeqID_83799; Strand=-; Position=1 -48,581-712
MKPSGRKFAPCPSEISWIFDGFQVFFPITFVSVYGLIPSADHLALERACHLDQQEGISK

SEQ ID NO: 157377 - protein, 68 aa, Heterodera glycines
  Coding regions on vcDNA: vcDNA=SeqID_83800; Strand=-; Position=1 -72,529-663
  Homolog annotation: Hit_ID=NP_501943.1; Match level="QueryCoverage =86%, HitCoverage=31%, E-value=2e-15, Identity=69%"; Hit description =CALmodulin and troponin related (cal-4) [Caenorhabditis elegans] emb|CAB05271.1| Hypothetical protein T07
MGEKFSEEEVDEIIKEFDKDGDEQIDYEEFVNAVAPIVNDGAKEDAPWVQEASSTALPTVNGNGTKKQ

SEQ ID NO: 157378 - protein, 15 aa, Heterodera glycines
  Coding regions on vcDNA: vcDNA=SeqID_83801; Strand=-; Position=1-47
MPKKSWQKECGALTR

SEQ ID NO: 157379 - protein, 40 aa, Heterodera glycines
  Coding regions on vcDNA: vcDNA=SeqID_83802; Strand=-; Position=1 -30,133-225
MLSPIRVPFSEHHSTNCKVGQPCGGKMPMLFGGKQNANAE

SEQ ID NO: 157380 - protein, 239 aa, Heterodera glycines
  Coding regions on vcDNA: vcDNA=SeqID_83803; Strand=+; Position=1 -93,199-341,547-606,693-801,1032-1346
MEIEKKTGEKAPKFIQSRANPRIVPTRVFENFGDSSENRPGVGPAPTHCTEAWQFPCDDGIHCIARYDECDGIEQCPDASDEKHCQANERASMSQERGRHYTQQQQHGREDNQQHKQQQAQKQQQQQQTKSAVPKIFGIPYSLLMHWLRYYRSFQDRHFFKDKRRGRGQARAAGTVAGGCCCLRARLGARARGDEGDAAAPVGAAARPPAGANRRGAGFRKGESLVDEEDDLLIAQMYG

SEQ ID NO: 157381 - protein, 92 aa, Heterodera glycines
  Coding regions on vcDNA: vcDNA=SeqID_83804; Strand=-; Position=1-591
LSFFIFNFSFFVFLVPFSASFSISVHSFSKRAMFSPSGSSELNEHHQDLKVYITTVTGNSEVNIFKAAIIQQSVPSVNPKMPKKLGKNVLLE

SEQ ID NO: 157382 - protein, 27 aa, Heterodera glycines
  Coding regions on vcDNA: vcDNA=SeqID_83805; Strand=+; Position=1 -27,951-1007
MPHKGTTRTICAYFLCLKNFKKFTVIP

SEQ ID NO: 157383 - protein, 308 aa, Heterodera glycines
  Coding regions on vcDNA: vcDNA=SeqID_83806; Strand=+; Position=1 -519,608-1015
MLGNIALSLFVKTVFVISYFNRTCIQGPFQPHFDLLVMGQKFLDSVTQIMVNGIQRGNFDEELTTKFDNESFLGILCFNANFECEMNDNFGKFLSNFCHEFKTGKNLEEAIETVKNSLIILARSITIEQIITKESIFQKIAKNEFFGAKNAENIAKFFEHANSAFRLNLSAQLHHFNNLMSASENVPSTKKRIRRMIRRGFSRAMDQFQNSLDNSRYRLRNDRKKCAFFLALSVVLLVGIVFTMANLAKISANASHGQWAFFILFFTIIVTYFIMHTVSFVLLCVQNPHHQQEEQPEQQGQELGEIGN

SEQ ID NO: 157384 - protein, 31 aa, Heterodera glycines
  Coding regions on vcDNA: vcDNA=SeqID_83807; Strand=+; Position=1 -93,292-294
MAQYVVMPVDGKQWNGLADHGTIIFKDGEGK

SEQ ID NO: 157385 - protein, 76 aa, Heterodera glycines
  Coding regions on vcDNA: vcDNA=SeqID_83808; Strand=+; Position=1 -28,190-392
MDIVHPYQAWGERGTSLLWLRAGAAGPQTYRTHKTDHPFRSIKFQPYTNRPTDQSTVCQYHHSNTSYHKSSFSVCQ

SEQ ID NO: 157386 - protein, 213 aa, Heterodera glycines
  Coding regions on vcDNA: vcDNA=SeqID_83809; Strand=-; Position=1 -66,160-647,934-1018
MIDKYEKLMEKLIDQIYDNYEKLNVPVYSLHTEVTSFKPVAKPIAGNELFKYVPYKDASRVEHVGYRVNHVLLYYYPDVVHFVLHAMMDVAGISSAVRLQRSFAYFYRRVLDNTKLRDKREQLVHAMKQTAGGPKMSAEKRERVADALVLFAAAFICAGKIEADQCEVVHRNEAGNKLKAIIGESESIELEKHVKVFVHQFIVSYNELIAEEE

SEQ ID NO: 157387 - protein, 93 aa, Heterodera glycines
  Coding regions on vcDNA: vcDNA=SeqID_83810; Strand=-; Position=1 -23,124-265,322-435
MLIFAGIRFSVKQTASQWTMQNENGKALLFFYVCLCRKLVGFLGMPYAENAKFGKEINELSSFINNFPFVIMQELKKKIGKIENAEKDEFERK

SEQ ID NO: 157388 - protein, 126 aa, Heterodera glycines
  Coding regions on vcDNA: vcDNA=SeqID_83811; Strand=-; Position=1 -77,290-593
MARIIGRTNRRRAFIVSVEAAFALKSSYYEITIIFCFLTPNEFMKRPWCWYISGMGNVQKKKIRKQEIGSRYGTQTAEKFFGIANRNSNGPKILAIGNRRNSELRNVENRHFLPSLYIWHNKITYL

SEQ ID NO: 157389 - protein, 240 aa, Heterodera glycines
  Coding regions on vcDNA: vcDNA=SeqID_83812; Strand=-; Position=1 -395,433-613,660-806
  Homolog annotation: Hit_ID=NP_493879.1; Match level="QueryCoverage =68%, HitCoverage=40%, E-value=1e-28, Identity=39%"; Hit description =transposase family member (2B289) [Caenorhabditis elegans]
MESFCCVCKAIYGGSHSCYVCKLPCHTFCGDSGGVENERFGGKVVCNFANEEGNAPIAEGSENDDYEPQNKENEGTPAKEKRRHRNNDAAKKLEAVEWARKNSINAAAKKFKMYRKTIRDCIAHEDKLRKQIMSPNGGKRMRLDGAGRPVHRPDIDTELAEWVTKKRKNKQPVSRNIIRQRAAALFTDTDTKASLGWLQKFLRRHNFVLRKKTSVCQKPPSNYAEAVAKFISFVAKGARR

SEQ ID NO: 157390 - protein, 629 aa, Heterodera glycines
  Coding regions on vcDNA: vcDNA=SeqID_83813; Strand=+; Position=1 -700,746-1088,1130-1701,1744-2018
  Homolog annotation: Hit_ID=NP_001004509.1; Match level="QueryCoverage= 90%, HitCoverage=39%, E-value=2e-71, Identity=31%"; Hit description =si:busm1-180o5.3 [Danio rerio] emb|CAD60788.1| novel protein similar to DNA polymerases [Danio rerio]
MYEMKIRAQKKRNPNIIFRDSFNLMPCALGQLVPAYGLDVEEKPFFPHMANRPDNYGREIFPTPDDYLAQGMMPEKRRQFDDWYQQHREEPFVLDEALASYCSNDVEILMAALVAFRREFIEISRRQEYVDGVDDRENHDGIDVLRECMTIASACMKHFRTNHLPAEHLAIVPERGYDNAQNQSLLAIRFFKRYEERHGVQLQAAHSAGGERKVGNYSLDAWVEAEQRAIEVNGCVWHGCQKCFPDDNMLLPNGKSAGEVRERDAKRLEFLRNQIGRVDVYWECEIERMLAGDREMRQMFKKYVDYGPLEIRAAFMGGRTGPLKLFRKARDGEKISYYDFTSLYPFINFTTRYPIGHPRVHVLNEEVEWTTSADNPYDLSLLKVWVIPPRNCDVPVLPVRVGERLCFPLCMKCASDHPTGGVNENYHCTHNDSQRGWVSTCTSLELNAALDEGYRVTKLFRVLEYQSSDDQLFKSYIAEFMALKIQASGFDTSIKGNPELEEAFVRECYEKFGITIDPTKMEPNKGKRSIAKLCLNNLWGRFSLRNFGLSQTLITDDPVVLAEYLDNRSLEVTAIDEFDAEHILISYEKKKEWVEEHAWSNIGIIIYEHKYKNNLVISLWTTSGARLDY

SEQ ID NO: 157391 - protein, 63 aa, Heterodera glycines
  Coding regions on vcDNA: vcDNA=SeqID_83814; Strand=+; Position=1 -18,102-275
MPGKLIVGDGDADKPTGKWRRFGGRGNGFSMGLATKDEHDQSEKPSQNIFCNYTPLDTLQIVL

SEQ ID NO: 157392 - protein, 44 aa, Heterodera glycines
  Coding regions on vcDNA: vcDNA=SeqID_83815; Strand=+; Position=1-134
MCPNQMSVPSQNSFKTFSRKQNGMIQTDQASGPFLIIQNGLICH

SEQ ID NO: 157393 - protein, 102 aa, Heterodera glycines
  Coding regions on vcDNA: vcDNA=SeqID_83816; Strand=-; Position=1 -106,233-435
MSKQPTKTFHYPEWVLTKSLLRPTSRAATARECARKRKRKDTSLTLTKVWTESRDKKSTFLTTPTKELSEEEPSSVTREMLSDNLADEDFGREETQLAPHAK

SEQ ID NO: 157394 - protein, 542 aa, Heterodera glycines
  Coding regions on vcDNA: vcDNA=SeqID_83817; Strand=+; Position=1 -185,243-433,576-707,1446-1642,1695-1860,1904-2019,2275-2377,2425 -2496,2541-2592,2650-2734,2983-3312
  Homolog annotation: Hit_ID=NP_509496.2; Match level="QueryCoverage =36%, HitCoverage=22%, E-value=5e-46, Identity=51%"; Hit description =exocyst complex component sec15a (XJ452) [Caenorhabditis elegans] sp|Q18286|SC15_CAEEL Probable exocyst c
EQSLLLNGGLAIYENYIICSASNSEFPDGEKERIYVFHAEKQLDLYEANSIQTNRILQMALNRSHLLTFDVNSLIAIYSLSLSLENDQSADSLSLECLAEIRIAEFLPHPNCLVSMDLTRLNFYSDAVPFCDDLDSLLVNISGHLLLLSPMQSQQPNEDGHSGKTQGENSVNDDYLACGASCVSSLPKSSSAKLSDNISLVTDDGSSSLSSFVGVVKNVDFLSRLSVHTLVRVSEVFIHKLLKQLLKRNLGAFAFDLATACRSLPYFGHILELLLHDLLDEEATSSEPIPDPLLPTAVAFLREFPAEYLRTIVFCARKTEPAFWSLLFSDIICFMHKISHAVDQEIGVSSEDSLLEGGGQKDHYSRSKVEKLIDEAFREKIQVFLDNSHYDWELEQSSGVASEYITDLITFLNTTFVSFANLPPVLARHVRMQTCKFLADRMSSMLLSSEHRSVSIGALEQFSLDVMQCELFTAQRPVPGFEDNALAITFAHLRQLLDLVMGPDWTTFFAERDEGNSHRKGGSSGTKYARVKASSAAALMEK

SEQ ID NO: 157395 - protein, 39 aa, Heterodera glycines
  Coding regions on vcDNA: vcDNA=SeqID_83818; Strand=+; Position=1-143
FGERNGKSISDFGKCPKCRHFWGILCARANPRQIQCLTH

SEQ ID NO: 157396 - protein, 37 aa, Heterodera glycines
  Coding regions on vcDNA: vcDNA=SeqID_83819; Strand=+; Position=1-111
MDRCLWGRLHLAAAARLFVCSAQPDAESGNTNQEEGP

SEQ ID NO: 157397 - protein, 288 aa, Heterodera glycines
  Coding regions on vcDNA: vcDNA=SeqID_83820; Strand=+; Position=1 -546,652-895,939-1015
FHKGDPLIREIPLRHDAGCKVWQKMGGEHGIEWSNFVVGKALVGHNANECGGLPLCEGIKSEGLSCGQDMPCEGRKSDLSDRNAQGDSGSGMEWKRRRTVGIGTAPPRQNATRQRAKIEPQLPPAAALSSAPFSRSASDQLTNVHLVGNGSKANGSLTQRIVTMPITEKRVPLRMKRRKSKIHSRNVLRTPLIIPELELMKKWRNSRRNDEKPSRELPSQGEDEAVKLLLLNDIGQSAEERREEVIGRTDRSEVITELIGVTSREKVVDDSPHLSVGPIHSDCALCEE

SEQ ID NO: 157398 - protein, 92 aa, Heterodera glycines
  Coding regions on vcDNA: vcDNA=SeqID_83821; Strand=-; Position=1-281
PAIGGNPRIPRPPPVRGGRGENGRNAVSGSNRSGGRLGASKKHRRRGPDGRTEENCVMMGDDERGGLDDDDDDDDDDEEKLRLSLPSNLISV

SEQ ID NO: 157399 - protein, 350 aa, Heterodera glycines
  Coding regions on vcDNA: vcDNA=SeqID_83822; Strand=+; Position=1 -182,228-783,827-1138
  Homolog annotation: Hit_ID=NP_507780.1; Match level="QueryCoverage =98%, HitCoverage=23%, E-value=2e-45, Identity=33%"; Hit description =predicted CDS, DNA polymerase type B, organellar and viral family member (5T899) [Caenorhabditis elegans]
MPVKLESLKATFNLDCEDKPFFPYYYNKKENYGIRLEHLPPMEDYSPGSMNKDKFIKFEKWYNENKGAPFYLDDELKNYCRNDTEILLLSIIEFRRILINDITKGFDPLPRSCTNAGVAMNIFKAMFLLTEQLSIVPEKGYERCDRASVMAIKYLEWRSQRDGIEIRHAGNGREVKVGKYKLDGFIANNGARDKCIEVMGCYIHGCLNCYDPAAELIGGRTAQELNDETQERLAELQKTLDVEEVWGCQIEKELKKDEEMRGFFDDRGNEKGPIDPRMAYAGGRTGPMKLFAKSDEKKKISVYDIVSLYPSVNYGTAYPIGLPEIIIPKSDEINVNWTRPEDLKFNGLYK

SEQ ID NO: 157400 - protein, 15 aa, Heterodera glycines
  Coding regions on vcDNA: vcDNA=SeqID_83823; Strand=-; Position=1 -3,187-231
MNFGSRAICQVMEEK

SEQ ID NO: 157401 - protein, 49 aa, Heterodera glycines
  Coding regions on vcDNA: vcDNA=SeqID_83824; Strand=-; Position=1-290
VEVNSVWPTPSQQCSKSYNFFLCWPNFTIMVSLESPRCLEDIYKLFLSD

SEQ ID NO: 157402 - protein, 222 aa, Heterodera glycines
  Coding regions on vcDNA: vcDNA=SeqID_83825; Strand=-; Position=1 -316,376-518,571-780
  Homolog annotation: Hit_ID=CAG02702.1; Match level="QueryCoverage =62%, HitCoverage=10%, E-value=3e-11, Identity=28%"; Hit description =unnamed protein product [Tetraodon nigroviridis]
MDLNNGFYDREEDKVKLTIDLTTVDEPKVDKFNLDQSNSKGTLFMEIEKVSEFAREIFKSERKSETVHIKGLPWKIWAQIEKKDESTDKNEKWFAIFLLCDAPKEAETWSCKCSANFRIVSLKSGVADFRRKLDDHVFDNKENNRGYNYISFAELMNPSKGFYDQSEDKVTLAIDVSVKEANIEDFINTQYDLAKISSLNYHPMDLLFLASFLLFIFWVLQY

SEQ ID NO: 157403 - protein, 212 aa, Heterodera glycines
  Coding regions on vcDNA: vcDNA=SeqID_83826; Strand=+; Position=1 -426,531-686,1306-1361
MATIDARDYEVFLDPELRILSTTAQTANCEGFRYHYFAMNEEAKEWVKIDSRTGTIGRMERTSIHEWKDGTLGKEGPAEMPIGFHNWILRNDSRSSSSISPRERDIRELAAARRRIRDEKSDGAWSTTRRTRGSGQNMAQRAPDPLESSRIDRNTAQTTTSKRQSRGYPDGGRNADGRSDPRIDTGEHEEKAHHGMMQRMRKFAREPHRKYE

SEQ ID NO: 157404 - protein, 221 aa, Heterodera glycines
  Coding regions on vcDNA: vcDNA=SeqID_83827; Strand=+; Position=1-663
  Homolog annotation: Hit_ID=NP_996064.1; Match level="QueryCoverage =92%, HitCoverage=83%, E-value=3e-23, Identity=33%"; Hit description =CG33265-PA [Drosophila melanogaster] gb|AAS65018.1| CG33265-PA [Drosophila melanogaster]
MKISIIDLVFFGMLFAFLGNGASTFPLNSAVMEVEKDEADNSTTVEAEDNSTTVDAETEEADNSTTVEDVTEDADNSTTVEDVTNDADSTTVEAETEEADNSTTVEAVTEDADNSTTVEAVTEDADNSTTADDVTEEADSSTTLEDVTEDADNSTTVEVVTEDADNSTTAEDVTEDSDNSTTVEAVTEDADNSTTADDVTEEADSSTTLEDVTEDADNSTT

SEQ ID NO: 157405 - protein, 203 aa, Heterodera glycines
  Coding regions on vcDNA: vcDNA=SeqID_83828; Strand=-; Position=1-607
  Homolog annotation: Hit_ID=EAK93385.1; Match level="QueryCoverage =100%, HitCoverage=28%, E-value=2e-21, Identity=37%"; Hit description= flocculin-like protein [Candida albicans SC5314]
VVELSASSVTASTVVELSASSVTSSKVVELSASSVTSSAVVELSASSVTASTVVELSESSVTSSAVVELSASSVTTSTVVELSASSVTSSKVVELSASSVTSSAVVELSASSVTASTVVELSASSVTASTVVELSASSVSASTVVESASFVTSSTVVELSASSVTSSTVVELSASSVSASTVVELSSASTVVELSASSFSTSN

SEQ ID NO: 157406 - protein, 32 aa, Heterodera glycines
  Coding regions on vcDNA: vcDNA=SeqID_83829; Strand=+; Position=1 -57,361-402
MNKKLKNGPKYGLKTVKIYSNEQGKASDRKKG

SEQ ID NO: 157407 - protein, 95 aa, Heterodera glycines
  Coding regions on vcDNA: vcDNA=SeqID_83830; Strand=+; Position=1 -103,145-329
MGSDACETLRDALHRFTIEGIPKESVDNELDLTEDGEMICSARTGSDDLLSALEENIQQLKPIEMPVRVTRKDIPGVRMQLQREFNRMNFTIGNC

SEQ ID NO: 157408 - protein, 184 aa, Heterodera glycines
  Coding regions on vcDNA: vcDNA=SeqID_83831; Strand=-; Position=1 -287,426-570,929-1051
MQMKFEMIDLPLSRKKFHMRQKLRRAVKSAHFLHSLIDDNPLVFTVGLLLMLIFFVFQVHEVTRVETVSYVSFIFGSLELELKNWKRAIETFDRARAIKRCREVENLLILCRAQTGDANVLLSTVSSVNLNASEDDRKPSPEQLIGKAITESTKQQKKKARMMKEPKPIKPFFFDLAANFTEVC

SEQ ID NO: 157409 - protein, 284 aa, Heterodera glycines
  Coding regions on vcDNA: vcDNA=SeqID_83832; Strand=+; Position=1 -207,511-661,972-1205,2063-2326
DHELIVCYKTKKVKHVVNNEIAEVCQKHLGNVGQQQAHGFRIRFCAKRNATEQLISVESILDFSFSDKIYKREHSYSYKPGGHIAMKEKMPFFFIEFGNAKQHSMLRGTGDSSELSAELFLCLFERLTIGTILPSIASEPSSSSPNNDGGAQHRTKLLHFVPPANEELKIFFQTRLPFSRLITRKTDLLPYENNPNILYPDKCEQLGDDCEPTRELLLKIQDVLQCCSPANPWNKCLCDGSNSVDKVLKFKDPIWEVYIVLVPKRNCGLGSRKIPRGIPSRAGL

SEQ ID NO: 157410 - protein, 120 aa, Heterodera glycines
  Coding regions on vcDNA: vcDNA=SeqID_83833; Strand=-; Position=1 -63,460-619,983-1122
MCCSAVRLKTRGINAFVMDRTTEFAAPPGKKDSSPDTTPNNSSSRWGHLGDPLNADDIFYDREMAQRRYDDIMEAIFAFLMSIFKMQLGDLIKIVPNVYNRQRLLKSRQKIGGNDRLMHI

SEQ ID NO: 157411 - protein, 170 aa, Heterodera glycines
  Coding regions on vcDNA: vcDNA=SeqID_83834; Strand=+; Position=1 -75,716-823,902-1002,1560-1666,1715-1834
  Homolog annotation: Hit_ID=CAD19995.2; Match level="QueryCoverage =80%, HitCoverage=28%, E-value=2e-23, Identity=41%"; Hit description =metalloprotease III [Ostertagia ostertagi]
MISSPFVLNLKKNNLATLAYYWMVLTSSIAHEILHTLALYHEMHRDDAFYFLKLNPFDRNTFWVNNYVPLKKTNNFGFTYDFASLLQYPASIKNGYFNMITMSRFYQRTIGHGGILSFKDSAIINHIYCRGYCKEKKNECQNGGYPNPKQCNECFCPGGYGGAHCDDVEQ

SEQ ID NO: 157412 - protein, 137 aa, Heterodera glycines
  Coding regions on vcDNA: vcDNA=SeqID_83835; Strand=+; Position=1-415
TIHRPYAVTTPTTARCPRARGTPNSAAKCPPTPPAAAGIAVVFRFSAPSAAFAGRDRAKFQRLRRAQRCPRGRFAIRLDAIVCRNGRLLPAAARTSTSPAAAPARRRCRRCQRKRKCSRNTGSGHAAATIQHSTSLG

SEQ ID NO: 157413 - protein, 262 aa, Heterodera glycines
  Coding regions on vcDNA: vcDNA=SeqID_83836; Strand=+; Position=1 -96,197-475,652-1064
  Homolog annotation: Hit_ID=EAA16908.1; Match level="QueryCoverage =93%, HitCoverage=27%, E-value=4e-22, Identity=36%"; Hit description =Drosophila melanogaster CG8797 gene product-related [Plasmodium yoelii yoelii]
MLNPATATLYAYQSYLQQHQQQPQTPAPAAASLQLLAQLLAGGGVSTGTAGNCGVSAVGSGLQSVLSAFPGGGQQQNLLAALAVQQAAQPQQQQQQPTQQEETRILLEQLIRQQQQGRDQQQQQQREREQQLKQQQMLQQQLGRFNAAAVGAISSEPQAPQLEQSPTMTATAVAAFASAQEQMQQQQQQTATAIAVEQQQQQQQNEQFHQQQQQSQQTNGNALREQQQTTGNAAGAQPQQQQRQATPNERLLTSEALQDRIS

SEQ ID NO: 157414 - protein, 103 aa, Heterodera glycines
  Coding regions on vcDNA: vcDNA=SeqID_83837; Strand=+; Position=1 -37,88-212,354-503
MAKATKARWAKKTAPQLNPNAKIPPQDEAGPRIGARREQFRKRDLTGNSIRKILAQILSPNDLDGLERSIDDFKVFLAEQDRMSAFLSKKPKAHLLLFHLVLK

SEQ ID NO: 157415 - protein, 231 aa, Heterodera glycines
  Coding regions on vcDNA: vcDNA=SeqID_83838; Strand=-; Position=1-696
  Homolog annotation: Hit_ID=NP_491240.1; Match level="QueryCoverage =68%, HitCoverage=11%, E-value=3e-19, Identity=36%"; Hit description =zn-finger, CCHC type and RNA-directed DNA polymerase  and Integrase, catalytic domain containing protein
MSNGTAERFVGIFKRSMKKCRQEGKDWLQKVLLAYRTTPNTALNGHSPDELFLGRRMRTRMTLVHPEKQKLQPTNLENFQQFQGQYIKKMENQFNTKHGAKSTIFQNEEPIYFWNLKNNKAIWLPGKIIEKFGTSPTYRILEPTLGRAIHRHANQIRRRFPIELEDNDQVVENDQTQAQNPQQSPIAHKPQTNRQQSPAQPVLLRRSGRAKQAPQRLVLDPTKPKYGLIRS

SEQ ID NO: 157416 - protein, 18 aa, Heterodera glycines
  Coding regions on vcDNA: vcDNA=SeqID_83839; Strand=+; Position=1 -28,118-146
MGGVYRSSKYAKIKKDQE

SEQ ID NO: 157417 - protein, 109 aa, Heterodera glycines
  Coding regions on vcDNA: vcDNA=SeqID_83840; Strand=-; Position=1-327
  Homolog annotation: Hit_ID=NP_502797.1; Match level="QueryCoverage =97%, HitCoverage=30%, E-value=1e-14, Identity=35%"; Hit description =HASI (4P602) [Caenorhabditis elegans] emb|CAB16520.1| Hypothetical protein Y57G11C.19 [Caenorhabditis ele
MDQILSKVYFNLKSPASYAGILKVLEEARKVDKNITLEDVNTFLEKQRTYTIHKPIKKIFPRLKTIPSGLHTDWQCDLCIFDQLKKDNDGYKYLLVCIDVLSRMIFSAP

SEQ ID NO: 157418 - protein, 153 aa, Heterodera glycines
  Coding regions on vcDNA: vcDNA=SeqID_83841; Strand=+; Position=1 -292,371-540
MGCPYAFSCKFLLIIFTLCQFVAPNFSFFGTFGDCFDLFNIFHNNWCKEKVAVESRSLDQMYTSALTEGGKLVVYAGGTMRGQQVMKRRNCLIKKLNGTHAFRRWRFDADVSALAFRRQLVFPLKLFSLASKSNNLGIIRKLLSCSISLTKSG

SEQ ID NO: 157419 - protein, 63 aa, Heterodera glycines
  Coding regions on vcDNA: vcDNA=SeqID_83842; Strand=+; Position=1-723
QLMSLFGFFFKQFSVIAHQLLGVQQRRHLHPMQLFTGSLNLFLFFFYLFSEWSYNNFSQQFCI

SEQ ID NO: 157420 - protein, 229 aa, Heterodera glycines
  Coding regions on vcDNA: vcDNA=SeqID_83843; Strand=+; Position=1 -106,150-189,241-262,744-1265
MTSRKEKKNNLKNENNLPNNDKMQNDGTELLEEFKAILKSDTYMTKGAKVGLRSFGRFGNENVPNATQYMANDFKAFLDEMPETEGKSAIIALLASNPSSPILPSDLIERLLITKPTTNSKNLETPIVHRRHARNGFKISASDMEKIIKTIIEIRVILTLLTLYFWYCENNFILVIIILIFIWFVVDLRDDLEQGGSDLKIFKKIRTFCKIAPSNQDICNKSGQITSLT

SEQ ID NO: 157421 - protein, 268 aa, Heterodera glycines
  Coding regions on vcDNA: vcDNA=SeqID_83844; Strand=+; Position=1 -145,191-230,362-983
MLSTFSIATIILINVVHFNAFIINEAPTNLANEHKKPINETPFLTELKGIIKSDKFKTKGNKPLVEWALEIGCKIIIKNLNENAKICEQNEEKCPAQITNFYKIMTKICIKNGDKNLILDEHREQLTQLKDILGTQTLAQMKKYEQNFQQNGPNAKQYSALLQFGDDLKAFLNEMPEMEGKSAIIALLSSNPSSHILPSDLIQLMLITNKINPKNLITTNRRGRRDMRDSFAIAFIIWFIIYLWWFGYSFLAGLVTGFLLAVWLGRKF

SEQ ID NO: 157422 - protein, 270 aa, Heterodera glycines
  Coding regions on vcDNA: vcDNA=SeqID_83845; Strand=-; Position=1 -66,385-507,555-666,899-1030,1076-1215,1497-1693,1743-1782
  Homolog annotation: Hit_ID=EAL26376.1; Match level="QueryCoverage =40%, HitCoverage=38%, E-value=1e-11, Identity=35%"; Hit description =GA21422-PA [Drosophila pseudoobscura]
AYTANNRSKFGVGTIQELYFPADSSLNDSSKVGDGILRENGANLFDPNVQIGTQISKITLTKREANPIEQIDKMIMVDEGEGVRKERKASAKTAPKKNKEDAKKQKSDAKATSTAAPPTSTTTVASAAAAKPKEDGKEGQAGGTSNSEAKSQVKTIPQGPPMPPPKSAPPAPPQPPASPSAPPASPPPQQPVPPKLVNQSSAGMALPMPIGVGGKLPNFKLIYFDARGICEPIRLIFHYSKVPFDDVRISRKQWLALKDNTVYGKVPILE

SEQ ID NO: 157423 - protein, 35 aa, Heterodera glycines
  Coding regions on vcDNA: vcDNA=SeqID_83846; Strand=+; Position=1-107
METNTVRLKEYMECDNGTTERPLDVLVLQRDAGGG

SEQ ID NO: 157424 - protein, 109 aa, Heterodera glycines
  Coding regions on vcDNA: vcDNA=SeqID_83847; Strand=+; Position=1 -195,247-381
MLKLYYSFGFSNSIEQNVQTIGGDPSEWSRTANTATKRRTVAFVSAWQMAIGHRFFLDSVANAFVEELFSSLLEDVRTAEETTEAMEFEEMMRQMETLMEFREGFMRKC

SEQ ID NO: 157425 - protein, 25 aa, Heterodera glycines
  Coding regions on vcDNA: vcDNA=SeqID_83848; Strand=+; Position=1 -25,336-388
MSHYGTSARETLVFAVRIGMERDIW

SEQ ID NO: 157426 - protein, 57 aa, Heterodera glycines
  Coding regions on vcDNA: vcDNA=SeqID_83849; Strand=-; Position=1-173
MPTVPLALLLTSAVCLATVLLPPTPLSPLLLTLLAALRVAGAPAYAARSASSVAMGN

SEQ ID NO: 157427 - protein, 32 aa, Heterodera glycines
  Coding regions on vcDNA: vcDNA=SeqID_83850; Strand=-; Position=1-96
WSRFPNKNRGPGPDFSGPGKSRSRFCPKFPVP

SEQ ID NO: 157428 - protein, 19 aa, Heterodera glycines
  Coding regions on vcDNA: vcDNA=SeqID_83851; Strand=-; Position=1-58
MSSKTNGTKVCSAVADSKF

SEQ ID NO: 157429 - protein, 350 aa, Heterodera glycines
  Coding regions on vcDNA: vcDNA=SeqID_83852; Strand=-; Position=1 -621,1086-1173,1230-1289,1386-1505,1933-2093
  Homolog annotation: Hit_ID=NP_499993.1; Match level="QueryCoverage =51%, HitCoverage=63%, E-value=2e-46, Identity=50%"; Hit description =Enoyl-Coa hydratase (4B551) [Caenorhabditis elegans] gb|AAK29838.1| Enoyl-coa hydratase protein 5 [Caenor
PSNSLFTCISPFTHFTVQKYAQQIAAAEKRRSMSLTPIFMMMKRGKSPLLLLHHQSLSLSSSSSSSLSSRLLPPLFFIHRRDHFNNLRRHIFTAEPSQNRLITSIRHRQITTISGYHSAAPITLFNGSGNFRQHKTATSNNKMGSITQLSSVEQHKCALLHTNGGPAVAPAAPLTLEPLAGPDTGILVARISVPSTRNAFSRALAQAFRDMVDQLRYGLETRALILTSSVPQAFCSGVDLKERRKMTSNEVTTFVDGLRRTINDLSELPFPVIACIDGCALGGGLELALACDMRIATPRSELGLPETRLAIIPGCGGTQRLPRVVGVAKAKELILTGRKVRGDEAAQIGL

SEQ ID NO: 157430 - protein, 68 aa, Heterodera glycines
  Coding regions on vcDNA: vcDNA=SeqID_83853; Strand=+; Position=1-205
CLGSIKLFFKIQIGVQYYSFGIYESVVEKMLKLARFCGSAVANVGTILRRTKKKKIKIPEFSEECCRI

SEQ ID NO: 157431 - protein, 304 aa, Heterodera glycines
  Coding regions on vcDNA: vcDNA=SeqID_83854; Strand=-; Position=1 -132,481-564,626-763,1171-1272,1575-1654,1837-2215
  Homolog annotation: Hit_ID=NP_508537.1; Match level="QueryCoverage =82%, HitCoverage=78%, E-value=9e-56, Identity=31%"; Hit description =spectrin (spc-1) [Caenorhabditis elegans] gb|AAB53876.1| Spectrin protein 1 [Caenorhabditis elegans] pir|
MGTAGKDDDGEKPSVEGGKQAEDVHGSGEGPRVLAGRGEFHQKNVETLLASEDYGRDLASIENLLKKHQLLEADIVAHADRVEEMNRQADALLESEQFDQAQIDGRRRNINERYEQVKDSTDVRREKLNKAITVHQFLRDIDEEESWIKEKKLLVSSDDYGRDLAGVQNLRRKHRRFGRKMQKSKNLKRCPMLGLRTGKTEFFLGVDSRPGTKNVPPKIASFSYTFFFKNSELDTHQPQVEVVRSKGKELAKSSEIGGPEIERRIKALDQSWTQMVELADDRQKKLQERWEKGEKALKISKLYE

SEQ ID NO: 157432 - protein, 17 aa, Heterodera glycines
  Coding regions on vcDNA: vcDNA=SeqID_83855; Strand=+; Position=1-51
LFFTANAYDLIFKNISV

SEQ ID NO: 157433 - protein, 113 aa, Heterodera glycines
  Coding regions on vcDNA: vcDNA=SeqID_83856; Strand=+; Position=1 -183,497-655
MGDPIQLNPPLNYFFEERTVEMRGWTFGNETDIGQFPVLATLSCAVEICADPCEQSCLDKISLDKCSLNDFIGDKNATDICHEGNAAAVQGTISFCLMTLLMFLCSSTVLMFQ

SEQ ID NO: 157434 - protein, 16 aa, Heterodera glycines
  Coding regions on vcDNA: vcDNA=SeqID_83857; Strand=+; Position=1-50
MAEGKKDEIWIYQRRN

SEQ ID NO: 157435 - protein, 430 aa, Heterodera glycines
  Coding regions on vcDNA: vcDNA=SeqID_83858; Strand=-; Position=1 -150,207-292,361-567,616-825,877-994,1596-2114
MIKTALFDLLDGHTAQNLPFLRENGRIAVPKMLFCFYRNPLRIDLSNSKKKELLEKMEKCIESQVSHFMRQHGIIDNRFPENALGQITISSGAPFVYIFNHDELPKDANNEFVLSLYPEESCEDFSAERIQKLIETVLELHPKNKKCTRSDYNFDYFLHTAILNIRNKIVEDIGTTLSLNDFVQAAKFLKRMFVDGAADGYSMAFSRHSLQEVDTLNSIIDSSVGFGMNLYKSQLNQQPNVTGGGDIAFSQLEHDFTEANFTFYQKSDLTFASCCADLDRYDFHLFNVHDAATNRASKSDEDLDTTMVFDDQNPKGPSPSGTKRENEAHFEVDDEENVVIDPHEYNIRFFDDDDDGAAQIPSDEGEGLEMSDQPKGNEAPIEPMTQDDVPMSKAFSGDDIEEDEEVEEQRRKERIESTEEDEELDEEAEE

SEQ ID NO: 157436 - protein, 138 aa, Heterodera glycines
  Coding regions on vcDNA: vcDNA=SeqID_83859; Strand=+; Position=1-605
FIVNSKFQEANFTFYQKSDLTFASCCADLDRYDFHLFNVHDAATNRASKSDEDLDTTMVFDDQNPKGPSPSGTKRENEAHFEVDDEENVVIDPHEYNIRFFDDDDDGAAQIPSDEGEGLEMSDQPKGNEAPIEPMTQD

SEQ ID NO: 157437 - protein, 433 aa, Heterodera glycines
  Coding regions on vcDNA: vcDNA=SeqID_83860; Strand=+; Position=1 -36,142-252,669-778,826-845,1225-1367,1456-1619,1865-1964,2274 -2367,2497-2613,2690-2818,2922-2966,3015-3125,3608-3650
  Homolog annotation: Hit_ID=CAE60801.1; Match level="QueryCoverage =98%, HitCoverage=35%, E-value=1e-113, Identity=53%"; Hit description= Hypothetical protein CBG04493 [Caenorhabditis briggsae]
MLEQRDKMQEQLVRMQKCVEETEEKCRETERERDVLRRQIHQQTKDMPLEVQNLTHELVQCREQLYEKEEEIVEMKAERNNTRLLLEHLECLVEHLECLVSKHEKSLRMTVVKRHAQSNRGVSSEVEVLKALKSLFEHHKALDEKVRERLRVSIEVRERLRVSIERVHNLEMTLSATMEDNAALKAQLNSAKNSSSRQHCNTRQNNARGGAQSAAVVELQKQLDRLSQEYSTSIKQTNELSSRNSELQTELSNAEKEARQAKEKMHSIEQQIQELQAQRDEQDTRVSVLEGRMMGAQRETACIRDLNDKLIFQIANKDAAIRISEEKVQQLKERLELAEAQLAQSLKKAESLPSVEAAELFQRMEALSAAEKKQLSAEERIHKQLSAEERIHRMETLLEEKNAELERTLQRERINEGHNERKGSGVANRRRRG

SEQ ID NO: 157438 - protein, 362 aa, Heterodera glycines
  Coding regions on vcDNA: vcDNA=SeqID_83861; Strand=+; Position=1 -122,226-270,319-429,636-779,858-967,1094-1482,1687-1770
  Homolog annotation: Hit_ID=CAE60801.1; Match level="QueryCoverage =100%, HitCoverage=30%, E-value=5e-80, Identity=50%"; Hit description= Hypothetical protein CBG04493 [Caenorhabditis briggsae]
KDAAIRISEEKVQQLKDALLAEAQLAQSLKKAESLPSVEAELFAELFQRMEALSAAEKKQLSAEERIHRMEKQLSAEERIHRMETLLEEKNAELERTLQRERINEGHNNRLSATVDKLLSESNERLQIHLKERMQAQIDKNKLMQQLDQAKKMFDQTERFKERLLRENDTERFKERLLRENDDLHKEMDMLRNSLYTQRTAQFYSRGAAVGVPHHPLYQQAPMPPSYPTQSVCAMQRGQRSARVKRRMQKGRVTALQDDPGKVQTLGEQEWDRIQQANVLANIQQVGTPTATRNNNQQLKISPQMDPQILLNFQKKNSPQGFSMFDLRRFTIQSQSTTDPHTLAYFIQDRLDAINNEIRLIQ

SEQ ID NO: 157439 - protein, 47 aa, Heterodera glycines
  Coding regions on vcDNA: vcDNA=SeqID_83862; Strand=+; Position=1-142
MLSNLTSQKKVMRVKFLSGYNSTPKLLFSTKMRKTNHFLLILNVQSR

SEQ ID NO: 157440 - protein, 25 aa, Heterodera glycines
  Coding regions on vcDNA: vcDNA=SeqID_83863; Strand=-; Position=1-75
TCTCGVVVKLSTFHNFSPGFNSPLG

SEQ ID NO: 157441 - protein, 60 aa, Heterodera glycines
  Coding regions on vcDNA: vcDNA=SeqID_83864; Strand=+; Position=1 -63,197-316
MHKLDNVLAKNASVHPSNHCEAFWRNGGDGGHRAIGGKHEAGGDECVKQKEGTVDSMKRW

SEQ ID NO: 157442 - protein, 37 aa, Heterodera glycines
  Coding regions on vcDNA: vcDNA=SeqID_83865; Strand=-; Position=1 -52,109-170
MDLKMSERKNDGEKVFTGDCACPKTEQVEMDRGWSKC

SEQ ID NO: 157443 - protein, 46 aa, Heterodera glycines
  Coding regions on vcDNA: vcDNA=SeqID_83866; Strand=+; Position=1 -112,314-342
MSLPGKPFNCWNSSACHSDLEITDDKCLAVHYKENEYGQLFWLFTQ

SEQ ID NO: 157444 - protein, 97 aa, Heterodera glycines
  Coding regions on vcDNA: vcDNA=SeqID_83867; Strand=+; Position=1 -147,338-484
MMEKKSKGQFYTESVAYGTARPRGSTQNATAGSFRKTVNCQEHFLKTALKMATLIRRGVDLGRERTAELEETHAMLNVGQAATANQQRKERVLGREK

SEQ ID NO: 157445 - protein, 58 aa, Heterodera glycines
  Coding regions on vcDNA: vcDNA=SeqID_83868; Strand=+; Position=1 -17,290-361,542-629
MRRPAEFGAFRSQEATDKAKSSGQREKSAICQQTAIGHEHCCEEIVPSTDEPNEFVRL

SEQ ID NO: 157446 - protein, 103 aa, Heterodera glycines
  Coding regions on vcDNA: vcDNA=SeqID_83869; Strand=-; Position=1 -63,416-562,618-719
  Homolog annotation: Hit_ID=AAL78218.1; Match level="QueryCoverage =98%, HitCoverage=58%, E-value=7e-47, Identity=97%"; Hit description =histone Hgg-28 [Heterodera glycines]
MTTDTAANRQRRGRGERRTRVQLRDSAKKITKASILRLARRAGVARINARVYDEVRAALRSYLETIIRDAAIYCQHERRKTMKSRDVVHALKRQGNLMYGFEQ

SEQ ID NO: 157447 - protein, 72 aa, Heterodera glycines
  Coding regions on vcDNA: vcDNA=SeqID_83870; Strand=+; Position=1 -37,463-644
MNIASGNSARHEDASGSGTEKACRNFGVGGHLRGGKEPSGGREAGANSALRSTNARAGVSIKDLIPKLEEQK

SEQ ID NO: 157448 - protein, 119 aa, Heterodera glycines
  Coding regions on vcDNA: vcDNA=SeqID_83871; Strand=+; Position=1 -225,610-744
  Homolog annotation: Hit_ID=NP_492517.2; Match level="QueryCoverage =87%, HitCoverage=31%, E-value=4e-21, Identity=47%"; Hit description =STomatin-Like (stl-1) [Caenorhabditis elegans] emb|CAB03018.2| Hypothetical protein F30A10.5 [Caenorhabdi
MAIGLAKSAESEKESRVILAEAEEQEQVIVSRGLACAIETEAEARAKALERMAQGIEKMGGTNAAAFVTADNYVKAFANLAKSSNTVIIPSNSMDISGMVTQAMGIYGTIANANTANKH

SEQ ID NO: 157449 - protein, 73 aa, Heterodera glycines
  Coding regions on vcDNA: vcDNA=SeqID_83872; Strand=+; Position=1 -103,189-307
MICLALHSPNNKMSATLKISKSKWKTRAILTFQKTSLDCVLSNDIKKIGFVRTWKKLLYENPGLSIDWTHKVH

SEQ ID NO: 157450 - protein, 272 aa, Heterodera glycines
  Coding regions on vcDNA: vcDNA=SeqID_83873; Strand=-; Position=1 -90,151-234,290-336,675-795,847-910,994-1130,1183-1317,1386-1523
  Homolog annotation: Hit_ID=NP_495708.1; Match level="QueryCoverage =95%, HitCoverage=71%, E-value=6e-53, Identity=40%"; Hit description =protein c20orf4 homolog (2I437) [Caenorhabditis elegans] emb|CAA88309.1| Hypothetical protein F10B5.2 [Ca
MNESQLQNVSLTGEMSQELALELFENGGVLIFKDFPKGCEFGMDYRSWIVGPNFLGMKMIPPGIHFIYFRCRLCVPGAPRIAFFHNFRQKEVILRRWDTKKEDLVTDEKSDEVELDRLRENLRNIDRFLGVYPFADYRNWLSLSSYITPNSVRRLSPSNSLGRISSQNEMVTQEAKLEKKLGDPFGLSIVDREHRGRIRFTDEGGLPLMSEGEEAKLNFTRISQITLADTNLRRAGIDSSDRLFQCFEAMGGDYREVLAEFQFAFVVFLVGQ

SEQ ID NO: 157451 - protein, 284 aa, Heterodera glycines
  Coding regions on vcDNA: vcDNA=SeqID_83874; Strand=-; Position=1-853
MPTYPRRNNSFAANAVANDRRNNVLVYLGKLGEKGAMEMGEEVTVLTSAERREENGGDPFAMRRKIGRHHKNPSGTTVAQRDSVYMSKGTVTLAKAKNCSGLLEGNEHKKEKYQWKLMNDANGEGKEEEERARKLDNDNAGGEAETAVDGRGRDEAGREPRKRKNETQMLVNDEDKLEPWTKSEEKQLNGPNLKMDDDGKEARKADERKRKMRIHGQQKSAKLEANEDGTEEPFETTFITPKLHIEGEGLVEAEKAIEYHNRGGMSDSECGRRMGDALRRHRVQ

SEQ ID NO: 157452 - protein, 339 aa, Heterodera glycines
  Coding regions on vcDNA: vcDNA=SeqID_83875; Strand=-; Position=1 -122,175-454,499-891,1289-1513
MNNRLNQNHAGSAASALPSQQSHGQKMRQKLTFEIISKEHRQIYRASGLPWKLPDNFVYMLGKRISEVESAMADDATAPASALKLRKFKHTGFVVESFHRPTIQCYLDSIEYLTTTQKSAVMASFNKEGLSAIQGPPGNGKTELIAHISILAALSYVCNYSKEEDEECRNRMQNMKPQILIVCATNSAADHVAEQISRLKDQLISDDDLFQISEGLQKSLPTSGKCMTLGQIRIMRKYAASYSADQVPHRLWYCSNKNGIPYHPKEASMTNFFEMFGVLCRPINQEARENMVESAHQRRKGIYPLMMLTLAKPFKQTMVCRSAQNINIKGKMMMMAVLD

SEQ ID NO: 157453 - protein, 98 aa, Heterodera glycines
  Coding regions on vcDNA: vcDNA=SeqID_83876; Strand=+; Position=1 -129,219-283,809-911
MAIGYTLLAFITPSNPLLIQSMYVLIMSLVGLCTIGLVKQARWVDAENAQAINSTNTAIIYIIVIGYCFPFYCCFANIERSNFAHFDYEEEIKKDQKR

SEQ ID NO: 157454 - protein, 80 aa, Heterodera glycines
  Coding regions on vcDNA: vcDNA=SeqID_83877; Strand=+; Position=1 -104,840-978
MPVIVPKWLSCVESGISSGFRTDLRELAAILVSCLKKGFKFDLICNFAIFLQFFIGFSSLFLATFNFNHQYDKTSFKLPA

SEQ ID NO: 157455 - protein, 527 aa, Heterodera glycines
  Coding regions on vcDNA: vcDNA=SeqID_83878; Strand=-; Position=1 -142,188-379,427-499,547-724,832-1112,1169-1360,1405-1572,1621 -1714,1773-1957,2013-2090
  Homolog annotation: Hit_ID=CAE57406.1; Match level="QueryCoverage =91%, HitCoverage=61%, E-value=1e-137, Identity=53%"; Hit description= Hypothetical protein CBG00360 [Caenorhabditis briggsae]
NLADVQQSVTSFSPIQTSSFITTDKKAQVSNIRIEPEQGAGGFVGYADKGVSIVEPDMDVRVVLFGIHLDEIDLVGFTSTDNCSDAAVLIDRNEFVIQSERRVVVIYHFASNSLYKLCVRQKPHPDYSHELPIHLTDEAHCWVSTNIPPRKYYFSMPLQIVIIAVLLVLSGLFSGLNLGLMSLTPQELTLIKNSGSRKERKYAQTILPVRKSGNRLLCSLLIGNVCVNSAISILFDDLTSGTVALIVSSTGIVVFGEIFPQALCVKKGLAVGACTIWVTRFFMMLTFIVSYPISLILDKLLGEQVESYDRKRLIELIKLNMKNAAQAEELKIAIGAFEMNDKIVKDVMTGIKDVFMQPQDTILNAKNIAEIVRSGYTRIPIFDGSRGNVVSLLFVKDLILLDPDANLFVKTVCEYYQHPVRHVPENTPLRTMLEEFKKGDYHMALVDRVVAPSTEDKESKYELVGLVTLEDIVEEILQAEIVDETDVVTDNVTKIKRRRQQHRDLELFIDDGEACQISMQMQLVTIQ

SEQ ID NO: 157456 - protein, 50 aa, Heterodera glycines
  Coding regions on vcDNA: vcDNA=SeqID_83879; Strand=-; Position=1-253
MCAFAANCGRKQFLRWKSDFFLPKSMSTLVTQETCLYDFLIWIPTNVIQW

SEQ ID NO: 157457 - protein, 17 aa, Heterodera glycines
  Coding regions on vcDNA: vcDNA=SeqID_83880; Strand=-; Position=1 -36,413-430
MANWNGAQQSAEKPSLC

SEQ ID NO: 157458 - protein, 52 aa, Heterodera glycines
  Coding regions on vcDNA: vcDNA=SeqID_83881; Strand=-; Position=1 -65,335-428
MAVPPQAPSDACQGQLTAKSISEKVWAPNAMPMPTPNKESTCQFASFEKRKY

SEQ ID NO: 157459 - protein, 98 aa, Heterodera glycines; identical to SEQ ID NO: 157453
  Coding regions on vcDNA: vcDNA=SeqID_83882; Strand=+; Position=1 -129,220-284,938-1040

SEQ ID NO: 157460 - protein, 80 aa, Heterodera glycines
  Coding regions on vcDNA: vcDNA=SeqID_83883; Strand=+; Position=1 -104,730-868
MPVIVPKWLSCVESGISSGFRTDLRELAAILVSCLKKGFKFDLICNFAIFLQFFIGFSSLFLATFNFNHQYDKTSIKLPA

SEQ ID NO: 157461 - protein, 211 aa, Heterodera glycines
  Coding regions on vcDNA: vcDNA=SeqID_83884; Strand=-; Position=1 -23,254-856,1224-1233
  Homolog annotation: Hit_ID=JW0076; Match level="QueryCoverage=95%, HitCoverage=43%, E-value=3e-22, Identity=30%"; Hit description =sorbitol oxidase (EC 1.-.-.-) - Streptomyces sp dbj|BAA19135.1| sorbitol oxidase [Streptomyces sp.]
MHFLCNFWLHNWGGNFKFCSQNVEYPRTTAEVQRIVRRAQKLRVFGTRHSFSKIADSCGTLLSTLGMNSIIAISGSRSTVTVQPGITYTDLAPTLCQLKGVLANIVIMLHMLETDANNFALPTLAAIADISVAGATQTCAHGSGLTNSNLATQVRSMRIVLANGTEASFGPESAELRAVACGLGAFGVITEVELNLVPTFDTISYNFVSAP

SEQ ID NO: 157462 - protein, 169 aa, Heterodera glycines
  Coding regions on vcDNA: vcDNA=SeqID_83885; Strand=-; Position=1 -141,241-332,815-966,1662-1786
  Homolog annotation: Hit_ID=P11707; Match level="QueryCoverage=64%, HitCoverage=21%, E-value=3e-15, Identity=37%"; Hit description =Cytochrome P450 3A6 (CYPIIIA6) (P450-3C) pir||A34236 cytochrome P450 3A6 (version 2) - rabbit gb|AAA31178.1| c
MTQNAIPEREHAPKSLMRNILTVLRDDDWRRVRNRITPAFTTGKLKKLIPILCESTEKLCKVLETENALKGKEVPLKDLFGRFLLDVIGRCGFSLDLDTFDEENIFVKQARTIFDFTRKGQKLRMILGADDAEIIHSELRSNEQQQKQQGKHLTRIELFAQSFIILIAG

SEQ ID NO: 157463 - protein, 86 aa, Heterodera glycines
  Coding regions on vcDNA: vcDNA=SeqID_83886; Strand=+; Position=1-261
MLLFIFAIFGGNAILCQCANLMAITGQELTYTRKQQQPEKTECYRRNRTETWKFNCVDSAAGLDFIFAGWDPARFILLSSAPISRT

SEQ ID NO: 157464 - protein, 299 aa, Heterodera glycines
  Coding regions on vcDNA: vcDNA=SeqID_83887; Strand=+; Position=1 -293,374-702,819-1093
MTKIFFSFRNLKEFDFESKKVANLERKRKTNLGNLEMSKHYEELRTKIEQKIDNLGMVELCELWDFAQIVQTVKCQFEGQRTAQGNVKVLKSITVERNYDCAELRQIGKGNEPNWISDFKKEIALNHFAYIGSKLAFDHHIKCDFSAWFGDAKIAGESELSHRFRTSSTQANFEQIQFTKTMLQKHLLNVADLDKLLQIAHPITLAADVFTESSFAFLVTGMFGDEPNNAIWLEYFSFLGRILAFFRHFKNDEAKRAELNKFWGKTAAIFGRENAMIDESYGEMNLILIKEFKLILTEL

SEQ ID NO: 157465 - protein, 256 aa, Heterodera glycines
  Coding regions on vcDNA: vcDNA=SeqID_83888; Strand=+; Position=1 -243,607-696,758-890,955-1259
MSAEFSICLLLLLFLSFSLSAFATFDGQQNLTTDGQFLGCQIKNLKLLQTKFMDRKLMEKFHFELSKKQRILEALFVGEKKLNKYGEKKQFDLSKESVKYLMEELIGFSDKVKSCDSFNNNGRKGRQNDDEKLLRFAFRANQIDLDEAALFNGRKDEKRRRRRKRMINAYVVYFMILAMFFLIIICLCFIGCHDTQNDWRNIHRNNGQTEANGAMTRVANSAELSADFWEKILKMAIFSLSEPPTPKFAKIFTNLI

SEQ ID NO: 157466 - protein, 23 aa, Heterodera glycines
  Coding regions on vcDNA: vcDNA=SeqID_83889; Strand=+; Position=1-69
MVVQFVDKKYWTRTCCQQQQQMH

SEQ ID NO: 157467 - protein, 45 aa, Heterodera glycines
  Coding regions on vcDNA: vcDNA=SeqID_83890; Strand=-; Position=1 -20,59-176
MYVKSISGGNAAPVKQSILLRTCAPISPRWPWTRPRLLLKDAFLG

SEQ ID NO: 157468 - protein, 433 aa, Heterodera glycines
  Coding regions on vcDNA: vcDNA=SeqID_83891; Strand=-; Position=1-1302
  Homolog annotation: Hit_ID=S08405; Match level="QueryCoverage=100%, HitCoverage=36%, E-value=1e-99, Identity=44%"; Hit description =hypothetical protein 2 - silkworm transposon mag
MPEPKTIKELESFLEMVNYYSKFVKDLAECVEPLNRLRRKDVEWEWRDEQTKAFNLVKEKLTSDKVLVHYDPKNNLFLATDASDYGIGAVLFQRDNKSGKEGVVAYASKTLSSAERRYAQIEKEARSIIFGIEKFKQYLYGRKFVLQTDHEPLKKIYGPKGEMPVVAARRLHRWGLILMNFDYEIEYRSTKKFGNADGLSRLPCVETDEDDDDNGQEVNLIQVQAIESLPVTVEMIAKETEKDPLLKLVKKFVKEGWPNKVDKEFRPFYIARNSLEIQSGCIMLGIRTVIPATFRPEILQLIHSAHPGIVRMKSLARQKVWWPGLDKAIEEIRKSCRPCQINASEECKVPLHPWEEPERPWQRLHVDFCGPFWGFMWFVMVDAKTKWPEVIKMKTTNTSTTISEMRRIFATHGLPEQIVSDNGPQFTSGEWHE

SEQ ID NO: 157469 - protein, 109 aa, Heterodera glycines
  Coding regions on vcDNA: vcDNA=SeqID_83892; Strand=-; Position=1 -118,255-466
MGIVPEATRTTTASTIVALLLILLLMSDGGTIAGGNGEEIANLSSLSASASTALSTNVVVPHRFDCRLSGMECFHDGICSRDGSHCEWVFQLLIFVFLSFIQFSFHFFS

SEQ ID NO: 157470 - protein, 180 aa, Heterodera glycines
  Coding regions on vcDNA: vcDNA=SeqID_83893; Strand=+; Position=1 -412,471-601
MPPQDEAGPSTSAASAEEAMEPPPPTPAPVPTPEMDEEILEFGFSLPSTSVTPIGDLVPFSTTPTASMDTGETTPPPLAIDERSERIEQLEKQLNDLDDTIKFLRKQVRNREALISDLRRQLDEHMVPPMAPPTTSKTPPNRGRPKKRLDELQRSARRDIVDQIVGVIDHRRPNCGRHRS

SEQ ID NO: 157471 - protein, 46 aa, Heterodera glycines
  Coding regions on vcDNA: vcDNA=SeqID_83894; Strand=-; Position=1-236
NHRNTSIACTGNRTWDPPPLGDLLTDHFATHTNLFWYSSSVSGRRV

SEQ ID NO: 157472 - protein, 111 aa, Heterodera glycines
  Coding regions on vcDNA: vcDNA=SeqID_83895; Strand=-; Position=1-336
  Homolog annotation: Hit_ID=NP_701061.1; Match level="QueryCoverage =96%, HitCoverage=7%, E-value=6e-19, Identity=50%"; Hit description =hypothetical protein PF11_0201 [Plasmodium falciparum 3D7] gb|AAN35785.1| hypothetical protein [Plasmodium
MEKQQQQQPKSDQKPKNDQKLKNDQKLKNDQKPKNDQKLKNDQKLKNDQKLKNDQKLKNDQKLKNDQPSNDGEPSLASDFDFKNLKKVQNGTEERHASANHLIGHPERRNP

SEQ ID NO: 157473 - protein, 62 aa, Heterodera glycines
  Coding regions on vcDNA: vcDNA=SeqID_83896; Strand=-; Position=1 -95,321-414
MIAEEKKGSLSSHFPWQPFAQNLAKFYRHGDGPSTFGNPLWSLCCVWVLISHLQEQSVDLDQ

SEQ ID NO: 157474 - protein, 69 aa, Heterodera glycines
  Coding regions on vcDNA: vcDNA=SeqID_83897; Strand=+; Position=1 -78,566-697
MWMTRHSTSNRATLVRQWASSSSKTEESDGVSGSGTVFSLIFFYWPMEGFVSQTLPSPPGLKECKSSAE

SEQ ID NO: 157475 - protein, 138 aa, Heterodera glycines
  Coding regions on vcDNA: vcDNA=SeqID_83898; Strand=+; Position=1 -259,766-923
MTKSATTDGGGGTAAASSVHRLQSPQKVPHPPPKKRPAPETVPQPAVAEVPALPGAPPPAKFRKRQSSFYAHVNVRDPLNLGNVRPDNPDDPNFAKPIQLIPTNVNDPLNLQNLSSAPADAEDEALPTAADAQQRRKR

SEQ ID NO: 157476 - protein, 280 aa, Heterodera glycines
  Coding regions on vcDNA: vcDNA=SeqID_83899; Strand=-; Position=1 -115,202-252,299-448,548-628,845-967,1025-1158,1285-1404,2033-2101
ALTEVQDAYEVIKQENAVFLRGICETIPNFNRLFQQIENSFTYLNEENLALAIPPVPPNSVETSATSSGHSEPTYDQPPDGPDVNAQRELLKVADRSSETDHYLKVAVDAPGSVVPSRTVHPTEKAEQTRPTVSIDNSGTESRIRQPTESGKQQNRIPSPPKCRPPPPPAQSAAKKGEEITFGLAGSSPNRLLPSGQFVCDASTAGTSSQPSLPAIEAVEEDDYAEIVEPEEQKSPQKKEYISRLRMPTIFTRRNTRKNPCACIFQKLGPPPKNRPYYSS

SEQ ID NO: 157477 - protein, 134 aa, Heterodera glycines
  Coding regions on vcDNA: vcDNA=SeqID_83900; Strand=-; Position=1 -44,106-466
MDLDLDPEKSRTGSRIGATNNLLNIFIAVIQADHDERQGQKWPMAIQNAKIYLKIYKFAAIYLHVDPSNKAVIKSMTNGPQVWEVIKNFIDQSVTQLEALINQWNVAKVHPFCDEQLEMQAINKYIKEHCPKTD

SEQ ID NO: 157478 - protein, 67 aa, Heterodera glycines
  Coding regions on vcDNA: vcDNA=SeqID_83901; Strand=-; Position=1-204
MDTNILLTILLCSCFKFLNCIDFEEFISNETAKNLVDQYLRNAIKTRGDLLEKLGDIGVDLSFCIHL

SEQ ID NO: 157479 - protein, 106 aa, Heterodera glycines
  Coding regions on vcDNA: vcDNA=SeqID_83902; Strand=-; Position=1 -107,768-829,1335-1484
MTNNEGYDCFRLAAGASSYESLKVLLDSCQFGPDNKSGNVNETLQSLHSEEDEMEIALGRPRGRPRSISEERRKMVQKFKQANPNSSLAEIAKATQTTSGSISRIL

SEQ ID NO: 157480 - protein, 112 aa, Heterodera glycines
  Coding regions on vcDNA: vcDNA=SeqID_83903; Strand=-; Position=1-339
MTDSQSPSRSPRGQSPSPSSPCHARPNLYAPGGKLQFENVAAANPGTKVPTAKQIGHQLIGKARKGKLARVIVHDATAGEFGGPQTNPKAALAIQTEQTEQPNERSQKTEAK

SEQ ID NO: 157481 - protein, 93 aa, Heterodera glycines
  Coding regions on vcDNA: vcDNA=SeqID_83904; Strand=-; Position=1-280
  Homolog annotation: Hit_ID=A32461; Match level="QueryCoverage=100%, HitCoverage=51%, E-value=1e-13, Identity=38%"; Hit description=cAMP -dependent protein kinase II-B-binding protein - rat (fragment) sp|P24587|AK15_RAT A-kinase anchor protei
MRQLDNATVGQCDSWTMRQLDNATVGQCDSWTMRQLDNATVGQCDSWTIRQLDNATVGQSDSWTIRQLDNPTVGQSDSWTIRQLDNATVGQCD

SEQ ID NO: 157482 - protein, 75 aa, Heterodera glycines
  Coding regions on vcDNA: vcDNA=SeqID_83905; Strand=+; Position=1 -206,549-570
MMCFVRMLFSPIVLYGFNVPVVARPLITVVAQFQSYSLVSMRLHMVAMAANRAHAVLFPFHYAQKVTKNSGSNPT

SEQ ID NO: 157483 - protein, 95 aa, Heterodera glycines; identical to SEQ ID NO: 125597
  Coding regions on vcDNA: vcDNA=SeqID_83906; Strand=-; Position=1-701

SEQ ID NO: 157484 - protein, 163 aa, Heterodera glycines
  Coding regions on vcDNA: vcDNA=SeqID_83907; Strand=-; Position=1 -100,271-362,521-820
MASMNKRLPAELLLEIVASIPIMYLFGGIAKKPDQSCSKFREALRNKEVTVWRIVHPVRVHPVRPIKIGELFGAILIYVLGSANPLTMKKRTAGGYLLRQHFPRLLQFPATEMASHGLGQLVRADGMELYRLMNPHHKGDVGYLMIIETTQHPGSYYFNFSIE

SEQ ID NO: 157485 - protein, 203 aa, Heterodera glycines
  Coding regions on vcDNA: vcDNA=SeqID_83908; Strand=+; Position=1-612
MENRFPQRPSNFSIDYILSIPAKKPRRGVQAGAGPSSAKPAKEYVKKLESSVEHVPRFQYVKAKSKFSIEDVPTNPEGLIAGIFQCCIDEAVMESQQRGVKPTHLGCVISSPLLTGGDIPIPIRQITDNTVHTIMNQFTKVAQSKQQQNITLWGEPFTVTVTTVDRIGLPNKRSLKGGARRALAPVHHRVKENCLIKVRPAGK

SEQ ID NO: 157486 - protein, 136 aa, Heterodera glycines
  Coding regions on vcDNA: vcDNA=SeqID_83909; Strand=-; Position=1 -100,270-346,498-729
MASMNKRLPAELLLEIVASIPIMYLFGGIAKKPDQSCSKFREALRTKEVTVWRIVHPVRPIKIGELFGAILIYVLGSANPLTMKKRTAGGYLMRQHFPRLLHWPVNRMASHGLGQLVRADGMELYRLMNPHHKGEC

SEQ ID NO: 157487 - protein, 1341 aa, Heterodera glycines
  Coding regions on vcDNA: vcDNA=SeqID_83910; Strand=+; Position=1 -591,637-1326,1372-1869,1916-2172,2270-2670,2713-3055,3102-3603,3717 -3909,3954-4049,4098-4228,4274-4597
  Homolog annotation: Hit_ID=NP_001004509.1; Match level="QueryCoverage= 76%, HitCoverage=69%, E-value=3e-84, Identity=26%"; Hit description =si:busm1-180o5.3 [Danio rerio] emb|CAD60788.1| novel protein similar to DNA polymerases [Danio rerio]
MENRFPQRPSNFSIDYILSIPAKKPRRGVQAGAGPSSAKSAKEYVKKLESSVEHVPRFQYVKAKSKFSIEDVPTNPEGLLAGIFQCCIDEAVMESQQRGVKPTHLGCVISSGLLTGGDIPIPIRQITDNTVDTILNQFTKVAQSKQQQNITLWGEPFTVTVTTVDRIGLPNKRSLKGGARRTLAPVHHRVKENCLIKINNPDERNYCLFYALQATMVAKTRGWPRWLFYNYVHSRYGQQGCLRRDALQLVQQIGARPGLNAYDAEIFVPRVVDYWNNNQQQQQQQHRFAVFIFGSSGQYKPLYKYINDHYDTPIVLYFNNDHFDGVQKIHGLFGQNYCLECEKPYERPSRHLNACKARCMLCSRVGPRFPCAPLNGFFRECPGCKKVFRNNDCHQHHMTSNFCTRSKRCKECGVIWDTCANNLNGPRVHKCDERYCQTCNNFHNMERGCFIQPIEPKEYDPYRIVSFDLETMQHQAMDPDQPEKREHQPNFIAARVSCPCCIDNDRWRRGTGGCQICGLHRTVAFCQRRFVNTNVDHQVVADNPLEAFVNWLVFQLPKKYDTYAYSHFGGRFDMVLVFRELFRIGFNPEMLRRGNKMYEMKVRKQKRQNPNVVFRDSFNLMPCSLAALIPSYGLDVEDKPFFPHLANRPENYGRAIHPTPEDYLANGMMPGKRRQFDMCYCTNDVEILMAALVAFRREFFEITRRQEYVEGIDDRENHDGIDALRECMTIAGACMRHFRTNHLPAEHLAIVPERGYDNAQNQSLLALRFFYWYSEEYDVEVQTAHSAGGEKRIGPYSLDGWIEAEGRAIEVNGCTWHGCKKCYPNDNMVLPSGKTAGQIRERDGKRMEYLSARVNRIDVFWECKIDEMLARSKAMRKCFANYVDDGPLVIRDAFMGGRTGPLKLYHKAARGEKISYYDFTSLYPYVNFTTRYPIGHPKVHVFNQQVVWTSSADNPYPLALLKVWVVPPRRIDVPVLPVKVDDRLCFPLCLKCAKKYPTGGVDDDYHCQHNDQQRGWVSTCTSIELNAALDEGYRVIRLFRVLEYEDSDDQLFRPYIAEFMAQKIQASGFDNEIKGNAAMEEQFVRECAEIFGINGGRFSLRNFGLCQTLITDSPVVLTEYLDNKSVEVASIDQLDEKHILISYQHKKDWVDEHACSNIVISLWTTSTARLVLLKAMQKVVRSERCELLYTDTDSLVLVHPEGRCPLKTGPHLGQFTDEYPDHDIVEYCSGGSKQYGLCLRRKGAGPDVEPEYVLKVRGMTLNYDVINNQGLRYERFKEEVINYATRGDYEPIIVTYPNFLRPNIREGGRVVSMPMQKCYRPFVGKGIVGPNYRVLNFGHTL

SEQ ID NO: 157488 - protein, 56 aa, Heterodera glycines
  Coding regions on vcDNA: vcDNA=SeqID_83911; Strand=+; Position=1-169
MKKSVTISVPEQKEINQQNTEMEPTKSDTTKKRKADDRELWKLAKGKFMLATYLCP

SEQ ID NO: 157489 - protein, 220 aa, Heterodera glycines
  Coding regions on vcDNA: vcDNA=SeqID_83912; Strand=-; Position=1 -38,133-261,585-1080
MGICLCRVSAAAHNTVTTITTSRTPTTPNGTATKNWSESLADAVGGKTTLVLIIVGALIAIIVLLVVVVCCCCCKKRKRRRRHTSADDDKEDNKKRKRRHHTSADDKKEEDHHHIDQHNKEEEQHGKEDNKSPIQSELKVSTISAVPSDYNSNKRLGATDLDVEAEEVPKTKPVPKKPKSEGGTKRKLSNFFWSTGTTEKRPSAAEHGVEVPETIRDDED

SEQ ID NO: 157490 - protein, 208 aa, Heterodera glycines
  Coding regions on vcDNA: vcDNA=SeqID_83913; Strand=-; Position=1 -141,243-358,413-533,720-924
  Homolog annotation: Hit_ID=NP_505380.1; Match level="QueryCoverage =98%, HitCoverage=19%, E-value=1e-50, Identity=50%"; Hit description =PaTched Related (ptr-1) [Caenorhabditis elegans] gb|AAA96120.1| Patched related family protein 1 [Caenorh
SFALDRRFVRLFWLWGFLVHRFRWPLFLAPFLTTAFLAFGFLWINDQETRDPLFVFSPENARWKFERAALSEHWPLDEQHFWPGKSYDYFGYVDVIAVGYDYFGYVDVIAVGRRNSDEGGERPNILSRDYLNELERINKFILHNLTVPVLLPNSSTREVGFTDLCMTYAWKCYLNDHIIMLQPKGRWIGGLQAEVIELAKEIIEQEVS

SEQ ID NO: 157491 - protein, 314 aa, Heterodera glycines
  Coding regions on vcDNA: vcDNA=SeqID_83914; Strand=-; Position=1 -481,768-1228
  Homolog annotation: Hit_ID=NP_502797.1; Match level="QueryCoverage =49%, HitCoverage=43%, E-value=2e-26, Identity=39%"; Hit description =HASI (4P602) [Caenorhabditis elegans] emb|CAB16520.1| Hypothetical protein Y57G11C.19 [Caenorhabditis ele
MKFAKKMLMIPEAEYLALLSAMNSGDYLQNEKASLDAKISQNLQDPGISEDLKAKRHDWLYKERRTVKGILENRPQKVVIENHVPGPNVAPYLGLNNQSKPQETEEPRKIIIPRKRLKERTPDPESDNDTLEALTPEPQTPSTLKTPVPTKTIIHPTLLNEKQRTYTIHKPIRKKFPRLKTVPSGFHTDWQCDLCIFDQLKKHNDGYKYLLVCIDVLSRMIFSAPAKSKKSEDMIEVFDRVFEKSKIIPMKIYSDSGLEFQAGKMKKYFEEKFIIKNVMYSPDLHAGVVERANRTIKERLYRYFTKKDTLRWVD

SEQ ID NO: 157492 - protein, 371 aa, Heterodera glycines
  misc_feature (322)..(322): Xaa can be any naturally occurring amino acid
  Coding regions on vcDNA: vcDNA=SeqID_83915; Strand=+; Position=1 -191,237-395,613-681,734-926,971-1058,1105-1364
  Homolog annotation: Hit_ID=CAE61321.1; Match level="QueryCoverage =85%, HitCoverage=53%, E-value=7e-61, Identity=43%"; Hit description =Hypothetical protein CBG05158 [Caenorhabditis briggsae]
VHSPSALSNCPPPFTVSPKRFFSVLRLRIENESQLRFLMDLLRNSTRLDFWKEPSSVGEDAHVMVARGPMLNDFSERLREHVMVARGPMLNDFSERLREQNISSRVMIEDVSELIRRRARETTEREAKQRKTDSSGGFARFSMSKYHSFSDVIHHLNALAVNFPSRVQVQNALAVNFPSRVQVQPIGTTHEGRQIPLIKIGTSAGTKPAVWMDGGIHAREWISPAAVLYMIDQLVTGYDSQPAIRQFLVTGYDSQPAIRQFVDHLDWFIVPMLNPDGYEYSRSSADYEYSRSSADPEVRLWRKNRSPVQCTQISTGKRRNDXRLRVREQFTDWRMNFTKDIFVRSSPANYFPCHVRPSGANCPSPSLAFVD

SEQ ID NO: 157493 - protein, 207 aa, Heterodera glycines
  Coding regions on vcDNA: vcDNA=SeqID_83916; Strand=-; Position=1-624
MHLKLCLLFCSILFLIIRTDQIGSENKKLEQKSFDEIFGEKWEEKRNEEQKKREIIGKFYKIKEKIKQKGRKYSKKEWNKIEGKIAKKLGTNRKYIYEWIKELGLNQKNCYKTMTEEEKLDTVQKFIEMINEYKEKGRKYSKKEWNKNYEQICKKIGVGLFILRKWMKQFGISRKIIAEKEKMEKMKMYWQIKGEKPKMSDKEMEKC

SEQ ID NO: 157494 - protein, 35 aa, Heterodera glycines
  Coding regions on vcDNA: vcDNA=SeqID_83917; Strand=+; Position=1 -91,218-234
MEKMKIYWQIKKEKPKMNDREIGKIQKLKLETFNR

SEQ ID NO: 157495 - protein, 204 aa, Heterodera glycines
  Coding regions on vcDNA: vcDNA=SeqID_83918; Strand=+; Position=1-615
MELTRILFCLILFLITLTDQIGSEKKKMKQKTFDEIFGEKWEEKRNEEQKRREIIGKYYKIKEKIKQKGKKYSKKEWGKINGKIAKKLGTNRKYIQKWIKELGLNQKINHSKLKTDEEKLEIVLKFIEMTDKYKEKRKYSRKEWNKNCAEICKGIGVSYGTITKWKKQFGISRKITEKEKMEKMKIYWQIKREKPKMSNKEMEK

SEQ ID NO: 157496 - protein, 55 aa, Heterodera glycines
  Coding regions on vcDNA: vcDNA=SeqID_83919; Strand=-; Position=1 -84,218-301
MELSSGYFGGQFRGFLFPEEQINDEAAKILPGIRTLAEKVRDDAQMDEERRKLGK

SEQ ID NO: 157497 - protein, 269 aa, Heterodera glycines
  Coding regions on vcDNA: vcDNA=SeqID_83920; Strand=+; Position=1 -95,631-832,889-1137,1205-1468
MTTTSCPFDSNSALRPQVPLRARHLQAKRPASKDHPQTRIRLLPADRRYVSVGDQFMFTATFYDHNEGFIVCGIQLLDEEDEEQFVGLDSIKLGGDDILFVQKLKTHMRQWAAEGHDSPNFGPVADPKELVTDYICREEIQWPENIEVLVCFNPEWMQGADTLMKVHSLVIDGEFEQGVKERIESMNNDETSIASPATLSLRQEDNDGAHVPARTHLEEEEEECNCLEVWGILRELLEDERATSELEPEMIQGMVELRKAFHIDNRANN

SEQ ID NO: 157498 - protein, 43 aa, Heterodera glycines; identical to SEQ ID NO: 144666
  Coding regions on vcDNA: vcDNA=SeqID_83921; Strand=-; Position=1 -42,360-449

SEQ ID NO: 157499 - protein, 40 aa, Heterodera glycines
  Coding regions on vcDNA: vcDNA=SeqID_83922; Strand=+; Position=1-123
TSILPRRFPHVSSLWSSAVFAAVAEMGAVEGSVPPRSAAV

SEQ ID NO: 157500 - protein, 169 aa, Heterodera glycines
  Coding regions on vcDNA: vcDNA=SeqID_83923; Strand=-; Position=1 -130,191-318,527-667,713-823
HCPPNRFSRLSIRPSSSAANGPSSQFVPLPADLADPGTECQMIAEDFLTEEKVFRLHLNGVAEPPTDDPFHHYRSRVYKDGHTACYDDSGAPLFCKLSSSDKGHVQLGLFQSLTVPLDVLSKGMDKGKEQCRKAREMRFTLLTEDQKLAEAIQRYGKIDEGFHNCDKEK

SEQ ID NO: 157501 - protein, 204 aa, Heterodera glycines
  Coding regions on vcDNA: vcDNA=SeqID_83924; Strand=+; Position=1 -58,108-180,238-400,464-524,573-703
  Homolog annotation: Hit_ID=AAO21429.1; Match level="QueryCoverage =100%, HitCoverage=31%, E-value=5e-39, Identity=44%"; Hit description= Prion-like-(q/n-rich)-domain-bearing protein protein 34, isoform b [Caenorhabditis elegans] ref|NP_872252
MTAHLRSLVSIDKIVHAISNYTSVEKREEPNYTSVEKREEPLDCMDALLFWINKVCLLVRDDVCLLVRDDIERVDKLPTIPEMEDLYEDLCDGTCICALISFYRPDALPLREICFKDPMSVHDCICFKDPMSVHDCRFNLELLCKFCSSSLPWDPFHFETKFCSSSLPWDPFHFETEDILFLHESLQPNINVFLADLFQFFEIP

SEQ ID NO: 157502 - protein, 144 aa, Heterodera glycines
  Coding regions on vcDNA: vcDNA=SeqID_83925; Strand=-; Position=1 -79,128-344,401-539
MTFFYIFVATCIIYLFVGIVIKFKSAGLPSSETINHRVFRSLCCILTVNVGGYLITMLYGGLIKPSISSPITAWFWHIITAIPLNFGGASNGPILYLTSTEYRRAFQTEFPFVFKRILNQNRMAPQQNVQITRMFPVMNTSSQR

SEQ ID NO: 157503 - protein, 280 aa, Heterodera glycines
  Coding regions on vcDNA: vcDNA=SeqID_83926; Strand=-; Position=1 -24,67-194,250-413,464-530,783-930,981-1074,1128-1344
MADSNNISFYLSFKDVNPNWPLISCSFVNGSIAVFGIIFNLSVIWVTVQTKSFRGTVNYLLALCSFFELLHQLGNFLFVYTAFSGQNFIAYRLAVQIVFISMFGLGGIYPAMLFIGIDRLIGIFFEEIHNKHKMRLYLTMITLICIAFCVDFCVTLYQSIDLYGDQLITGCLIDFFKGPNPSIFRTSLVPLTITVYLLVGFVVKVKSSGFPSADEVNQRVFRALFCIIVINVGGYLINAFYLNLIKPSIASPITAWFVHFITGIVVNIGAASNAPILYFT

SEQ ID NO: 157504 - protein, 55 aa, Heterodera glycines
  Coding regions on vcDNA: vcDNA=SeqID_83927; Strand=+; Position=1 -70,179-276
MRYTQKENCQVDEAIQKRSKEPKDKLKMIPNTAMLPLTNEQLISGQLGFTSLNDK

SEQ ID NO: 157505 - protein, 62 aa, Heterodera glycines
  Coding regions on vcDNA: vcDNA=SeqID_83928; Strand=+; Position=1 -35,426-576
MNAQNRKVYRCGEPEENCDCPDLIRDFEEKEKQREASKKKARSSTSSAAGGPAKKRKTSKSM

SEQ ID NO: 157506 - protein, 297 aa, Heterodera glycines
  Coding regions on vcDNA: vcDNA=SeqID_83929; Strand=-; Position=1 -181,425-1136
  Homolog annotation: Hit_ID=AAO51006.1; Match level="QueryCoverage =56%, HitCoverage=46%, E-value=4e-10, Identity=33%"; Hit description =similar to Dictyostelium discoideum (Slime mold). RTOA protein (Ratio-A)
ATDQSTVYNSPSTANCAGSIASQNALVQQQWAQSVQQQTQRIHQQNQFMGQQNLAGIKNQQFPINYHGQNLQPQSVQNPSQMPSTGNQKIQWQQTKEGHTGNMHSTSSSNFIMPSSTGSSNFIMPSSSGSSNLIMPSSTSSSNFIMPSSTGSSNFIMPSSTGSSSFVMPSSTGSASFTMLPAAENIYQSGGSKSFTMNTTGNLTHIGPTRFNAQQKGKMTEQIGSTSLTNYHGPNVQSGQSVHLTPHMQTESQMSQIGPEMGQMGNIGPTNFNSPSRQLQNQQKLQYQQQPLLSMPI

SEQ ID NO: 157507 - protein, 188 aa, Heterodera glycines
  Coding regions on vcDNA: vcDNA=SeqID_83930; Strand=-; Position=1 -36,161-376,835-1146
MSEILGLRQANGLPQGYANAGGVGPSSFVPLGQPPMQARQQSVDHIQFPPQFSVVQYQNFGQQPPPMQQTLAVPMANLSLEQATSKKKSDRKPKKATDQEAQNQTVQHHHAQNNQFVGQNSLVQQAFAQSMQQQIQPLSSQQYMFDQNQNVQFQQSLQQMVQYQGQQPPLMQPTLADPMANLSFEQTK

SEQ ID NO: 157508 - protein, 177 aa, Heterodera glycines
  Coding regions on vcDNA: vcDNA=SeqID_83931; Strand=-; Position=1-550
  Homolog annotation: Hit_ID=AAG23159.1; Match level="QueryCoverage =77%, HitCoverage=63%, E-value=6e-47, Identity=71%"; Hit description =polyprotein [Heterodera glycines]
WPNYYPGWKGFARQIQSSIIDWKAWRTGVQTLHLQCRSKFGKIFLIVVDAFSKYPEVFEMTNSSATVTIEKLRYLFTRHGIQETIVSDNGTQFSSSEFAKFVAANGITHAPYNNSTGQVERFVDTFKRAFRLGEKPNKEIIDIFLITYRTTPNDTLPLKCPAELLLGRRRTTIDLLR

SEQ ID NO: 157509 - protein, 96 aa, Heterodera glycines
  misc_feature (95)..(95): Xaa can be any naturally occurring amino acid
  Coding regions on vcDNA: vcDNA=SeqID_83932; Strand=+; Position=1 -150,704-841
  Homolog annotation: Hit_ID=AAH51301.1; Match level="QueryCoverage =90%, HitCoverage=19%, E-value=3e-27, Identity=69%"; Hit description =TEAD2 protein [Homo sapiens] dbj|BAC04104.1| unnamed protein product [Homo sapiens]
SPQSSCSNGGNNNNMNSNGGTNGNSAAGDGGDAEGVWSPDIDQAFHEALQIYPPCGRRKIILSDEGKMYGRNELIARYIKIRCGKTRSEYHLSSXI

SEQ ID NO: 157510 - protein, 117 aa, Heterodera glycines
  Coding regions on vcDNA: vcDNA=SeqID_83933; Strand=+; Position=1 -58,109-254,301-450
MSTSSNKNYLPKNQCPNCDDDEVDTDPPPEEVEKWTPKQVIEWDQRCYGKMPAEEELWQEFLDKGEANVRREFFGGKGALEVEKSLREYAKKKERRDAILIEKRNEYKKNDGKKDEN

SEQ ID NO: 157511 - protein, 47 aa, Heterodera glycines
  Coding regions on vcDNA: vcDNA=SeqID_83934; Strand=-; Position=1-354
NFGDFFRKKHHFENLEATILEKLTKGRVQFIEEKCNINEMKTTKCKN

SEQ ID NO: 157512 - protein, 107 aa, Heterodera glycines
  Coding regions on vcDNA: vcDNA=SeqID_83935; Strand=+; Position=1 -87,463-576,764-886
MRKHFSLAALLTLCLRLISLFMLSLITPVEDIHLQPGYYYSFVLDVILFDTPQNRQLSIVLASVMLKDERMKLLFQFHKTVPIFNAFSARSVLSRLYTLVRKYLCTV

SEQ ID NO: 157513 - protein, 19 aa, Heterodera glycines
  Coding regions on vcDNA: vcDNA=SeqID_83936; Strand=-; Position=1 -51,411-419
MPEDSFGRDPISPPPKQLQ

SEQ ID NO: 157514 - protein, 201 aa, Heterodera glycines
  Coding regions on vcDNA: vcDNA=SeqID_83937; Strand=+; Position=1 -125,447-763,1027-1190
MAFANGAASGQQQQLQQHQQPNRFTMVPSPMPRNHLRRVPTRLVLERSVSDSVLDDAAIPDDQFSALQHSAAAAFNASILRRLSSSSSTMSPGGGLLGSFDEQLEDNIVDNKTEQFMHQQQQGSNGNGGNNSSSSSSCPSSCSSETIDTDGSAQSAAPAPIVKKRVSFSECVHARYFRRCVVWAHGIQMQKGDLLLKTKCH

SEQ ID NO: 157515 - protein, 219 aa, Heterodera glycines
  Coding regions on vcDNA: vcDNA=SeqID_83938; Strand=+; Position=1 -513,653-799
  Homolog annotation: Hit_ID=EAK90721.1; Match level="QueryCoverage =81%, HitCoverage=69%, E-value=1e-17, Identity=32%"; Hit description =hypothetical protein CaO19.64 [Candida albicans SC5314]
MDNGWSPEEFGNCDWGGNNRTEEFGNCDWGDNNRTEEFGNCDWGNNNNNRSEEFGNRNCGNNRSEEFGNRNCGNNNRTEEFGNRNWGNNNRTEEFGNRNCGNNNRSEGFGNRNCGNNNRSEGFGNRNWGNNNRTEEFGNRNSGNGTAQRRDANGRNNGGGPFRVPSPPPQQVPVPPPVTPLDFCCPGTEPSPPVRSNIVYVDGIEDYKHSLPLMRIEEV

SEQ ID NO: 157516 - protein, 72 aa, Heterodera glycines
  Coding regions on vcDNA: vcDNA=SeqID_83939; Strand=+; Position=1 -114,573-677
MDFFIVTLLYHLTLNLDVNAAPTKPTNLRNLNLSEWQNVVQVFGIDTDASALMGSRKESFLNFLCMIKLIHY

SEQ ID NO: 157517 - protein, 36 aa, Heterodera glycines
  Coding regions on vcDNA: vcDNA=SeqID_83940; Strand=+; Position=1 -105,356-361
MSEYARLLEARCPALHEAGHAAAARFNRHGPRVQFA

SEQ ID NO: 157518 - protein, 121 aa, Heterodera glycines
  Coding regions on vcDNA: vcDNA=SeqID_83941; Strand=+; Position=1 -282,1400-1483
MNNNGKNSNNCDSADEARRSRKRDRADLLHEVEMDKIREEQRRRRQRRKNEEVQRQRALLRLRTDYRNARCAVSTGQYRMSCTGTTTFVAIPQIGQSRGQPAMPFTLAFSYEPALPIGARS

SEQ ID NO: 157519 - protein, 131 aa, Heterodera glycines; identical to SEQ ID NO: 144707
  Coding regions on vcDNA: vcDNA=SeqID_83942; Strand=+; Position=1-396

SEQ ID NO: 157520 - protein, 33 aa, Heterodera glycines
  Coding regions on vcDNA: vcDNA=SeqID_83943; Strand=+; Position=1-101
LPALLLPWNLYLAHVWTKVRVKVVNGSLSDPTK

SEQ ID NO: 157521 - protein, 139 aa, Heterodera glycines
  Coding regions on vcDNA: vcDNA=SeqID_83944; Strand=-; Position=1 -115,186-250,443-514,565-640,768-829
  Homolog annotation: Hit_ID=NP_509342.1; Match level="QueryCoverage =94%, HitCoverage=52%, E-value=1e-41, Identity=58%"; Hit description =adaptor protein required for cell signalling, in particular during sex myoblast migration; functionally r
RFENAVQHFKVLRDTNGQYYLWAKRFNSLNELINYHRANSISKTHNILLRSMDSAFSNIQALFDFTPQEAGELGFQRGDIITVTKREDENWWEGTTKREDENWWEGTLNNRTGVFPATYVCPYNSGRSNQNLPSPSLSS

SEQ ID NO: 157522 - protein, 98 aa, Heterodera glycines
  Coding regions on vcDNA: vcDNA=SeqID_83945; Strand=-; Position=1 -99,487-684
MHKLPSGKEGQLLSANRKPLVEQSERGGKIGKTAKIGHYVQRMEVHASVLTVGPKLEVGQLSADGNDCRIPIESAENWHRSKIWQRLPEFPEMNCCND

SEQ ID NO: 157523 - protein, 366 aa, Heterodera glycines
  misc_feature (312)..(312): Xaa can be any naturally occurring amino acid
  Coding regions on vcDNA: vcDNA=SeqID_83946; Strand=+; Position=1 -64,116-234,284-355,405-583,688-883,931-1056,1164-1208,1563-1669
  Homolog annotation: Hit_ID=NP_491673.1; Match level="QueryCoverage =98%, HitCoverage=31%, E-value=9e-54, Identity=38%"; Hit description =disPaTchED family member, sterol-sensing domain protein required for apical sorting in epithelial cells,
VSVPSSFIIPLVVFLGGGLVISLISLPPPVSAYLISLPPPVSAYLCVNGLSLPRYNPLQLFRSSSVHEYFDQNAERLFPFVSDKIASINAERLFPFVSDKIASIPLADRLVWGIRAISAKFYFDANSLGIRAISAKFYFDANSLPTQLESDNHFHLRTVGQLRALAQQLEQMRALPFVEHSARFWPERFFLDWSVRLSCASRPSAESVCCNVQSPHFVDAQLDSCIRHSTSVLFTNYNDTLIWDNSTHRLIGYTALLPTHLRYSHRFANLSAAFALLPTHLRYSHRFANLSAAFALFDQWRTQQLSFLPGWXFMSQMSQWFDLQRAIISDCLPSLFPSLFLFLSFPPFLRWKAFCATFTIFCIVLT

SEQ ID NO: 157524 - protein, 30 aa, Heterodera glycines
  Coding regions on vcDNA: vcDNA=SeqID_83947; Strand=-; Position=1 -84,798-806
MSTEFEEKFRKILNRVYRTLQQFEIREEEN

SEQ ID NO: 157525 - protein, 395 aa, Heterodera glycines
  misc_feature (41)..(41): Xaa can be any naturally occurring amino acid
  misc_feature (169)..(169): Xaa can be any naturally occurring amino acid
  misc_feature (388)..(388): Xaa can be any naturally occurring amino acid
  Coding regions on vcDNA: vcDNA=SeqID_83948; Strand=-; Position=1 -282,491-768,973-1067,1256-1397,1772-1882,1931-2090,2360-2465
  Homolog annotation: Hit_ID=CAE56498.1; Match level="QueryCoverage =83%, HitCoverage=75%, E-value=6e-59, Identity=37%"; Hit description =Hypothetical protein CBG24216 [Caenorhabditis briggsae]
MGFFKNVHRGNQRGRIKKQTNFRKNSKPKNLVEKNRKLKKXLRKMMKFLPHEEESIGDEQVGHDEDEDNEYEEDNQTVAYREAKRLLESLKDQQGIGDSVAQQLRQEALAKQAKLHRAVAAHVRFGAQAQQRMVAHRGHRLAPICVCFSTSGAVLVSCSKDGAVVKCKXQQKRTIAKIGRNFSRTMAQQRPMICHGIVAISPDDQFLVTGSIDGLVRVWRLDTLSPVRTFSGHRGRVTALRFRRQCVALELFSASADKSIKVWNLDEMGIVNTLYGHQDSVLHLDILQWPRLVSCGAMDKTCRLFKVLEDKTCRLFKVLEDSHLVFNGLAECVSIDCVAMVNEEHFVSGSVDGLALQFGLSHHRHPRLTPPPPSVHFLSIQRRQWWAXTWENITI

SEQ ID NO: 157526 - protein, 27 aa, Heterodera glycines
  Coding regions on vcDNA: vcDNA=SeqID_83949; Strand=+; Position=1 -23,226-286
MPKQVWECSAESFEGPKEQKENVEDKK

SEQ ID NO: 157527 - protein, 222 aa, Heterodera glycines
  Coding regions on vcDNA: vcDNA=SeqID_83950; Strand=-; Position=1 -204,259-402,462-782
MSIKQEIDLLPKDETQEEPPLDSLVHCTEKLKKVVFSFSEVRHLRKHATIRQCLVGCLAACKRKLTETVIVDEVIFVDQTYVMFKHSETRYLFDNLDYVHITDKVFRQWIDELVMRDEPLPLYAHYFDRKINLLKMWKELKEIGFFDKTEQPKNDGGTNLQMELEKQFGIGTQHIMVTPWHLVQLLQLSRREFEHVVVGLYVCCVVSSSFSAKTALIKMPIH

SEQ ID NO: 157528 - protein, 121 aa, Heterodera glycines
  Coding regions on vcDNA: vcDNA=SeqID_83951; Strand=-; Position=1 -56,396-522,1069-1251
  Homolog annotation: Hit_ID=NP_508105.1; Match level="QueryCoverage =92%, HitCoverage=29%, E-value=4e-13, Identity=42%"; Hit description =glucosidase (XB85) [Caenorhabditis elegans] pir||T32449 hypothetical protein F52D1.1 - Caenorhabditis ele
MPNVGADVGGFFKNPDAQLYTLFYEHTKTGVPPMRPVWSEFPEDEASYDEEREWLVGPGLLGFTYKKVSDHTYSILAKSLDSRGTFDPDVWIERIVIRGLRYYPRNVHMYYEGQLFSSLMR

SEQ ID NO: 157529 - protein, 80 aa, Heterodera glycines
  Coding regions on vcDNA: vcDNA=SeqID_83952; Strand=+; Position=1-243
VYILLRASGALSELAPIDVHTAVKTQGTDVFVGGAYDGINNSKRISDEQNGIEKEEEEEYNDEEGEEAEGEKEDRKFATI

SEQ ID NO: 157530 - protein, 32 aa, Heterodera glycines
  Coding regions on vcDNA: vcDNA=SeqID_83953; Strand=+; Position=1-253
SVADPQNVQPTKCPSLEFEFFIIQMGLRLGKG

SEQ ID NO: 157531 - protein, 117 aa, Heterodera glycines
  Coding regions on vcDNA: vcDNA=SeqID_83954; Strand=-; Position=1 -19,688-1022
MTRPNTAKEWNKIDGKIAKKMGTNRTYIQHWNKEFGLQKLKSYKSKSDEQKLEIVQKFIKMKNEIKQQNRKYSLKEWRQNYAGICKKIGVGYGTICRWKNQFGISCKITEKEKTGKN

SEQ ID NO: 157532 - protein, 300 aa, Heterodera glycines
  Coding regions on vcDNA: vcDNA=SeqID_83955; Strand=-; Position=1 -279,332-779,833-1009
  Homolog annotation: Hit_ID=AAL78214.1; Match level="QueryCoverage =50%, HitCoverage=75%, E-value=7e-11, Identity=30%"; Hit description =putative esophageal gland cell protein Hgg-20 [Heterodera glycines]
WICNDVWMDIFPSFDHAQLGLKLALLSPRFNALVDKHFDGKSELTIWKTIEIRKDKGPEPKLYVKMDDKFVPFPLPDDRLLRSKIRFKCLHIDYIDHSVIAFLRSNHQIFDKRGTNLDLWIPSPHTTDGQRIWDIFVREIWPIFSENIHHLGFSHGDHLDNLRLRTSPTILTDLNQLNSIDSFVLLPAAIGDDFDGPNATISAGQSLSKWLHSPRKDGQPKQLRCGGINEQANTDWVNNFKEHFLRATISSVSYQIHFYVHVSSMQMVPFELVNEWTKEKLTLAKAIKNGFEDLLRFTRP

SEQ ID NO: 157533 - protein, 61 aa, Heterodera glycines
  Coding regions on vcDNA: vcDNA=SeqID_83956; Strand=+; Position=1 -93,360-452
MTAMKTLEKNMPSSNSNSEKLKREAIVFGPKCVKAEPLSCGFCPREDQQWSRSNPPPFLSI

SEQ ID NO: 157534 - protein, 46 aa, Heterodera glycines
  Coding regions on vcDNA: vcDNA=SeqID_83957; Strand=+; Position=1 -76,166-227
MEELQLNMPYRVQPHFGDTQELLGRGMHPVPKSVDTAEPLRAEMMY

SEQ ID NO: 157535 - protein, 37 aa, Heterodera glycines
  Coding regions on vcDNA: vcDNA=SeqID_83958; Strand=-; Position=1-113
MPNAVFCSLLAGVACVIEIHYNFDYTDIEWTKNGQWW

SEQ ID NO: 157536 - protein, 342 aa, Heterodera glycines
  misc_feature (13)..(13): Xaa can be any naturally occurring amino acid
  misc_feature (44)..(44): Xaa can be any naturally occurring amino acid
  misc_feature (82)..(82): Xaa can be any naturally occurring amino acid
  misc_feature (290)..(290): Xaa can be any naturally occurring amino acid
  misc_feature (304)..(304): Xaa can be any naturally occurring amino acid
  Coding regions on vcDNA: vcDNA=SeqID_83959; Strand=-; Position=1-1049
  Homolog annotation: Hit_ID=EAA16792.1; Match level="QueryCoverage =98%, HitCoverage=18%, E-value=5e-54, Identity=40%"; Hit description =ookinete protein-related [Plasmodium yoelii yoelii]
QRRVKWETSNGEXHGNRGGLNGGQAMGNGAGTEEGKWGTFNGEXRGNRGGLNGGQPMGNGTGTGGLNGGQPMGNGTGTEEGXMGDNGEWHGNRGGLNGGQGEWHGSRGGLNGGPMGNGTGTEEGMGDNNGEWHGSRGGLNGGQPMGNGTGTGGLNGGQPMGNGTGTEEGKWGTTNGEWHGSRGGLNGGQPMGNGTGTGGLNGGQPMGNGTGTEEGNGTTNGEWHGSRGGLNGGQPMGNGGNRGGLNGGQGEWHGSRGGLNGGQPMGNGGNRGGLNGGQPMGNGTGTEEGXMGDKGNGTGAEEAXMGDKGNGHGRRGGVKWGPPIGDGTGRKGGNGGQPMGNG

SEQ ID NO: 157537 - protein, 423 aa, Heterodera glycines
  misc_feature (168)..(168): Xaa can be any naturally occurring amino acid
  misc_feature (173)..(173): Xaa can be any naturally occurring amino acid
  misc_feature (236)..(236): Xaa can be any naturally occurring amino acid
  Coding regions on vcDNA: vcDNA=SeqID_83960; Strand=+; Position=1 -24,172-1350,2134-2209
  Homolog annotation: Hit_ID=NP_510849.1; Match level="QueryCoverage =97%, HitCoverage=31%, E-value=4e-68, Identity=36%"; Hit description =predicted CDS, zn-finger, CCHC type and RNA-directed DNA polymerase and Integrase, catalytic domain conta
QVDVLSRLLPVTADEVAEHTQLDTTLRKVFDFCRNGWPKKSPTDSSAFFTHRHKLSEVNGCLLFGERVVIPAALRQRILSALHFTHPGIVRMRALAQQHVYWPLMDLDIERWVRHCVDCAMAAKAPTKTTLSPWPRTNKVYERIRMDFAGPCSDGNLYLIIVDAFSKXPEIFXVKSTSADNVIVQLEWLFSRYGFPREIVTDNGPPFHSKDFSHFCRIKGIKQRFSPPNHPQSNGXAERFVDIFKRQMKKCSHGDKWITNSLFAYRNTPNAALKGQTPAELFLGRSPRTQLSLLKPDISCSNRNQNDYTNNMSKQFDRKHGARHRTFAIGDDMLIITRNNKKSLLQGKVVSGSGVIWEIKIPVLGNVIVRRHTNQMRNFFIPQKSQNGNGPGTQHGSPASGFGSGLTRKMAKNVGVRGRGGVG

SEQ ID NO: 157538 - protein, 172 aa, Heterodera glycines
  Coding regions on vcDNA: vcDNA=SeqID_83961; Strand=+; Position=1 -141,185-399,461-624
EFSKPLITNREIHFDISNPDPEFRQESDIQFRISHIQSYNAFWLIFDYCLNSDSGFELVRNEYIRVQCSETPKTFSIFLPETPSAQLAFFDRKMYFTSSNSSSNDEVEEHFTHFAPDQSIFPNLSLSEELRIIRARMARILEKKRTKTMGTSSRGTSDDVTEQNTGNKNMFH

SEQ ID NO: 157539 - protein, 211 aa, Heterodera glycines
  Coding regions on vcDNA: vcDNA=SeqID_83962; Strand=+; Position=1 -169,257-343,392-514,664-825,1246-1340
MDDDDDDNCDDVSSSFHEDTKQQQQYEKRKTTNIGKANEKKKLKINYEYGTKIYIYAFDVQFKAILKRITELEKKQHKQNEKVTKALVGQMKQLQNDQQKQLERISELEKQQTAIVDQLHTAQKQIDDRISQPQTDQQPMELCAKISELESNTNLLFGKILDEFSEFGNFVGILKDRFGRAWVSVFAKYSVPSSEIGGLFYFEVKIINLRK

SEQ ID NO: 157540 - protein, 158 aa, Heterodera glycines
  Coding regions on vcDNA: vcDNA=SeqID_83963; Strand=+; Position=1 -181,239-390,437-580
  Homolog annotation: Hit_ID=AAV34698.1; Match level="QueryCoverage =68%, HitCoverage=40%, E-value=1e-11, Identity=38%"; Hit description =IC5 [Globodera pallida]
MAFCEKAEGLNCYVYRNEGEFWTHCTSKKGKPKYSRDDVIGCGVNLASGRIIFTKNGQPLDTADLFVCPSSPSANDAVDHRLFPCVSLADSGDLIEANFGPNFKFDPANAEEFSNTKQRNCWDLAVCHNEITISGPHNLIVRHKGSGNGMLLLYLQEI

SEQ ID NO: 157541 - protein, 266 aa, Heterodera glycines
  Coding regions on vcDNA: vcDNA=SeqID_83964; Strand=+; Position=1 -275,337-597,662-926
MASADEYLHIFHFLHPKLLGVDLALRCNLFDAIVDAHFLSRIRTLGTMEIRQATGENGADDMQILNGTGELLPIADRPVPHRVVGFESIMISYISPTVATFLQNLGHLFASCDSYLLLEIVNGHVLEFVIHVLLPLIKQKVYRIEFDPTGQNGDAFHKLRQYVPGFLNECPSLRVDFESGASSAVNFIVLMTLTRGSVKPFTITNDVTREELKLEYRKDHGLLLVRCPISRDKAKWKAYEDGALEGAMNRNTIYVLKNCTGGWSVL

SEQ ID NO: 157542 - protein, 238 aa, Heterodera glycines
  Coding regions on vcDNA: vcDNA=SeqID_83965; Strand=+; Position=1 -243,282-701,916-969
MPSSKIHGRQAVSGTNDRTTIQMIRDHQILTATFQTAHIVEDMDKDVVAAFSTKDKEAEEIGEDQTTWLTAAGINDRTVLFRKNQFSPNSGPNLNAIHDSSEFHQDANRQTSNVTLDINELLRAFSVMNTQGPSSRGGNESASMNVISTMPADHPRIAEDAYQGTGGTQGNPSESNDQHKISQWEGIGPKLSKYFMILTAFMLLITGLINTTTANAPKHPMKCLNQFRLKLVQMNAGK

SEQ ID NO: 157543 - protein, 161 aa, Heterodera glycines
  Coding regions on vcDNA: vcDNA=SeqID_83966; Strand=+; Position=1 -59,198-621
MADMDKEDFVNLEIEPTAETPSGREFTYKTFLKNPLTNSPLKYCSQSATTINYPYTFVRMLFGDECCTSSTDQCKQPEATEEIFVSMAKTTATQPQAGRGGQPRTTDSTTNAPKMFSSKLTKKADHYKWPRGQTDNGCDQRKKLIGKSSIKNGWKNVKAAP

SEQ ID NO: 157544 - protein, 172 aa, Heterodera glycines
  Coding regions on vcDNA: vcDNA=SeqID_83967; Strand=-; Position=1 -79,406-505,551-749,970-1110
MPKYVQNMCQTPKYVRYVFMCENAKISKYKKRGGETAVAKARGEKSADGQGDTSSPGQEKRSTFDEQMPQQDEAGPSNSAASAEEAMEPPPPTPGPVPTPEMDEEILEFGFSLPSTSVTPIGDCLQEMRHCIPCGGDLSNFGRRCRTVYKCANSWSIISSRIGCWTPGDLTN

SEQ ID NO: 157545 - protein, 539 aa, Heterodera glycines
  Coding regions on vcDNA: vcDNA=SeqID_83968; Strand=-; Position=1-1619
  Homolog annotation: Hit_ID=XP_320889.1; Match level="QueryCoverage =92%, HitCoverage=62%, E-value=2e-54, Identity=26%"; Hit description =ENSANGP00000012033 [Anopheles gambiae] ref|XP_313651.1| ENSANGP00000013044 [Anopheles gambiae] ref|XP_314
MDKTLADILEKLTQAIKQQSAPTSTATQPAQNITLPDIHPFSTENAEEFEEWLERFQFALDCAVANMADEAKVKLLMTKLNPSAFGEYKRYCLPEEITKFDFADTKLRLIKLFSHPPSLAIDRYECLRVCREDGEQFEIFVNRLKAALRKFRFSELNEEEFKCLVLLTSLKSPSDAKLRQHILARLTAEGTKTTKTSKLFDKVVEDLNTQLKTEAEAKILEQPKPKINAIQHGKSSPNKHQNRGNGRPNQKFTGKSKAKIPPSNCYRCGELHWAQDCSKKENFCRKCNRRGHIDRQCDKIRAFHQNKGTNFKTNTVILPAAYINSVHSSNLLKAPINVNGTAIGFTLDSCAEIIIINEDDYNAMGRPPIHICSEEARFFDGKRCKFIGRGTATFPIHGIQTIQPFYVAKSGSLNLLGTPAMEAFGFLEEIRRMISPAQINQISSNDAAKIQQFVEILPQKYEQIFSDGLGFCSKMKANLMLKEGANPTFKRARPVPYSTLPIINAELDRLEKMNVITPVEHTDWSAPILVVKKANGTAR

SEQ ID NO: 157546 - protein, 203 aa, Heterodera glycines
  Coding regions on vcDNA: vcDNA=SeqID_83969; Strand=+; Position=1 -296,1294-1609
MAKILGNIENDGQILVLRSDSQIFHFILKYLANSTAEESANQTKFVIKYSFCFLAQFVEELLKKAMKVNELKELLNIELIGEAIESFADKKEQKCANKKLNQKEMLEWKLIEIELINEEKMGKWEAIESARKEWKENFDRTVFNENGRENGKIEEKMEQLMEELKHLQIEKGIGQNKNKNKQKEEEKEGKEGKKEKGKGKVEN

SEQ ID NO: 157547 - protein, 97 aa, Heterodera glycines
  Coding regions on vcDNA: vcDNA=SeqID_83970; Strand=+; Position=1 -194,551-650
MSMFELLQRRFNCICMLTRDGVLEILRVVHHVMCVQLRQFVNTPVRGPTVAHNCCTCVNVLLNQWEVKPLKLAQFEDDCEDWSAGGSRGRKKKKVLC

SEQ ID NO: 157548 - protein, 45 aa, Heterodera glycines
  Coding regions on vcDNA: vcDNA=SeqID_83971; Strand=-; Position=1 -80,210-267
MHEKLRNPILDTLTQLQNAIGKEKEASRMAELKTWNQAKNVVIWS

SEQ ID NO: 157549 - protein, 397 aa, Heterodera glycines
  Coding regions on vcDNA: vcDNA=SeqID_83972; Strand=+; Position=1 -103,287-769,960-1159,1207-1408,1667-1872
  Homolog annotation: Hit_ID=AAN11401.1; Match level="QueryCoverage =81%, HitCoverage=65%, E-value=1e-37, Identity=33%"; Hit description =metalloprotease 1 precursor [Ancylostoma ceylanicum]
MYKYFDKQSLKFSLFFFACFILCYDCFWVDIRKQGKIYEKFRKNEIEKLKQKKKRKEMDSEEVKKHNEEKEKVKKLMAEYKRKVNKQMEKHVEEMEKDEKLKEVLREIEEAQAKHPGEKRKAAKSITEINEKHWDELYQGDIELSVEQAQYLLDTVTKPENRALMRAKRGAASNARKFPNHKWPILVPFSFDGSISSEMKAHIYEAVKLWNDNTCLNIVEDDEVSPRIQFTNIKGMGCLSKVGMQSSDTYQEVKLEYPNCYQLGTIAHEIGHALGFFHEHERYDRDSFVTFYADNVDPKNYYAFEKETIEMTDNYQVPYDLGSVMHYNAKACHVTMNCDNDGFQNPDTCTTCICPQGYIGAKCQDVDIGGYAPASIANTCEGNILFATSNWQYVSIY

SEQ ID NO: 157550 - protein, 24 aa, Heterodera glycines
  Coding regions on vcDNA: vcDNA=SeqID_83973; Strand=+; Position=1 -64,572-582
MGAFGETQRLEQQQTEAPLEYEIN

SEQ ID NO: 157551 - protein, 21 aa, Heterodera glycines
  Coding regions on vcDNA: vcDNA=SeqID_83974; Strand=-; Position=1 -17,458-506
MKCLRLQLEDLVKSNYTKKII

SEQ ID NO: 157552 - protein, 74 aa, Heterodera glycines
  Coding regions on vcDNA: vcDNA=SeqID_83975; Strand=-; Position=1 -103,154-275
MAINFGSGILPNPKCEICETEIKPTEKLIVEKHTMHISCFKCAFCDVKLSIGACAMEPNLLERFGPLFFCADHM

SEQ ID NO: 157553 - protein, 28 aa, Heterodera glycines
  Coding regions on vcDNA: vcDNA=SeqID_83976; Strand=-; Position=1-87
RRVGSDFQRLAGRPIENGQTDEGINHFI

SEQ ID NO: 157554 - protein, 19 aa, Heterodera glycines
  Coding regions on vcDNA: vcDNA=SeqID_83977; Strand=+; Position=1 -19,233-273
MTNSNLASNEHSAFNFEGK

SEQ ID NO: 157555 - protein, 59 aa, Heterodera glycines
  Coding regions on vcDNA: vcDNA=SeqID_83978; Strand=-; Position=1-298
FPVGQPLDRFCFQKSPEDQFPFPGETIFSTKFSPTVTFKQCPGDKYLLRCENSKLINNF

SEQ ID NO: 157556 - protein, 401 aa, Heterodera glycines
  Coding regions on vcDNA: vcDNA=SeqID_83979; Strand=-; Position=1 -163,211-371,522-935,1359-1826
MRFFSRANVFTKREIAKQYVSALRRQDASIQQMRIIYQEKHRRTLHQIMELRGKSHLTKLNPNRDSQKIKRILAMRQYLLKRHNWDRILERKLADQTAMAAASFRHKKWMEQLASPPDDEQRDVEMAVAEMVNLVDECANSSRNLNIEEMHTARRNNFMSSDAFCPPLPKSVVDILEQLRKHSDEAGPLRKSTSRAIVQQNNNLTDPHGYLSNCGTFSMPKPSTSKALVDNNSVEAKTVVPVSIDDDLNPDLFLRISYPTLMDGQNQQFSPQNSKVRRWRKVDEKEDASQTCARINRPWDGTRHKGTKFAGGDLENNNNTNSTNISNNNTSGKYPLKMRTNAGIIHMLHPQTGKRSRRENNGQNNVHADNNMSYGTYQQYLSLQRLIPGPRYSLAKTISRT

SEQ ID NO: 157557 - protein, 102 aa, Heterodera glycines
  Coding regions on vcDNA: vcDNA=SeqID_83980; Strand=-; Position=1 -293,406-421
MENAHFLKISSGFHIVICFSSMCVGKLRSLIFEYPAELGRHLAVRLLCGVPATLRLFAWHFVQRVQSPLGVQSDVHGQCQHHRLLRAAAAGRTAGRKCFLKI

SEQ ID NO: 157558 - protein, 51 aa, Heterodera glycines
  Coding regions on vcDNA: vcDNA=SeqID_83981; Strand=+; Position=1 -58,119-214
MSPPTQACTPLWMNSSTLSGFGVGCVQAPLRALDVNAKTFSIWGCPIRLAT

SEQ ID NO: 157559 - protein, 168 aa, Heterodera glycines
  misc_feature (7)..(7): Xaa can be any naturally occurring amino acid
  Coding regions on vcDNA: vcDNA=SeqID_83982; Strand=+; Position=1 -83,124-198,268-333,612-696,984-1071,1294-1350
  Homolog annotation: Hit_ID=NP_491709.1; Match level="QueryCoverage =72%, HitCoverage=15%, E-value=1e-35, Identity=54%"; Hit description =tyrosinase family member (82.2 kD) (1G477) [Caenorhabditis elegans] gb|AAB52481.1| Hypothetical protein C
KNFGDTXENAKKCREGVGFHFLAFHSFIWEQWRLLHQNRQIWEQWRLLHQNRQQRETQFPPDSQICAGSQCAGSQNYLLSATMPFSRPRRAPGLSNSYTDSLYTYAPRPTCRAAGDCRSRYLFCDTTSGRPLCTSRIKPGGNCASFVQNPCFASTCVNGFCQAAGGAA

SEQ ID NO: 157560 - protein, 165 aa, Heterodera glycines
  Coding regions on vcDNA: vcDNA=SeqID_83983; Strand=+; Position=1 -278,340-559
  Homolog annotation: Hit_ID=XP_418257.1; Match level="QueryCoverage =92%, HitCoverage=11%, E-value=8e-18, Identity=37%"; Hit description =PREDICTED: similar to Paired amphipathic helix protein Sin3b [Gallus gallus]
MCDRLAKIKRRTEELAEEYHVELAIRERQKKLFEEKGDSVEAQLMNAVDVHLGLRDLKKPLQNPENFYQIMLQEMKNLLDGQVDASKFEDTLRSMFDTRAYVLFTMDKLVNTLVRQLQNFVGDSASGQCVEQFEKYFDQRVNGCESGQPAARVDKDYSEAMEKVR

SEQ ID NO: 157561 - protein, 172 aa, Heterodera glycines
  Coding regions on vcDNA: vcDNA=SeqID_83984; Strand=-; Position=1-519
MAELDKLGQSDGEDGGVGVGENSGEALDKRSLLLSEPVQITVTCLTPPTGAGRPRFYPYQHWGYNEAHRIRIRDWEDNYCMFHALIGARAYHDPVLFNEWMLADQQPQQQNLARLMLMQDFCETKEAFRRLIINRELMCSSVHRLMHAAGVPEGQHAYGMDHLQTVQHYWVQ

SEQ ID NO: 157562 - protein, 200 aa, Heterodera glycines
  Coding regions on vcDNA: vcDNA=SeqID_83985; Strand=-; Position=1 -207,462-857
ESKGHFEGQDFDWIIMSMCADNKDVEKEEEEKAKKKVEKEDGELKEESEDDDGDEIQLVGETKSTSTEAQPSPPEQSSALSTPQQQLTDDDNDDEHQQGEGRGTRAEGGSQSTGNDLFQQVSHSVHRLERFSVSRHITEFVLNANVEEPDEVLRGAFQILMERAIQNAEQQSGRKVLKIGVTLQGRGLIGRLVALLFLTY

SEQ ID NO: 157563 - protein, 112 aa, Heterodera glycines
  Coding regions on vcDNA: vcDNA=SeqID_83986; Strand=-; Position=1 -132,284-490
MPSSSSASSSAASSSATTATTTASVFFDTINNNNRKQLAQQWIRLSSNGSKHREDELVQALWTLRDQLIEGTVGVARHAELPPGEPPTTTAAAAAVPSSTSGSNKLNLIIYK

SEQ ID NO: 157564 - protein, 17 aa, Heterodera glycines
  Coding regions on vcDNA: vcDNA=SeqID_83987; Strand=+; Position=1 -21,144-176
MPLVFILGLFSRIYIKI

SEQ ID NO: 157565 - protein, 63 aa, Heterodera glycines
  Coding regions on vcDNA: vcDNA=SeqID_83988; Strand=-; Position=1-191
MVLTSLKLLVQFFGALSILQCNRLGWPSFRGVCNHLDNAWPAVAFGPSSAIASGNRLPECIEF

SEQ ID NO: 157566 - protein, 29 aa, Heterodera glycines
  Coding regions on vcDNA: vcDNA=SeqID_83989; Strand=+; Position=1 -45,531-575
MVYKLPKSCFKPSKNNLSFLPKFSLQINI

SEQ ID NO: 157567 - protein, 21 aa, Heterodera glycines
  Coding regions on vcDNA: vcDNA=SeqID_83990; Strand=-; Position=1 -51,208-222
MIYVGIRLTKLQNRAHEVYMI

SEQ ID NO: 157568 - protein, 48 aa, Heterodera glycines
  Coding regions on vcDNA: vcDNA=SeqID_83991; Strand=+; Position=1 -108,1177-1215
MMFGWKFCPVLTMLNSASNWHCFCPVLICWWTNISMMHIYIKLWQSVH

SEQ ID NO: 157569 - protein, 1440 aa, Heterodera glycines
  Coding regions on vcDNA: vcDNA=SeqID_83992; Strand=+; Position=1-4320
  Homolog annotation: Hit_ID=AAK54292.1; Match level="QueryCoverage =58%, HitCoverage=48%, E-value=3e-44, Identity=23%"; Hit description =putative helicase [Oryza sativa (japonica cultivar-group)]
MPSKQKNLRKKMKDVYRRQAERSVSRDNSPVSDGSADGNGEASASLRGTTTPSLSALQISTPASSIGSKKRGRPSKAGAKPILATQERVSLIDTPRTAVTQSDQGSPCKKRGKVAECGQPMFSNEAIALTPVSTQSRGGRPAKKIGGPGRGRLTDSMSKSSEMDINLENAPIPAPSHIVSEKIDFSTVPINFATSRNMACKIWRWAAIGLYERDGETALGPRSGPRLIETCWNRPNEWLNDSFIVAYLAYIASISQRKTVVVDSLASRTDVSRFSNVKNYTFGYDPNAVPEVVLMPLHFPNHWTLIVYDVAHGAYFLDSLHMSSLSDERMALIQSIIAEIVPGNASFAVEYVQQLTKQNDGNSCGYFVCLYAESWLMNNRTFVLPDLNINYEKKRILWHINELYGSDIVPFHPREGVSTSFAVVSHHNGDVAQTSSKVIMPMEVDDSAVLPSSEDTAVLAQAPVIGENQADTHGVVADTIVQQEPIAQADDVIFIRPKTPPRRSMRVQKRLSASVSRSPSPAPKRPPPANSMGVATPITRRCSAFHKGWQCAAAAAKHFPEYCDSGKLGDKKCADCGAHLFSHEDSTICCRKGRVVLPMLNPHPDELKQLIVGNKQSREGKEFVRHMSRYNNLFQFASVSTGNKPSPAGGPMAVILNGEFHRRISSMQAGTTQIPGFGQLYILDPVEAMEQRRNNPRFTGEKITNEDEFVQGHQLNEQTLEILEQMIQVYHPAAQAYKQAREQLTELLQQQTPEELRFFRMTLLNERRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFDSEAESDNESCETQSIASSDAGSVANSDAESVASVSSQHRRIDKSKQFISLRDYCKYYLAIRDENVELQYHHILSCGGGLGQRWILDQAAKIDWQIATFLRRPDMDLRISTPKNLLQYLVNQYNRQQARQNPNAQQKTVDDIGSVVRLSEHNVNSLQYWKKMYEDCNTVFARCHDAKKARLFITFTNNREWPEFKENIYKNGQVFTDRFDMWMRVWTSKIAEFREELYEKKFFGTILGYGESMEFQGRGGPHAHIVAQTDLDAVPYVIQEYIWAHIPSLPDKDDDTPIAKMHREIRETIHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKQESGNKIGIDEPAQYAKMNFRGATEAYAIVHSLPFAKLSHQVVKLSIHMPNQQPIVYRAFQLVSKAQQIQQGKLPETQCSAYWKQWQNEWKHDPKLKDMLFEKVPEHFIWAKDKWNKRKYNLTKRPPIGRIVPVPPKDPERFALYSLMRHFPGDPDHLKM

SEQ ID NO: 157570 - protein, 161 aa, Heterodera glycines
  Coding regions on vcDNA: vcDNA=SeqID_83993; Strand=-; Position=1 -54,98-191,295-500,628-682,745-819
  Homolog annotation: Hit_ID=NP_495041.2; Match level="QueryCoverage =65%, HitCoverage=7%, E-value=2e-21, Identity=46%"; Hit description =encoding in order receptor tyrosine-phosphatase isoforms, negative regulator of the Fibroblast growth fact
MGDSYTAKYDFRNPLCYHKRCICPPQFDPQFVLPPAPGFNTRLPMKCDKRELQVVFAATPSNFVNLGGAAYLFCCVNLDPRTFIPKDGVVFVQNDTIQHQPTSTPYESFSHDIDTYFSPTNARYRVINATMEFSVKALSVNHHNRRVPRSAQGKRRRLFND

SEQ ID NO: 157571 - protein, 225 aa, Heterodera glycines
  Coding regions on vcDNA: vcDNA=SeqID_83994; Strand=+; Position=1-678
MVENMAINLFNSLKLEHIKSEEEKTNENILENERKIAEMKRWRSAEKAMKERLKVLVNDASKKCQKMRKRLDRFLNKIGIKFDKMFGKNKKNEFDGEENDSRREDFVGCIYYYLYSFSLNLIRNIGTKKANAADNCDNYDTKQCQNGEKDTEMEIKNLRKIYENLREKMWQQIKIVYAKDDLKKMNDQLNGDQNADDDDEFKKCANIVDEDGEEPIFNEGDSIKE

SEQ ID NO: 157572 - protein, 24 aa, Heterodera glycines
  Coding regions on vcDNA: vcDNA=SeqID_83995; Strand=+; Position=1-76
ITGVSIIAVLFLVFLMLSQNLVRF

SEQ ID NO: 157573 - protein, 95 aa, Heterodera glycines; identical to SEQ ID NO: 124813
  Coding regions on vcDNA: vcDNA=SeqID_83996; Strand=-; Position=1 -544,844-884

SEQ ID NO: 157574 - protein, 58 aa, Heterodera glycines
  Coding regions on vcDNA: vcDNA=SeqID_83997; Strand=+; Position=1-249
NFLLIFKLHYFIFLAKLIHKYFFTNCSETHQFYLQVILGTQMLSLSKREMNKNLKIFN

SEQ ID NO: 157575 - protein, 24 aa, Heterodera glycines
  Coding regions on vcDNA: vcDNA=SeqID_83998; Strand=+; Position=1-96
LYKRSAGSVGIHCSVINALEFRIF

SEQ ID NO: 157576 - protein, 26 aa, Heterodera glycines
  Coding regions on vcDNA: vcDNA=SeqID_83999; Strand=+; Position=1-78
MGAIFENIALHDFVVKEVINSFPDKK

SEQ ID NO: 157577 - protein, 47 aa, Heterodera glycines
  Coding regions on vcDNA: vcDNA=SeqID_84000; Strand=-; Position=1 -56,836-923
MGRNGCRIRDHRPRKTINRSILRCSFVEGLLNDLLKKGALSGEYENM

SEQ ID NO: 157578 - protein, 57 aa, Heterodera glycines
  Coding regions on vcDNA: vcDNA=SeqID_84001; Strand=+; Position=1-173
MFSYSPLSAPFFSKSFSSPSTNEQRKIDLKFTDLCEYFFISHPFSGRKEGSEHRRHI

SEQ ID NO: 157579 - protein, 196 aa, Heterodera glycines
  Coding regions on vcDNA: vcDNA=SeqID_84002; Strand=-; Position=1 -304,352-638
MSHSLLKRPLNSNSLNQIPQKRHFLNEVTSTNLAIDTLDDDPSISPAARVIISQLSNLLKIAVSLVNNSVSDIDFLDQLGVETHSIVSYRMGWYSKDRARNAHMPSPMEQKIIGNSLNIRELLTQEQLKSRRELQAQCAEKRKETSADWIIYNGMLVLRSEIKGRRMNGENLSGPFPHIDSLLTRYRKNSFMTAMF

SEQ ID NO: 157580 - protein, 298 aa, Heterodera glycines
  Coding regions on vcDNA: vcDNA=SeqID_84003; Strand=-; Position=1-894
  Homolog annotation: Hit_ID=NP_510671.1; Match level="QueryCoverage =96%, HitCoverage=29%, E-value=6e-55, Identity=41%"; Hit description =predicted CDS, endonuclease/exonuclease/phosphatase family and RNA -directed DNA polymerase (XR69) [Caenor
IFQIKIHNTSPDNISFKFLKTFHLILARHLTDLFNLSLCSGNLPKIWKTSLVLPLFKNGDKNLVNNYRPISITCSCCRIFERLIAKKLTEFLLKNNLISEHQFGFLKRRSTTLQLISSLEDWYNAILRNQKIDIIYLDLQKAFDQVPHDLLIYKLKKPGITGNLLNWLRDFLLGRTFKVRINQKFSNEFPVKSGVPQGSVLGPILFLIFINDLPEEIPKEISIKLFADDTKIYHCYSNESQRKVLETALISVFNWAETWGLNFSVKKSSVLYLGKNNKKIPYTIKNSTFPESKIISDL

SEQ ID NO: 157581 - protein, 40 aa, Heterodera glycines
  Coding regions on vcDNA: vcDNA=SeqID_84004; Strand=-; Position=1 -77,1174-1219
MSEVDKAQLAPMIPTTVVILGIFNCRKILSNMDLNDNDTT

SEQ ID NO: 157582 - protein, 143 aa, Heterodera glycines
  Coding regions on vcDNA: vcDNA=SeqID_84005; Strand=-; Position=1 -118,204-332,925-1107
MSVRKCPSANVRPQMSVRKCPSAKVRPQMSVRKCLVAILVPSDVLTVGEIDAILYHFLPNQPMPSIQNNELQFPTNRRSTYDDPNKAHGMLAMKIKMSDLLLNNSKHVSRAVYIQALPWRLAVHKSKYSLRFYAQYDTTKMKM

SEQ ID NO: 157583 - protein, 86 aa, Heterodera glycines; identical to SEQ ID NO: 143181
  Coding regions on vcDNA: vcDNA=SeqID_84006; Strand=+; Position=1 -8,165-417

SEQ ID NO: 157584 - protein, 310 aa, Heterodera glycines
  Coding regions on vcDNA: vcDNA=SeqID_84007; Strand=-; Position=1 -47,108-383,440-794,1072-1326
  Homolog annotation: Hit_ID=AAL78214.1; Match level="QueryCoverage =47%, HitCoverage=77%, E-value=8e-10, Identity=27%"; Hit description =putative esophageal gland cell protein Hgg-20 [Heterodera glycines]
MSDNRNEAEQKMAKAIFISADCWLCVYDLLPASQLGLGIAMISHRFDFYVDEHFKTRRWTLRSMAIKFKSKSDGTVGMDIVNYAGKALPIPQNPLPKKIIGFKAISMKYFNNNAIAFPGNFRQLFAKCPINLTIDTFKDRILEFFLHNIWPMIARNICAIQLSDEVFRRLRLLVPSILDDCPSLRIINAYYDGFFAEFPANDNDNASNGQAVAKWLFTCRPDNVPKAFTNASSPVNFIVFIRFPPTFTEFVLLFDLINELTREQLTLRMTDIGHFLLIRCPIVRDESKWTKWEKEAIEWNFIDQWNRIDI

SEQ ID NO: 157585 - protein, 250 aa, Heterodera glycines
  Coding regions on vcDNA: vcDNA=SeqID_84008; Strand=-; Position=1 -58,109-608,679-873
MIKNVMNRRHGSAHSPMEIANEKPIKAIEKNIIRPKIEINLENEFGGQNTIITNISPNFKCPLNEYLSAVVDYNGFYFNVPAKTIEKIAMNLIFAVLSSQKWSIKHQQNSDQPIFDGILTFDHFSVIRQNEFEFGAEELAGNLKIEFNGTKNIQDPRERTLPPEQRPKEQMIWLKDVVFMSPEQIKDNRNTTTGKDLVWFVGLLLYRMLFDNKHPMDNCGAKRRLDMDFMPKMCISKLKQFNCMYKTTIL

SEQ ID NO: 157586 - protein, 202 aa, Heterodera glycines
  Coding regions on vcDNA: vcDNA=SeqID_84009; Strand=-; Position=1 -72,115-387,604-864
MHSQAASALARTNNGLEATHLHFMKGLCHHPALSDFICGVNENIDRQVDAARSARHFIHKRHKRYILQDAVIMRILADASYNNNGEIRDLMTALGLQIEGYAAKLKDFVNFDDSIAWTFRGLDISWLGHFVAWSALVSGRESQGDSKRVNSVWPTPSRQLRLANSVLGPTPSGQLRLANSVLGPTPSEPTPSRQLRLANSVL

SEQ ID NO: 157587 - protein, 53 aa, Heterodera glycines
  Coding regions on vcDNA: vcDNA=SeqID_84010; Strand=+; Position=1 -32,200-553
PSGQLRLANSVLGPTPSEPTPSRQLRLANSVLVPKEPTPSQIKKIYKKFFNEF

SEQ ID NO: 157588 - protein, 236 aa, Heterodera glycines
  Coding regions on vcDNA: vcDNA=SeqID_84011; Strand=+; Position=1 -87,359-556,734-824,883-970,1025-1200,1272-1339
  Homolog annotation: Hit_ID=NP_353964.1; Match level="QueryCoverage =71%, HitCoverage=31%, E-value=7e-25, Identity=37%"; Hit description =hypothetical protein AGR_C_1721 [Agrobacterium tumefaciens str. C58] ref|NP_531642.1| sucrose hydrolase [
MTSDNRTLTLTLTNESIVHFWIHPVTPGDIAKVFLCPSANDGLQQQQQQVAECAKYSSDRWYEFFEINGAAAGEYLLRWTEHTKLSLVYVYEPKTVLEEGIRIIFVNENAKLPSLGGSYHFRAPFGWTSDPSGFVRSKDGLFHLFYQHYPHAKQYYLIHWGHAVSKDLVNWVHLPIFMIPPNVLHLDFEVGYFVGSVVNLPSDDFGIFWTQRIPLVLRGTESENPWRENQNFVSTK

SEQ ID NO: 157589 - protein, 97 aa, Heterodera glycines
  Coding regions on vcDNA: vcDNA=SeqID_84012; Strand=+; Position=1 -195,746-844
MGEKRSGNGNIETAGHFVGGQPGQNVRIANANCLGRPARLKHEMAAVVHAGQGVVHNVRERRRRKELVLSENEQFLLVKPLPELNSLRMAKKPQNLK

SEQ ID NO: 157590 - protein, 23 aa, Heterodera glycines
  Coding regions on vcDNA: vcDNA=SeqID_84013; Strand=+; Position=1 -14,115-172
MARLSVNFKCQICVKMVEISKTT

SEQ ID NO: 157591 - protein, 110 aa, Heterodera glycines
  Coding regions on vcDNA: vcDNA=SeqID_84014; Strand=-; Position=1 -105,394-621
  Homolog annotation: Hit_ID=CAE64606.1; Match level="QueryCoverage =78%, HitCoverage=29%, E-value=1e-18, Identity=53%"; Hit description =Hypothetical protein CBG09362 [Caenorhabditis briggsae]
MDRLLLETDAPYMYPNLEDKKLRKDIDIRQRISTEALALHKHSDFKRNEPSSLAAICELVAAFMDCPAHELANATTANAQRVFGLELEDNHHQQQQQGQQQCNQRQRKRK

SEQ ID NO: 157592 - protein, 42 aa, Heterodera glycines
  Coding regions on vcDNA: vcDNA=SeqID_84015; Strand=+; Position=1-127
MLVISGWQTLVQGRQDGDESVWSTDRCPPPRSGSSQATRDQP

SEQ ID NO: 157593 - protein, 44 aa, Heterodera glycines; identical to SEQ ID NO: 147826
  Coding regions on vcDNA: vcDNA=SeqID_84016; Strand=+; Position=1-189

SEQ ID NO: 157594 - protein, 34 aa, Heterodera glycines; identical to SEQ ID NO: 124987
  Coding regions on vcDNA: vcDNA=SeqID_84017; Strand=+; Position=1-102

SEQ ID NO: 157595 - protein, 34 aa, Heterodera glycines
  Coding regions on vcDNA: vcDNA=SeqID_84018; Strand=-; Position=1-244
YKNKSDFGIRDQRGVTMIFEWKIFFTKNLSKTCH

SEQ ID NO: 157596 - protein, 127 aa, Heterodera glycines
  Coding regions on vcDNA: vcDNA=SeqID_84019; Strand=+; Position=1 -335,393-441
MAYGRLGRPFNVNVAAHFYVRHRIKLRHPFLHCAVESFPEGQEDRFYPLELCEMEDGSSEPDWLGRIFTEIRNDNYTETMSSANREVLTPEDTSMSREGRDECSQNISYTLCQKVLFPILNFFENVF

SEQ ID NO: 157597 - protein, 240 aa, Heterodera glycines
  Coding regions on vcDNA: vcDNA=SeqID_84020; Strand=-; Position=1 -24,87-366,419-706,747-838,882-920
  Homolog annotation: Hit_ID=NP_001004509.1; Match level="QueryCoverage= 90%, HitCoverage=15%, E-value=1e-21, Identity=30%"; Hit description =si:busm1-180o5.3 [Danio rerio] emb|CAD60788.1| novel protein similar to DNA polymerases [Danio rerio]
MTDKEAGLLNAALEEGYRVTELLRVLEYHKSDNKLFRPYMSEFVVEKLHASGFDEQIKGNFEAEEQFIAECWDQFGIKIDRTKMVPNKGKRSLAKLAVNNLWGRFSLRNYGLSQTLITDDPSELGNYLDNKKIEISGLDMLTPERILISYQLKKDWIKEHPCSNVVISLFTTSAARLHLLKSMQKVVRSPGCTLLYTDTDSLFLVHPEDSNPLQTGVHLGQLTDEFPKHFRVLDFGHISP

SEQ ID NO: 157598 - protein, 225 aa, Heterodera glycines
  Coding regions on vcDNA: vcDNA=SeqID_84021; Strand=-; Position=1 -339,455-793
MSQQYQPQNFQPQNFQQPQNFQQPQHVQQPQMLIPQHYGYIPVAPQPQQQPQSVQNVLPAANGQAYQPAQPLMQMVVPPNAAPPMQQPSGGGHVPRPVRPNVEQNANGNQQQQRRGAAPYRRNNRNRGQQPANGTNAHQPGAKAVPARAPTPRVEQLLTELLGEVHNFTGQFAHFAGQFSRFFAHVKKNTIPPPLPNGDDEEEEEEEESDQEEGEVEKENGQKDD

SEQ ID NO: 157599 - protein, 120 aa, Heterodera glycines
  Coding regions on vcDNA: vcDNA=SeqID_84022; Strand=+; Position=1 -167,213-408
MLFFGLSRHRRAYNRRKKQMNKDDSSDPFNVPEKLQMTKRGAIKLILRKKLTSNDMWLRFRENEIGVMLFITPTQKNAASHCKVLVSDGTFELAPLSFQQIWTIHGLVSFDYGLVLLNLI

SEQ ID NO: 157600 - protein, 69 aa, Heterodera glycines
  Coding regions on vcDNA: vcDNA=SeqID_84023; Strand=+; Position=1 -204,326-331
MGRRNFNGFTRIHSDYETAEVNALTKIFGANKVYGCIVHFIRAVVHHIKSSFQNLFREFNERKDVWKWK

SEQ ID NO: 157601 - protein, 66 aa, Heterodera glycines
  Coding regions on vcDNA: vcDNA=SeqID_84024; Strand=+; Position=1 -141,419-478
MIDELDKKSGTECKNKEVYCFCVPLHFDQIIRGMCCDSNKKCECCKTDPEIKKRPQVKIVVVFLLI

SEQ ID NO: 157602 - protein, 43 aa, Heterodera glycines
  Coding regions on vcDNA: vcDNA=SeqID_84025; Strand=+; Position=1 -123,204-212
MRRSVCVLSEGWEASACCPKNYQLVDLDDRYDERLIPLGLWVF

SEQ ID NO: 157603 - protein, 170 aa, Heterodera glycines
  Coding regions on vcDNA: vcDNA=SeqID_84026; Strand=+; Position=1 -81,534-734,1005-1130,1464-1565
MVADQRTVVVVENTTTEPNTDMDTVNDLKEKRKVPTSKDKLVDRKRFTMSDLVRWKPKTENTLKRKWAERRRQLKEDTVDGEATGQPEHQDQQQALPAVNDGGTSGSGQHDCVVPTAAQPQKQGPSSAPTAAAGPRVMINERGEMVVDEQSLVVIENPEQNTAGMETVND

SEQ ID NO: 157604 - protein, 39 aa, Heterodera glycines
  Coding regions on vcDNA: vcDNA=SeqID_84027; Strand=-; Position=1-117
LHRAVLVPAAVAGVGQQLRPHRVDGQQQSARHCPARTAP

SEQ ID NO: 157605 - protein, 97 aa, Heterodera glycines
  Coding regions on vcDNA: vcDNA=SeqID_84028; Strand=-; Position=1 -106,193-289,498-585
MAFCSYPKYLLIILLWQLIYVAISNPTTEELSKNEGGNADDIQMLVEEAIDMAQNLSMIVSPKALVGRGDTAEIVAFSLFPSPFPRQLFEQAKSVQM

SEQ ID NO: 157606 - protein, 49 aa, Heterodera glycines
  Coding regions on vcDNA: vcDNA=SeqID_84029; Strand=-; Position=1 -42,359-466
MGELNFRRRKKKWKHLFWVYRLLRRRHLRRDICASTLAPPYKIHLHRSK

SEQ ID NO: 157607 - protein, 360 aa, Heterodera glycines
  Coding regions on vcDNA: vcDNA=SeqID_84030; Strand=-; Position=1 -268,500-591,638-1183,1349-1522
  Homolog annotation: Hit_ID=NP_508190.1; Match level="QueryCoverage =82%, HitCoverage=34%, E-value=1e-83, Identity=48%"; Hit description =DIACYLGLYCEROL KINASE (dgk-1) [Caenorhabditis elegans] gb|AAC48135.1| Diacylglycerol kinase protein 1, is
MINNHQQQQQRSTTTQSFCSSMAADGSGAAAAATASVSAAMAATSSTASTEVSTDLGHVFAKKTFGKPTYCHHCCDKIWGMLSQGFACEDATSAVCAVKGQRTADCPRSVRCATVMCTSTDLALADCREASTYVPSLDLVTHKQQHHMREGNLARDAKCAVCRKGCYTAECFSGFRCQWCNLSVHSTCFRQLRSQCDFGVLRKIMLPPNSVTIPRAELPMDMLLNIHTGSIGNEGSRKVSSPSRMTADEREGWPGAGGPGREEDKESEDYLLLRIYDGNSSLRNQISRTASVPKTASVEQIRDIALRRFHICDNRDNYYITQAPHESGDEEEMLEDPIPLRNVKKPEGKCAQGGQGQSQP

SEQ ID NO: 157608 - protein, 75 aa, Heterodera glycines
  Coding regions on vcDNA: vcDNA=SeqID_84031; Strand=+; Position=1 -7,719-936
MAQEDAKQTEGTQKAAMGGGTGGKSDGEELKGRGTARRRSDGTGGGDGVGEEKGTVEEKRRGRSEDEQIWEWSGK

SEQ ID NO: 157609 - protein, 80 aa, Heterodera glycines
  misc_feature (64)..(64): Xaa can be any naturally occurring amino acid
  Coding regions on vcDNA: vcDNA=SeqID_84032; Strand=+; Position=1 -110,163-250,302-343
PFFGLFLSLYLSPKAENAAPSARIVRLLRSISCLNYVRFGHPRLLFLRDQFLLHHRSGRLDSVXRNLVPFAPLFGPHSMS

SEQ ID NO: 157610 - protein, 94 aa, Heterodera glycines
  Coding regions on vcDNA: vcDNA=SeqID_84033; Strand=-; Position=1-285
MAALGDAERDEHPILPKVGHAEHWHQEKEEGEAQNSQQPLSDCIGLNNEKNGETDHNEKVRHEEEVILGQISEECHGGNGTKDDAEANEGQTEK

SEQ ID NO: 157611 - protein, 42 aa, Heterodera glycines
  Coding regions on vcDNA: vcDNA=SeqID_84034; Strand=+; Position=1-131
WCPFAPLFGPPFDVRHLPRGTTGLSAAPRNGQGDEQLKSQTI

SEQ ID NO: 157612 - protein, 116 aa, Heterodera glycines
  Coding regions on vcDNA: vcDNA=SeqID_84035; Strand=+; Position=1 -147,197-397
MEEAPKNGRHQQKNKNEQQLTASELRHYEADFDESDPKWKCWPERKHVQKVAFHASVATVVLAVLLLLLALLLLRPLFLRLSFVSLGVVLCAVSAMAFFANLAQNDFLFVPYLFVV

SEQ ID NO: 157613 - protein, 188 aa, Heterodera glycines
  Coding regions on vcDNA: vcDNA=SeqID_84036; Strand=+; Position=1 -135,214-361,620-807,850-942
MKTCVVCTCLVSIVYSIYMNWFPERRPFHCLIQLGYFEPMTSITKYITATLPDAGLYDAVQIAELASICIPFFLYGITVIKMVHDHKKNPSTSIIQVATVMPRGSQSNGEERAKFVNLMQERTRLFSMCLLSQVPYYLSHALYQSSRIFELSEDTVQILAILWQLLGTIFHVQQPILMLLLSKDLRSS

SEQ ID NO: 157614 - protein, 201 aa, Heterodera glycines
  Coding regions on vcDNA: vcDNA=SeqID_84037; Strand=-; Position=1 -154,1215-1399,1450-1504,1581-1715,1836-1910
  Homolog annotation: Hit_ID=NP_509363.1; Match level="QueryCoverage =75%, HitCoverage=76%, E-value=8e-34, Identity=47%"; Hit description =mammalian VEntral Midline antigen related (vem-1) [Caenorhabditis elegans] gb|AAD31555.1| Vema (mammalian
SDGLNVFELGSENDFDGWRRKSQGTEFIQFPLGQIAFSKPNSPSWSNSTPIDVVLVVLFVYVVYKLFFARRHIPPPPDVPQVEPLEKQDMTVEQLRRYDGVQDEHICMAICGKIYDVTKGRDYYGPEGAYGALAGHDATRALGTMDVKQIKDEFDDHAGIDPSDLEEAKEWQQRLSLKYPFVGRLLAPGEQHTEYETVAEN

SEQ ID NO: 157615 - protein, 94 aa, Heterodera glycines
  Coding regions on vcDNA: vcDNA=SeqID_84038; Strand=-; Position=1 -84,480-680
MALPNRPPYLPDNWDNDVEMSGLMSFLKCRTRSIEGGTRKAESGLAAVEHLFAEAEQLASGPRESNGRRKKAPIRIGAHPHTKRNFLDFQTDQL

SEQ ID NO: 157616 - protein, 261 aa, Heterodera glycines
  Coding regions on vcDNA: vcDNA=SeqID_84039; Strand=+; Position=1 -91,151-248,306-448,588-839,1047-1247
  Homolog annotation: Hit_ID=NP_766304.2; Match level="QueryCoverage =92%, HitCoverage=87%, E-value=2e-38, Identity=38%"; Hit description =ring finger protein 3 [Mus musculus] gb|AAH49266.1| Rnf3 protein [Mus musculus] dbj|BAC40745.1| unnamed p
NGNGKPIEAGPSGNCARENLIRLNSLNPYITCPLCNGYLVEATTVIDCLHTFCKSCLLKYFEDNNDCPKCHNQIHQSHPSHYVAFDRTMQDIVYKLVPGMQAEEQRRREQCKKRHQQMKEAREMNGRAAEKHNHQNISSSSSATAVIPPPNTNDENSAECAEQRKSANLATAAPKTEKMDENGDTNGLSVYLAAQDEPVLIRLVPGSTLSPLDRPFVRLSAFSTVNTVKRLLAFLLLNDITKYNDFDVFCNRELMGRDFSM

SEQ ID NO: 157617 - protein, 19 aa, Heterodera glycines
  Coding regions on vcDNA: vcDNA=SeqID_84040; Strand=+; Position=1 -15,83-127
MPKKKGCKKYARKMAKIYA

SEQ ID NO: 157618 - protein, 222 aa, Heterodera glycines
  Coding regions on vcDNA: vcDNA=SeqID_84041; Strand=+; Position=1 -63,446-553,964-1018,1106-1212,1713-1812,1860-1973,2025-2145
  Homolog annotation: Hit_ID=NP_505680.2; Match level="QueryCoverage =68%, HitCoverage=29%, E-value=5e-46, Identity=57%"; Hit description =amino acid/polyamine transporter, family II (57.3 kD) (5K912) [Caenorhabditis elegans] emb|CAD54163.1| Hy
MAYRAMGQHAKSFTSAILNIMTGQLGSEGTRVGIPTESRFPINPEDFGKTIGTEPAEHDMRRPKKFTRSSFLAFAIVASMYVPISFFGYYVYGDSLHDSIISSIQTPSIQQFANLFIALHCILTLTVVINPLNQEIEHLLDIPHQFGWQRILVRTFVMFSVVFVGLTVPSFGPILNLIGGTTVALTSAILPCLFDLYLHSSDNKKGVQKLGGDQQQNTTNFK

SEQ ID NO: 157619 - protein, 309 aa, Heterodera glycines
  Coding regions on vcDNA: vcDNA=SeqID_84042; Strand=-; Position=1 -81,189-237,347-427,469-545,652-760,807-866,974-1079,1137-1297,1866 -1906
  Homolog annotation: Hit_ID=NP_507623.1; Match level="QueryCoverage =97%, HitCoverage=43%, E-value=1e-75, Identity=49%"; Hit description =general substrate transporter family member (66.7 kD) (5T3) [Caenorhabditis elegans] emb|CAA16400.1| Hypo
SMNIVSPTAAGPKLPKHKPKLGKFIYLLAFIAVIGGFLFGYDTGIVSAAMLYVPKNSDLKPMSNAWIGLIVSITPGMAGVGALLAGKASDIFGRLIVSITPGMAGVGALLAGKASDIFGRRKMIIMIILSTIIFTFGAIVCAIGLSKWILLAGRILLGIAIGFASMIVPIYVSFASMIVPIYVSESSPAHIRGRLITSFQLMITFGLVAANIFAFAFSYIDPLNWGWRLLMVGFAAIPSVVQFVGFWFLPESPRWLYENKSHKECEEVLSKIYNGDTAWIQFELSEIQTAHDQQRQNISGSGSIIWRIL

SEQ ID NO: 157620 - protein, 95 aa, Heterodera glycines
  Coding regions on vcDNA: vcDNA=SeqID_84043; Strand=-; Position=1 -108,160-285,509-562
  Homolog annotation: Hit_ID=CAE71771.1; Match level="QueryCoverage =78%, HitCoverage=84%, E-value=2e-19, Identity=54%"; Hit description =Hypothetical protein CBG18766 [Caenorhabditis briggsae]
MALKMGQVKAEFDFEAQPGSGELTIKTGEILTILKEGIEGGWVEGRNSKGKVGLFPASYVKKFQAENASIYPQLSISKRFEHSKFAMSLVSHFIP

SEQ ID NO: 157621 - protein, 38 aa, Heterodera glycines
  Coding regions on vcDNA: vcDNA=SeqID_84044; Strand=-; Position=1 -75,557-598
MMKKFTVEEEKLNIEMTSGAIVAWQKFDALRGGKQGNE

SEQ ID NO: 157622 - protein, 161 aa, Heterodera glycines
  Coding regions on vcDNA: vcDNA=SeqID_84045; Strand=+; Position=1 -123,181-249,1367-1660
MYHFLFLICLAALFAPHGVLCRHKHFHHRVPIIDLDGAEQLVGTIREDDRTVNVSPKLRICKEQVIAFGAAGAECQAEADLELEQIGSEHQVKADALAECGLSSADAVELLPEEEGIRKLQPDGMKKKKKDEAEKEDAEAEEEEEEADRDTEGKAALDGKT

SEQ ID NO: 157623 - protein, 167 aa, Heterodera glycines
  Coding regions on vcDNA: vcDNA=SeqID_84046; Strand=-; Position=1 -36,84-551
MDEQNSSEPLKKIFLLKMCCYCKNVCSGAHQCRKCSKPCHAIAPCSFLAEDDEGFGAKVTCCSCWLDDDGIMDQNANAIVINEATNKDKDDDAFKQFVNTQTIAEDNDNTDALASPSTRKRRGYTMTKNRHFGLRQDVVHSRRQPTLQSGRNTVRDWKKQETALRKT

SEQ ID NO: 157624 - protein, 111 aa, Heterodera glycines
  Coding regions on vcDNA: vcDNA=SeqID_84047; Strand=-; Position=1 -150,500-595,642-729
  Homolog annotation: Hit_ID=NP_608348.1; Match level="QueryCoverage =98%, HitCoverage=20%, E-value=7e-11, Identity=35%"; Hit description =CG14232-PA [Drosophila melanogaster] gb|AAF49009.1| CG14232-PA [Drosophila melanogaster] gb|AAK93272.1| L
DLTSEQAMLEFVRLLDVVCPSFRAQLEIERKAKTNEPNQKATIDNPSKDSNGQSKNDCHLNVLVDSASIRAQEVLEQFEQQKRQIQEALNKQTYHQFLAYAQQTHPGEPTK

SEQ ID NO: 157625 - protein, 39 aa, Heterodera glycines
  Coding regions on vcDNA: vcDNA=SeqID_84048; Strand=-; Position=1-118
MDVIEYESPREQTEISANLLSDFGVTAQQAYKIAVTFYK

SEQ ID NO: 157626 - protein, 64 aa, Heterodera glycines
  Coding regions on vcDNA: vcDNA=SeqID_84049; Strand=+; Position=1 -13,241-422
MGAPGIRGQSNTLETCNMTYKCQIFDDRLTPATAQCACLFVRHPTVNATPSGKDPEQMLKAKMS

SEQ ID NO: 157627 - protein, 49 aa, Heterodera glycines
  Coding regions on vcDNA: vcDNA=SeqID_84050; Strand=+; Position=1-149
MDHARTQSLPSQQRLSVTGRKGSDVQRKRSLVEHAEAAGFDKNTIILTV

SEQ ID NO: 157628 - protein, 263 aa, Heterodera glycines
  Coding regions on vcDNA: vcDNA=SeqID_84051; Strand=-; Position=1-793
  Homolog annotation: Hit_ID=CAG83749.1; Match level="QueryCoverage =68%, HitCoverage=37%, E-value=2e-27, Identity=40%"; Hit description =unnamed protein product [Yarrowia lipolytica CLIB99] ref|XP _499823.1| hypothetical protein [Yarrowia lipol
GRESGKGIESLSESGTGTGSGRESGTGIESGRESGKGIESLRESGKGTGSGRESGKGIESLRESGKGIESLRESGKGTGSGRESGKGIESLRESGKGIESLRESGKGIESLRESGKGTGSGRESGKGIESLRESGKGIESLRESGKGIESLRESGRGTGSGRESGRGTGSGRERGRGTEEEEQKVEEEQKVEEKVEEEQKVDEKEKVEETVVENVEEQQKVEEKMEETESGRESGRGTESGRENGRDRKWKRKWKRNRKWKRK

SEQ ID NO: 157629 - protein, 92 aa, Heterodera glycines
  Coding regions on vcDNA: vcDNA=SeqID_84052; Strand=-; Position=1 -91,463-650
MAREDFISHSDKKKAVQFYRSSEKGHRSLSYHEVHFNVLVPVLRPGEQSLLLVDSWNGWNDFRLPDNVKLKVKQIPKHATGICQPLDVYIFR

SEQ ID NO: 157630 - protein, 116 aa, Heterodera glycines
  Coding regions on vcDNA: vcDNA=SeqID_84053; Strand=+; Position=1 -121,879-937,1879-2046
MAREKQQQQQKKQNELRKDMTMLDRAIVAVENARDAAAENGKINPSHENVLLETDYGLTISHVCKDNNTRRAWLRRSPSLFCCLSLPADCDRRTESGAPRRDLTEHGDDGQQKHLQ

SEQ ID NO: 157631 - protein, 552 aa, Heterodera glycines
  Coding regions on vcDNA: vcDNA=SeqID_84054; Strand=-; Position=1 -510,566-1714
  Homolog annotation: Hit_ID=NP_507780.1; Match level="QueryCoverage =75%, HitCoverage=26%, E-value=1e-25, Identity=25%"; Hit description =predicted CDS, DNA polymerase type B, organellar and viral family member (5T899) [Caenorhabditis elegans]
MAMLTMSTTTTTGGDAEPNRRRRPLRFLFWDVECAQVADENEEGDEGVPARVLKHVPLLVCAEVICERCVAAGVDLEREPDRRAPGCCCGGAAWRDGQHRQWLMRAREDAFSDDDDDNADGGRRWRRPNPRRLRFFHDAANGRTPMAQFADFVLHDGPVNVRTVMLANNGGRYDVHLLMEELQRRGVRPRRLVATGLRVYTLELGGRNQRSVVAKDSLNFFGCALSKLPAMFGLDGVPDKPFFPYNYIRAENMDVAHVGLPPAADYDPDRMRPAERDAFQRWHAEEQQRRPNRLFVLRRELLRYCANYVRILRRACLRFRHVVGELSGGVEPFLAASTIAGLALAIYRQQHLPRDLMVHTPEGGFLRGRRASAASRHFFALLERLRPQWRGRLRTARWSIGEACVEDDGYRLDALLYRPVPLRPLVIEFNGCFFHGKDGGGGAPFPFASSKVAPSATRGAIKCWRAAKPPSRCVPGHGSVPGSWSSTTASRCARCGSAPSSGGCAASPPECGACTRMCAGRCPARWTCAGTRCSAAEWSRSRSTTRAQSERK

SEQ ID NO: 157632 - protein, 61 aa, Heterodera glycines
  Coding regions on vcDNA: vcDNA=SeqID_84055; Strand=+; Position=1 -127,688-746
MEALQAETEKLKLIMENIVLQAKVDKMEEEKGQYEKELMGNYKIFECTTPIESLGFECLSQ

SEQ ID NO: 157633 - protein, 108 aa, Heterodera glycines
  Coding regions on vcDNA: vcDNA=SeqID_84056; Strand=+; Position=1 -15,71-157,510-617,843-957
MFFYKKKTTQSKTNSDQQKMWEQKFKEGQAKLTEAEAQNQKLKNDIEKMQAKFDGKVAQLEKNLEELQKNQKELVTEHNELKAKVDKIEQQEQQKQQQEDSSKTQTND

SEQ ID NO: 157634 - protein, 95 aa, Heterodera glycines; identical to SEQ ID NO: 133575
  Coding regions on vcDNA: vcDNA=SeqID_84057; Strand=-; Position=1 -787,952-1140

SEQ ID NO: 157635 - protein, 104 aa, Heterodera glycines
  Coding regions on vcDNA: vcDNA=SeqID_84058; Strand=+; Position=1 -233,471-552
MPIEPFELVNERTNEKLTLTEDEDYDGEFIGGGEVIKDWLLKRCPIVGETAAVQQKKKDENLDHLCGLYFNLHGNCIGPLSPPDQSDEKVFSFPGPSDQRKKKK

SEQ ID NO: 157636 - protein, 248 aa, Heterodera glycines
  misc_feature (10)..(10): Xaa can be any naturally occurring amino acid
  Coding regions on vcDNA: vcDNA=SeqID_84059; Strand=+; Position=1 -216,283-327,374-436,477-528,584-618,660-797,894-935
  Homolog annotation: Hit_ID=CAE63281.1; Match level="QueryCoverage =84%, HitCoverage=37%, E-value=8e-40, Identity=44%"; Hit description =Hypothetical protein CBG07660 [Caenorhabditis briggsae]
VNSVFFFPSXKRKMTANESFALDAKVELVPISPVILRVSFIMSLAILGNVLLVFVIRRGNAVARQRLSPVQLLLLHTCTADLLFALLLLLHTCTADLLFALLSLGTLSLGTQIAILATYPYFHGPDLLCRFVRYLQALLCRFVRYLQALPMYASPFLLVAISIDRYQLLVAISIDRYQAICRPLAHYRAICRPLAHYRSDRYRRPNCLGIFAWLLALLCSVPQLFFWRKDSLSNECHTIYSIYSQCHF

SEQ ID NO: 157637 - protein, 197 aa, Heterodera glycines
  misc_feature (2)..(2): Xaa can be any naturally occurring amino acid
  Coding regions on vcDNA: vcDNA=SeqID_84060; Strand=-; Position=1 -199,296-475,696-761,829-948
  Homolog annotation: Hit_ID=CAE62706.1; Match level="QueryCoverage =92%, HitCoverage=50%, E-value=6e-42, Identity=50%"; Hit description =Hypothetical protein CBG06858 [Caenorhabditis briggsae]
LXMPHRAYLRMVVLCPSPWELSPGRHKFGLRVTIPDSVPSSFESQFGSIRYSIKVQLVGNAEHCSAVECSAVEVFPFLVLAKSYFDDIPHAIKHFDYQDEIDFTVCTLPFGTVCLQISLPRTGFCLGEVIRAHLHVRNGTRKTLKDCRLQLVLKTQFLVLKTQFEARSRYEQASDQKLVENVMDSYPLGKVKGRTDL

SEQ ID NO: 157638 - protein, 294 aa, Heterodera glycines
  Coding regions on vcDNA: vcDNA=SeqID_84061; Strand=+; Position=1-885
MAGNGNELMRTEDDENSDDFLNLFENLELTTSEKLASLREIEKIFADTAPPPAGQTPIENSVLGFVFISHPILWALVQPDILGEQNELLDRKSLSLKSDQLVFQSTSSYVTTITLDPNNNWPHFTQISLNWNKQSLLGTRVKTIDLKQMTSPPKLGQSVNQIVPSSCCGIIREVIQNKITSDIMAIDVFLYGEETNQRFFPHQIDSSVNLTELEEGTRVQTTGFWAKTSAMEWPTSSDGIRDWWTEQIYIGTNLKIFGADEHEDIHQWLQNEQFRLSYRYLCAAMDLQQSPKRR

SEQ ID NO: 157639 - protein, 92 aa, Heterodera glycines
  Coding regions on vcDNA: vcDNA=SeqID_84062; Strand=-; Position=1-276
INPNNSPIPLACGQETENMAGNGNELMRTEDDENSDDFLNLFENLELTTSEKLASLREIEKIFADTAPPPAGQTPIENSVLGFVFISHPILW

SEQ ID NO: 157640 - protein, 101 aa, Heterodera glycines
  Coding regions on vcDNA: vcDNA=SeqID_84063; Strand=+; Position=1-304
MQKPIPSNRPNSSVSKTLACGLEKIVNLSGNEPLSVPVLADRSDPLGLKSVQPDPVPMESAEAGTKEMEVMEVDEMSGEKGKKGEMGKEKVKSGGIEEEEE

SEQ ID NO: 157641 - protein, 265 aa, Heterodera glycines
  Coding regions on vcDNA: vcDNA=SeqID_84064; Strand=-; Position=1 -92,152-566,1002-1292
MKIVNSNGKTLPTPQNPLPNKVMAFRSISIYFIDQNVFTFLHRFHRFLATCATELAIATENVRISAFFVLNIWPMFNNTTILMHLNTMNFHQMRMFAPSMLNDCPCLRVVTFYDGISTEFPPDDSANATDGQAVAKWLFTPRADNLPKMLRIEKTTVDQWLASVEQIKTAFFIASSPVNFVISIDVPPLSSLSSAVVPFKLTNAFTGEKLTLSQENAEDGNCFLLIRCPLSACDEEKWEKEMEAEFDARQNKIGIFIGYGGIDNG

SEQ ID NO: 157642 - protein, 49 aa, Heterodera glycines
  Coding regions on vcDNA: vcDNA=SeqID_84065; Strand=+; Position=1 -25,256-380
MANKFNAAMSAPIRLSTAVKLTLNVQCRLQFASPPSFLMLHVYAPLSLA

SEQ ID NO: 157643 - protein, 62 aa, Heterodera glycines
  Coding regions on vcDNA: vcDNA=SeqID_84066; Strand=-; Position=1 -49,110-249
MVAFASNTFPDLNNKFELVHIPVELRDTLICCILGDLVCCLFLDRMLNYLFGDQRVRKMLMY

SEQ ID NO: 157644 - protein, 83 aa, Heterodera glycines
  Coding regions on vcDNA: vcDNA=SeqID_84067; Strand=+; Position=1 -9,128-370
MVTIRGNNHFKGIEFSFLSASGKTKYTNRITALRQINATNGFGFLESGDRINVMVQSKDGTMPKSAVKVFFLSEALAFNEISE

SEQ ID NO: 157645 - protein, 81 aa, Heterodera glycines
  Coding regions on vcDNA: vcDNA=SeqID_84068; Strand=+; Position=1 -117,473-601
MYKFEFIVVNSTAFNVSVNEVQNCAYSTPLPLWTIQYISVDYAKWSFHPPIITCNPSIRCFEPTSNNSNMFMAFPEKKGNN

SEQ ID NO: 157646 - protein, 67 aa, Heterodera glycines
  Coding regions on vcDNA: vcDNA=SeqID_84069; Strand=-; Position=1 -46,94-251
MQKVVRSPGSDLLYTDTDSLILVHPEERCPLKTGPHLGQFTDEYSDHDIVEFCSGGAKQVNFRLILR

SEQ ID NO: 157647 - protein, 603 aa, Heterodera glycines
  Coding regions on vcDNA: vcDNA=SeqID_84070; Strand=-; Position=1 -630,681-1352,1399-1908
  Homolog annotation: Hit_ID=NP_507780.1; Match level="QueryCoverage =46%, HitCoverage=20%, E-value=1e-10, Identity=23%"; Hit description =predicted CDS, DNA polymerase type B, organellar and viral family member (5T899) [Caenorhabditis elegans]
MQNQPPKHPFLFSIDQILSVPSKKPRRGFLINELLGEVLQEGGGSSSSSSKSAKEYVKKLDSTVEHVPRFQYSKVKSRFSIEDVPAANPEGLLAGIFQYCLDAAMEESRGRGIEPTHLGCMISSPLLTGGDIPIPVRQITDNTVNTILNQFTKVAQSKQQQNVTLWGEPFTVVVTTVDRTGLPGRRVLKGGARRSLASVHHRVTETCLIKICNPDGHCLFYALQATMVAKTCGWPRCRFYDYLHSRRGQQGCLRRDALQLMQQIGVRTGRNTYDAEICVPRVVDHWNNTQQQHRFAVFIFGSSGQYKPLYKYINDHYDTPIVLYLNNQHFDGVQKLHGLFGQHYCLDCEKPYERPSRHLNSCKARCMLCSRVGPAFPCVPSGGFFHQCAGCNKMFRNNGCLQHHLASNFCAQSKQCKDCGVIWATRVHNRDGRKGHKCHETYCQLCNTFHNPERGCFIQPIEPKEHDPYRIVAFDLETMQHQPVDPQQPEKREHQPNFIAARVACPKCIESGNWRRATAGCRFCGPHRTVAFCQRPFEDTRVDKRVVADNPLQAFVDWLIFQLPAKYDTYAYSHFGGRFDMVLVFRELFRIGFNPEMLRRVLN

SEQ ID NO: 157648 - protein, 344 aa, Heterodera glycines
  Coding regions on vcDNA: vcDNA=SeqID_84071; Strand=-; Position=1-1036
  Homolog annotation: Hit_ID=XP_473047.1; Match level="QueryCoverage =58%, HitCoverage=36%, E-value=2e-15, Identity=31%"; Hit description =OSJNBa0067K08.24 [Oryza sativa (japonica cultivar-group)] emb|CAD41241.2| OSJNBa0067K08.24 [Oryza sativa
SVKSTAKAPPPASVSAELAPRAPLADSPPRFEETEQQKPTTPAKPSVKTTITAPPAQLKSSATPHQQKQQVPVKPPAPVSIPAKPSGSPQRFEGTEQQKPTTPAKPSVKTTITAPPAQLKSSATPHQQKQQVPVKPPAPVSIPAKPSGSPQRFEGTEQKQQPPPPPTSAALTLADLNLPENTLSVQIDPLSYVPNSVSIQYLENMERFKLVFNEAIVSHVSFSPQLGYVLGFENPQHVVSNELSKYPVDLRGGISSFAVYSKGLTENMIIGNSLSSLLRVVSISGAIPWEYNEKIYDSPIFARVLPREINEIEIELRTMDKGRLVPFAYGTTMVVLIFKKVINF

SEQ ID NO: 157649 - protein, 40 aa, Heterodera glycines
  Coding regions on vcDNA: vcDNA=SeqID_84072; Strand=-; Position=1-129
LINNFESRLIDGPPNGQFDEDKVPETAGEESAAVNAAATG

SEQ ID NO: 157650 - protein, 225 aa, Heterodera glycines
  Coding regions on vcDNA: vcDNA=SeqID_84073; Strand=-; Position=1 -156,202-327,457-579,1061-1113,1316-1533
  Homolog annotation: Hit_ID=CAE68974.1; Match level="QueryCoverage =39%, HitCoverage=6%, E-value=1e-22, Identity=49%"; Hit description =Hypothetical protein CBG14956 [Caenorhabditis briggsae]
KFVEHFQFIWLSSFAPLFLPLPVNAETTNSTELKRLERTLTSEHGMAKALALTLSRLLPFIETMDEWLGFGKLLYRIDKQQIDLDSPDEQHTTRAVPTKFLQFISNFWTNYRSKIVGKSPKVSTMKEYTMLVIPPVPSREQMRAVLNEHDLFLYMGHGSGGRYFGRSLIRESECRAVSVLMGCSSVRVVDEGPGLDGRSSVYEYMIARAPCVIGCLWMVTDGEID

SEQ ID NO: 157651 - protein, 68 aa, Heterodera glycines
  Coding regions on vcDNA: vcDNA=SeqID_84074; Strand=-; Position=1 -94,185-297
MHAFCARAIYHRACQSKAKQQRWCFERIKGIESVNRLLGKYICNLSTILRSELEMINFTIQTNFRCSN

SEQ ID NO: 157652 - protein, 39 aa, Heterodera glycines
  Coding regions on vcDNA: vcDNA=SeqID_84075; Strand=-; Position=1 -7,207-319
MRKSVNRLLEKYICNLSTILRSELEMINFTIQTNFRCSN

SEQ ID NO: 157653 - protein, 78 aa, Heterodera glycines
  misc_feature (56)..(56): Xaa can be any naturally occurring amino acid
  Coding regions on vcDNA: vcDNA=SeqID_84076; Strand=-; Position=1-234
  Homolog annotation: Hit_ID=CAE72971.1; Match level="QueryCoverage =87%, HitCoverage=21%, E-value=4e-15, Identity=57%"; Hit description =Hypothetical protein CBG20308 [Caenorhabditis briggsae]
GGDRPSSADFASPVPHVRNGASLVDFYIGLGLAISSSLFIGSSFIIKKKALIKTCXGRQNTTKERRKGGYGYLKEWLW

SEQ ID NO: 157654 - protein, 97 aa, Heterodera glycines
  Coding regions on vcDNA: vcDNA=SeqID_84077; Strand=+; Position=1 -199,246-340
  Homolog annotation: Hit_ID=CAE72971.1; Match level="QueryCoverage =82%, HitCoverage=21%, E-value=1e-20, Identity=61%"; Hit description =Hypothetical protein CBG20308 [Caenorhabditis briggsae]
FILYVALVLLFTFVLVVYVAPRYGHTNILVYIAVCSLIGSLSVISVKGLGLAIKESITTEEQFTNWLTWFWLLAVLGCISEAIGLSHQIIGHLQKID

SEQ ID NO: 157655 - protein, 30 aa, Heterodera glycines; identical to SEQ ID NO: 141344
  Coding regions on vcDNA: vcDNA=SeqID_84078; Strand=-; Position=1 -12,103-183

SEQ ID NO: 157656 - protein, 45 aa, Heterodera glycines
  Coding regions on vcDNA: vcDNA=SeqID_84079; Strand=+; Position=1 -102,798-833
MLRVVSKELVSKDMTGKFHKIQGQLKILSFFEEQEVIAFSMLPGF

SEQ ID NO: 157657 - protein, 77 aa, Heterodera glycines
  Coding regions on vcDNA: vcDNA=SeqID_84080; Strand=+; Position=1 -92,1043-1182
MAGLDQSFLSKGLVYDVMGTQNCNYDYNVKGVANIKSLNKMCVTALCTVQTMHRMKNIAKSEQRQKQCAKWEQGQCQ

SEQ ID NO: 157658 - protein, 365 aa, Heterodera glycines
  Coding regions on vcDNA: vcDNA=SeqID_84081; Strand=+; Position=1 -26,178-317,771-1090,1122-1445,1812-2099
MINDDEHQRVANIKSLSKMCVTALCTVQTMHRMKNIAKSEQRQKQCAKWEQGQCQANDGHQQRDESTDGGNAKATKADGKQKHANENGGQQRGKDFGGGPLPSGRLERKRTPSAAPAEQPLRGRMVSATAEQWHRRKAISTANRAKQFDPRGRRPIRNENGKKWLTFGGQLPQPQPVVITRQQQIEQRRAIKEEMGGEDRKGGAEGANTAGTDRTAQPQQTAGEEQKAAESGSAGLTATETTNEGGDQQRVTGVPLITVGLTKAEEGAKEMNKREKCVHCQQNEQQQIERDGGTERQTEKKEENDGTKANPTGEEQQLNSQLTALKGIGEMGGQRVELNTGDDSEEQEQQAILRRLYSKYGSNAR

SEQ ID NO: 157659 - protein, 314 aa, Heterodera glycines
  Coding regions on vcDNA: vcDNA=SeqID_84082; Strand=-; Position=1 -31,76-346,400-472,550-1022,1072-1165
MKDIATEESIAQRRLNLKANFMRQLQIRRGVLPSEIPPVGVATNAVPTMGRKFRKVCCENKKTFGEKSLIFPQPLESRFPPAKPRFGLGMTAADFEDKTDNCSSLAKGPSLTETNAPKGRNVRPKAINCYINPSQSVSTWPTSNDTDSDGQSPSPTVFTHHHFCAFISVFRQSSASVTSFGSSLTTATDPLVAQHVDQNGTIFFPTSSTPSDHGQSYDETPASSVLTFDLSSHTSSDRTLTNNSPLSMNNETPRPVFSLFHEVQFLHSLGRRLSLHCNSRQDEGSFIFKHQMLNKMIVLTRSEALGEEGIRISQ

SEQ ID NO: 157660 - protein, 474 aa, Heterodera glycines
  Coding regions on vcDNA: vcDNA=SeqID_84083; Strand=+; Position=1-1425
  Homolog annotation: Hit_ID=XP_320889.1; Match level="QueryCoverage =80%, HitCoverage=48%, E-value=6e-30, Identity=26%"; Hit description =ENSANGP00000012033 [Anopheles gambiae] ref|XP_313651.1| ENSANGP00000013044 [Anopheles gambiae] ref|XP_314
MEAAIHQLTAAIQQLLSNQNGAPAANAHASPTLPPIDCFEPSDDRSISDWLERFNFALDCAAPQLADEAKVKLLMTKLSEVAFSQYSKSCLPKKVIDFDYSQTEERLKIAFSRPQSIWIDRYECLRASKSEDESFRPFINRHKRLLRDFQFEKLNEEQFSCLMLLTALKSPKDAELRKRILSKLAADGYLVEYDGVVEDLQMYQSTIAEAKVLEQQPMGSRNLMATKLKAKKKRTNSDLSSNASSISTGTRSSNRSQRVCWRCGLSHSSRNCRHETTVCRKCKKSGHLERMCAKHQAWLKKNGGKNEKAANNVRVGGVFLVKSENQRKNGIIDVPIDVNGTKVDFIADLGTEGTVLCEDTVRQIRALKLSRCQERAQYHDGTTRPFVGKGKTTFSFGDRSCYGHFFVSKDGSKNLLGLDMMDRLGLSDSIRNGLKDKFRTEASKENGASQKKKKKSSEKTDVAKRRISSLWERM

SEQ ID NO: 157661 - protein, 252 aa, Heterodera glycines
  Coding regions on vcDNA: vcDNA=SeqID_84084; Strand=-; Position=1-758
  Homolog annotation: Hit_ID=XP_319741.1; Match level="QueryCoverage =91%, HitCoverage=53%, E-value=2e-24, Identity=30%"; Hit description =ENSANGP00000006515 [Anopheles gambiae]
ERFNFALDCAAPQLADEAKVKLLMTKLSEVAFSQYSKSCLPKKVIDFDYSQTEERLKIAFSRPQSIWIDRYECLRASKSEDESFRPFINRHKRLLRDFQFEKLNEEQFSCLMLLTALKSPKDAELRKRILSKLAADGYLVEYDGVVEDLQMYQSTIAEAKVLEQQPMGSRNLMATKLKAKKKRTNSDLSSNASSISTGTRSSNRSQRVCWRCGLSHSSRNCRHETTVCRKCKKSGHLERMCAKHQAWLKKNG

SEQ ID NO: 157662 - protein, 28 aa, Heterodera glycines
  Coding regions on vcDNA: vcDNA=SeqID_84085; Strand=+; Position=1 -78,243-251
MPVVAAVDLILENQMNFVKKRRKRTHIN

SEQ ID NO: 157663 - protein, 161 aa, Heterodera glycines
  Coding regions on vcDNA: vcDNA=SeqID_84086; Strand=+; Position=1 -99,143-416,712-824
MMDVARDNFEKVLIEMVQNAENKTALKGIQWMGKSILCYFSKDTAIFECSVCFTESYVSTAFRCTAIQPLKDDSEKRHLFCLDCVRGQAEASVNEALLSEEALGLRCMASECRNPILFSIFNANYHGSPKGSGQSLQLPEMRIFILQVLKIPNKIVLFQTL

SEQ ID NO: 157664 - protein, 570 aa, Heterodera glycines
  Coding regions on vcDNA: vcDNA=SeqID_84087; Strand=+; Position=1-1710
  Homolog annotation: Hit_ID=NP_920205.1; Match level="QueryCoverage =81%, HitCoverage=31%, E-value=4e-50, Identity=31%"; Hit description =putative DNA helicase homolog [Oryza sativa (japonica cultivar -group)] gb|AAP52492.1| putative DNA helica
MYEDCNTVFARCHDAKKARLFITFTNNREWPEFKENLHKNGQVFTDRFDMWMRVWSSKIAEFREELYDKKFFGTILGYGESMEFQGRGGPHAHIVAQTDLDAVPYVIQEYIWAHIPSLPDKDDDTPIAKMHREIRETMHMQLHRCSDSWCGPSDPIYGRCKKGFPAPYSKCTILRPDRPAMYFRPSPSDGGAQLEVNGLIYDNSHVVPYNPYILLRYRVHHNVLFAYGNKANIKYALKYPFKGPGHCYVECKEESGNKIGIDEPAQYAKMNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEKFFFGDDDLNLPPGQPNPRPQPNTPPPLNSDQQK

SEQ ID NO: 157665 - protein, 282 aa, Heterodera glycines
  Coding regions on vcDNA: vcDNA=SeqID_84088; Strand=-; Position=1-846
  Homolog annotation: Hit_ID=CAH99049.1; Match level="QueryCoverage =98%, HitCoverage=53%, E-value=7e-26, Identity=24%"; Hit description =conserved hypothetical protein [Plasmodium berghei]
MSVRKSRSAKVGPQMSVRKSRSANVGPQKSVRKCRSAKVGPQKSVRKCRSAKVGLQMSVRKSRSANVGPQKSVRKCRSAKVGPQMSVRKSRSANVGPQKSVRKSRSANVGPQMSVRKCRSANVGPQMSVRKSRSAKVGPQMSVRKSRSANVGPQKSVRKCRSANIGPQKSVRKCRSAKVGPQMSVRKCRSAKVGPQKFGPQMSVRKSWSAKVGPQMSVRKSRSANVGPQKSVRKCRSAKVGPQKSVRKCRSAKVGLQMSVRKSRSANVGPQMSVRKCRTTVP

SEQ ID NO: 157666 - protein, 47 aa, Heterodera glycines
  Coding regions on vcDNA: vcDNA=SeqID_84089; Strand=+; Position=1 -97,137-346
KFSILMSLSVTRNHYFGDFVTKIVKNHYFGVLSLFRHFLENSLTKMQ

SEQ ID NO: 157667 - protein, 81 aa, Heterodera glycines
  Coding regions on vcDNA: vcDNA=SeqID_84090; Strand=+; Position=1 -135,197-307
MIVKTDYSKTLKITDIGNAYTPNEEPLAQIVHWHWDEKGAQRIVDTHTLNKGSEHNCGIYTNASSFVVRIHKKREKKSNET

SEQ ID NO: 157668 - protein, 98 aa, Heterodera glycines; identical to SEQ ID NO: 152313
  Coding regions on vcDNA: vcDNA=SeqID_84091; Strand=-; Position=1 -142,760-914
  Homolog annotation: Hit_ID=NP_499279.1; Match level="QueryCoverage =91%, HitCoverage=94%, E-value=3e-15, Identity=66%"; Hit description =UNC50 (3L404) [Caenorhabditis elegans] pir||T24631 hypothetical protein T07A5.2 - Caenorhabditis elegans

SEQ ID NO: 157669 - protein, 70 aa, Heterodera glycines
  Coding regions on vcDNA: vcDNA=SeqID_84092; Strand=-; Position=1 -28,388-572
MTTNNGAKKGETHKYGRLAIKDITPLITRLDTHWRCDTEHERKEVLRECLAATAVVSLFNWLNGQAHCLG

SEQ ID NO: 157670 - protein, 143 aa, Heterodera glycines
  misc_feature (138)..(138): Xaa can be any naturally occurring amino acid
  misc_feature (141)..(141): Xaa can be any naturally occurring amino acid
  Coding regions on vcDNA: vcDNA=SeqID_84093; Strand=+; Position=1 -55,106-236,285-363,459-495,1387-1463
  Homolog annotation: Hit_ID=CAE65252.1; Match level="QueryCoverage =94%, HitCoverage=15%, E-value=2e-47, Identity=68%"; Hit description =Hypothetical protein CBG10136 [Caenorhabditis briggsae]
SYPYTFQFCVLCQKNVHSSKLPCHIRQKLPCHIRQCHVGKPMFQCPVCDFTSTYSKNNVKSHMVSLHGLAGDPISYMDQGDPISYMDQYATQVEEFMKQCFPNVRGRGRPLHGRQSPKRIASSATVSGRMSEFESNFXRRXVK

SEQ ID NO: 157671 - protein, 91 aa, Heterodera glycines
  Coding regions on vcDNA: vcDNA=SeqID_84094; Strand=-; Position=1-276
  Homolog annotation: Hit_ID=NP_608540.1; Match level="QueryCoverage =98%, HitCoverage=10%, E-value=2e-09, Identity=33%"; Hit description =CG2839-PA [Drosophila melanogaster] gb|AAF51469.2| CG2839-PA [Drosophila melanogaster]
MERTFRKGRNGTDGGERKQRRQGFDEEDEDTTTKQQNNNKHKQRKMEEEGEEKDERKKEEKGGAGRGKRKKKRREEEKEKEEKGGEESKQE

SEQ ID NO: 157672 - protein, 272 aa, Heterodera glycines
  Coding regions on vcDNA: vcDNA=SeqID_84095; Strand=-; Position=1 -728,796-885
MALFSPLFCSSFLLLSFCFSICAFLPQISEVENEIAEFIHRNPLAIDHRIALVQLIFEHQTELILANEQISFPKNISLDDLAFPYEMLVSKITSENFEELAQNLRKNALKLAKESTGKFHFLTENHFYGQFINYLAKIAQLKVEEALKKRRENDNLDELSEKETNDFSEGWKSLQMFVEMYSFGSELFMQLAANYGGKFPKKTRKTMKQLVVKKIPQMDELCQQFVDYFQAKFMKSIPQKLSIEPMNAQKIIDQNDTATAWANWFREIGDIT

SEQ ID NO: 157673 - protein, 61 aa, Heterodera glycines
  Coding regions on vcDNA: vcDNA=SeqID_84096; Strand=+; Position=1 -111,419-493
  Homolog annotation: Hit_ID=NP_502142.1; Match level="QueryCoverage =85%, HitCoverage=2%, E-value=1e-12, Identity=53%"; Hit description =kinesin-like protein (klp-12) [Caenorhabditis elegans] emb|CAB05214.1| Hypothetical protein T01G1.1 [Caeno
MPRHIAIVMDGNRRFARTQNCATPMEGHSAGFVQLTKVLDWCNELGVEEVGISILQFMETN

SEQ ID NO: 157674 - protein, 69 aa, Heterodera glycines
  Coding regions on vcDNA: vcDNA=SeqID_84097; Strand=-; Position=1 -121,206-294
MSNNENENVMNGEAVGGVEIKVEAKEEVNTEPQEDAEEAKIPQFSKEQMERSVMCCTNEGEIVNVHLGF

SEQ ID NO: 157675 - protein, 234 aa, Heterodera glycines
  misc_feature (2)..(2): Xaa can be any naturally occurring amino acid
  misc_feature (10)..(10): Xaa can be any naturally occurring amino acid
  Coding regions on vcDNA: vcDNA=SeqID_84098; Strand=+; Position=1 -239,603-679,971-1115,1162-1219,1497-1620
  Homolog annotation: Hit_ID=NP_491843.2; Match level="QueryCoverage =65%, HitCoverage=39%, E-value=3e-39, Identity=47%"; Hit description =C2H2 type zinc finger containing protein (1G964) [Caenorhabditis elegans] gb|AAK39376.3| Hypothetical pro
TXLHRSVCFXSLLIAMPLQLHTSAGFFACELAAVRSASQFRQQLETHSLLPPAPSSLQLITDASSSPSSSLSFASATEEAEAEEQFICQICNKDFRRPDILSRHVRRHTGEKPFGCDWCGRFFSRSDHLRTHQRTHTNEKPYQCTECHYSARRRDVLTRHMGTRHEQKTNPYSARRRDVLTRHMGTRHEQKTNPSVFATAAAMAQCRDDGVEDRMRRLLRANVLRRKSRTSAEE

SEQ ID NO: 157676 - protein, 196 aa, Heterodera glycines
  Coding regions on vcDNA: vcDNA=SeqID_84099; Strand=-; Position=1 -85,263-457,672-879,937-1012,1056-1082
TNVGENPRAEQVDAHILPQIRRSARFPHVARFSVCPMDKYQMASPQGNNFLLHRFVRVQARPTVGHGQLRAGDERTELSQLRTLNGRGRAEEQQTSVRSTRDQLFATVLLLLLFYGLSVTMSAHFKRMDWRLFALFLRFFHHKFCRFVPFMRTVQAFFDQYNLHVQTILTANACKSAQTEENRADASLAHWTTARG

SEQ ID NO: 157677 - protein, 1533 aa, Heterodera glycines
  Coding regions on vcDNA: vcDNA=SeqID_84100; Strand=-; Position=1 -1284,1408-1729,1874-4868
  Homolog annotation: Hit_ID=DAA04499.1; Match level="QueryCoverage =54%, HitCoverage=64%, E-value=1e-92, Identity=29%"; Hit description =TPA: pol polyprotein [Schistosoma mansoni]
MDLKGVIALGEKKVRLGEIWTSIVSVIGTEPPKLPRVILPKNDTFEPRTENILNARIDEIFPTGQNFLVRGIQHQYPGIIIGRTLVAPGATKEVIIRLMNAGNAPIKIYGNSHLADLEPLQINALPGDEIAAKDFIPPETRWSENLPKLPVNDMNRPPSERIDLEETRLSEKAQRELKQIVDKYSDAFVGDDGKIGRYNGPIVHKIDLTPGALPFHFRPYRYPPETQKEIERQIKMMLDQNIIRESESEFASPIVMVPKADKKSWRFAVDYRALNKMTKKRVFHLPNIQELLDLMGAKKYYTCMDMQQGFMQIPMAKEDIEKTAFISHLGIYEFITMPFGLTAAPDTFQRVMNSLRRRLTAAMLIYLDDIIIGSETEEIHLVDIENFLRLLKEVGLKLKIEKCHWGKAEIRYLGFLLSEKGVRMDPRQTLTQDKFEGKIEENWGPEQENALKILKEMLTTAPVLQSPRFGRPFTIECDASKKAIGAVLLQEKGPVAFVSRALNRHETNYPSIEREALAVVYSVKEFSPYIVGSGINFLSRYNVPGIDSGGEEEINSQNKKILSTEDKAEKQTKENEQIGVQEEAISLKEIIEAQRKVKELAKIYYILKTGKFPENVLKWKRVIQDYDLVNGAIYYKRGKSNSEKPKLVIPYSLREKIFHLIHDQGHFGFDKTWPEIKSRFYWVGMKDDVSLLTETCEGCQKRKVQPGQAKAAPNIPIKPTEGPFQRVHCDIMGPLKKTKNENSYILLAIDSFSKWIMTKAISDQKAETIANSFVEMVIHQHGTPEIVVTDQGRQFTSQLFENLSKIYGFEHNMSTAYHQQSNGLAEGSMRIVANIISQSINEGGDNWDEILQGAIFAYNTSINTATKNSPFFVIHLRNPRLPTDQLLKLPSSDELLSDVSVYTRTHVEKAAKAWEIVRTEIVKAQERNKEGNDAIRRATEREFEIGDLVLVKKEVMKHKFDQKWMGPLRCVGIETERKNLILQTLDGKGKFKRVHQEKVKKFHGPATLPLREADEPINWEKYVDDPNLEQEEAEESEEEGFEIVLSKEKAMSEEMIGKSKKFSKFSFESSEEEENGSTIAFVQNQEDISDDEGPEIFFENRNFVFENDETPTLLDIVLNGTIVTACTGWLNPTIIPLTSSVPENQVDENWEIYRNQEGERYVMCWIFGENFEMHISSITDRIVLGMEVQFLFAEKWSLKTENERESYWEIISGINGVMYEINRIPEIFISEKENYDDQNEFRMGINIINSGRNEEMGEMENNDKQFLDKVENMNKKGRLNESSKLNGVTYESHSFFKTIDHTEMELLTKDEEHVLKSLEKSLQSQLLAVRKSLAESEGSKMPVEDEDQVAPLMDEWREKEEKEEKKEKKEEKGMKENKKEEKKEKREVPRKKAEEEKRSASAVTVGEEVVSIVDSTEEREQEREQELFLNPKVTSERMAFWESTLYNQAKKDVAEMREMNRKTGQVGVTVSSKKRVWSELEPPALPDEPSSKFGEKMRRCAEMDQNTKEARVVMDTLLVIREKERELSDQAQK

SEQ ID NO: 157678 - protein, 76 aa, Heterodera glycines
  Coding regions on vcDNA: vcDNA=SeqID_84101; Strand=-; Position=1 -51,118-297
MSPRTESPFGFTSFQIWAAICAYLALLQTYVAFVEQIGAGIEFVLVTLEALLQLFTMITFSTNRSTASAAVQAHNS

SEQ ID NO: 157679 - protein, 101 aa, Heterodera glycines
  Coding regions on vcDNA: vcDNA=SeqID_84102; Strand=-; Position=1 -24,70-163,210-397
MVVQSDKILSSVPLELLLRVNSKFSILFCLLTYALFIYKIFSLPYPLHVLLSEAFIVILFGPIEAFRISSGCFIGGERNNLATEIFKKILKNGKTENSKSI

SEQ ID NO: 157680 - protein, 972 aa, Heterodera glycines
  Coding regions on vcDNA: vcDNA=SeqID_84103; Strand=+; Position=1-2919
  Homolog annotation: Hit_ID=NP_494149.1; Match level="QueryCoverage =99%, HitCoverage=65%, E-value=1e-177, Identity=38%"; Hit description= predicted CDS, putative protein of ancient origin (2C297) [Caenorhabditis elegans] gb|AAF39854.1| Hypoth
MTCNPLWEEISENLFHEQVSSDRPDLVVRVFNLKVKALMNEINKVKIFGEVIAWMYPVENQGRGLPHIHLLLTLAEQDKLVNGEDVEKKGISARIPDKELEVELFALVKRFMIHGPCGDLNPNCPCMEDFVDKNGIRGRKCSKGYPKAFQEETIVLENGLALYARPNDGRTVEVFANGRRHGLDNRWVVPHNLYLLKMFKCHINLEKVNSVNSVKYLHKYVHKPPDRARLELEEKNDHDEVKEFIDARYVCPQEAVWRILELPMYDRSHCIMSLTVHLQGEQICYFDENMEEEEIRERISNGSELMAYFELNKESELAKTLFYHQIPEKFCFKKGKWTARKTYFNTIGRMVKVSPAEPERYHLRLLLLNVKGACSYDDLKSVIDMNGIVKVCETFSASCLERGLIRNDEEWKKALEEAESFEMPWKLREFFALILVHCNPAKPEELWNMFKDSLSEDFCRSFRKELAYAKAYKEITLSIMKAGKTLADFPTMEQINVDDDVEQVFDLAEELDLGQREYALMYAEQREICDEILHRIWNPVNEPAFYFLSGPGGTGKTHVNKTIVHMLRGQKKKVCTMAFTGIAATLLPAGRTLHNRFGLTLDMSNSSISPRSKAWQELKTTDLFICDEAPMINKRAMRTLDEKLKEIMNNGIAFGGKVMLWTGDFRQTLPIQKHATRAEVVNSTLKRSEYWRLAKRYKLTKNMRALETEQEFAKDLLEIGSGKWNSENDEIILSENCISYGDLAEEIFANCIASENWNEMAKSAILAPKNVDVSEMNNRVLEMLPGEEVVYTSIDLAQDENRQRADDYLDEYLNALNPSGFPRHKLRLKKNAIVLLMRNLNIEMGLCNGSRMKVEEMHPNLIMCKILTGDKAGQTVYIPRITLCCSEDYPFDLHRHQFPLVLAFAMTINKAQGQTLEQVGIDLRKDVFSHGQLYVALSRARAWNKLRIRLDDGNLERKVKNVVYRELLDNSD

SEQ ID NO: 157681 - protein, 36 aa, Heterodera glycines
  Coding regions on vcDNA: vcDNA=SeqID_84104; Strand=+; Position=1 -35,326-401
MSLLPPVVALMRSRKNPGTSGPGSRPGPGGFLKFVF

SEQ ID NO: 157682 - protein, 69 aa, Heterodera glycines
  Coding regions on vcDNA: vcDNA=SeqID_84105; Strand=-; Position=1 -68,683-823
LNQVCSMNEHLRAENARLIQQQVNNVSSSSATSSAAGGSGGGIALPSANHPFVSPTSLVPQLEAANSFW

SEQ ID NO: 157683 - protein, 214 aa, Heterodera glycines
  Coding regions on vcDNA: vcDNA=SeqID_84106; Strand=-; Position=1-645
  Homolog annotation: Hit_ID=NP_491240.1; Match level="QueryCoverage =61%, HitCoverage=9%, E-value=4e-10, Identity=31%"; Hit description =zn-finger, CCHC type and RNA-directed DNA polymerase  and Integrase, catalytic domain containing protein f
MKKCAKDGKFWAEKMLLAYRTTPNSALNGLSPDQLFFGRRLRTQLSLVHPKEEQAEVIDPAKIRKSQADYARKMARQFDQHHGSKSVEFLPKDPVLLLNFNSGKRFWLNGTIIERLEKSPTYRVHVPALGRNVHRHANQLRRRYPLEEDGNDTVRIPPQAQEEQDRDPSPIREPPPQPAPIRRTQAKRRSPSPPLAPRRSQRQRKAPIRFSPNP

SEQ ID NO: 157684 - protein, 64 aa, Heterodera glycines
  Coding regions on vcDNA: vcDNA=SeqID_84107; Strand=+; Position=1 -138,216-272
MFLDYNFFLCHPNQRLLVSFESPSNALLACKNPKNSVNFEQIMAKKANRRHLGLSNDTNNVGFG

SEQ ID NO: 157685 - protein, 182 aa, Heterodera glycines
  Coding regions on vcDNA: vcDNA=SeqID_84108; Strand=-; Position=1 -51,90-587
MGKVDESTREALEEQFQSFYTSVLAYLDKWHRIDRFPEKLQWVALAYRKIPHDDALALARQIAPELTNDLFDDVNEANQILNSFPNDEFQKLTPEQKWKKLFEADLQICLICSSWSASYFPCLSRMHLWRGYSLCADRNGLINEIFCKSKQSRRWSKPKSITIFLAHKCTKCSFPITNCQRK

SEQ ID NO: 157686 - protein, 36 aa, Heterodera glycines
  Coding regions on vcDNA: vcDNA=SeqID_84109; Strand=-; Position=1-109
HCGGRRVGSVGAASLLLPLDVVVARGPDRKAAQQAH

SEQ ID NO: 157687 - protein, 345 aa, Heterodera glycines
  Coding regions on vcDNA: vcDNA=SeqID_84110; Strand=-; Position=1 -232,282-553,799-1332
  Homolog annotation: Hit_ID=AAA79368.1; Match level="QueryCoverage =55%, HitCoverage=82%, E-value=1e-15, Identity=33%"; Hit description =TATA binding protein
MDLILATDWINNAYPEMDQQDHNKETTKKDQQDHNNETPKKDQEDEEETKEPSWISLIDEEQKQDPFTPIYDEPPRASTPKTCACAERPRPIPLVEHLCKRFNCSAHELHVLFRNLEKRRDIVEHLRSAQLRTAHLRPFVRNFPVRCNDLSILDAHSVPAYRGFLGITMKISNCTVIFKINSLNTQQFLAIAQRGINTEYNPRRFHAIIMRIRYGAKTVAALIFQSARVVLTGVPHPDQAQKFAARVLRRIEYTQCRTMTIYELRVVNIVGVLTFDQRIRVEKLQQSLGGIYDPTIFPALRCKLDNGATCLIYISGKVILTGVKNVENLKNSFDYLSKIVPNYFR

SEQ ID NO: 157688 - protein, 112 aa, Heterodera glycines; identical to SEQ ID NO: 127606
  Coding regions on vcDNA: vcDNA=SeqID_84111; Strand=+; Position=1-549

SEQ ID NO: 157689 - protein, 532 aa, Heterodera glycines
  Coding regions on vcDNA: vcDNA=SeqID_84112; Strand=+; Position=1 -637,859-1820
  Homolog annotation: Hit_ID=CAE56414.1; Match level="QueryCoverage =63%, HitCoverage=89%, E-value=1e-52, Identity=35%"; Hit description =Hypothetical protein CBG24106 [Caenorhabditis briggsae]
MQHTKRYLLVPEEIYQSLATLSPSDGSPIGLVRARIKQIKNDDAINEAERAVKYEQEIKRLNKLKKDEDERPVGVKLENLSDVVDAMPKPFNIKRPIVVATRRHLKVGRARKENVEQLEDDDDDEDDYETPRASSTNKRQPTQMEILNLIYKNAQSLGVSEEGQVLRAGGRPFITSSVDDIVSHLLNKDKRGQKEPTAFKEFIERAKQNRQLTTQRTYTLHRQAKRRYRRLPTLAPGLHTEWQADLAIFDRITKQNRGYKYLLVCIDTLSRQVFVEPVKTKTSANMINAFEHIFKRSKYIPWKVLTDQGKEFTARAVQQFFRTKDVEHFCMLTSPQFHAGMAERANRSIKERLYRYFTEHNTYKWIGVVQDLVYAINHSQNSSIGMCPADVNFKNAEALRQKLHDAAANVLRHQPKYRVGDRVRIEKYKHVFQKGYLPRFSNELFTVVEVHSERSPVVYRLRDDNNEIISGWFYANDLCKTLENKQQKMYEIEKILKKKRQNGVKYALVKWKGYDTRFNSWIPAHSISEKSI

SEQ ID NO: 157690 - protein, 54 aa, Heterodera glycines
  Coding regions on vcDNA: vcDNA=SeqID_84113; Strand=-; Position=1-215
VDAYARIYRKTLIYHSHVDNVGIKNKYVLMDVRISGALNIVSMWMRTHASTVKH

SEQ ID NO: 157691 - protein, 224 aa, Heterodera glycines
  Coding regions on vcDNA: vcDNA=SeqID_84114; Strand=-; Position=1 -49,440-1065
MATYVYFSLSSFLSFFPEKKKLQQKSFGEIFGEKWQKKKEEKRNELKKREIIGKYYKIKEKIKQKGRKYSTKEWDKINLKIAKKLGTNRTKIYKWIKEFCLQKNKCHKSKSDEEKLEIVQKFIEMTKEYRQKRKYSRKEWNQNYAEICKKIGVSQFIIDKWKKQFGISKKRITEKEKMEKMNIYWQTKIENPKMSDNAIAKTVNTSHQNIFNWKKQFGEEINEE

SEQ ID NO: 157692 - protein, 129 aa, Heterodera glycines
  Coding regions on vcDNA: vcDNA=SeqID_84115; Strand=-; Position=1-390
MKPNLIFNPVCPCLVVVETVLVEVDDVGVVLLEVLVVLLDSVVELGVVLVVVLVVELGVVLVLVLVLVLVDVDVDVDVDVLLVVELVELVDVVSSDDESHKIFEDILATKKIITRIAIGSGIEETIFIK

SEQ ID NO: 157693 - protein, 429 aa, Heterodera glycines
  Coding regions on vcDNA: vcDNA=SeqID_84116; Strand=-; Position=1 -325,507-1107,1255-1618
  Homolog annotation: Hit_ID=AAF36092.1; Match level="QueryCoverage =23%, HitCoverage=79%, E-value=2e-32, Identity=56%"; Hit description =flagelliform silk protein [Nephila madagascariensis]
MGPLGPGGMGPGGAMGPMGPGGMGPGGAMGPMGPGGMGPGGAMGQLSPGGMGPGGAMGPMGPGGMGPGGAMGQLSPGGAMGPMGPGGAMGQLSPGGAMGPIQTCICSPNACCMESQRAPQIGAEARALQALTISCICTPVQRSDCCPPPPPMGQQFNPPMGQQFSPPTPPMGQQFNPPMGQQFSPPTPPMGQQFNPPMGQQFSPPTPPMGQQFNPPMGQQFSPPTPPPPPMGQQFNPPPFPPPPSGNQPVCVCTPAASVQQDACCALPQQLQAAPLLPLPPIPQQNFPRSSPPVGGFATGGPFTPQLQAFAVETNYRNSNSTRLSAPPISGIGFGASSADGSQSPPIGYAGKTQPCLCVPTQLGGGGQMPLCCQQKSKQKRDRRFRERGEERERMGKEEEQTDERESSAAKREGGEREEAEKQTTKRPI

SEQ ID NO: 157694 - protein, 28 aa, Heterodera glycines
  Coding regions on vcDNA: vcDNA=SeqID_84117; Strand=+; Position=1-84
AIEFAQFATAGIVLSAFALPFVLAHAGV

SEQ ID NO: 157695 - protein, 45 aa, Heterodera glycines
  Coding regions on vcDNA: vcDNA=SeqID_84118; Strand=+; Position=1 -70,118-185
MVIGQNTYKAKRNASNLKRNFILAHCLLKPSISSKLPTPHLSASF

SEQ ID NO: 157696 - protein, 78 aa, Heterodera glycines
  Coding regions on vcDNA: vcDNA=SeqID_84119; Strand=-; Position=1 -114,170-289
VQIYCFKFCFYIMDGNNLFPLVKRKQTNAELEALKKLKLNSPRMKFRFRLEAFRFALYVFWPITIVWIFNSPFFQQKS

SEQ ID NO: 157697 - protein, 95 aa, Heterodera glycines; identical to SEQ ID NO: 125597
  Coding regions on vcDNA: vcDNA=SeqID_84120; Strand=+; Position=1-677

SEQ ID NO: 157698 - protein, 93 aa, Heterodera glycines
  Coding regions on vcDNA: vcDNA=SeqID_84121; Strand=+; Position=1 -123,350-508
  Homolog annotation: Hit_ID=CAH69012.1; Match level="QueryCoverage =92%, HitCoverage=17%, E-value=7e-14, Identity=38%"; Hit description =novel protein similar to cytochrome P450, family 2, subfamily J [Danio rerio]
MVHNPKVMEKIQEELDQTVEKEQQICWEDRLKLPYTSAAVNEVLRVGNVVAQDFPHRMMRDTLVDNWTLPRGQPIVAQISVVLMDPEVINRNE

SEQ ID NO: 157699 - protein, 123 aa, Heterodera glycines
  Coding regions on vcDNA: vcDNA=SeqID_84122; Strand=+; Position=1 -117,372-626
  Homolog annotation: Hit_ID=NP_507076.1; Match level="QueryCoverage =29%, HitCoverage=7%, E-value=2e-10, Identity=80%"; Hit description =cytochrome 450 family member (5Q654) [Caenorhabditis elegans] emb|CAB07250.1| Hypothetical protein K05D4.4
MLKTDELIPFALGKRQCLGESLARMEMFLFFANILNRYKTFGIYTPHDYFMLVGAHYSRIGIFNTHYSAFVSSPLGTKCHRWSVGWAFPCCAQSSRVALRSDARNRNKQFENVFNYPMLIDSF

SEQ ID NO: 157700 - protein, 65 aa, Heterodera glycines
  Coding regions on vcDNA: vcDNA=SeqID_84123; Strand=-; Position=1 -163,233-267
MRPFSICLLLLPLILLLLQRSTAIRPYPIDQHGRIGENDGYGRYGYGNSAVMPRDATKLFFKLSI

SEQ ID NO: 157701 - protein, 19 aa, Heterodera glycines
  Coding regions on vcDNA: vcDNA=SeqID_84124; Strand=+; Position=1-85
VDLVKNLANYALFVLRLTT

SEQ ID NO: 157702 - protein, 56 aa, Heterodera glycines
  Coding regions on vcDNA: vcDNA=SeqID_84125; Strand=+; Position=1 -113,434-491
MEKCEKLTDGKTDEDEARRKADAKMKQFEAKMEMIGKIFSSGFIEHYSILKAQNFS

SEQ ID NO: 157703 - protein, 63 aa, Heterodera glycines
  Coding regions on vcDNA: vcDNA=SeqID_84126; Strand=+; Position=1 -34,91-206,758-799
MCSLMHSKMREIQPPVLWPPTLAYALAIGTRAGTAPTMRDPRSRQNGRAKNCWTESLGLQRLD

SEQ ID NO: 157704 - protein, 124 aa, Heterodera glycines
  Coding regions on vcDNA: vcDNA=SeqID_84127; Strand=+; Position=1 -147,532-633,731-856
MSSNGIITIVALFLVLFGTHITTQIGAMNRHRQQRSLGHPFTVDKQQHTAQNENLVGAYLSRGMFSCGAKYVGTLQRLKRIIEEVHADYSECQKSMKQMDEDEQMAFGKGHGTERFAVIDELIN

SEQ ID NO: 157705 - protein, 160 aa, Heterodera glycines
  Coding regions on vcDNA: vcDNA=SeqID_84128; Strand=-; Position=1 -41,105-546
MRQYSAHINAFFFGSLFLFILPSVVRTLADENERFASSKIMRRGPTIAMVLQRQKQQKSEAEEMAPADVDDDENGAGGRGGGEGRGRHVPIEEEDDGAAESGQQIQCQFHANEELHGEKMGRGQVDTKVDNWKLPYICAPDICDYVQNRIQTSVFQSLIA

SEQ ID NO: 157706 - protein, 166 aa, Heterodera glycines
  Coding regions on vcDNA: vcDNA=SeqID_84129; Strand=-; Position=1-499
MCAKHQAWLKKNGGKNEKAANNVRVGGVFLGKSENQRKNGIIDVPIDVNGHKVDFIADLGTEGTVLCEDTVRQIGALKLSRCQERAQYHDGTIRPFVGKGKTTFSFGDRSCYGHFFVSKDGSKNLLGLDMMDRLGLSDSIRDGLKDKFRTEASSYTSLFHRIAVAK

SEQ ID NO: 157707 - protein, 246 aa, Heterodera glycines
  misc_feature (186)..(186): Xaa can be any naturally occurring amino acid
  Coding regions on vcDNA: vcDNA=SeqID_84130; Strand=+; Position=1-739
  Homolog annotation: Hit_ID=XP_319741.1; Match level="QueryCoverage =91%, HitCoverage=53%, E-value=1e-21, Identity=29%"; Hit description =ENSANGP00000006515 [Anopheles gambiae]
ERFNFALDCAAPQLADEAKVKLLMTKLSEVAFSQYSKSCLPKKVIDFDYSQTEERLKIAFSRPQSIWIDRYECLRASKSEDESFRPFINRHKRFEKLNEEQFSCLMLLTALKSPKDAELRKRILSKLAADGDLVEYDGVVEDLQMYQSTIAEAKVLEQQPMGSRNLMATKLKAKKKRTNSDHSSNXEQHFDRNTQQQSIATRMWRCGLSHSSRNCRHETTVCRKCKKSGHLERMCAKHQAWLKKNG

SEQ ID NO: 157708 - protein, 258 aa, Heterodera glycines
  Coding regions on vcDNA: vcDNA=SeqID_84131; Strand=-; Position=1-777
  Homolog annotation: Hit_ID=XP_309989.1; Match level="QueryCoverage =56%, HitCoverage=55%, E-value=3e-16, Identity=31%"; Hit description =ENSANGP00000015194 [Anopheles gambiae] ref|XP_319667.1| ENSANGP00000022407 [Anopheles gambiae]
MGDAIQQLTAAIQQLLANQNGAPAANAHALPTLPTIDCFEPSDDRSISDWLERFNFALDCAAPQLADEAKVKLLMTKLSEVAFSQYSKSCLPKKVIDFDYSQTEERLKIAFSRPQSIWIDRYECLRASKSEDESFRPFINRHKRFEKLNEEQFSCLMLLTALKSPKDAELRKRILSKLAADGDLVEYDGVVEDLQMYQSTIAEAKVLEQQPMGSRNLMATKLKAKKKRTNSDHSSNESSISTGTRSSNRSQRVCGDAV

SEQ ID NO: 157709 - protein, 45 aa, Heterodera glycines
  Coding regions on vcDNA: vcDNA=SeqID_84132; Strand=+; Position=1 -19,113-231
MNFLYLGIAGNAQFFNTQQKEEEEEADQKEDEENGDGKESITQGI

SEQ ID NO: 157710 - protein, 42 aa, Heterodera glycines
  Coding regions on vcDNA: vcDNA=SeqID_84133; Strand=+; Position=1 -70,158-216
MSDQIRCLIQSGVGSDHYAITSDVSLFIGLIKVSLATMPYFC

SEQ ID NO: 157711 - protein, 100 aa, Heterodera glycines
  Coding regions on vcDNA: vcDNA=SeqID_84134; Strand=+; Position=1-303
MSFVLHNSPVITSFFQFVPSNSLRAVPFFIFQKHPSHFGRPIGMIGVAPECFRSLLPNPPMSAGRPPLWSGRCPAEFAGEVGLHVAEALGVAVRFAKLTK

SEQ ID NO: 157712 - protein, 329 aa, Heterodera glycines
  Coding regions on vcDNA: vcDNA=SeqID_84135; Strand=-; Position=1-992
NGKQIIEHLRKNEKEQKISTISGFNGTLAEFLAQKSGSETEAQKLFLSVKNLFRVMSHQLDAEGKAEEGKDGIRYGEEAEERTEGKGCDKKHGDNGKGQIKEENANANNRERKAYANDGDKDGVLRRRKVRKVKDEVQTREINKERSVRVGDKKQNKAKLGKEKTKTKKVDDNGMEKGENEAANVQKIIKKTLATNAVPMPSDLLQLLMQLWPNVLLLGAEGGPADTSAANDGKTSPRGHRRRKRSQQAEIEKTADVLLAILSLAVAFVLLNIFTITLGFFESWPSIFALTIAGICCYKLMKTDFYHGRVYKALIWLNNRNRIGGYQFH

SEQ ID NO: 157713 - protein, 239 aa, Heterodera glycines
  Coding regions on vcDNA: vcDNA=SeqID_84136; Strand=+; Position=1 -52,503-549,612-750,1258-1504,1892-2092
  Homolog annotation: Hit_ID=Q9P2D1; Match level="QueryCoverage=100%, HitCoverage=11%, E-value=3e-88, Identity=71%"; Hit description =Chromodomain-helicase-DNA-binding protein 7 (CHD-7) dbj|BAA92654.1| KIAA1416 protein [Homo sapiens]
LLKLHADGHKVLIFSQMVRVLDLLEEYLSIKGYPFERIDGNIRYPFERIDGNIRGNDRQAAIDRFSRPQSYDRFVFLLCTRAGGLGINLTSADTVVLFDSDWNPQNDLQAQARCHRIGQTKPVKIYRLITANSYEREMFDKASLKLGLDKAVLQSMLHNNKGESTQQMSRQEVEDLLRKGAYGAIMDDNEGTKFSEEDIDTILLRRTQTIRLEPGVKGSTFAKASFTSSHNREDINIQD

SEQ ID NO: 157714 - protein, 151 aa, Heterodera glycines
  Coding regions on vcDNA: vcDNA=SeqID_84137; Strand=-; Position=1 -125,244-415,625-785
EAYALSQEANISLEQIIKRYTKCRNQFLERVADQISDQLQQDHSDSTDDISTNKHERKKRPIVFISPQLRKRVKIQQQLAEADSANDGDDDSEQKQQKEKSPFTIPGGAEDDEMTDVHSQLEQKQQQQKQQQETEAKKSDGTTKTEDIPSS

SEQ ID NO: 157715 - protein, 52 aa, Heterodera glycines
  Coding regions on vcDNA: vcDNA=SeqID_84138; Strand=-; Position=1-156
MVFSHDEWFVQCVPALGEQLDKLLLLSQHQREEEGNSCLQQRRNTDDDGECH

SEQ ID NO: 157716 - protein, 258 aa, Heterodera glycines
  Coding regions on vcDNA: vcDNA=SeqID_84139; Strand=-; Position=1 -195,252-590,647-787,844-945
  Homolog annotation: Hit_ID=XP_518341.1; Match level="QueryCoverage =90%, HitCoverage=78%, E-value=3e-13, Identity=22%"; Hit description =PREDICTED: similar to KMQK697 [Pan troglodytes]
MKQLQKCPPQINNLTNSQVSTNSPSIAKGGGTTSKGDSKTDKPKDKKEATSKGGSSTTNNAPNAMVSTNAPSIAKGGGTTSKGDSKTDKPKDKKEATSKGGSSTTNNAPNAMVDEATSKMRQSINNLTNSQVSTNAPSIAKGGGTTSKGDSKTDKPKDKKEATSKGGSSTTNNAPNAMVSTNAPSIAKGGGTTSKGGSKTDKSNAQEEGPASEGGSSTKNAPNAQVTANAPAQGEGPSSEGGSTKKPIKDKSEYMSQP

SEQ ID NO: 157717 - protein, 139 aa, Heterodera glycines
  Coding regions on vcDNA: vcDNA=SeqID_84140; Strand=-; Position=1 -75,689-1033
MTALGLQVEGYAGKLKDYENTEDSIPDPDAEMPQQTKEGPSTSVESVEDTSEQLPTTPTPMTPQELDVPSVEMVDTDVPFPSTPADADQQAEPVPSASTARCELMATPSTLCLPQIHSGTDEAPRIDGDIHLSALRSSE

SEQ ID NO: 157718 - protein, 231 aa, Heterodera glycines
  Coding regions on vcDNA: vcDNA=SeqID_84141; Strand=-; Position=1 -90,151-321,378-710,767-868
  Homolog annotation: Hit_ID=C61615; Match level="QueryCoverage=83%, HitCoverage=66%, E-value=1e-09, Identity=23%"; Hit description =sericin MG-2 - greater wax moth (fragments)
MLFLFPLPLILLLLVAIVLVSQCCGGCVKKKGDSKTDKPKAQEEGTSKGGSINTKNAPNAQMDKLKAQEEGTSKGGSSSTKNAPNAMVSTNAPSIAKGGGTTSKGDSKTDKPKDKKEATSKGGSSTTNNAPNAMVDEATSKMRQSINNLTNSQVSTNAPAQRGAMTSKGGSKTDKSNAQEEGPASEGGSSTKNAPNAQVTANAPAQGEGPSSEGGSTKKPITDKSDYMRQP

SEQ ID NO: 157719 - protein, 231 aa, Heterodera glycines
  Coding regions on vcDNA: vcDNA=SeqID_84142; Strand=+; Position=1 -148,653-1002,1097-1294
MAERSGGGGGRKAGQATDGHAGQDHHSVESIVGKGRHKNGGERHGQGHDVSVSLQVVREHNVTISASCCFGGVAEKKFPPLFATTTAHRGMPLSFCRNEKGSKSVNRTPMGAEVRANGAAGDVVRKLELRMVDIELEEGEDEEDGMEEEKRKWRRREWHDGMSGKRSRQEEEDKGGAAPTAAQPKQTTTGWTQFKRNREQQQRERREDGGEKKGRWFGHALISYARESRVN

SEQ ID NO: 157720 - protein, 114 aa, Heterodera glycines
  Coding regions on vcDNA: vcDNA=SeqID_84143; Strand=+; Position=1 -76,264-514,610-627
MDRTIGEFDNCTDTIKAKKTTTGEYAAASFTNAKTVVRENRNYDLQSVDCWRRWSSLRRMPTTANAAKGGGGGTLPAKKREAKRTEESQNDGEEEDEALRRDEWGRLIVMGSRM

SEQ ID NO: 157721 - protein, 99 aa, Heterodera glycines
  Coding regions on vcDNA: vcDNA=SeqID_84144; Strand=+; Position=1 -75,212-406,758-787
MQITIRGWRDSTQLGEEVRRREERKYTKKCTKNKQPIHLGFCAKKKCENQGQSTTCPRKCAKKQPIPLGFCGKKGENRGPSRCENPATVEKLALIYSSD

SEQ ID NO: 157722 - protein, 53 aa, Heterodera glycines
  Coding regions on vcDNA: vcDNA=SeqID_84145; Strand=-; Position=1 -112,853-902
MPEKRQGKTKKDPRSPNKKMRKHIITASNKNSPTFDLVDSFGNIFIVLNYSMH

SEQ ID NO: 157723 - protein, 92 aa, Heterodera glycines
  Coding regions on vcDNA: vcDNA=SeqID_84146; Strand=+; Position=1 -97,1260-1441
MTDKCINREFDNVMFDGVWNDTTAGGSIRFGAENFTRNPQYWIKVAGDNPNKSVILIISLMQKYQREERRPNYAAGFNIFKMVVNIKMGLDN

SEQ ID NO: 157724 - protein, 58 aa, Heterodera glycines
  Coding regions on vcDNA: vcDNA=SeqID_84147; Strand=-; Position=1 -150,472-498
MTNFYIILFKFIFFRQMNISNKENIQEKNGAKNMPKFARKSELAVEQLTNKVLQVAAN

SEQ ID NO: 157725 - protein, 94 aa, Heterodera glycines
  Coding regions on vcDNA: vcDNA=SeqID_84148; Strand=-; Position=1 -205,276-355
MPIIIYFSLNFQLVFLLFNIDIQGWDWLLYYNKLSPFPIILPSALNPIVSFCTINAYRIKFVSNIKCFGKSMKRLFRMKIGDQNAVSNIQMQQH

SEQ ID NO: 157726 - protein, 80 aa, Heterodera glycines
  Coding regions on vcDNA: vcDNA=SeqID_84149; Strand=-; Position=1 -123,164-283
MFICFFPPADHAILDDKSVAEILGINLDDQIILAAYAINVTDIHLALSLYYLVIISTFAYIIMFGLAYCIKKFLDMKTKW

SEQ ID NO: 157727 - protein, 64 aa, Heterodera glycines
  Coding regions on vcDNA: vcDNA=SeqID_84150; Strand=-; Position=1 -102,295-385
MRPIIWPSPLDHCPPPIALSGRTFAKRIVLAEDDFDAGKECVKNLSGGIYVQFVGQEETLTHRK

SEQ ID NO: 157728 - protein, 389 aa, Heterodera glycines
  Coding regions on vcDNA: vcDNA=SeqID_84151; Strand=+; Position=1-1184
  Homolog annotation: Hit_ID=NP_502721.1; Match level="QueryCoverage =75%, HitCoverage=21%, E-value=2e-53, Identity=40%"; Hit description =endonuclease/exonuclease/phosphatase family and RNA-directed DNA polymerase (4O953) [Caenorhabditis elega
HSVTTQLLEVVDDFSALENRKSIDVIFFDLAKAFDTVPHNRLISKLQNIGINNSLLKWIQNYLENRKFFVKIGSDFSDEYPCLSGVPQGSILGPLLFLIYIYDLPKFCETDVKIKLFADDLKAYHVLSNISFSPLQNFINKFNQYCKFNGLKIASNKCLTLHLGHKNQKINYFIDDFQIPKNPGNEPVRDLGIYFTNDLKWAQHIDIISKKALRSAFAILKSIKTRDTKILVNLFNIYCRPILEFGSPIFNPYLKKDIEKLENVQKTFLRVIFRRNNYAAANYAELLNIYDQKSLESRRLKIDLKLFHEIILGKINLQNNESFSFSKNIVKNEYTIRTAYCSTNARYNSFFIRTSRLYRLLPKETRLLNPNEFAKLLERSDLNLLISLP

SEQ ID NO: 157729 - protein, 161 aa, Heterodera glycines
  Coding regions on vcDNA: vcDNA=SeqID_84152; Strand=+; Position=1 -242,493-733
MHHQIHRRQRQNGTNEAANLLINAVQANECLRLTDTNEAETILLIDAIKENGTVPLKPPAQPAKAMHFVVISAVYSTKSKLYSDNQIVLLVDAQFDDAIVQQIFVAKTSNGTNEQQTNFTLHKASRRTDVCLWSSYMSVFDSVDQPEMLQVGQAENMAQIE

SEQ ID NO: 157730 - protein, 122 aa, Heterodera glycines
  Coding regions on vcDNA: vcDNA=SeqID_84153; Strand=+; Position=1 -21,559-735,812-982
  Homolog annotation: Hit_ID=NP_506032.1; Match level="QueryCoverage =77%, HitCoverage=16%, E-value=2e-13, Identity=36%"; Hit description =putative membrane protein family member (5M571) [Caenorhabditis elegans] emb|CAB00121.1| Hypothetical pro
MVSKQCKVKRSYDKKRFEVGTCFSPLFFAEHWQLVVLTIEIYRHFGSALQIIYLMSAIEGIFDILKLYQAADVVQIEHWYSIQIEGEKYKGLAQTINTNQDWRNQISAHTDCLIKYGVNLTN

SEQ ID NO: 157731 - protein, 53 aa, Heterodera glycines
  Coding regions on vcDNA: vcDNA=SeqID_84154; Strand=-; Position=1 -92,292-361
MRLVQVHLCRHDNVEQREALRVPSLRAMICDAGTGWVTTGYRHEDAGNEIGLI

SEQ ID NO: 157732 - protein, 161 aa, Heterodera glycines
  Coding regions on vcDNA: vcDNA=SeqID_84155; Strand=+; Position=1 -82,232-635
MRNLKVWIFDLLYKLGSGFSNWSKCTPEIISLNKIYILHLNCSLMQILNVTDDWVVGVIRRLIEVTHRIITHEKMQRFYTDFIHWLCFALRWMNAKNSVLNKKLKFSTLIGTFFCVYVVQQLLPIIFPIRPPPAPVFKPITRDVIIYATFSYKNSTRYISL

SEQ ID NO: 157733 - protein, 118 aa, Heterodera glycines
  Coding regions on vcDNA: vcDNA=SeqID_84156; Strand=+; Position=1 -111,1020-1084,1120-1300
MHSNFQIFFQKISLGKIPGWSQSRTKIEVPVPTFLVPFRKFRFSHFAFYFSIWPIPGVYNFCCVFNLYCLKIKIRLYLAIVTFISALHGCIVSLGLLNSGNLHGDLMITCCFIDFFMV

SEQ ID NO: 157734 - protein, 335 aa, Heterodera glycines
  Coding regions on vcDNA: vcDNA=SeqID_84157; Strand=-; Position=1 -279,332-779,1190-1470
  Homolog annotation: Hit_ID=AAL78214.1; Match level="QueryCoverage =56%, HitCoverage=95%, E-value=1e-15, Identity=30%"; Hit description =putative esophageal gland cell protein Hgg-20 [Heterodera glycines]
WICNDVWMDILPSFDHAQLGLKLALLSPRFDALVDKHFDGKSELTIWRSIEIRRKDKGPEPKLSVRMDDKFVPFPLPDRPLPSKIRFKCLQIDYIDHSVIAFLRSNHQIFDKRGTNLHLRIQSSHTTEGQRIWDIFGREIWPIFSANIRHLCFSRGDHLDYLLRQISPTILIDLNQLVSIHSFGLLPSAFGGDFDGPNATITAGQALSKWLHSPRKDGQPKQLRCDNYYEQTNTDWIDNFKEHFLRANAISYVSYEIHFSVRAPSMPMVPFELVNEWTKEKLTLAKAKKNEWGIGWIMKRCKIIGETAAVNWEDGNWDNNCNNVLIWLNSDTNCI

SEQ ID NO: 157735 - protein, 38 aa, Heterodera glycines
  Coding regions on vcDNA: vcDNA=SeqID_84158; Strand=-; Position=1-126
NKRGDPFVLQNFFKIKNHDNFLSGVLKVANHESDMYFY

SEQ ID NO: 157736 - protein, 77 aa, Heterodera glycines
  Coding regions on vcDNA: vcDNA=SeqID_84159; Strand=+; Position=1 -133,189-289
MSFSPNSNWDNDFFTGQQQRNNNNSNNGATANSSNSSSLGWCVRANLSSPPAHAFGQHGPFSDDVHRAAEQTLIQGR

SEQ ID NO: 157737 - protein, 429 aa, Heterodera glycines
  Coding regions on vcDNA: vcDNA=SeqID_84160; Strand=+; Position=1 -53,100-194,256-345,410-564,614-719,766-929,1014-1112,1170-1311,1366 -1499
  Homolog annotation: Hit_ID=CAE62022.1; Match level="QueryCoverage =96%, HitCoverage=95%, E-value=6e-54, Identity=36%"; Hit description =Hypothetical protein CBG06032 [Caenorhabditis briggsae]
VFPFYYALIGLGSPLLDISANVGSELLDKYGLKENGISANVGSELLDKYGLKENGAVLIDQQNMDKFDEILNLDSDEILNLDSVIFLPGGSALNTIRVFQWVLNGADRAIFFGSVGDDSEAEADRAIFFGSVGDDSEAEMLLEKTVETGVEAKFQRIEGVRTGKCFSLINATNRSLCACLGASLCACLGAASLFSLDFLHLPENAKLIDTAKFFYSSAHFFTVCPEAIKHLATKAAHFFTVCPEAIKHLATKANELERPFLFNLSADYIPGKFKKELNEIMPFVDILFGNEMEAFAYAKEMNYPTDHLHQIALLLTEIKRNKGKRGKRGRIVLITRGEKPLIGHKMGQKEFPVIFVDKIVDTNGAGDAFCGGFLAAFACDFSLEKFLAAFACDFSLEKCVKFALSAAAIIVQNCGCTFPEEWVGECRER

SEQ ID NO: 157738 - protein, 89 aa, Heterodera glycines
  Coding regions on vcDNA: vcDNA=SeqID_84161; Strand=+; Position=1 -80,227-416
MPIKHCVISLSLFVPLQMQNSEVQIGIKSHQSDCFVRANVHQNAKLFTFDSNITRKDVENGEENGVGEVQRENDTHGQNVFICLIVSAQ

SEQ ID NO: 157739 - protein, 121 aa, Heterodera glycines
  Coding regions on vcDNA: vcDNA=SeqID_84162; Strand=+; Position=1 -64,117-265,315-467
MSTPKQENKFPKKPEFCKTEQDDDEVDTDPSPEEVEKWTPEQVIEWDQRCYGKMPAEEEIWQEFLDNGEANVIREFFGGKGAMEVEKSLREYAKKKEKRDEILMRKRKEYEQKMGNKKDEN

SEQ ID NO: 157740 - protein, 88 aa, Heterodera glycines
  Coding regions on vcDNA: vcDNA=SeqID_84163; Strand=+; Position=1 -121,168-313
MLQNEDSCMNEPKEIPPNVPITQSWKLFRPKYMLTYRLCDFCLSALWNNKNKFKTNEERSVISFELCEKCTIDNCRATDILAPFKPKK

SEQ ID NO: 157741 - protein, 691 aa, Heterodera glycines
  Coding regions on vcDNA: vcDNA=SeqID_84164; Strand=+; Position=1-2076
  Homolog annotation: Hit_ID=XP_318550.1; Match level="QueryCoverage =98%, HitCoverage=69%, E-value=1e-171, Identity=45%"; Hit description= ENSANGP00000020240 [Anopheles gambiae]
MRLELSVADTEAPSIMGLDWIIPFERATQQPIATTLEQQSPIVNSVQPTNDPVKLEGQIKASFPKVFQPGLGHCVKTKATLHLKQNVKPVFCRARPVPHGVQAAVDEELDRLLDSGVLKPIDFSRWAAPVLAVRKKSGNVRICIDFSTGLNDALELNRHPLPRTEDIFHALRGAKVFSQLDLRDAYLQVELDESSKQLVGINTHHGLFQYQRLPFGIKSAPSIFQKAMDQLTSGIPGVFAYLDDIIIASADHSQHVAALIELFSRIQDYGFRVQLDKCHFLKAELKFLGHVVSSDGLKPDPARSDAIRNMPSPHDIGTLRSFLGALNYYGRFDKEMRNLRTPLDLLLKKDTPWFWGPDQQKAFDQAKQVLQLDLLLTQYDPSLPIIVAADASQCGIGATISHVFPNGVERVIEHASRTLTPAERNYAQIEREALSLIFAVQKFHRMIYGRNFTLLTDHKPLLAIFGNKNGIPIYTASRLQRWALILSNYDFTIKYVKSANFGQADVLSRLISEHRTDEEVIVAHTSDNDVDSTEEVEYALLVNLEQLPVDAKEVSELTTSDDLLQQVAQFVRSGWPNKCPANELMPFYSRRDTLTLVGGSILTGNRVIVPAPLRQRVLKTLHFAHPGIVRMKALARNHVFWPGLDSDIEAMVKHCAECQFAAKMPPKAPLRPWPIPGEVFGRVHIEIAGMR

SEQ ID NO: 157742 - protein, 249 aa, Heterodera glycines
  Coding regions on vcDNA: vcDNA=SeqID_84165; Strand=-; Position=1 -32,119-539,1024-1318
MPFLTDRCPTKYIDHTVISFLRSNQKVFDKPTDLCLRIVEVMPIVWNVLVHEIWPIFAPNICRLTFFGGAHLTNLRHHISPTILCDLKRLISINSGDLFPAVIGDDVPNTTAGQALSKWLHTPTKNGQPKQLCCKDYNSLRNSGWVNDFKEEFLRATTTTRASYAIRFVLRVATPIVPFEVVNELTREKLTLETENDGHYNANWLLKRCPINGDETVPGAVQRAKRKTNENLARFVRCPLLVVLCRVAL

SEQ ID NO: 157743 - protein, 124 aa, Heterodera glycines
  Coding regions on vcDNA: vcDNA=SeqID_84166; Strand=+; Position=1 -113,805-1063
MRRKKCHFEAKSKTVKKWHNVQPNISTKPTEIIENYLRFISADCWLEVFALLPPSQLGLGIALISRRFDRRVDEHFKTRKWILDKELRIQEKKRWFGEEANGNCRCQRRKADCRIPQIPLPNEV

SEQ ID NO: 157744 - protein, 63 aa, Heterodera glycines
  Coding regions on vcDNA: vcDNA=SeqID_84167; Strand=+; Position=1 -66,499-624
MRIMRKAKCEKRNLGPSLVNTYFSSTPLLPGRVVSSRNELINQLIDVICDRNDFGTLEFHIGN

SEQ ID NO: 157745 - protein, 25 aa, Heterodera glycines
  Coding regions on vcDNA: vcDNA=SeqID_84168; Strand=+; Position=1 -73,127-131
MIFSALFFLKAPIVPAVGVAPEYKI

SEQ ID NO: 157746 - protein, 246 aa, Heterodera glycines
  Coding regions on vcDNA: vcDNA=SeqID_84169; Strand=-; Position=1 -103,146-258,312-768,841-909
EESFKINRELENYRGSIVHGTSVQQFNDIIDQLLNELSRAADDRDKLIASHREYVGHLQLTHSAAQEMKDRRIKQLEQSLDQIQQKLMASFKHEQLHLVKNNVEGNGHAKGGEGEQKHPMEHHHQQEGIGSAAGDSAGGVATVAHPSNLSSASSQMENLRPAGTVVRHIYPIGQNPSQSQRVRGAVSSMTEGGDGTGQMPHATQYGLNSPYDDEYDDELEDDEEDFEYDEGDSADIDDDLGAQVTI

SEQ ID NO: 157747 - protein, 54 aa, Heterodera glycines
  Coding regions on vcDNA: vcDNA=SeqID_84170; Strand=+; Position=1-161
LSPSFVPFLPLHLPPRPQFTCTYLSRKIGPKDNASGILCRLFAHFPTQLPQHRP

SEQ ID NO: 157748 - protein, 221 aa, Heterodera glycines
  Coding regions on vcDNA: vcDNA=SeqID_84171; Strand=-; Position=1-664
  Homolog annotation: Hit_ID=XP_344704.1; Match level="QueryCoverage =98%, HitCoverage=15%, E-value=4e-55, Identity=45%"; Hit description =similar to mKIAA1632 protein [Rattus norvegicus]
HWRNHSLANSLTGEFTHWRIHSLAKSLTGEITHWRNHSLAKTHWRNHSLAKSLTGEITHWRNHSLAKSLTGEFTHWRIHSLANSLTGEITHWRNHSLAKSLTGEITHWRNHSLAKSLTGEITHWRNHSLAKSLTGEFTHWRIHSLANSLTGEITHWRNHSLAKSLTGEITHWRIHSLANSLTGEFTHWRIHSLANSLTGEFTHWRIHSLANSLTGEITWAK

SEQ ID NO: 157749 - protein, 414 aa, Heterodera glycines
  Coding regions on vcDNA: vcDNA=SeqID_84172; Strand=-; Position=1 -63,113-232,291-524,600-1320,1364-1468
  Homolog annotation: Hit_ID=NP_741131.1; Match level="QueryCoverage =75%, HitCoverage=9%, E-value=8e-25, Identity=28%"; Hit description =furry (3G219) [Caenorhabditis elegans] gb|AAF99910.1| Hypothetical protein F21H11.2a [Caenorhabditis elega
MHLLFTYANYNESPPEMINSQVIRVILKHIHGPNGREASKILKIVTDQWNSISYNYLIQNEKNATALRKPEFELHFERTFAKESAEMGTAKNERLTKNRVKQFKTVPVSLYSELLKVRDRLISVLSASGHRARSPKHSSMLFSHSSSDIHQRVRETTVLAAKSSAICQNGASMLPSPDSADTAHPSAWSQQQPSDEMGVSGGIGFDRMSSPNSLMSAVVGGNNSGANSGGELASLRTTDSFPRVFKEFDFLEAEHDSVSESTESCFNWLSTMRTARCGVCREDTDGQNGTNQDQEEDVPDEDDFYIDEEEDEMDHQSALAANRACIGNFGSSPRTMTGSRHSMGSNNGKSCRNGVAMGGGEKKGTANAGGTVIKRPPSKMSDSNDVSSDTTPVQLSRHSDEEEEEDEDEEAERD

SEQ ID NO: 157750 - protein, 251 aa, Heterodera glycines
  misc_feature (3)..(3): Xaa can be any naturally occurring amino acid
  misc_feature (8)..(8): Xaa can be any naturally occurring amino acid
  Coding regions on vcDNA: vcDNA=SeqID_84173; Strand=+; Position=1 -42,194-423,732-848,909-976,1301-1445,1693-1809
  Homolog annotation: Hit_ID=CAE59982.1; Match level="QueryCoverage =93%, HitCoverage=19%, E-value=6e-56, Identity=50%"; Hit description =Hypothetical protein CBG03474 [Caenorhabditis briggsae]
IKXMYLWXSSKTLLGWRGTPPFCQFPSPFSQLPLSYFHSASTNAQFGLSHGEAAQRMHTYGPNLIEVKLKPLAVLLFREAITPFYIFQVFSVTVWYMDNYAYFASIIVLMSVMSISLDVYQMRKQERKLRSMVHTHEPVHVLRSMVHTHEPVHVLRDGGQVLELSIQLVPGDILLIPPRGCVLQCDAVLLNGTVIVNEAMLTGESMPITKVNRRDDDHQTEFSFKEHSKHVLLGTQVLQVFVVYRFGPAAC

SEQ ID NO: 157751 - protein, 104 aa, Heterodera glycines
  Coding regions on vcDNA: vcDNA=SeqID_84174; Strand=-; Position=1 -122,169-361
MEFLQRSGLTKAAAESVKGAEEEKKKPNCDQKKEQSRKRKGEFSGQLTQAKTIKRDTDEPTECQRTEIKKAKVEEPTTAKMNPTAQLPRPKPMVNEAKHQPKWH

SEQ ID NO: 157752 - protein, 336 aa, Heterodera glycines
  Coding regions on vcDNA: vcDNA=SeqID_84175; Strand=-; Position=1-1010
  Homolog annotation: Hit_ID=EAK89729.1; Match level="QueryCoverage =91%, HitCoverage=94%, E-value=2e-22, Identity=27%"; Hit description =uncharacterized glycine-rich low complexity protein [Cryptosporidium parvum]
HQHSNHWGLNPPTFQSTGLNPPTFQSLGLNPPAFQSLGLNPPAFQSLGLNPSTFQLLGLNPPTFQSTGTQSTSISITGTQSTNISITGTQPTNISITGTQPTSISINGTQSTSISITGTQFTCISITGTQSTNIPINGTQSTSISITGTQSTNISITGTQPTNISITGTQPTSISINGTQSTSIQSLGLNSSAFQLLGLNPPTFQSLGLNPPTFQSLGLNPPTFQSTGLNPPAFQSLGLNPPTFQSLGLNPPTFQSLGLNPPTFQSTGLNPPAFQSLGLNPPTFQSLGLNPPTFQSLGLNPPAFQSTGLNPPAFNHWDSILLHFNYWDSIHQHFNH

SEQ ID NO: 157753 - protein, 278 aa, Heterodera glycines
  Coding regions on vcDNA: vcDNA=SeqID_84176; Strand=-; Position=1 -57,100-252,310-409,557-602,649-1127
  Homolog annotation: Hit_ID=CAE64079.1; Match level="QueryCoverage =87%, HitCoverage=76%, E-value=2e-42, Identity=37%"; Hit description =Hypothetical protein CBG08683 [Caenorhabditis briggsae]
MIHHPNAAYPDTAIITKHKFISEPIAMQFQRDISDFLFHEENFFNHSIVTYGVGGSIELEDGQRVNVFSMHLDWKSYGPYAANNKQVKSEKQIMSGERNKEGYGDFNSPSHLDWIEETKENHGGWTFEWPATKLLTDKGFVDSYRSVNPDLVKNPGIFNNPRVGFKMKRTGETWSTVQKSAGPEWDWTIPEPQDRIDFIFFKPNKFFRPIRSEIYAGKNSLRPIPDQWENDWPSDHYAVITEFEISERNGTTQNESKQRNDINGKIVLNGRCCGNNGK

SEQ ID NO: 157754 - protein, 58 aa, Heterodera glycines
  Coding regions on vcDNA: vcDNA=SeqID_84177; Strand=-; Position=1 -92,164-248
MAASERMMDGDEKSVGEGRSTDRACRGNNVCIAYCLTKQRDKMKIIGVNQLPKSERRL

SEQ ID NO: 157755 - protein, 69 aa, Heterodera glycines
  Coding regions on vcDNA: vcDNA=SeqID_84178; Strand=-; Position=1-208
MPLDTFAKPHHNSYGYHNYGTFYGPIDENDSFNVFVELSPSLFGIGDVIGCGMNLETRQIIFTLNGKRL

SEQ ID NO: 157756 - protein, 108 aa, Heterodera glycines
  Coding regions on vcDNA: vcDNA=SeqID_84179; Strand=-; Position=1 -47,570-849
  Homolog annotation: Hit_ID=AAV34698.1; Match level="QueryCoverage =80%, HitCoverage=30%, E-value=6e-10, Identity=44%"; Hit description =IC5 [Globodera pallida]
MSANHKVHYYYLWLDQYSQVSLGLSTRDFPLTRKWLPTYGQTYAYVFRKKLAGFWGHNVEGSVPDQGNRRIAVANASFYTGDVVGCGVNLATRQIIYTLNGKRLSLSV

SEQ ID NO: 157757 - protein, 98 aa, Heterodera glycines
  Coding regions on vcDNA: vcDNA=SeqID_84180; Strand=-; Position=1-296
  Homolog annotation: Hit_ID=NP_473218.1; Match level="QueryCoverage =100%, HitCoverage=3%, E-value=6e-31, Identity=53%"; Hit description =hypothetical protein [Plasmodium falciparum 3D7] pir||T18440 hypothetical protein C0425w - malaria parasi
DTCGDDTCGADTCGDDTCGADTCGDDTCGADTCGDDTCGADTCGADTCGDDTCGADTCGADTCGDDTCGADTCGADTCGDDTCGAQSKGHCGGAKFND

SEQ ID NO: 157758 - protein, 30 aa, Heterodera glycines
  Coding regions on vcDNA: vcDNA=SeqID_84181; Strand=+; Position=1 -32,372-432
MHLQVKRRFSRKKIWKSGPRQYGLFRLKSN

SEQ ID NO: 157759 - protein, 85 aa, Heterodera glycines
  Coding regions on vcDNA: vcDNA=SeqID_84182; Strand=+; Position=1-255
MPFFIFSIFLLFNGGLAINTSKNRALIYFGGYEYRQKGTSVDGQTQFWQCTQKNCPGRAHGPIGTLDITRIVSEHNHPQVSSQNT

SEQ ID NO: 157760 - protein, 30 aa, Heterodera glycines
  Coding regions on vcDNA: vcDNA=SeqID_84183; Strand=-; Position=1 -53,329-368
MPTSYHSSYNIPKIYYFKLINIKRIEFVFD

SEQ ID NO: 157761 - protein, 360 aa, Heterodera glycines
  Coding regions on vcDNA: vcDNA=SeqID_84184; Strand=+; Position=1-1083
  Homolog annotation: Hit_ID=AAA93301.1; Match level="QueryCoverage =92%, HitCoverage=88%, E-value=2e-50, Identity=34%"; Hit description =HASI
MLERFYNDPKSPAAFAGVDRLWLEAKKELGNKIRKNDVKHYLEGHRTYTLMRPRRINFPRARTTAAGFMTDCQVDLADFQTLSRHNRGNRYLMVVIDVLSKRIFVTPLRTKKADDMVDGFKEVFSTMPMKPHRIFSDKGTEFRNQKLKKLFDEEEVEKYESTHSEKKAALAERAIRQIKNRVYRYFAQTKTLNWVDVIDQIVNGINKSPSRVHGMRPIDVNFKNSQQIWEKMFGDDQHMALFGKPRKRARFVPGQTVRMSIAKGQFEKGYIPNYGDEILEVDAVKRHMKPMRYKLRDSKGEKFKGFFYPEELAPVRKDAETTYRIERVFRKRKMPDGTTEVLVKFIGYPEREWIHETQLV

SEQ ID NO: 157762 - protein, 65 aa, Heterodera glycines
  Coding regions on vcDNA: vcDNA=SeqID_84185; Strand=-; Position=1 -56,407-548
MKIFKFSPREVKKQRMRLSGIIWCHRILSEQQFYINMQKNGFHNDAFKNLSIFGHFTHISSFLFI

SEQ ID NO: 157763 - protein, 77 aa, Heterodera glycines
  Coding regions on vcDNA: vcDNA=SeqID_84186; Strand=-; Position=1 -99,663-797
MACTCTKVQEKYRLPKICLYLYLDPGKIQAWIQHDQQHLDRKALFCPSLSLFSSTEFELFGAGGIRQPLIILKTEAT

SEQ ID NO: 157764 - protein, 79 aa, Heterodera glycines
  Coding regions on vcDNA: vcDNA=SeqID_84187; Strand=-; Position=1 -215,324-348
MIYAAIAITAITVIFGVPFMIFIACVACRSSRNSRRLVESLEQRAQQRREAERIDGTAALRNVLEMRAYSRKIFFEMKI

SEQ ID NO: 157765 - protein, 67 aa, Heterodera glycines
  Coding regions on vcDNA: vcDNA=SeqID_84188; Strand=-; Position=1-225
AKNFFYFRKKIEIFSKKIPFDRARKTMFWKWSSFSRENSLKILKIQKPKNRFLGLARKILKIFEVLK

SEQ ID NO: 157766 - protein, 117 aa, Heterodera glycines
  Coding regions on vcDNA: vcDNA=SeqID_84189; Strand=-; Position=1 -281,327-396
MHQSDTGSSTPGDSPVDRIEITGPMSLAEFVETIEAEFPEQILLKVVTFSFIYNSHFNMKLYADFRGHNLKMPVEVDEPDDPQFDRFDGQGHLLVEDIVFDMIHKTKRDHHHDIPFK

SEQ ID NO: 157767 - protein, 71 aa, Heterodera glycines
  Coding regions on vcDNA: vcDNA=SeqID_84190; Strand=-; Position=1 -146,214-285
NYYTYFGFVSSVEPPVDVLLAETDCQAEVAKLVEERGGLAVSSEWVIQAIVTGSLPDLGEPGGEKFRYDFV

SEQ ID NO: 157768 - protein, 19 aa, Heterodera glycines
  Coding regions on vcDNA: vcDNA=SeqID_84191; Strand=+; Position=1 -3,1271-1327
MGILGLRICTLFASIIFNS

SEQ ID NO: 157769 - protein, 92 aa, Heterodera glycines
  Coding regions on vcDNA: vcDNA=SeqID_84192; Strand=-; Position=1 -151,808-935
MELIREFDEMKKEKIYGFNYDGRKRAKIEKEIMHNLGISRREIKQWKNEFATHTIQRVWTIGQFVLLFRPMGWQKSIRRSAGRKKQNAKHKI

SEQ ID NO: 157770 - protein, 92 aa, Heterodera glycines
  Coding regions on vcDNA: vcDNA=SeqID_84193; Strand=-; Position=1 -198,430-510
MAWYIENWCDESRYTTNVRCGCMEDKTCNVLTDLLLKRKKLLNVWAFEFCHSIRRTETFLYKQWAQNLIECHKTNLMQGDHQVSFGQNLAIN

SEQ ID NO: 157771 - protein, 33 aa, Heterodera glycines
  Coding regions on vcDNA: vcDNA=SeqID_84194; Strand=+; Position=1-225
THFVFINFEKFWTFRGFLLFWTFRGLDTLWGRR

SEQ ID NO: 157772 - protein, 133 aa, Heterodera glycines
  Coding regions on vcDNA: vcDNA=SeqID_84195; Strand=-; Position=1 -102,946-1143,2089-2190
MCHKILLFILVISLNIGYGGGWEFLDSIGSFIANTAKSIWDNGHVVVETLEKVVNVVAAMSSVVYVHTMPLGMIMHLVEQIQYPNATNEPFACGAAGASEAIFKFIRTFLTEFPSFPSLIPKFFGSSPRWVVS

SEQ ID NO: 157773 - protein, 19 aa, Heterodera glycines
  Coding regions on vcDNA: vcDNA=SeqID_84196; Strand=-; Position=1 -3,1038-1094
MSRLIDRKPSNFQQKDKSE

SEQ ID NO: 157774 - protein, 146 aa, Heterodera glycines
  Coding regions on vcDNA: vcDNA=SeqID_84197; Strand=+; Position=1 -47,406-799
MSDHTQEEEMPKLKKRCFLCNDVLFNVFTLVSNKFILGTRLALVNGQFNTIVDKLLLRKSREWSLGILELRCAEQQQGEGKVPQIYKEFVWNLMNHMPPCREYAQILKEVPIATVPVHQSVTGFQGLTIRLETLAFLAKMDLLIKQ

SEQ ID NO: 157775 - protein, 97 aa, Heterodera glycines
  Coding regions on vcDNA: vcDNA=SeqID_84198; Strand=+; Position=1 -152,587-730
VDECPDYGMNSASDDERRHFLRRYFVHFGQPIGEECEMDKMLCKIRHFEAAAHFFWTLWAIHQAAKSAIQFDYMLYAITRHRYCTQLMTSLGIAKNN

SEQ ID NO: 157776 - protein, 288 aa, Heterodera glycines
  Coding regions on vcDNA: vcDNA=SeqID_84199; Strand=-; Position=1-867
  Homolog annotation: Hit_ID=XP_487330.1; Match level="QueryCoverage =95%, HitCoverage=44%, E-value=7e-10, Identity=26%"; Hit description =similar to Hornerin [Mus musculus]
HSITGTQLSSIQSLGLNPPTFQSTGLNSPAFNHWDSTLQHSITGTQLSSIQSLGLNPPTFQSTGLNSPAFNHWDSTHQHSNQRDSTLQHFNHWDSTLQHSITGTQLSSIQSLGLNPPTFQSTGLNSPAFNHWDSTHQHSNQRDSTLQHFNHWDSTLQHSITGTQLSSIQSLGLNPPTFQSTGLNSPAFQSLGLNPPTFQSTGLNPPAFNHWDSTLQHSITGTQPSNIPITGTQPTSISINGTQPTNIPINRTQPSSIQSLGLNPPAFQSHYFTGTQWDSTHQHSNHWH

SEQ ID NO: 157777 - protein, 54 aa, Heterodera glycines
  Coding regions on vcDNA: vcDNA=SeqID_84200; Strand=+; Position=1-659
KYSVLYSFSIFQFPEGLNLIGKMKCQKGFLNLFIQEIKAEKLILKKFFALTIFK

SEQ ID NO: 157778 - protein, 55 aa, Heterodera glycines; identical to SEQ ID NO: 130282
  Coding regions on vcDNA: vcDNA=SeqID_84201; Strand=+; Position=1 -141,298-324

SEQ ID NO: 157779 - protein, 143 aa, Heterodera glycines
  Coding regions on vcDNA: vcDNA=SeqID_84202; Strand=+; Position=1 -197,410-530,801-914
MSISVGGGCHWFQGGGWRCRWHTATAEPKRRRCGHCIRRTPVPHYNWNFAAAVPTSTTGTRHWAAITQPAEVAPSVVGISKLTRTPDDVGHAHTGEQNEQRVIWGTPNKFNPYSNSNCHSDGLGSSGGGGGLNACAPTSFCSF

SEQ ID NO: 157780 - protein, 242 aa, Heterodera glycines
  Coding regions on vcDNA: vcDNA=SeqID_84203; Strand=-; Position=1 -576,621-775
SSSTMNIPPKSFNLAPIAEQEGCDLDQSVSSSSFTNHQQIGQARRPHPRGMPRMIRLRRKRRDDPFGTLIQSTKKMRLNDQWNSSEGQASGVEGTTTIAKNFAMIGERAPSGSHNISKMDGVLFTEDEEDELLFYYGGQDEEDDSDADGYDDESDSNAEEYYKNDYPDEENGKFISFADGVRTNEYENDSTKMNDLQTDHYGDEATKYGHFCYEDDKEEDEDPFSFGKMISAQKKGSEDDSD

SEQ ID NO: 157781 - protein, 60 aa, Heterodera glycines
  Coding regions on vcDNA: vcDNA=SeqID_84204; Strand=+; Position=1-182
SLSSIYIVKKNIDNNRRFAVSTSFDVFFCPVSSLSQITAADTARAVPRPAPSALRRRCCR

SEQ ID NO: 157782 - protein, 120 aa, Heterodera glycines
  Coding regions on vcDNA: vcDNA=SeqID_84205; Strand=-; Position=1 -229,296-429
  Homolog annotation: Hit_ID=NP_998658.1; Match level="QueryCoverage =99%, HitCoverage=27%, E-value=7e-30, Identity=54%"; Hit description =DnaJ subfamily A member 2 [Danio rerio] gb|AAH68384.1| DnaJ subfamily A member 2 [Danio rerio] gb|AAH4804
AGNHEDLFEMLNGGGMPSFMGGGGGLFQQMFSGGRQRSRKGETTVQPLQVSLEDLYKGKNTKLQLTKKVLCKTCNGIGGKQGSVRKCDRCQGSGKVFRTRQIGPGMIQQMAARCDQCSGE

SEQ ID NO: 157783 - protein, 429 aa, Heterodera glycines
  Coding regions on vcDNA: vcDNA=SeqID_84206; Strand=-; Position=1-1287
  Homolog annotation: Hit_ID=AAM51140.1; Match level="QueryCoverage =97%, HitCoverage=41%, E-value=4e-48, Identity=31%"; Hit description =SD27140p [Drosophila melanogaster]
MVGFVSGTSNTADIASRGAKATELLDNNLWQFGPNWLTLKEEEWPMDQIIFDPEVERHTVIDELPIMEMTLPTMEHPPQKALIDENRFSSFIKLKRTMALVLRFLQPRKAEPKKGNLKEKLEAIPPTTAEELLKAEQILIKNAQQRHPADPQLVQNLQLYEDERGILRSKGRIQKGDIAETAKDPIFLPCKAELTALLIRHIHDKLHAGANNVLSEIRQNFWVSQARRTIRHVLQNGRSRHFCHTCHKFKTKPFGQVTMPPLPQFRVDGHTSRPFLNIGLDYFGPMLTKSNGKKMKVWGCIFTCAVTRGIHIELVNDLTAEAFLNALSRFCARRKVPKLIVSDNAKTFKLGSKAAQQICQTPNAAQLFNQPTVQKSVADKGIKWRFNIERAPWTGGFFEKMVHLVKEPLRKTLGKKLVDYEQLMTTLIE

SEQ ID NO: 157784 - protein, 35 aa, Heterodera glycines
  Coding regions on vcDNA: vcDNA=SeqID_84207; Strand=+; Position=1 -42,208-273
MNGQRKDNQTENELKESVARVEKMEEFANKFNFDE

SEQ ID NO: 157785 - protein, 914 aa, Heterodera glycines
  Coding regions on vcDNA: vcDNA=SeqID_84208; Strand=-; Position=1 -1277,1325-2792
  Homolog annotation: Hit_ID=CAE57029.1; Match level="QueryCoverage =43%, HitCoverage=36%, E-value=6e-45, Identity=34%"; Hit description =Hypothetical protein CBG24906 [Caenorhabditis briggsae]
MARLLKTRLQTATDQLEELLSHDHPAATQQMNIGELTLRIHLIDDDLDKISKVVAEIKSISAEWTQIISKIPQKDQDAAINDYDNHVALLQVADKVKSSGTRARQFKTSQISLASAKATLEAAQLQQQNAGGAPAAQAAGAQTTGRVQYQVEIAKIRPQIFSGGKCEWQSWWPVYNLAIHTDPSKPKFLKMADLMSLLKGEAKDIVYGLQLTDADYDLAIKALAEKYDDNSHMIRELHRQLISLKASQSFEDDRKLLIDVQRITRMLKNNAQDINAPTIWLTLEQKVTKPVLRQLQEAKAKAGVDWDTEKFLSSFKDLVIAEEAIEEIYNQSHQRREIGKKPRMVEKTPFKKFQTTIQTTVEQKAKIAPKNGTFGQQKKGVKKPQRDDKAKATPSCRLCSQSHWTSGCSCFRDAKSREEKAKELKFKNQKLLVLQQMGAQPSVLSTTIWGEEAISSHGATCINPAVQRNRKGKQQQYKTNGIRDVYNPENPKLSKKVLVFFDSGSERSYVEKALASFLKLEAKNPAEITLTGFAGVDLGTYTMHMTKLCMKTAMGEKTIEPEITTRVLREMAHVEFADLYDSDFEATQLQRQTESLQPLVLIGTDYFADFDIKTEKRLPSGFWVGNSKVGRLIFGKGNLSKPKMAKKVTSTAISQEAVEVQLQNDDDGLNSMVKQFFDLEAAGMADAAHPTENEQWLDHFNKELHFNMEEKRYEVALPWNNRAEELQPNYGLARGRLDNNLKKLDKEKFQLYDQIIQEQLSKGIVEMVPDPKAWTGKLHYLPHQAVIKDDHQTTKLRIVYDGSAHTKDTPSLNQCLDKGPQLLNDLIGIVMRCRMSEILICADIEKAFLQILIKEEDCDALRFLWVNTDGQVRTYRFRRVPFGLISSPAHLSVTLKPSAKRIIQWPRTSRKTCM

SEQ ID NO: 157786 - protein, 90 aa, Heterodera glycines
  Coding regions on vcDNA: vcDNA=SeqID_84209; Strand=-; Position=1 -99,366-539
MVPLFSIFISLLLSHFGIAAPIIGIRESIFDANLNAEYVMLINTNSGSDSAVYKLSSTEAQQLPHFTRNEESNFQNAYPMTNFMIGIMFG

SEQ ID NO: 157787 - protein, 93 aa, Heterodera glycines
  Coding regions on vcDNA: vcDNA=SeqID_84210; Strand=+; Position=1 -83,531-726
MSGGQNAPKSVQGMPTEKVFGDWHEQRRCSTRTWPPHFDASPSVGVRTQPAVGPTSPPADVGQFCGRQKIAASSAADDGNGTFLTAQRPSSCR

SEQ ID NO: 157788 - protein, 130 aa, Heterodera glycines
  Coding regions on vcDNA: vcDNA=SeqID_84211; Strand=+; Position=1 -120,209-295,488-673
MYGVFCRRDAGMRTGVLSLRKRGGLCADEQRAQYHQLIRRIDSGKSPSFATMSDTEETKYEMRKNEALSPIGGVQRGSLKELNGDPLTPLLPARADFFKERTLEEVIPPNQSLINRSMPFHNIHSQILNF

SEQ ID NO: 157789 - protein, 31 aa, Heterodera glycines
  Coding regions on vcDNA: vcDNA=SeqID_84212; Strand=+; Position=1-93
MPANIFRGADPMEVFDNIITNEAPPKARVGH

SEQ ID NO: 157790 - protein, 223 aa, Heterodera glycines
  Coding regions on vcDNA: vcDNA=SeqID_84213; Strand=+; Position=1 -112,429-508,712-758,811-919,1336-1519,2126-2265
IFPNLSTSEEMSVLIARIAELNRVNTIEPSIASRSDVQKKNDEIVHVDGSEHYGNSGTDRLHCELLKAVHPDIRKKIAENFSNPKHNFWDVNTSHTDLEIFGSGSLKVHYKGDGSVFAQLDSPPKRCHWTEVLAKIRTVAHIKAMANFGPMGQRILECQTFLKAISSVVALIWPLVGWITFGFAVKQQSKFESIIQNGTYAYQSRGYLWINGEEKRIISQYSY

SEQ ID NO: 157791 - protein, 297 aa, Heterodera glycines
  Coding regions on vcDNA: vcDNA=SeqID_84214; Strand=-; Position=1 -118,167-308,351-453,516-678,724-1091
  Homolog annotation: Hit_ID=NP_502882.1; Match level="QueryCoverage =66%, HitCoverage=39%, E-value=1e-23, Identity=33%"; Hit description =DNA polymerase like family member (4Q408) [Caenorhabditis elegans] emb|CAB60306.1| Hypothetical protein Y
MEAEDDESDDNDAENNYMLGYDEEGEKPRSVTTYAYAHAGSRYDHVLIYGEMLRMGVRPELVRQGNHLLEMKARKRGAITTTIFRDSYKLIPIKLASFVKTFGLEIEGVDNKKYFPHKFNKAANYGVVLDTLPPLEDYYPGGHFPEERKKLEQWYEENRNTPFDLREVIADYCKADVQILAHGMVKMRELFAAATSQELTDSITIPSACMKFFVVLSHVGKERVAIIPHLGYEKRGKQSAIARKYLKWRAEEEMRDNGWTLRHVESPGGEYKHGNFLLDGMLERIGEDKNLAIEVNG

SEQ ID NO: 157792 - protein, 63 aa, Heterodera glycines
  Coding regions on vcDNA: vcDNA=SeqID_84215; Strand=-; Position=1 -52,97-236
MHYGLQAGPRTPALQTSGELLLRARHLHGMHCKGHLGPATGPELRNLWNDENLRIGAVRVLRY

SEQ ID NO: 157793 - protein, 128 aa, Heterodera glycines
  Coding regions on vcDNA: vcDNA=SeqID_84216; Strand=+; Position=1 -141,699-926,1246-1263
MQTLTTASCSSSFAADQACQLLAKGTALTPDEFIALLKTVTADDVKKQLTKLFAFVMLVGREPEFIKLESLLSSALGARADCDAAAAADDEPKPLAVYICGPPGTGKTATVGAVVKKLESAHKPCKLQ

SEQ ID NO: 157794 - protein, 208 aa, Heterodera glycines
  Coding regions on vcDNA: vcDNA=SeqID_84217; Strand=-; Position=1 -610,1434-1450
MLEGSGNPTLVPVIERLEKLEKLVEWLIAGENRYGNRFADPQHISSSPSAHTSNNGTQLQWGQPPPFAGNGAVSRMITDAIINSEQLKEKANRAVIEKLPEAIDERALVEQIADECGVKDKLSPDIHRHPRTRTDGGVKRDRILKVPFTDKYSRDKFIYNFRNAVKKLPNVPQHIKVRRDMTQSELKILYSLRQQAYQANIAAEILKI

SEQ ID NO: 157795 - protein, 27 aa, Heterodera glycines
  Coding regions on vcDNA: vcDNA=SeqID_84218; Strand=+; Position=1 -19,91-155
MGEQNDKNRKSNQRQGHFLTNYVNKSH

SEQ ID NO: 157796 - protein, 82 aa, Heterodera glycines
  Coding regions on vcDNA: vcDNA=SeqID_84219; Strand=+; Position=1 -85,401-495,557-625
  Homolog annotation: Hit_ID=CAE64421.1; Match level="QueryCoverage =98%, HitCoverage=19%, E-value=3e-16, Identity=49%"; Hit description =Hypothetical protein CBG09115 [Caenorhabditis briggsae]
MDELQKCPKQKVKSARGKGLLCAIELDNGIDAWQMCLRLMDNGVLAKQTHEHTIRFAPPLVINEKDTRTVAKIIGRTLNAFD

SEQ ID NO: 157797 - protein, 121 aa, Heterodera glycines
  Coding regions on vcDNA: vcDNA=SeqID_84220; Strand=+; Position=1-365
MEIGGSLEDEPMRRRRRRRGQQQQQQNNNDDEDDDDDNDGNEEGDDDHGHDADNEEEEEVGTNRSVRLCFFDAETSQDLPLQLRTKVVQKHVPMLIIAEIICEACINEGISVHSGVGQYAN

SEQ ID NO: 157798 - protein, 92 aa, Heterodera glycines
  Coding regions on vcDNA: vcDNA=SeqID_84221; Strand=-; Position=1 -70,492-700
MYRQYRIFCPITVCLFPRFESGYLAHSPPKLCCFPAILSMCTNRSVSMNCCLLRPLPQLLPSLTNPAQFLIKPSKLPMPFRDSKNNSKELRI

SEQ ID NO: 157799 - protein, 118 aa, Heterodera glycines
  Coding regions on vcDNA: vcDNA=SeqID_84222; Strand=-; Position=1 -58,529-592,931-1164
MARLVNDADLLMMMMIMVGALKFGQFFLLHFTQNTLNSLKRFFSTLLRILPPLPAQFEHLKRVNGTELLVSVSQNGDDGTIGTAERTAIGQLIGGEPTFIGRHIPCRKPQSRHQLEMY

SEQ ID NO: 157800 - protein, 72 aa, Heterodera glycines
  Coding regions on vcDNA: vcDNA=SeqID_84223; Strand=-; Position=1 -35,438-621
MAKILSFFAQDRNGDWGIIFQPPQKGGGVIGDCGINRDWAIIREYTVYKRDCSNQERVLEKNWRTIFLGNVY

SEQ ID NO: 157801 - protein, 91 aa, Heterodera glycines
  Coding regions on vcDNA: vcDNA=SeqID_84224; Strand=+; Position=1 -158,212-329
MTLSPNLKYATHIIFFISWILFVEILYGVIPFLDNAKSAVAFSIDESFSPIESFHGTSWFRSEPKFLVTSFFLANQIQQSWYHSIALSVLY

SEQ ID NO: 157802 - protein, 126 aa, Heterodera glycines
  Coding regions on vcDNA: vcDNA=SeqID_84225; Strand=+; Position=1 -55,452-598,1216-1359,1865-1898
  Homolog annotation: Hit_ID=CAE65207.1; Match level="QueryCoverage =96%, HitCoverage=26%, E-value=3e-38, Identity=61%"; Hit description =Hypothetical protein CBG10082 [Caenorhabditis briggsae]
YGVVNTFLLYVLRFLSLLVLPQCICNSLGLILFNSFKDRIKLKTTPLLAPFICFRVVTKGDYPDLVKVNLEKNLQMCYEAGLESFIFEVVTDKAIHLPHCSNRVREIVVPHAYKWGSGIYFFFFVI

SEQ ID NO: 157803 - protein, 103 aa, Heterodera glycines
  Coding regions on vcDNA: vcDNA=SeqID_84226; Strand=-; Position=1 -23,80-208,492-580,626-694
  Homolog annotation: Hit_ID=AAS84611.1; Match level="QueryCoverage =66%, HitCoverage=27%, E-value=2e-26, Identity=67%"; Hit description =cathepsin L-like cysteine proteinase I variant form precursor [Heterodera glycines]
MLLLQTNGWRARERAIELADSDESIELQNIGQRKTDIRTPTERMSALRQMIAKQFIDKHNEAYKEGKVVLPSGRDSYCRPALFRIPKAERIPSFDGRQFAPQC

SEQ ID NO: 157804 - protein, 44 aa, Heterodera glycines
  Coding regions on vcDNA: vcDNA=SeqID_84227; Strand=-; Position=1-132
MINCKSSLSLLCILRDYQQQQNYFHSALSDPTTVETLGTVVSTT

SEQ ID NO: 157805 - protein, 114 aa, Heterodera glycines
  misc_feature (107)..(107): Xaa can be any naturally occurring amino acid
  Coding regions on vcDNA: vcDNA=SeqID_84228; Strand=+; Position=1-345
MCLFFKHSKNLHNSYIMLVNCFIISVKMINCKSSLSLLCILRDYQQQQNYFHSALSDPTTVETLGTVVSTTVRRAKEGTVETVVLPMVMIREGISGGASEIWRGIIXAKFGKRA

SEQ ID NO: 157806 - protein, 33 aa, Heterodera glycines
  Coding regions on vcDNA: vcDNA=SeqID_84229; Strand=+; Position=1 -42,120-179
MADVFANWYFWIFKHLPLPYLIRVMDCFLVEGD

SEQ ID NO: 157807 - protein, 334 aa, Heterodera glycines
  Coding regions on vcDNA: vcDNA=SeqID_84230; Strand=-; Position=1 -279,332-779,849-1126
  Homolog annotation: Hit_ID=AAL78214.1; Match level="QueryCoverage =44%, HitCoverage=75%, E-value=8e-11, Identity=30%"; Hit description =putative esophageal gland cell protein Hgg-20 [Heterodera glycines]
WICNDVWMDIFPSFDRPQLGLKLALLSPRFNALVDKHFNGKSELTIWRSIEIRRKDKGPEPKLSVWLDDKFVPFPLPDRPLPSKIRFKNLQIEYIDHSVIAFLRSNHQIFDKRGTNLHLWIPSSHSTNGQPILDIFCREIWPIFSTNIRCLGFTNGVDLDNLRRLISPTILTDLNQLNSINSGDLSPAAFGGDFDGPNATISAGQALSKWLHSPRNDGQPKRLRCDNYYEQTNTDWINNFKEHFLRANAISSVSYQIHFSFRVPSMQMVPFELVNEWTKEKLTLTKENENDLENWIMKRCKIGEAADVQLQKDENWGNNWNTVIIWLDSDTNCI

SEQ ID NO: 157808 - protein, 107 aa, Heterodera glycines
  Coding regions on vcDNA: vcDNA=SeqID_84231; Strand=+; Position=1 -99,730-954
MSDDFNRLMSSNSIHNITQETDTCDIEPWIEDWHETPKARSHTTPSEFYQCMSNNSTRIELVCPTFEFGAAFFNLAFCIIPQGKAEAAAEKHQRRRHFSAVSPNVLK

SEQ ID NO: 157809 - protein, 179 aa, Heterodera glycines
  Coding regions on vcDNA: vcDNA=SeqID_84232; Strand=+; Position=1 -139,817-920,1342-1463,1964-2138
MGTEHDDDDGEKGVQQLLEQFVAEGAVQLGQFTLKSGQLSPIYVDLLGLRLVGQADVVEAQGGQDVRQKAVDRRPFRGGPKRTDHRGRGHLRCQRVGDGGRPPCGWAALCARLLRVGPPAGRLLSMGSLLDFLEQCGTIDAGKKTQIVHQLQNPIFDDSATHLQEQKTEKNEGQTEMFF

SEQ ID NO: 157810 - protein, 256 aa, Heterodera glycines
  Coding regions on vcDNA: vcDNA=SeqID_84233; Strand=-; Position=1 -92,143-563,626-883
MEIVDANSKRLPIPQIPLPNKVIGFKRITFSYFDHNVLTFLGRFHRFFASSPTYLTIVTENVRILAFVLSTNWPLLRNCIRLLYLPNFAFRRMRQLAPAILNDYPSLRFVMFSGDDILPEFPPDDSAMATDGQAVVKWLFSSRPDGVPKVLKYNVNLSANEWSSRIEQFKAAFSIASSRVGFSIFFQCSPLTPFLMTNELTGEQLALSKCSSEQRFVLTRCPIAQNEREKQWKELLMDDQWNQIYIGIGDHGIDNG

SEQ ID NO: 157811 - protein, 428 aa, Heterodera glycines
  misc_feature (415)..(415): Xaa can be any naturally occurring amino acid
  misc_feature (423)..(423): Xaa can be any naturally occurring amino acid
  Coding regions on vcDNA: vcDNA=SeqID_84234; Strand=+; Position=1 -39,197-266,606-681,737-907,1081-1221,1277-1573,1870-1998,2207 -2309,2335-2451
  Homolog annotation: Hit_ID=NP_767149.1; Match level="QueryCoverage =88%, HitCoverage=68%, E-value=3e-87, Identity=46%"; Hit description =malonyl CoA synthetase [Bradyrhizobium japonicum USDA 110] gb|AAF28840.1| malonyl CoA synthetase [Bradyrh
IFKANNKHISIIRVEPAEKDDVACILYTSGTTGRPKGAMVTHGGLVANAETCTDIWHFSENDINLHVLPFYHIHGLFIINLHVLPFYHIHGLFISFNCTLMSKSSCIFLPKFDVDETIAYLPKSTAMMGVPTFYARMVEHAGLNRAAVKNMRVFISGSAQLTPQVFEKFETMTGMRILERYGMTETLVSTSNPYDNMTETLVSTSNPYDNARTSGSVGQPVKGVQVNVDKSRKNDNFPRINVDGVIEVKSPSLFNGYLNLPEKTKQEFTADGFFITGDMGEIDQNGFVWIKGRQKDLIITGGLNVYPPEVEDVVTNIFGVKECAIIGVPHPDFGEAVVAVCEPSDAFAEKLSGVAHIDGRLAPYKIPKAVQYMPLPRNHLGQGVAHIDGRLAPYKIPKAVQYMPLPRNHLGQSQXYLINMDIXDWTRS

SEQ ID NO: 157812 - protein, 108 aa, Heterodera glycines
  Coding regions on vcDNA: vcDNA=SeqID_84235; Strand=+; Position=1 -67,364-623
MLNASDVFESMFRFDGENAKEKISRQFYDIMIDAFESDDFAWQLNLRNWQSFPIVIGNFHFVGAIFSNVGPNSNKFQCPFARLEVYIHIFDIPTNDCDLDLNGLKARV

SEQ ID NO: 157813 - protein, 188 aa, Heterodera glycines
  Coding regions on vcDNA: vcDNA=SeqID_84236; Strand=+; Position=1 -78,133-261,318-462,748-839,892-1118
IVIIIKPLKIGHIFLVLSQNFGTVCSCAAKASSNVHSQKPILAAWIANTATNNGTTSAITCCPARIAAVLGQMSSVLHRSSLHVWQQKVPPLAVHCAPNLSQLKRLSMSQSPCVYHGMATFDPSLQFVTVQMSFFPSQSTSFGSVLNFVPGSSSGYCLHCRPTMGGGKRKPKKERQADRRGTERRRSI

SEQ ID NO: 157814 - protein, 73 aa, Heterodera glycines
  Coding regions on vcDNA: vcDNA=SeqID_84237; Strand=-; Position=1-222
MAFSTVFLGNTLIGHFTFLPNVLRIAQVFFACVATKSATFGRALCAQFVAAKATLNVTVAVCVPWDGDSKKAI

SEQ ID NO: 157815 - protein, 708 aa, Heterodera glycines
  misc_feature (347)..(347): Xaa can be any naturally occurring amino acid
  Coding regions on vcDNA: vcDNA=SeqID_84238; Strand=+; Position=1 -658,750-2211
  Homolog annotation: Hit_ID=NP_493834.1; Match level="QueryCoverage =99%, HitCoverage=51%, E-value=1e-120, Identity=36%"; Hit description= putative endoplasmic reticulum protein of ancient origin (2B142) [Caenorhabditis elegans] gb|AAF60594.1|
IRRNDHDEVKEFIDARYVCPQEAVWRIFELPIYDRSHCIMSLPVHLQGEHICYFDENEEEIRERIANGSELMAYFELNKTNVLAKNLFYHQIPEKFCFKKGKWTERKTYFNTIGRMVKVSPAEPERYHLRLLLLNVKGACSYDDLKSVFDTNGNAKVCETFSAACLERGLIRNDEEWKRALEEAESFEMPWKLREFFALILVHCNPAKPEELWNMFKLEKRLPLEKRLPIFQPWQINVDDDVEQVFDLAEELDLGQRSYALMYDEQRKISDEILHRVWNPINEPAFYFLSGPGGTGKTHVNKTIVHMLRGQKKKVCTMAFTGIAATLLPAGRTLHNRFGLTLDMSNXSSPSSKAWQELKETDLFICDEAPMINKRAMRTLDEKLKEIMNNGIAFGGKVMLWTGDFRQTLPIQKHATRAEMVSSTIKRSEYWRLAKRYKLTKNMRALATEQEFARDLLEIGSGKWNNENDEIILPENCISNGDLAEEIFGQCIVLENWNEMARSAILAPKNVDVSEMNNRVLDMLPGEEVVYTSIDLAQDENRQRADDYLDEYLNALNPSGFPRHKLRLKKNAIVLLMRNLNIEMGLCNGARMKVEQLQPNLVVCQILTGDKAGQTVYIPRITLCCSEDYPFDLHRHQFPLVLAFAITINKAQGQTLEQVGIDLRKDVFSHGQLYVALSRARAWNKLRIRLDDGNLERKVKNVVYRELL

SEQ ID NO: 157816 - protein, 246 aa, Heterodera glycines
  Coding regions on vcDNA: vcDNA=SeqID_84239; Strand=+; Position=1 -436,497-762,815-854
YIDHSVIEFLRSNKHIWDRSGTKLELTVYSYKTNDVQQIWDALTSEIWPIFATNIRNLGFTSANGLDNFRRHTSPTILTDLNHLNSINSNFLLPDAIADDGPDATAGQVLSKWLHIPTTDGQPKRLYCHGYYDESNLEWINNLKEAFPRATSSASFIIRIDRERAMSNAEPFELENERTKEKLTLEKEPRSAGYWLLKRCPISEKAAAIQFENWDANLNKIKFHLWGDINKFIGPLSPPTEEKADE

SEQ ID NO: 157817 - protein, 35 aa, Heterodera glycines
  Coding regions on vcDNA: vcDNA=SeqID_84240; Strand=+; Position=1 -58,178-227
MHFILSNTVITDQSLLQADHYPITIYSSLALKMLM

SEQ ID NO: 157818 - protein, 115 aa, Heterodera glycines
  Coding regions on vcDNA: vcDNA=SeqID_84241; Strand=-; Position=1-348
TDGWAEMVKEHPRLVTEVVAAMSQEQSRLCECCFVGIGIGGVPPPPCSKSSASPPPPHHQQFPIVDGGGGEHPIAAVPGGVLNTFLLSIFYAFFILFCFFHALFTTLWHKFGGVA

SEQ ID NO: 157819 - protein, 122 aa, Heterodera glycines
  Coding regions on vcDNA: vcDNA=SeqID_84242; Strand=+; Position=1-603
NHNDGFLNNDLAPFQFPMDFFKIFRPTAGPRWSRSTRDSSPRWSPPCPRSSRASVSVVLLALALVVSLLRPAPNRRLLLLLRIISNFRLLTVVVVNTQLLLFPVVFSTHFCCPFSTRFSFCF

SEQ ID NO: 157820 - protein, 92 aa, Heterodera glycines
  Coding regions on vcDNA: vcDNA=SeqID_84243; Strand=-; Position=1 -131,458-498,1048-1154
MSNSNIYTTFRNPNYYFFALNQQPPEDTDMADLCGTPMRPSDSWSSTEVRSLQHTHVLYNIACYFSIFFYSTRQAVARPSPIRWLAAVPAAD

SEQ ID NO: 157821 - protein, 90 aa, Heterodera glycines
  Coding regions on vcDNA: vcDNA=SeqID_84244; Strand=-; Position=1 -212,272-332
MSNAEPFELVNERTKEKLTLEKEPRYNVVNLLLKRYPIDEKAAIQWENDEKLDDKLNYVQIELMRGSRSIGPLSPPSTEEKAGQSNQNLV

SEQ ID NO: 157822 - protein, 40 aa, Heterodera glycines
  Coding regions on vcDNA: vcDNA=SeqID_84245; Strand=-; Position=1-120
MLTTRDRPGPGSRPGFFLDPGPGHFSATWIFPGPGFSWIF

SEQ ID NO: 157823 - protein, 59 aa, Heterodera glycines
  Coding regions on vcDNA: vcDNA=SeqID_84246; Strand=+; Position=1 -93,262-348
MKGRTNMPLEAVLALVHMVKARQQELRNHTKLYGSGNFGKTGTCQEGQKGRESRPGTGA

SEQ ID NO: 157824 - protein, 171 aa, Heterodera glycines
  Coding regions on vcDNA: vcDNA=SeqID_84247; Strand=+; Position=1 -102,164-304,376-551,603-699
  Homolog annotation: Hit_ID=CAE63596.1; Match level="QueryCoverage =99%, HitCoverage=30%, E-value=2e-41, Identity=52%"; Hit description =Hypothetical protein CBG08087 [Caenorhabditis briggsae]
VLGDAQNWPVAFAFSGLPAFILCCVLPFCPESPKFTLLSRRDRVGTLDTLARLVNVHEGQTMFEALQREGQSTQTLTVADGNIDQSSAMSAASICRLFRSTELRMAFLISMWVMVAQQMTGCAAVFAYSTDMFLNAGLEPSIARYSTLAIGIMYFLFACSSVFFIERKGRV

SEQ ID NO: 157825 - protein, 116 aa, Heterodera glycines
  Coding regions on vcDNA: vcDNA=SeqID_84248; Strand=-; Position=1 -54,561-815,990-1031
  Homolog annotation: Hit_ID=NP_502774.1; Match level="QueryCoverage =78%, HitCoverage=50%, E-value=6e-13, Identity=36%"; Hit description =putative cytoplasmic protein of bilaterial origin (4P423) [Caenorhabditis elegans] pir||T27243 hypothetic
MKRVMADQIKNTKKAFSSIDRDIWLNFVTDLNQIYAEAEKLTAIAYLENILGLVTCHLSMLCFKSLWKRKLEEAQALLYETNQQNFVRNGVYVCNPLEKGFRVDLAWSLFFNLMSS

SEQ ID NO: 157826 - protein, 30 aa, Heterodera glycines; identical to SEQ ID NO: 137412
  Coding regions on vcDNA: vcDNA=SeqID_84249; Strand=-; Position=1-243

SEQ ID NO: 157827 - protein, 88 aa, Heterodera glycines
  Coding regions on vcDNA: vcDNA=SeqID_84250; Strand=-; Position=1 -58,275-352,450-580
MHLLTNSISSQCFIFLHISGDFVLLNGTTIGYQEQIEHVAFETIGGNRVLVLINPKANPIKVSVVDGQRRWTIPMSAESIVSAIWKAK

SEQ ID NO: 157828 - protein, 74 aa, Heterodera glycines
  Coding regions on vcDNA: vcDNA=SeqID_84251; Strand=+; Position=1 -103,166-287
MCRALIAHGVNIELGTDSGESTLLCACFEGRFEIVTLLVENGANVNLADSDGMTPLIVTCYFTGKVVNKLLHNL

SEQ ID NO: 157829 - protein, 43 aa, Heterodera glycines
  Coding regions on vcDNA: vcDNA=SeqID_84252; Strand=+; Position=1-133
TARERRGGRPTRRSSRLSGRRTMRERERTDREKKQFVRLICFN

SEQ ID NO: 157830 - protein, 356 aa, Heterodera glycines
  Coding regions on vcDNA: vcDNA=SeqID_84253; Strand=-; Position=1 -384,1054-1379,1487-1658,1737-1925
  Homolog annotation: Hit_ID=NP_508988.2; Match level="QueryCoverage =55%, HitCoverage=28%, E-value=4e-24, Identity=35%"; Hit description =RabGAP/TBC domain containing protein (85.3 kD) (XG519) [Caenorhabditis elegans] gb|AAC69111.3| Hypothetic
MHSLSRQNAIDARVLFGRGTDKRTIGDRQPRLAVQNIPLPSHGVGQTHRTVRTMERRKGKVSDRKRSERGANGMCKGKPNNERTFQSPHTNGQERHLLISPGTELARTELDPEDGLYERLGWEMWRSYVGTSAKALVLSLYLVPLKMPSFGPFSPQGMSDLLAPLLCTLQDEPLTYWCFVHLIEQTLFRPSNGGEQPSEMEVQLDFIRELLRLFVPDFHAHLAKLGGDAPGLMFVHRHAGHAIAPTTSICSLRVPSFPFMGPTLWTKICHMTKSSFTSLRCPCTWMPISSCARRARGLLYQFHRLPRIPCTLAGLCSYESDSEQWTSHIEPHGQFECSQKHGENGEEQCPFAVGFI

SEQ ID NO: 157831 - protein, 57 aa, Heterodera glycines
  Coding regions on vcDNA: vcDNA=SeqID_84254; Strand=-; Position=1-171
TLFQFPSKLFHWICWDQKGISPVFIFHYDINDQHHSFPLLRRRRSFRADGVKGFLHP

SEQ ID NO: 157832 - protein, 57 aa, Heterodera glycines
  Coding regions on vcDNA: vcDNA=SeqID_84255; Strand=+; Position=1-173
MKISVKGFFGSLITNRAPIFANFETLTPGNPSPGRHGIQVQVQAFFKIPSNDNDIAP

SEQ ID NO: 157833 - protein, 191 aa, Heterodera glycines
  Coding regions on vcDNA: vcDNA=SeqID_84256; Strand=-; Position=1 -171,218-364,419-676
MKSVQPNNILIFERKIVEAETFETKKLKALYFYMQLFRKIIGQLETPYHKKYITNDYINQCQKERNFIVLWVRKTLENVSENFDVIANGPNINDSCQKVVFLKRENLFAANKLNKFETIKEIIVLAYFGIRQTLALIYEQQLENVLIMSKQSLADLLNETTKNDLACLLLSHKESLNLEQIVKNISILKNE

SEQ ID NO: 157834 - protein, 176 aa, Heterodera glycines
  Coding regions on vcDNA: vcDNA=SeqID_84257; Strand=-; Position=1-532
DNSSLMCHSQNLQQNQFIPNYKHFPSLSSSSSLSLPSSSSEATMFGEARENKIENDMEILNSNWSIVQQKMTEKSNDYENANERQQKLEEQMGNSALDEQQMEAQQAKKLLCIKFYKYNLILNGIEMHFYEHFDFLKMCSGKSGTKWMYNQQLETGGIGTSREIFAGISIPCFFLA

SEQ ID NO: 157835 - protein, 300 aa, Heterodera glycines
  Coding regions on vcDNA: vcDNA=SeqID_84258; Strand=+; Position=1 -366,415-606,1282-1433,1478-1667
  Homolog annotation: Hit_ID=CAA04390.1; Match level="QueryCoverage =81%, HitCoverage=54%, E-value=7e-79, Identity=50%"; Hit description =O. volvulus cyclophilin 4 [Onchocerca volvulus]
HNRGNQNNGQCVLNGGGRRAEFEAESSEGFVDGHALPEKSSIIRKKLYFFNYPFQDIITLQDPQDLDKFNIEQFYHVQFDTKTKAQIAEEKRAMQSPNYFLNRLNNEAKEALQQLEKQYVKEGTKKADDQTADEVNAAHFSQGKVAAGLTSTTMEPVTLNKAAVLEEDVVKFVCPKHFDNCMALTFLQGGDPTGTGKGGESIWGKTFKDEIQGTYKHGERGMLSMANRGSDTNNSQFFITFAACPHLDGKHTVFGRLVGGAQTLCNIENLETDEEDQPLRTVLFMQAEVFVDPFDEAMEK

SEQ ID NO: 157836 - protein, 200 aa, Heterodera glycines
  Coding regions on vcDNA: vcDNA=SeqID_84259; Strand=-; Position=1 -39,352-540,1633-1753,1837-2090
  Homolog annotation: Hit_ID=CAG10816.1; Match level="QueryCoverage =45%, HitCoverage=49%, E-value=3e-26, Identity=58%"; Hit description =unnamed protein product [Tetraodon nigroviridis]
MYGMVISKESPMKILDDKGMKRRFRASNFQSTTRVKPFICTMPLRLDEGWNQVQFNLADFVKRAYGSTYVETLRIQSDHILLISGDLVSDVRLRDMFKQYMENNAVLSCLLTDSALDRDFVILGPNGQLLFLVDEDDFAEEEGIPISLFDRHCHKIVIVIDSHVTNSSFRCPKAKATAKYKDVHLYLVQRKALDILLSKK

SEQ ID NO: 157837 - protein, 53 aa, Heterodera glycines
  Coding regions on vcDNA: vcDNA=SeqID_84260; Strand=-; Position=1-161
MADEFLGMPKAMAIEADGSSHLLYGTTPITTPAQVVGESEDGNCELDIFADRR

SEQ ID NO: 157838 - protein, 135 aa, Heterodera glycines
  Coding regions on vcDNA: vcDNA=SeqID_84261; Strand=-; Position=1 -239,529-699
  Homolog annotation: Hit_ID=NP_494439.1; Match level="QueryCoverage =58%, HitCoverage=26%, E-value=6e-11, Identity=44%"; Hit description =putative protein, with at least 4 transmembrane domains, of eukaryotic origin (2D354) [Caenorhabditis ele
TGATSLVFGYVLTMPSLVYAFLWYHRPLSLQYSFFDLLCAFGYSLAPFIPVTALWLLFPFTLARWTLAVSAVVLTGSVLEFFLDEAISRPAQPPVPFDSSSKFLTTTPQVPTASFHGDHPNALNNNGTATIAVVG

SEQ ID NO: 157839 - protein, 15 aa, Heterodera glycines
  Coding regions on vcDNA: vcDNA=SeqID_84262; Strand=+; Position=1-48
TDQKRTKLCRDTERK

SEQ ID NO: 157840 - protein, 95 aa, Heterodera glycines; identical to SEQ ID NO: 142155
  Coding regions on vcDNA: vcDNA=SeqID_84263; Strand=-; Position=1-811

SEQ ID NO: 157841 - protein, 63 aa, Heterodera glycines
  Coding regions on vcDNA: vcDNA=SeqID_84264; Strand=-; Position=1 -105,796-882
MSDQQFGMTRLKKAASSAKSSRPCSPFLTAAFFNAATKTCRTNIFPTSTRLRIGLGMTVRRAS

SEQ ID NO: 157842 - protein, 74 aa, Heterodera glycines
  Coding regions on vcDNA: vcDNA=SeqID_84265; Strand=-; Position=1 -118,666-772
MTNRSLFFTLFIAIIWLCFECANGTGKVPKNIDEPSSDAALISPGYEFLMEYRYLFSIPAVPVLTGTKEYSATF

SEQ ID NO: 157843 - protein, 68 aa, Heterodera glycines
  Coding regions on vcDNA: vcDNA=SeqID_84266; Strand=+; Position=1 -40,92-258
MFRFDSQNKKGENAPSNKPVEVTDIGVDAFKTMLDFIYSDDLSGLNGDNAIKVFYAGKFCGIKVYLIN

SEQ ID NO: 157844 - protein, 128 aa, Heterodera glycines
  Coding regions on vcDNA: vcDNA=SeqID_84267; Strand=-; Position=1 -25,393-534,844-984,1450-1528
  Homolog annotation: Hit_ID=CAE71617.1; Match level="QueryCoverage =100%, HitCoverage=4%, E-value=3e-30, Identity=53%"; Hit description =Hypothetical protein CBG18580 [Caenorhabditis briggsae]
FLSFFRCFSVRGNTVLNPFPFLKPCSTPYAALVVSSSNVLIRHNCFRNQNADFEIGTELMEHAKRIDARENNWGDPQAHNFMHRIFDQFNRYSLATIEASNFHKIIIFKMKYFLLINLNKVKKYKKCS

SEQ ID NO: 157845 - protein, 29 aa, Heterodera glycines
  Coding regions on vcDNA: vcDNA=SeqID_84268; Strand=+; Position=1 -41,533-581
MYQICIKTPKYVNSVPLAAMSEAQMSYNR

SEQ ID NO: 157846 - protein, 19 aa, Heterodera glycines
  Coding regions on vcDNA: vcDNA=SeqID_84269; Strand=-; Position=1 -36,375-398
MTHFQLAHFPVTHLLDALM

SEQ ID NO: 157847 - protein, 91 aa, Heterodera glycines
  Coding regions on vcDNA: vcDNA=SeqID_84270; Strand=+; Position=1 -76,440-639
MRKKFFAFTIFLFIVLQLTDAEMSNEYKEACNDTCAALPKQTCGRGRPQSNSNSQITCYCKWKTSGCCFGEGCVPREQTADEITLYGRTGI

SEQ ID NO: 157848 - protein, 189 aa, Heterodera glycines
  Coding regions on vcDNA: vcDNA=SeqID_84271; Strand=+; Position=1 -312,429-686
MNCLAIMDSHRQKRLMWRDHFVLMMPKRHKNLTFGMRRSQIWQKFNWPIRKKRKTKYSSSSSTTTTTQINGAARANFKEQRHFLSGKQPIRSVWRRAKVALGMERNSEVLVKQLHVRTTAGVFVAIRRPIRPPPPPPIFADKFPHAFTYAGGRWVMGGTVKIPKNFEDFKLCFFCVPISKGVWQLQSKM

SEQ ID NO: 157849 - protein, 104 aa, Heterodera glycines
  Coding regions on vcDNA: vcDNA=SeqID_84272; Strand=-; Position=1-315
MPFGMIIAGPSGSGKSTFLIRFIAESSELISSRPASLLYAFGEMSSIVPTLQKCGVNVYPGVPPEDLINRLPKPLLFIQFGPTSISWITLDCFICLWKHSKNAV

SEQ ID NO: 157850 - protein, 111 aa, Heterodera glycines
  Coding regions on vcDNA: vcDNA=SeqID_84273; Strand=+; Position=1 -304,1074-1297
WGPPQAQTKTKTAPAKSLRFLFTDFCSVQYLVLMRAPNSALAIRNIGVQLFPGKLDYFLSAYRIATNKPYGYLLVDMHAASNPLLRLRSGIFKDDEEEGKKIIFIPKNGLL

SEQ ID NO: 157851 - protein, 161 aa, Heterodera glycines
  Coding regions on vcDNA: vcDNA=SeqID_84274; Strand=-; Position=1-486
SITAATTGLDVPQKKHGEANEFFDALTAATTGMEVDENKVKKALPQPQSNASDFFSPISAATMGISGDHLKPKPKLRQHLPSASDFFSPISAATMGISGDHLKPKPKPRQHQPKASDFFSPISAATMGMSGEQKKDEPNSNQQKKDIPEFAEEKGEEGSRR

SEQ ID NO: 157852 - protein, 292 aa, Heterodera glycines
  Coding regions on vcDNA: vcDNA=SeqID_84275; Strand=-; Position=1 -291,334-918
  Homolog annotation: Hit_ID=AAU84948.1; Match level="QueryCoverage =31%, HitCoverage=66%, E-value=1e-24, Identity=59%"; Hit description =reverse transcriptase [Schistosoma mansoni]
MSINYNDKKFIMDNILPAVEISHTTNGITLISERIAVPRTIPFDIVGKCRECKATECETEWCISKEGVTIWCSRFKISPRFVPFDYVYELPGYTFFKIRNKGRVFNVDHGFRSNVCTQTETPVYNLPPPPPPPQLKPKGNEQGTEEQTTQKFFESITAATTGLDVPQKKHGEANEFFDALTAATTGMEADFSTGLNDSLQLNQHPLPLPSDIFVTLNGGKYFTKIDLSDAYLQIELEENSKKLCTIATLRVHYQYERLPFCVKSAPGIFQSIMDNMLSYLPFALAYLDDLII

SEQ ID NO: 157853 - protein, 88 aa, Heterodera glycines
  misc_feature (13)..(13): Xaa can be any naturally occurring amino acid
  Coding regions on vcDNA: vcDNA=SeqID_84276; Strand=+; Position=1-267
DDQRKTWPKLHLXQAGLCSARRRRLFRCHWHFRRKCAQFGKEIKTWKLGRREKGNANGATKRLDYYFVFPVALNCMDTHKLLLFLFCF

SEQ ID NO: 157854 - protein, 306 aa, Heterodera glycines
  Coding regions on vcDNA: vcDNA=SeqID_84277; Strand=+; Position=1 -162,443-591,645-761,943-1051,1239-1517,1579-1626
  Homolog annotation: Hit_ID=NP_505467.2; Match level="QueryCoverage =94%, HitCoverage=74%, E-value=2e-93, Identity=61%"; Hit description =golgi GDP-fucose translocator; rescues human disease Leukocyte Adhesion Deficiency II (40.4 kD) (5K28) [C
LKNFKISFLAKCRRRLSNNSPSRWQQYSQIVAAVSSYWVCSIGLVFLNKHLLSTVQLNAPLFVTWYQCLTSLDFCLFCSLLSKWFPRLINFPDMSLDLRLSREVLPLSIVFVAMISFNNLVLPLSIVFVAMISFNNLCLKYVGVSFYYVGRSLSTVFNVICSYLILGQSTSKPALLCCMMIIAGFFLGVDQEDVAGTLSVIGVVYGVLASLCVALNAIFTKKTLPTVADSIWRLTMYNNLNACLLFLPLMLVAGEFGEVPYSPHIVKLNFWGMMTLSGFFGFIMYVTGWQQVWQQVTRPDAHISGT

SEQ ID NO: 157855 - protein, 19 aa, Heterodera glycines
  Coding regions on vcDNA: vcDNA=SeqID_84278; Strand=+; Position=1-57
GPGSRSRILKSSGPGPGRA

SEQ ID NO: 157856 - protein, 133 aa, Heterodera glycines
  Coding regions on vcDNA: vcDNA=SeqID_84279; Strand=-; Position=1 -81,185-311,396-589
DFCEKFASLELNSSQQLSMIGELRADNNNLQAEFEKQKQMTSEHLVMLQAELFVLQNKQEEDEKENEKNALIGQLSRLQNEQIVLLGRIGELEKQQKEKDEQQQRQYGGKIMRDRPGPWSLAWIFLDPCVDFP

SEQ ID NO: 157857 - protein, 100 aa, Heterodera glycines
  Coding regions on vcDNA: vcDNA=SeqID_84280; Strand=-; Position=1 -85,651-727,795-899,1068-1103
MHAKLKQSKNFTRKAFKKVALFPCRMKKGKPIEFNSLKSFEIKCKIRPKTQQQKFKGNSADVICLGQNEGATNAESSSASDPQQQNILKPKFCCFFFGKL

SEQ ID NO: 157858 - protein, 83 aa, Heterodera glycines
  Coding regions on vcDNA: vcDNA=SeqID_84281; Strand=-; Position=1 -45,335-541
MRRKKLCEKQHIKNLTIKRLHEEVYSNVQEDAAGVYRVTDVYVGTEPVDVLPEDIEERMAEFVAWLNERRRWRTSTWWQRRHI

SEQ ID NO: 157859 - protein, 23 aa, Heterodera glycines
  Coding regions on vcDNA: vcDNA=SeqID_84282; Strand=+; Position=1 -44,634-661
MTKVAGVNFLVTVIRLVETYVKE

SEQ ID NO: 157860 - protein, 194 aa, Heterodera glycines
  Coding regions on vcDNA: vcDNA=SeqID_84283; Strand=-; Position=1 -321,795-1058
MAQQIWPIFAPNIRHLEFSKIEYRDNLLRLISSTIQFNPNLSSIYAGGQFSDMFADDGGTDGKIGKALSKWLHIPSTDGRPKRLTCGMSCYSKGPPPNFEWINKLKKAFLRATSSANYIIKIQLRALAPIVPFEVVNERTQEKLAVKKEREFGCVNDWVLKRSPIGETDQHKDEEDLSNLNGIVFQLYGSNCIG

SEQ ID NO: 157861 - protein, 119 aa, Heterodera glycines
  Coding regions on vcDNA: vcDNA=SeqID_84284; Strand=+; Position=1 -98,172-307,639-764
MDIFTNYIVVEEKTFTIWNKNSYFQDCTQFATLSFKVDANTFSLVIKDNGNANQSTEVPLAQITIWGWSNKGEQEAKEVKILNIGGKANFGNIGCSNGSQQMATIIIRILKKREKTDTK

SEQ ID NO: 157862 - protein, 69 aa, Heterodera glycines
  Coding regions on vcDNA: vcDNA=SeqID_84285; Strand=-; Position=1 -40,97-257,672-680
MHSKTALNCLLIWALAFIVVGFVQVTVQQPPNEQQREEDKGIFEKSKDTLSNAAEGTKDWLVGAKDSKD

SEQ ID NO: 157863 - protein, 41 aa, Heterodera glycines
  Coding regions on vcDNA: vcDNA=SeqID_84286; Strand=+; Position=1 -97,200-228
MPNIEVEFAKTCLASFVAICGMAKRKIYGWLKGKTMCNYSF

SEQ ID NO: 157864 - protein, 96 aa, Heterodera glycines
  Coding regions on vcDNA: vcDNA=SeqID_84287; Strand=-; Position=1 -12,115-393
MDGGCQITLCLKLDNGCAGITPPKCAATVPRHTVTEQYTTRRRKSKRQRKVRSVAQAQQNESGQVIGDEQNGGTKVDVFTRPIMVGFMQILGNIIY

SEQ ID NO: 157865 - protein, 79 aa, Heterodera glycines
  Coding regions on vcDNA: vcDNA=SeqID_84288; Strand=+; Position=1 -8,117-348
MKSLITFGFAVKQQNKFDGIILSHKGTYSYYNRGDIWINGKGKGRNGKYSYGVGDTVGIGVNTATRQIFFTKNGLRLGW

SEQ ID NO: 157866 - protein, 2265 aa, Heterodera glycines
  Coding regions on vcDNA: vcDNA=SeqID_84289; Strand=-; Position=1-6798
  Homolog annotation: Hit_ID=NP_498959.1; Match level="QueryCoverage =68%, HitCoverage=71%, E-value=1e-159, Identity=27%"; Hit description= zn-finger, CCHC type and RNA-directed DNA polymerase  and Integrase, catalytic domain containing protein
MENSRRYMTRQELRRLLDNGVAVEIEDNEINVAHQQGLRTNWTDYAAENFEASRNFQPAAVFLENHQREIAFSSLRVPIRTSSPNNQNRDPVAPPAQNFVLQNMLPRRLDNDTLSLAGEEVELDQHNENELLGLPLDGRGRTDSMLEHQVSAIHPRGYIRLNELRENIQQNEPRHKLPMPHAYIPRQQPPQQNFGREIQYGTQNPFNQNALNPMHYQAVPVVSRLEMALILDRIPDLTGREGADKIRAFFRKFDISTDEWTDQQRLRALQSKIEGKAERAFNSALASEKISARLVLREPKYQKIRAEMIRILEELDAKEITAFDQLFSGLKRKPVEPIDQFADRVSSVVRRAYPGLDEQLINDYAIKHFLRALDDPDIAMSLELTRSQGMDFDQFVTMAARAEATRKAVRSCNRGQNIRTFPTFSGQVHEPQSNYPQQRQVLTCYNCNRIGHVSRECREPRRNNQTFNNPSNKFVRETNGDSQMPNRNYNTPRFPAQPNFGNSQRNFFNNAQTQKEVTKSANCIQLENAPVVNNLVACVNVNQELEKLKILSVSEGRKKELSSPPAVGKLVVMEFEVCKKKAQGMVDGGAQVSLISAQFLHSLFKDESLKISENCFGHSNLKVRDFNGKTIDVVGEIVLPIMRDGMRPVLITLQVAASDFGFDLIIGTNALNQLGIKLFDEVHQKLVTFETADTETKKETAVRVVYNVKIQPRSSTIIEVAVNDEIDEQDVLIEGASEVSELKIEPTLVMPKFGKATIPVINFSSLPIVLGENDKIGTGVIVEKQVTAENSLNWDCLNHSVTISSIQFLNELEANHVKQIESVWREQANTNCANETDQLGKLIIDHSQIFAIDDKDLTQTDLVTHYVDTKDSSPVKMRMRSIPYAFREKVSIMLQDYLSRGIIRPSWSPYASPIVLVPKKDGTIRFCTDYRALNAVTVKDSFPLPNIDNTLMMLGNKKVFSTMDFMSGYWQIRMHPDSIEKSAFTTEFGLFEYLVMPFGMTNAVATFQRFMNRLFEGVLNDFVFVYVDDILVASENFEQHLEHLKIVFERIQKAGLKLKITKCHFVAEEIQFLGHILTRQGIKKDMDKIRPIFEYAVPKTQKELHSFLGFMTYYRKFIHSFGKLAAPLFRLLKKDTKFCFGEKELEAFKILKEKITENVVLYFPDFNAAQKIPERMFIIMTDASKVGISAILSQPDENQRIRPIYFASRQCNSAESRYSPTELEALAVRFGVNKFAQFITMIPTKVLTDHKALIPMFKTNKETGNSRVDKWIMELRSRFILQVEYNPGKSNVVADVLSRNFPRNESLSIEEELENVALLKSALVTVIENETENGNNEICADEMEWKEKIMESEFGQLIEFLEHRILPEDPRKVQQILAQASFFTFIKNKLFYCDEKTGKLRLFVPEEFRKKLIDQRHAGMCAGHFSAKKLFLQMSEHFFWPNMRADCSKVALDCRICAYTREPRANQPGIQMVRTNEPLELVCLDVLNIGRSRAKNRYILVCVDHFSKWTVAEPIPDKSAETIARAFVENFILIYGAPKRIHSDRGKEFVNSTLEGIAKILKTGTSTTSGYDPQSNGLVERMNQTILKLLKRTTPSSWDWDLKLPFVIFAINVTPSVTTGFSPYSLMFGRVVNFPTDENIKFEEDPRYTVDQETYLQAFNENLMEIMGHARKNAEIAREKSKLEFNSRPNVTREKFKPGDRVMIVVHSTKAQASHRKLAWNHFGPYQIIEMTGSSAKVVPADKLKADPISVPIERMIRVPPGIPNNSILPKGKAKFKNLIGLICVSEEIKNGEINFENETDKEVVYSLGTMNFSGADGKEAANCDEYCLGDGTCFWTTICSGEGHEHCTQLVVADFDAVLNRKIGIGAKEVTTPLQALFCAFLLKKFGSTTASRRLVETIMDGTAGQEFVLFIGARGDMVPSDMLPSAENLMEVIEMRVRTCRKLWRTLEESSYQLLQIAPPKLPFGEESQTEQLAWQEFFAKAPWAFEVIRAQLIHRRRLIEKPRVVMGDSTAKQLVNFTEMTAVEMLISEEEGLAGLVRNFDNAVLSSKVKALLIVCGRDALLANETMETICECFERLRAICERYGHVFIYWAVPPYIHSRKAQFLELVRRLAKLCDDTHIRFGAVTEEGRSLMEVFRYGGTNAGNRVNQSGLLTEHGAKTMMAWIYEVGKFPGEKELGRPRPRSEVVRPGASTSEERRRPNISRGFGLVDHRRHSFSRPSLQTSNREGHQQEWRGRDRSEWASASWRRRGSDQFRSSRRGQQ

SEQ ID NO: 157867 - protein, 152 aa, Heterodera glycines
  Coding regions on vcDNA: vcDNA=SeqID_84290; Strand=-; Position=1 -185,279-487,558-622
  Homolog annotation: Hit_ID=CAE72023.1; Match level="QueryCoverage =68%, HitCoverage=73%, E-value=3e-16, Identity=38%"; Hit description =Hypothetical protein CBG19105 [Caenorhabditis briggsae]
MSTNDVKEAAASTVLPPSSSQSISMASSADGSPLREENFVHSLKSQVDGENIEEIIQSQKKALERFEKTNEMLATCSSLAEKRLDRARKDFAIGREKICRAKSDLDSIFRRIASFKQTLASNYPAEFVAAQTDSPHNQNSDCINEHKKQTDD

SEQ ID NO: 157868 - protein, 36 aa, Heterodera glycines
  Coding regions on vcDNA: vcDNA=SeqID_84291; Strand=-; Position=1 -48,90-148
RGTHFLAGSIFFSALTVSWVLWDNRNQQHKRTSSVR

SEQ ID NO: 157869 - protein, 142 aa, Heterodera glycines
  Coding regions on vcDNA: vcDNA=SeqID_84292; Strand=+; Position=1 -216,374-586
MPGHNPNKNIRARYFEKSLDLDLDLDSMLNLDLDFLDKNPGKSRSRKNPGSSRPGSRPGPGFFETHLKNQKKVFRVLPGPGPGFFSHWTWNLDFLDKNPGKSRLPKNDLGLGPGSRKKSGPGSRSRPSSNKYICPYFFSFVG

SEQ ID NO: 157870 - protein, 26 aa, Heterodera glycines
  Coding regions on vcDNA: vcDNA=SeqID_84293; Strand=+; Position=1-79
RKASKFVLFGALATGGSVLLYSLENS

SEQ ID NO: 157871 - protein, 68 aa, Heterodera glycines
  Coding regions on vcDNA: vcDNA=SeqID_84294; Strand=-; Position=1 -29,154-331
MERRTESHKARKKDVMRVVLGKLDNLTHATSNKKPKMFEEEIECEKPQMEGAFPEAEDFHQKVNLISV

SEQ ID NO: 157872 - protein, 158 aa, Heterodera glycines
  Coding regions on vcDNA: vcDNA=SeqID_84295; Strand=+; Position=1 -113,922-1111,1761-1934
  Homolog annotation: Hit_ID=NP_740940.1; Match level="QueryCoverage =40%, HitCoverage=7%, E-value=2e-12, Identity=51%"; Hit description =sodium potassium-transporting ATPase family member (1P30) [Caenorhabditis elegans] emb|CAD21662.1| Hypothe
SYVEHHLTLDELRDVHPDSFIDVISPEKSDGLSSEEANILQSTGVKIESSAITGEPQPVDYTHEPAAAHISLFDARNVALRGCYCTEGEAVGLVIRAGKYTLDIIDELGAATVNQTQTDQLISITFIHLEVIAADKTGTLTQNLMILTDMWSVLHIKH

SEQ ID NO: 157873 - protein, 34 aa, Heterodera glycines; identical to SEQ ID NO: 140281
  Coding regions on vcDNA: vcDNA=SeqID_84296; Strand=+; Position=1-106

SEQ ID NO: 157874 - protein, 42 aa, Heterodera glycines
  Coding regions on vcDNA: vcDNA=SeqID_84297; Strand=+; Position=1 -51,518-595
MRQQMHTGAVRPWPIWEKIKDNVLNFLANLGSILKQISKDKS

SEQ ID NO: 157875 - protein, 51 aa, Heterodera glycines
  Coding regions on vcDNA: vcDNA=SeqID_84298; Strand=+; Position=1 -128,225-252
MPPDGTPNGCGWPFLWHRLAFFATMCTGCCKNIGARTKSPLFRNVIKCFCI

SEQ ID NO: 157876 - protein, 62 aa, Heterodera glycines
  Coding regions on vcDNA: vcDNA=SeqID_84299; Strand=-; Position=1 -54,273-407
MRRLSDINMAKDWYHWCTGQNLRFTFLLIWERNCKHCHLSNKKENNYHYNLDTLIRSSFLKK

SEQ ID NO: 157877 - protein, 78 aa, Heterodera glycines
  Coding regions on vcDNA: vcDNA=SeqID_84300; Strand=+; Position=1 -57,115-193,360-460
  Homolog annotation: Hit_ID=NP_510380.1; Match level="QueryCoverage =85%, HitCoverage=10%, E-value=4e-13, Identity=50%"; Hit description =DEgenerin Like (75.5 kD) (del-1) [Caenorhabditis elegans] emb|CAA91975.1| Hypothetical protein E02H4.1 [C
TLATVIYRTPMVPILCHVYNINYCLLRPERLKRIWEIRGRAIPDEGSPFRSDFLAQLKDLGYENMTDEVAITTKTLEK

SEQ ID NO: 157878 - protein, 45 aa, Heterodera glycines
  Coding regions on vcDNA: vcDNA=SeqID_84301; Strand=+; Position=1 -94,861-904
MAVLSKLTSSTVTKKVVLATLVEGIGRASGEGTFTLSASALSPAY

SEQ ID NO: 157879 - protein, 113 aa, Heterodera glycines
  Coding regions on vcDNA: vcDNA=SeqID_84302; Strand=+; Position=1 -99,1069-1188,1436-1558
  Homolog annotation: Hit_ID=CAE66863.1; Match level="QueryCoverage =66%, HitCoverage=11%, E-value=1e-17, Identity=57%"; Hit description =Hypothetical protein CBG12237 [Caenorhabditis briggsae]
MDEAPISSGTRGFSSSSRWSGRRRSSPSPSQKGLSDLRRVHPHWDELCGQLLNQGYYQLIGRAQWLLTDSQRKLNREPRLAQPIQLLTRLHVHVLNPVDAMRSFLDEGDKTNK

SEQ ID NO: 157880 - protein, 292 aa, Heterodera glycines
  Coding regions on vcDNA: vcDNA=SeqID_84303; Strand=-; Position=1 -194,348-536,591-804,867-1145
  Homolog annotation: Hit_ID=CAE59959.1; Match level="QueryCoverage =72%, HitCoverage=44%, E-value=2e-35, Identity=31%"; Hit description =Hypothetical protein CBG03449 [Caenorhabditis briggsae]
MNPGPLSDQDQPIEFRFGFSCGDGVQRREAMCVREPDGQRLEEKDCEPRERIVEKQCQMAACPHWKLGTWSPCSVSCGQDGFQTRLVQCVDSEGRKVSDQKCMGIKKQQQTEKPQSYKVCSPGPCPYWRAAKWGHCSVSCGNGVRMRHVECVLKGQIVDDSLCMKAMRPKTSFRCVLLACTVWHGVPQAAATGQIGERRVRKGVRGLRAVVVNGHSKNFLQNGRPSNSSSSAAVSPNCQCRCCHRVRGGRRRGRGGGAGGAHGIIGAVFGHGERDGGRGSSPGQQHAYQSQN

SEQ ID NO: 157881 - protein, 43 aa, Heterodera glycines
  Coding regions on vcDNA: vcDNA=SeqID_84304; Strand=-; Position=1-505
IKHPISALLCREPAGNGWLSICKKLDWQYVVVKNFWVWNYFLK

SEQ ID NO: 157882 - protein, 88 aa, Heterodera glycines
  Coding regions on vcDNA: vcDNA=SeqID_84305; Strand=-; Position=1-267
KNKTETGPGLRDNFLCTNKTPSKVHVQLRSFSALTWSCPCRPSPFSSADATWLQVQTAGPLQHRTAPPSSTGTEHAQQSVQNVQQTWT

SEQ ID NO: 157883 - protein, 129 aa, Heterodera glycines
  Coding regions on vcDNA: vcDNA=SeqID_84306; Strand=-; Position=1 -161,570-703,1061-1157
LDLNDEKRSGVCVDVFGIFPELKVDELNADKYPNIHKFLSNPSSRKSFDVDNLQSVQHELEELISLNVDCQKTIHGEITYMSTGDYPTIDLSNRPMPNLIDLGLLSSPEEEEPPHILDVPSRFWTWAKE

SEQ ID NO: 157884 - protein, 84 aa, Heterodera glycines
  Coding regions on vcDNA: vcDNA=SeqID_84307; Strand=-; Position=1 -120,167-301
MRRFVNSAKCQRFVNSKIRQLSQNVTIRQLIQNLLKKAIKGSASLALEGGGSARGSLPSQQRLGLNYLLEAYESRWQDQRPFNF

SEQ ID NO: 157885 - protein, 125 aa, Heterodera glycines
  Coding regions on vcDNA: vcDNA=SeqID_84308; Strand=-; Position=1 -84,501-644,719-868
  Homolog annotation: Hit_ID=CAG02622.1; Match level="QueryCoverage =60%, HitCoverage=11%, E-value=2e-17, Identity=53%"; Hit description =unnamed protein product [Tetraodon nigroviridis]
MALLRFAETKTNRGKSLLSRGGYDYTFEGSCPDMCPEKERYMRDAKKTVHFYECNAHGQMVHEKMVKDYSRSAADPDTPLAHELRPLKILQLTMDYLIFNVRIAFPKLFGFKMTDRGRNSDNFEQ

SEQ ID NO: 157886 - protein, 24 aa, Heterodera glycines
  Coding regions on vcDNA: vcDNA=SeqID_84309; Strand=+; Position=1-73
IGFLAIIGIGDLIGIGFCLARHIP

SEQ ID NO: 157887 - protein, 81 aa, Heterodera glycines
  Coding regions on vcDNA: vcDNA=SeqID_84310; Strand=+; Position=1 -105,153-293
MMNTEFGAPFKNVLGEIQLLSQAERDGELINKKISVKRKRYKFFMPIMPRGFEPTAWRKRSTRSVTVANYNGTAVFGQQHI

SEQ ID NO: 157888 - protein, 17 aa, Heterodera glycines
  Coding regions on vcDNA: vcDNA=SeqID_84311; Strand=+; Position=1-66
HKHLFDLFYHIHNLIKI

SEQ ID NO: 157889 - protein, 165 aa, Heterodera glycines
  Coding regions on vcDNA: vcDNA=SeqID_84312; Strand=-; Position=1 -165,215-547
  Homolog annotation: Hit_ID=AAK61383.1; Match level="QueryCoverage =60%, HitCoverage=13%, E-value=6e-10, Identity=36%"; Hit description =basic proline-rich protein [Sus scrofa]
MIRLPFLSLALAFSAVLLVLCDDLPCPTDPSSAPLPPGCPPPPADGKKAPADGGKDGGNKGRKKRDNILRAKREDKSKDSEQKADDDEADCAPPNGTPPPGAPPPGTPPPGASPPCRRQRGGPAGGRGRSSAAPAERSAADHAEAIEKLAKRKRKSGCSTHKHLG

SEQ ID NO: 157890 - protein, 29 aa, Heterodera glycines
  Coding regions on vcDNA: vcDNA=SeqID_84313; Strand=+; Position=1-87
MISRLFDSVNNFKSYIDSKLAQTELARSE

SEQ ID NO: 157891 - protein, 88 aa, Heterodera glycines
  Coding regions on vcDNA: vcDNA=SeqID_84314; Strand=+; Position=1 -72,125-319
AVQPLFKDRTVPCPQTEWREIIRQSILSSATVKGRADTSPMKIQMALTDRFPHNKFFVICSPFEQDNKNPSESAVNDGHQMPIEAQLR

SEQ ID NO: 157892 - protein, 75 aa, Heterodera glycines; identical to SEQ ID NO: 124542
  Coding regions on vcDNA: vcDNA=SeqID_84315; Strand=+; Position=1-225

SEQ ID NO: 157893 - protein, 92 aa, Heterodera glycines
  Coding regions on vcDNA: vcDNA=SeqID_84316; Strand=+; Position=1 -95,162-243,469-570
  Homolog annotation: Hit_ID=BAA91422.1; Match level="QueryCoverage =90%, HitCoverage=19%, E-value=2e-12, Identity=38%"; Hit description =unnamed protein product [Homo sapiens]
MCRRCNANWTEEHDKLSCEQFAKLKNYKDDPFDKKIADAIIHKCIQCNISFVKEDGCNHIFCIKCRTEQCYCCRKSIDLFDHYCWSSNKINI

SEQ ID NO: 157894 - protein, 47 aa, Heterodera glycines
  Coding regions on vcDNA: vcDNA=SeqID_84317; Strand=+; Position=1 -42,94-195
MNKVEAQNAERIRKCHEFKKKFFTPFSKKFDRKMNDKLKGSTRMNEQ

SEQ ID NO: 157895 - protein, 34 aa, Heterodera glycines
  Coding regions on vcDNA: vcDNA=SeqID_84318; Strand=+; Position=1 -58,109-155
MISGIKLTFVFILRITSAMDFSTKFPALVISRSE

SEQ ID NO: 157896 - protein, 52 aa, Heterodera glycines
  Coding regions on vcDNA: vcDNA=SeqID_84319; Strand=-; Position=1 -38,329-449
MTFLGVDGIMVAKMMCSSAGMQMTSLVMGRLLCAFLQQDDNKTPNDQPMLPV

SEQ ID NO: 157897 - protein, 184 aa, Heterodera glycines
  Coding regions on vcDNA: vcDNA=SeqID_84320; Strand=-; Position=1 -246,306-614
MAGAETRAPKRHRRNAVDPNVNPFHSLAFPVQLNEKIFLMLYFWFILMAFVSLLSLAEWCWTLLFRSQNRFIKRLIELSLLQMIPDPEFDFGYAGTRRDESGTDECGAETEDGDELEERQHGRFTAVASGLTAAKAENVCDDNQSGSPSNNSTATMEEIEQHAKQMLRNSAVGQCGASDGKVKG

SEQ ID NO: 157898 - protein, 181 aa, Heterodera glycines; identical to SEQ ID NO: 124594
  Coding regions on vcDNA: vcDNA=SeqID_84321; Strand=-; Position=1 -96,135-252,468-628,667-837

SEQ ID NO: 157899 - protein, 326 aa, Heterodera glycines
  Coding regions on vcDNA: vcDNA=SeqID_84322; Strand=-; Position=1 -230,279-669,766-1052,1110-1182
MALLSYRFDVLVDTHFDGKSELTIWRTIRIVKDEGPNANDNGPKPKVSVRIDGSFVDFPLSDRQLPNKICFKNLQIHYIDHSVIKFFRSKKRFFDKSGTKLEVFVHSIDTYVQPIWDVFTREIWPIFAKSIRHLGLHNANALDNLRRRTSPTLLTDLDELHSINSGHLCPEGIADDGPNATAGQALAKWLHTPTKNGQPKQLRFRAYTFRRATTSVSYKIQLYFWVEPMPIEPFELDNEVTKEKLTLKQEIDEFDLNVYNWLLQRCPIGETATAPVKWENRENPSANLNNVRFDLWSFDKSIGPLAPPAEEKEGEEEADQSNKNVV

SEQ ID NO: 157900 - protein, 662 aa, Heterodera glycines
  Coding regions on vcDNA: vcDNA=SeqID_84323; Strand=-; Position=1-1986
  Homolog annotation: Hit_ID=NP_920205.1; Match level="QueryCoverage =95%, HitCoverage=42%, E-value=3e-65, Identity=30%"; Hit description =putative DNA helicase homolog [Oryza sativa (japonica cultivar -group)] gb|AAP52492.1| putative DNA helica
MNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQ

SEQ ID NO: 157901 - protein, 1061 aa, Heterodera glycines
  Coding regions on vcDNA: vcDNA=SeqID_84324; Strand=-; Position=1-3186
  Homolog annotation: Hit_ID=XP_479365.1; Match level="QueryCoverage =28%, HitCoverage=18%, E-value=1e-17, Identity=26%"; Hit description =helicase-like protein [Oryza sativa (japonica cultivar-group)] dbj|BAD32013.1| helicase-like protein [Ory
MPSKQRNLKKKKQDVYRRQAERSVSRDNSPVSDGSADGNGEASASLRGTTTPSLSALQISTPASSIGSKKRGRPSKAGAKPNLATQESMSLIDIHQTVLTQSDQGSPCKKRGKVAEIDQPMFANEAIALTPVSTQSRAGRPAKKIGGPGRGRLSDSMSKSSEMDINLVNAPISATSHTVPEKINFSTVQINFATTRNFACKIWRWAAIGLYERDGETSLAPSSGPRYIETCWNDLTQFLNDGFAATYLAYLASISQRKVVVVDPMVWRNGLDRVMPYKNMTFGYNPNVPAEVILLPVHFPGHWTLIVHDVQWGTHFADSLPTPYGRLDWQLTDKIGKIISDILPSAVLTGIFNAVNLTVQHDGNSCGYFVCLYAESWLMNNCTFVLPDLNINYEKKRILWHINELYGSDIVPFHPREGVSTSFAVVSHHNGDVAQTSSKHIVPIEGDDSAVLPSSEDTAVLAQAPVIGENQADTHGVVADTIVQQEPIAQADDVIFIRPKTPPRRSMRVQKRLSASVSRSPSPAPKRPPPANSLGVATPITRRCSAFHKGWQCAAAAAKHFPEYCDSGKLGDKKCADCGAHLFSHEDSSICCRKGRVVLPMLNPHPDELKQLIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQLHHPAAQAYKQAREQLTELLQQQTPEELRFFRMTLLNERRAPAGLKDPKLHPHQIITPSTGEGMFAIHADPTGAPPPKGIWVENKQGQLNEIAPFSPWTDSLTYPLIKPMGDDGYTTGIKYAKPPSRKRKGAQNASGLFDSEAESDNESCETQSIASSDAGSVADSDAESVASVSSQHRRIDKSKQFISLRDYCKYYLAIRDENVELQYHHILSCGGGLGQRWILDQAAKIDWQIATFLRRPDMDLRISTPKNLLQYLVNQYNRQQARQNPNAQQKTVDDIGSVVRLSEHNVNSLQYWKKMYEDCNTVFARCHDAKKARLFITFTNNREMA

SEQ ID NO: 157902 - protein, 130 aa, Heterodera glycines
  Coding regions on vcDNA: vcDNA=SeqID_84325; Strand=-; Position=1 -181,228-439
MDAYNLKSDSAVRFRLSRNQAYFLAFVSLCLVIITGLLIAVLVIQVTTQNGEKRKEFGSEDIRSSIFANINSDKIAANLEAFAEKPHVAGTEANKKVADRIMETWKANGLEGQLRDKKQRHFENQSRKFI

SEQ ID NO: 157903 - protein, 265 aa, Heterodera glycines
  Coding regions on vcDNA: vcDNA=SeqID_84326; Strand=+; Position=1 -87,140-221,384-553,847-1104,1321-1448,1529-1601
MAQFLKNFLFAMILFIEFVVVVVVEREEKNKIFECPKENARPEQLRELDKKERSEREFELLYEMQETFKKMFSEDSTVTYNNPITKNLLNRRIPKWHFEFIVEKAFQLLRRIKQIDLTNFEKWNQTQEKHEKEWQKISEKGEYFHRKICLLQGFAHRIVRDETLKENSEWQKFHISVASEIFGIGEESEFEEVINEFEENNFAILTEEEYMEHVKKCEESEEYSRKIGDYMLSSTLNKSFYRMCLHKVISNSEEFQHFLCYHKSI

SEQ ID NO: 157904 - protein, 453 aa, Heterodera glycines
  misc_feature (295)..(295): Xaa can be any naturally occurring amino acid
  Coding regions on vcDNA: vcDNA=SeqID_84327; Strand=+; Position=1 -366,604-1085,1364-1888
  Homolog annotation: Hit_ID=NP_500013.1; Match level="QueryCoverage =92%, HitCoverage=29%, E-value=4e-93, Identity=42%"; Hit description =predicted CDS, polyprotein family member (4B673) [Caenorhabditis elegans] gb|AAC02594.1| Hypothetical pro
FREKAKVMLKVADICVPITIYFVNEQKSVCNRDYQLILGCDSLRHFGSFTVNIDKNKIQIGTQWISLGSKNYELMNNIRAFAAENYTIPPSSQVMIRANIKTASQPKHSLVVDKPDLNLISTDINEREREALKNLLEEFKDIFSKSQYDLGSFSGGEHHFDTTTEAPISSPPRRMPYKYRDELKKHIEQLLNKGVMVESETPWVTPFVVVQKKDGGIRPCLDFRKLNEVMIPDRYPLPRLDSIMEKVGSCKFYSSLDLSSGYMQIKLSDDTSWKCGVITEDNYKPSMSRIEIIQXMSTPKNLKDVKRVLGKKGFYRRHIPNFATVVEPLLRLSRRDVPFEWSAEHDKTFNHIKELLSQAPNLVFPDYSKTFHIFSDASMVGLGAVLMQKNELGTFSAISYCCRTLSASKRRWPPLQIELCAIIYATQFPFILSDIELHTDHKTVAFLKKSDTH

SEQ ID NO: 157905 - protein, 43 aa, Heterodera glycines; identical to SEQ ID NO: 155484
  Coding regions on vcDNA: vcDNA=SeqID_84328; Strand=-; Position=1 -66,298-363

SEQ ID NO: 157906 - protein, 117 aa, Heterodera glycines
  Coding regions on vcDNA: vcDNA=SeqID_84329; Strand=-; Position=1-354
MKSLLLKLFVGLCFIDFTSNIKSKFEDFLENQEAMKSIQNYQEKRIKTIKELHAELTKKGIKLAERSLRLYLCKIKSANSDTSKESPNIPEIKFEKQDREEYFWQIFTPNMDHSVKD

SEQ ID NO: 157907 - protein, 98 aa, Heterodera glycines
  Coding regions on vcDNA: vcDNA=SeqID_84330; Strand=+; Position=1 -119,245-422
MVIRRGTKVIRTGEKVIRRGTTEIRRGTTEIRRGTNLMKRRATTVIRRGATVIRRGVTVIRRGATVIRRGVTVIRRGATVIRRGVTVIRRGSTWFKII

SEQ ID NO: 157908 - protein, 154 aa, Heterodera glycines
  Coding regions on vcDNA: vcDNA=SeqID_84331; Strand=-; Position=1 -202,294-556
MPSGSVIWQIGLYKKSNNNDFEYECAECCKNIICKKGNTSNAINHLKSKHKNSEYEAKYEDLLKQKREGLSSFDKKVIHWIACTQSSFSDINNPTTIALFMGNNPLHKLKDESIYRKKILPMVYRMSNQRSKMNWTNAQKLLLRRIFGRTLQTH

SEQ ID NO: 157909 - protein, 153 aa, Heterodera glycines
  Coding regions on vcDNA: vcDNA=SeqID_84332; Strand=+; Position=1 -94,488-855
MQSLSPENQKEIEIFAKHCFAALKLFQQFITAAYCFIQQQIKMSGCLRLCSLVEDRQCLIKAQPYQLNRRPLDLIGNRKGSRHGEEKGAIGCPMGRVNGQNALVPFCWPAFPAICALCFGSSWPGVILIHSLTFLLMTSLFIIILIFRWERRW

SEQ ID NO: 157910 - protein, 40 aa, Heterodera glycines
  Coding regions on vcDNA: vcDNA=SeqID_84333; Strand=-; Position=1-7,48- 163
MTDIISDYFLKKYLESNIWIAEKIGISNAKWTKSPMDNNK

SEQ ID NO: 157911 - protein, 148 aa, Heterodera glycines
  Coding regions on vcDNA: vcDNA=SeqID_84334; Strand=-; Position=1 -8,103-323,399-616
MKNRISFGFAVNQQTKFEGINRSRKGICAYDSKGELWIYGEGRGITQFSYGVGDTVGIAVNFASLRIIFTKNGQCLDCYDFIYSPFLVGDYLHPFVSLYDTGDKIEANFGPKFKWDFATLWDKCSLILILLLFLMFFMHFFFNYVMVV

SEQ ID NO: 157912 - protein, 66 aa, Heterodera glycines
  Coding regions on vcDNA: vcDNA=SeqID_84335; Strand=-; Position=1 -78,152-276
SDDDEFRLDDEDGRKKQERETPTNAADTEERFSQLQNDQKKLLEKISELEKQQKEQTNGEEKLKQK

SEQ ID NO: 157913 - protein, 223 aa, Heterodera glycines
  Coding regions on vcDNA: vcDNA=SeqID_84336; Strand=-; Position=1-672
MKFCILLFLFLIALIIPIESEKKKLQQKSFDAIFGEKWQEKEEERRNELKKREIIAKFYKIKEKIKQKGRKYSAKEWNKINTKIAKKLGTNRHKIYEWIKEIGLYKYHKSKTDEQKRKIVQKFIVMKNEFKQNRKYSQKEWEKNYAEICKKIGISRSTIEKWKKQFGIRCKITENEKMEKMKIYWQTKKENIKMTDKEIAKTLQKDRKSISRWKNQSSKKLKY

SEQ ID NO: 157914 - protein, 51 aa, Heterodera glycines
  Coding regions on vcDNA: vcDNA=SeqID_84337; Strand=-; Position=1-153
MRAVVASRIPPSAGLSSSSALVCAAALATLCVQSADFGGGGGQQIFEHISK

SEQ ID NO: 157915 - protein, 81 aa, Heterodera glycines
  Coding regions on vcDNA: vcDNA=SeqID_84338; Strand=-; Position=1 -114,2001-2132
MVHKDENNCDGDLRLFAIVGRSHVLGTEPNAKTAAVTEKSVSKNIDDLKEGAVVAQKLVKAKNAYEEMVAKAEALLAKANK

SEQ ID NO: 157916 - protein, 187 aa, Heterodera glycines
  Coding regions on vcDNA: vcDNA=SeqID_84339; Strand=-; Position=1 -129,178-288,706-780,1264-1348,1471-1632
MRVCIDQQFFVGQWHTVLGRTPTTKMPQICRNMALVDDQSEPLISAFDIAMTKTPLKFPNLEADESGVFPADIPCRFELDLYLPFVYTHLTIMSGGRPITTLAEARADFGRAKGQFKRAVMALPNHSLDGTFSSLSAYFGLDSSVGVQIVRDLGLTDPAAIFEKRVDHLCEMVSEHWDVQMFGQATR

SEQ ID NO: 157917 - protein, 80 aa, Heterodera glycines
  Coding regions on vcDNA: vcDNA=SeqID_84340; Strand=+; Position=1 -68,593-767
MLHYQLDGDHYGSDQLAMNQLEGNEKKILKKCQTDRPTALGLGPGLPQIDPKVASRIPGWWPRRNCEKVWCTKYFGVGCN

SEQ ID NO: 157918 - protein, 198 aa, Heterodera glycines
  Coding regions on vcDNA: vcDNA=SeqID_84341; Strand=+; Position=1 -198,348-572,1033-1206
MNSSVLVESGVQFEMPILFALSGIEMLLNLVELPTSGMNIYLIGRTPMIHRNLKFILLYQSAWIFTRSFARFSICLLKFLSANALVSEQLQPFKFAYQLSAYNRNFVPHILIIERLMATFWRKNYERSVGWHFSLGWSSFVVFIWLWHYNKKAYMKSLANVKLHCLTERYQVKEEASLSQKQNLKLLSCLRTFALASN

SEQ ID NO: 157919 - protein, 18 aa, Heterodera glycines
  Coding regions on vcDNA: vcDNA=SeqID_84342; Strand=+; Position=1-56
YREAIPEGFGLPINLGAS

SEQ ID NO: 157920 - protein, 29 aa, Heterodera glycines
  Coding regions on vcDNA: vcDNA=SeqID_84343; Strand=+; Position=1-216
WLTKTSSNLVLSILFQIAPNFFYSLTRPY

SEQ ID NO: 157921 - protein, 46 aa, Heterodera glycines
  Coding regions on vcDNA: vcDNA=SeqID_84344; Strand=-; Position=1 -64,273-349
MHRASAEAAQRRAENRRLANAGAPPINVDEMTPAQLEAAQGGLDGN

SEQ ID NO: 157922 - protein, 26 aa, Heterodera glycines
  Coding regions on vcDNA: vcDNA=SeqID_84345; Strand=+; Position=1-160
VRFKVVKVANTSLLALFRGKKERPRS

SEQ ID NO: 157923 - protein, 250 aa, Heterodera glycines
  Coding regions on vcDNA: vcDNA=SeqID_84346; Strand=+; Position=1 -195,236-442,915-1061,1575-1778
MSSADGFFISMINLLAYGPIVPFVFALLIGIPSAILYCLEVWVIIANFADFNSAFFVLVVVRAILSLANWICQFFENRFGKIGLFLAFFHQLPECALSFLYFAVNFAFHVENLLTVFLLLNRFSSILLPFTYNKLWRCALVPALIVSFVLPLPFTVPIFSLQMFIHIQNDNVSFTIDHYKNENIIVYVTSTQFVDEPNKCTNNGQPAQFGLSAEQTQTLFLANYNQYPWVNDLSTIAIPAWLVHSQMNKH

SEQ ID NO: 157924 - protein, 134 aa, Heterodera glycines
  Coding regions on vcDNA: vcDNA=SeqID_84347; Strand=-; Position=1 -223,999-1180
MKIDILLLLCLFIIKNTIDQTVSMKIKQSKGFDQIFGDGWEKNLEENGMDQIDQNGTIGQRQNDDKNRTKNGKKMLKVYTNVERMEKMKQYYQLKSQNPKLTDRKMSEILNIPKRSLQRYKSETKVKANKFSIQ

SEQ ID NO: 157925 - protein, 57 aa, Heterodera glycines
  Coding regions on vcDNA: vcDNA=SeqID_84348; Strand=-; Position=1 -77,146-329
NGLNRMPNKLNADGTLPIYFMARKKWRLQKLGSEPLMISVLISSLFKTIILSHFVSY

SEQ ID NO: 157926 - protein, 193 aa, Heterodera glycines
  Coding regions on vcDNA: vcDNA=SeqID_84349; Strand=-; Position=1 -25,102-261,304-541,581-736
  Homolog annotation: Hit_ID=NP_001004509.1; Match level="QueryCoverage= 95%, HitCoverage=12%, E-value=4e-14, Identity=30%"; Hit description =si:busm1-180o5.3 [Danio rerio] emb|CAD60788.1| novel protein similar to DNA polymerases [Danio rerio]
MNMKNSKNEEKLDEYCSNDTDILMKALIKMRKIFIDITQDKETPNGIDVLRISTTIASSCMNIFRAKFLKNNETLPIIPESGFEPKDSQSNIAIKYFEWIMHRDGVKARHAGNGGEISLLGDKKLKIDCIIGAQKRIIEFQGCAFHGCQNCYKGYMIQANGFTAEQNYERTQNKMERLRSVGKKMGYTVEEVW

SEQ ID NO: 157927 - protein, 237 aa, Heterodera glycines
  Coding regions on vcDNA: vcDNA=SeqID_84350; Strand=+; Position=1 -449,641-791,1116-1229
  Homolog annotation: Hit_ID=NP_498234.1; Match level="QueryCoverage =86%, HitCoverage=31%, E-value=2e-10, Identity=25%"; Hit description =cutaneous T-cell lymphoma tumor antigen se70-2 like (79.0 kD) (3G803) [Caenorhabditis elegans] gb|AAK1885
MTVTAEPSDDKKSLPTDLATAEHPPPVSVPGITAPQHPVRPIYNSKLATQKKRAAIERDRLNKLAEVQRMKTELYTKLVEQQKSLLKKLQQTEDKEAKKKIVKYLKTFELKVDGVKTELEQLALKMREMQMRQPPTKRTRTGLSISEQQLLCRVVYVSACPQEFSEKLILHMERFGELFDYDINATPQIFTYKEPLDAQREQVAAKDLIALLEYDEEEEDDKKEGDEEQLSDKEGND

SEQ ID NO: 157928 - protein, 87 aa, Heterodera glycines
  Coding regions on vcDNA: vcDNA=SeqID_84351; Strand=+; Position=1 -118,227-372
MGKIKQVNNKYKKSPKTAQECKICERATLFKYYKIQSCDACKQFFRRTIVAQRTFICPKSNLCPINKGSFFTYVNIILIKNKKFNKN

SEQ ID NO: 157929 - protein, 88 aa, Heterodera glycines
  Coding regions on vcDNA: vcDNA=SeqID_84352; Strand=-; Position=1 -33,481-714
MVEKPMKFALLKSEKSLENCNVNKQINEQLFNTDEMQIAIFLRDFANESNDQGKGKAMDQNGGEEAQTNQQSNELIGSLELCRLSGVN

SEQ ID NO: 157930 - protein, 73 aa, Heterodera glycines
  Coding regions on vcDNA: vcDNA=SeqID_84353; Strand=+; Position=1 -72,1388-1537
MLWLKASADWRPPLGSVWNPSHPLVQAWIQVSKSLDFSWTWIFLDFCPGNPGPGPTWNPGPGPGPGFFQNTEL

SEQ ID NO: 157931 - protein, 60 aa, Heterodera glycines
  Coding regions on vcDNA: vcDNA=SeqID_84354; Strand=+; Position=1 -79,161-219,917-961
MFPCKDCPKWFLSPEKLKTHQRYSHGKCTFTCHKCSRVFTDSSNYRRQLKKHEEQCSQQN

SEQ ID NO: 157932 - protein, 66 aa, Heterodera glycines
  Coding regions on vcDNA: vcDNA=SeqID_84355; Strand=-; Position=1 -52,308-456
MCSILARLVNIFALKNADSINHLYFEKTFLILISIWLLARAFGIIFNYQHKNESTLKLYFTMTFEL

SEQ ID NO: 157933 - protein, 169 aa, Heterodera glycines
  Coding regions on vcDNA: vcDNA=SeqID_84356; Strand=+; Position=1 -258,314-565
MRCDFCGHKAKNPLKNLSVRVELRDCVDPEITQSTTRTTLFSNTAENFLQLKAKEIVEIGQKEPEKLARVFESKLDQQVLVKLNIKESKGDFEGSDFDWIVSRVFTEDKVKVEEEKEKKKLTEEGELVDDKTNHGEIQIIGEMLAGSTEFGSALWHLQIANSLFLNLII

SEQ ID NO: 157934 - protein, 197 aa, Heterodera glycines
  Coding regions on vcDNA: vcDNA=SeqID_84357; Strand=+; Position=1 -495,562-660
MAELDKLGQSDGDDAGGVEEGAGMDKRSLLLSEAVQVTVTCFAPPVGARPRHFPHQFWGYNEKHRIQICNWDDNYCLFYALIGSRAYHDPVLFKEWTQARQPPQQNMAQLTLLQDFCESQEAFRLLLINRALMRSSAERLLNAAGIREALNAYGIDQLQPIQDYWDQRFPGLYRILLFEDRPEVLPKPMEGANWPSF

SEQ ID NO: 157935 - protein, 42 aa, Heterodera glycines
  Coding regions on vcDNA: vcDNA=SeqID_84358; Strand=+; Position=1 -31,418-515
MSCQSVARLPAFGTAVNVDMIQMTNSLMDERVVNLTSQPRIG

SEQ ID NO: 157936 - protein, 19 aa, Heterodera glycines
  Coding regions on vcDNA: vcDNA=SeqID_84359; Strand=-; Position=1-59
TFAFSSLALPNTHTIFEML

SEQ ID NO: 157937 - protein, 19 aa, Heterodera glycines
  Coding regions on vcDNA: vcDNA=SeqID_84360; Strand=-; Position=1-59
TFSFSSLALPNTHTIFEML

SEQ ID NO: 157938 - protein, 19 aa, Heterodera glycines
  Coding regions on vcDNA: vcDNA=SeqID_84361; Strand=-; Position=1-59
TFAFSSLALPNTHTIFEML

SEQ ID NO: 157939 - protein, 19 aa, Heterodera glycines
  Coding regions on vcDNA: vcDNA=SeqID_84362; Strand=-; Position=1-59
TFAFSSLALPNTHTIFEML

SEQ ID NO: 157940 - protein, 19 aa, Heterodera glycines
  Coding regions on vcDNA: vcDNA=SeqID_84363; Strand=-; Position=1-59
TFAFSSLALPNTHTIFEML

SEQ ID NO: 157941 - protein, 19 aa, Heterodera glycines
  Coding regions on vcDNA: vcDNA=SeqID_84364; Strand=-; Position=1-59
TFAFSSLALPNTHTIFEML

SEQ ID NO: 157942 - protein, 19 aa, Heterodera glycines
  Coding regions on vcDNA: vcDNA=SeqID_84365; Strand=-; Position=1-59
TFAFSSLALPNTHTIFEML

SEQ ID NO: 157943 - protein, 19 aa, Heterodera glycines
  Coding regions on vcDNA: vcDNA=SeqID_84366; Strand=-; Position=1-59
TFSFSSLALPNTHTIFEML

SEQ ID NO: 157944 - protein, 95 aa, Heterodera glycines; identical to SEQ ID NO: 125597
  Coding regions on vcDNA: vcDNA=SeqID_84367; Strand=-; Position=1-655

SEQ ID NO: 157945 - protein, 35 aa, Heterodera glycines
  Coding regions on vcDNA: vcDNA=SeqID_84368; Strand=-; Position=1-108
KCLICSGVGATIPITYSHNDDPPLVSATPSISGGK

SEQ ID NO: 157946 - protein, 77 aa, Heterodera glycines
  Coding regions on vcDNA: vcDNA=SeqID_84369; Strand=-; Position=1 -78,662-817
MEFNVDAGGLGKEFFCEHIFVENASIVTRQGPVQENSLNILSRRALSLKILMAQDGFYGRSYGEYIKLCPYFWTIYC

SEQ ID NO: 157947 - protein, 100 aa, Heterodera glycines
  Coding regions on vcDNA: vcDNA=SeqID_84370; Strand=-; Position=1 -154,498-589,640-696
MLGHSEWMDAQEMMANFIEQHSVGSVLSAFAGHHVPQHIANLLNENEESTQVLKNWGIHPEKMTIETSIIFSKEITPAQKEKVFSTLDSFLKDNNIRTEM

SEQ ID NO: 157948 - protein, 207 aa, Heterodera glycines
  Coding regions on vcDNA: vcDNA=SeqID_84371; Strand=-; Position=1 -48,681-1256
  Homolog annotation: Hit_ID=CAE63276.1; Match level="QueryCoverage =35%, HitCoverage=12%, E-value=2e-11, Identity=43%"; Hit description =Hypothetical protein CBG07653 [Caenorhabditis briggsae]
MEAELCWTIWQNYFENLVDDPEKFGYAMDSLMKFKQDNYPNEHICFLGFGTTDDGDHLMNMVIAKFLQQNFEHISFVDGGYRTLHQMLKDGGNLTKLSNHYRRNDCTECKEGGPKEGENGKAMVGPQKCQIKVPIADCSLSDARPLLDVSQTVEKIAAEEKRINGAAGNGRPAKGDGHRRECEAREQHRSVRQALPQRAVGVQHQQR

SEQ ID NO: 157949 - protein, 145 aa, Heterodera glycines
  Coding regions on vcDNA: vcDNA=SeqID_84372; Strand=+; Position=1 -147,192-419,1435-1497
  Homolog annotation: Hit_ID=CAE59378.1; Match level="QueryCoverage =82%, HitCoverage=14%, E-value=7e-09, Identity=35%"; Hit description =Hypothetical protein CBG02731 [Caenorhabditis briggsae]
MSLNIGIWAEEEDDQRPSFQHGKKRPNDSAPVSFVSAGVKVGSKTQLADGNLQEDEEESEISAVETPPEKRPTPSTFVPSVPSTSDVGAQVFAGMRSSKFQSGGGMTDTTWIKAGKGSVVMQMMQEMSIKNRNEKVISQMSSRFV

SEQ ID NO: 157950 - protein, 156 aa, Heterodera glycines
  Coding regions on vcDNA: vcDNA=SeqID_84373; Strand=+; Position=1 -349,503-624
MDVTLPVSNSAGEWIGEERRDGVVLYAPWTDEWHVQQQQQQQQHQQQQHQQQQQQQQQQQQFVRRTGTGWTRFPAWNEPLVANDWREKEENRIQRKRLQRENPEYWAQILEEEKRAVCCWGREDSGWKFWRRALVNDVGMGLKVLRLTMIGDGIWH

SEQ ID NO: 157951 - protein, 238 aa, Heterodera glycines
  Coding regions on vcDNA: vcDNA=SeqID_84374; Strand=+; Position=1 -273,326-769
  Homolog annotation: Hit_ID=NP_723361.1; Match level="QueryCoverage =69%, HitCoverage=75%, E-value=3e-12, Identity=28%"; Hit description =CG8409-PB, isoform B [Drosophila melanogaster] ref|NP_476755.1| CG8409-PA, isoform A [Drosophila melanoga
MPVDLDDSLLSLDVSPTNSFPIDPPLADVDSFVPDLVPELGDDSAEYLSDSEEFEVERICGQKIENGRQFFLVKWKGYPKSQNDWEPEENLLGCQPKILQYWRRRQYDKEYRARTKDDEKSARGGKKKKSKAYEEKPKAAVDVEPDPVEKAKEEMGATPGEVLEEETEGLEEEDVCKKGKPESADAGPEVEQLKKMLRDSGQMPMDNAPLPLPRWVRGSGAFKKRYKKLYDAMTNNMG

SEQ ID NO: 157952 - protein, 86 aa, Heterodera glycines
  Coding regions on vcDNA: vcDNA=SeqID_84375; Strand=-; Position=1 -40,95-122,186-222,604-678,732-811
  Homolog annotation: Hit_ID=AAQ96595.1; Match level="QueryCoverage =70%, HitCoverage=11%, E-value=2e-18, Identity=72%"; Hit description =excitatory GABA receptor EXP-1B [Caenorhabditis elegans] gb|AAC67448.3| Expulsion defective (defecation) p
ILTITFLLFSYNEVMPRVSYLKALDIWLAVCFMIVFLSLIKLALMKYMRQRIRIVTGGAQSSPSALLGGMLPIIQLSTGAGPMLDY

SEQ ID NO: 157953 - protein, 142 aa, Heterodera glycines
  misc_feature (139)..(139): Xaa can be any naturally occurring amino acid
  Coding regions on vcDNA: vcDNA=SeqID_84376; Strand=-; Position=1 -53,503-556,605-626,688-730,983-1178
  Homolog annotation: Hit_ID=AAQ96595.1; Match level="QueryCoverage =96%, HitCoverage=21%, E-value=2e-35, Identity=56%"; Hit description =excitatory GABA receptor EXP-1B [Caenorhabditis elegans] gb|AAC67448.3| Expulsion defective (defecation) p
IATKNPREQSISHRSLLILQSNGQILYSRRLSVVAECPMDLTLAECPMDLTLFPFDSQTCKLGIESFPFDSQTCKLGIESYGYTSDQVSYGWSKGQREALKLHKIRLPDFRIKEAFVTSQLESYATGNLNNFFKFFLHXKII

SEQ ID NO: 157954 - protein, 153 aa, Heterodera glycines
  Coding regions on vcDNA: vcDNA=SeqID_84377; Strand=+; Position=1-464
NGANLSRALHNLTNEIGQNGKCELSYAIHKNYITEANKKNNKFDASNSHFMYELDKINKISIDQSTNTLPTALIWINQLRTDFATLVPEIGLVDIWQNVDSYTETRELVVKLCEKIATIQTDVSYNGSNLVNQIISEAKDKLEDFKEKSGGSN

SEQ ID NO: 157955 - protein, 258 aa, Heterodera glycines
  Coding regions on vcDNA: vcDNA=SeqID_84378; Strand=+; Position=1 -189,232-576,618-860
  Homolog annotation: Hit_ID=NP_501429.1; Match level="QueryCoverage =95%, HitCoverage=37%, E-value=2e-45, Identity=41%"; Hit description =tc5 transposase and CENP-B protein and Tc5 transposase, C-terminal family member (mut-x) [Caenorhabditis
MTKEVFEQFRQKIEMNLSLSDLILRKWALIANSKLGENQIIGFQASNTWTNRFKKRHRIVSRKITKFISKKHFVNYENVKKEASEFVENIRKIIKDEKFSERDLLNADQSGFELEMHAKRTLAPLGTKLVECVVQSVESTTHSYTIMPLITASGILLSPLFIVIAERSGKFPKKGIFQAKNIYSVANTSHIMTKTLMVEWVENVLYPTLRSNQKTMLLVDSWPGWNEFETKEGVELSVKQIPKHGTGICQPLDVYIFR

SEQ ID NO: 157956 - protein, 256 aa, Heterodera glycines
  Coding regions on vcDNA: vcDNA=SeqID_84379; Strand=+; Position=1 -339,877-1189,1276-1394
MLAKIRTVVHTKAMANFGPMGQRILECRTFLVAISSVVALIWPLGGLSSQRMANLWVFYFILNYFYLNYFSDTSDLFLSPPFGFPLFPFISLNDSGDLIETNFGPQFKFDPAKAEAENRKLKNEIEKIQEKFDKKEEQLEKDLGELQKKLVEMEQQQNEQQKSNEQMKKVGKEIFTAHFERFRQKAFQEELEKKVTERIVAVQSKVDKMEMAHQQQKVVTEKAIFERIGELEGQQKHQKQQGERETNGENIFSIYY

SEQ ID NO: 157957 - protein, 177 aa, Heterodera glycines
  misc_feature (11)..(11): Xaa can be any naturally occurring amino acid
  Coding regions on vcDNA: vcDNA=SeqID_84380; Strand=+; Position=1 -100,873-1016,1061-1274
  Homolog annotation: Hit_ID=AAD25921.1; Match level="QueryCoverage =91%, HitCoverage=20%, E-value=1e-37, Identity=50%"; Hit description =acetylcholinesterase [Meloidogyne javanica]
YFNFTFGDQKXGTSMFMNSIYFLNSMYLIQFKIVCSVQSVFCSVPYVSLRDGSPLFGIYSQAPTGKTVTQFLGVPFAEPPIGKLRFRRPVPKKPWRDQWNATAFRIGKLRFRRPVPKKPWRDQWNATAFRDSCVQSPDTYFGDFYGATMWNCSTCLFLDSLAINSKKRNILFVYFRN

SEQ ID NO: 157958 - protein, 24 aa, Heterodera glycines
  Coding regions on vcDNA: vcDNA=SeqID_84381; Strand=+; Position=1-75
TCTCGVVVKLSTFHNFSPGFNSPL

SEQ ID NO: 157959 - protein, 39 aa, Heterodera glycines
  Coding regions on vcDNA: vcDNA=SeqID_84382; Strand=+; Position=1-118
MDSLEAEKRRLQGRLDELEGGGTAATVATTTTTVADGGG

SEQ ID NO: 157960 - protein, 92 aa, Heterodera glycines
  Coding regions on vcDNA: vcDNA=SeqID_84383; Strand=+; Position=1 -3,886-1161
MEKTYILKTWAVFKVAEPFNYGSVELELRAQEGSTVTIVTKTDYVINGITKEMYFDFLGSKLALNETNFMPSKIENLRKGGEIHCKITQKIQ

SEQ ID NO: 157961 - protein, 214 aa, Heterodera glycines
  Coding regions on vcDNA: vcDNA=SeqID_84384; Strand=-; Position=1 -478,555-719
MPTFPPNLLKIHGSLQQKLSAKRTAAHLTTSPLSTIPTKRQQFLDGTAHLDITALLTCTEVSEPVRAVILQLDALLKLAVDMVHETSTQDTRAVLEEDRREHSVVLMGVPESDSGLSSTRRAIADQQQVLDILDVCEMRQCRPRFTGWAKERKEAPTSQTVSVRPSLSPEQLKERHNLINCCKTARAQFPNLNFIVYAGHVIHRNDVSVFRDDP

SEQ ID NO: 157962 - protein, 18 aa, Heterodera glycines
  Coding regions on vcDNA: vcDNA=SeqID_84385; Strand=+; Position=1-78
RKSLKITFLRLQNMKFIN

SEQ ID NO: 157963 - protein, 209 aa, Heterodera glycines
  Coding regions on vcDNA: vcDNA=SeqID_84386; Strand=-; Position=1-627
PRAITPSNLSASDFGAASNSAGVVSYFSSPSVFPSSHRPYSSNWAPNSNCISSTTFGNNDSTISTIESAWSTRRVQTFNAFVGGGAGGDSSDEEPMVARARRQVMDSMEPIGDGGSGGGRNVGTDLPWHGRQWQQQQRRISASAEVDQHANNNNNNNFKQFEHRWYNKDNQHSNGNNTFKQFEQRWYNNEKEEEHSRGRSLRSSHHYST

SEQ ID NO: 157964 - protein, 91 aa, Heterodera glycines
  Coding regions on vcDNA: vcDNA=SeqID_84387; Strand=-; Position=1 -26,84-221,278-439
APPAENALRHIAVIHPPAEKRKAQDRSQFALLRHAFPPLRPPPLHSHIPHKNPQSVYQRDENSQHFYDYWSAAPPPNVCCVKNNSLHFCGQ

SEQ ID NO: 157965 - protein, 228 aa, Heterodera glycines
  Coding regions on vcDNA: vcDNA=SeqID_84388; Strand=-; Position=1 -333,560-912
EFPSPTKLFIAQKMECLGRSKAKSLCDQNESEAPQPKIKRKHLKKRSWMTLFRTDNSIGEGRWEMAANGVEEKRNRTTPTTTMSPRMSSFSANNGRTAKYGLGPRRPYARATPLLSLTARAPSHFSSPFSSTIRHQQQRKSVAPGRNRNSISNDDEWVRKTERFITRTSGFVDNSSSSTAFSRANRLDTAIDAEQRSSMRLERTAGAFDGSWRRTLAPAEHSKTQPQQ

SEQ ID NO: 157966 - protein, 227 aa, Heterodera glycines
  Coding regions on vcDNA: vcDNA=SeqID_84389; Strand=+; Position=1 -212,353-499,722-1046
MYEHLLSVHSSGGRGIKIDEYQTTEKEKKGQQQTTIMRNHQQTPPMSASAPATPPTPNNARAFHCEECNFKGRTLVALEQHKVQKHSQRARTGTFPNITPKMSGLTAHFEPMIPQQNGGRPLNGLSLLSGVLSAASLPDSPLSPSSVGGGLFPPAFPSSLLFGTVPSPFFAQSAIVADQQQQLIAQLIAAQQKLASALLGSPPAAQQNATQTATMAEVGDSNQQKMF

SEQ ID NO: 157967 - protein, 21 aa, Heterodera glycines
  Coding regions on vcDNA: vcDNA=SeqID_84390; Strand=+; Position=1 -37,75-103
MKGQKRSGLKRGNLKRLNNLV

SEQ ID NO: 157968 - protein, 146 aa, Heterodera glycines
  Coding regions on vcDNA: vcDNA=SeqID_84391; Strand=-; Position=1 -72,124-235,354-369,465-705
MQIDQRTRLEKVSQFDKEQKQKRKALLNLRQNYWDANVCHENLQIIGNKSLIVHYKRNFSAVKNRKDWVISIGFVLKKQKELKGRMGNGAFAYVSNGEIWINAEGKGKNTEYSYGVGDTVGIGVTSATRQIIITKNGLRFGWKRNI

SEQ ID NO: 157969 - protein, 108 aa, Heterodera glycines
  Coding regions on vcDNA: vcDNA=SeqID_84392; Strand=-; Position=1 -95,324-432,986-1110
VNGNAINLGNDGQLFDGKNSEQSITDQQQLKKEQKLKYQELMGEQKALKEKVAKIEQEKEKNGKKRNTSVEEGFSQLQNDQKKFWQLFWKKSVNWKSSKKNSQKARTN

SEQ ID NO: 157970 - protein, 171 aa, Heterodera glycines
  Coding regions on vcDNA: vcDNA=SeqID_84393; Strand=+; Position=1 -135,306-484,541-742
MATSVVSLFLDLFRWLALGFGILFNAILIQMVVRHTPKPMRIYSKCNFITEKGEFAAILYGLVTIKGVEKGIWNLLAFVCFVFLVYVSMFGYVSQFIFRYFLIVRGKTISALNYFLLFFLMLLFPFAYCVHLFNCYFPPAEHGLMEDNYVAEILGINLDEQIPLAAFPLMY

SEQ ID NO: 157971 - protein, 180 aa, Heterodera glycines
  Coding regions on vcDNA: vcDNA=SeqID_84394; Strand=-; Position=1-541
MVLVSEFCAQFLSCPTKSLRDRLNHPEDRVRVLQQLIGKKVQTTYKDRNGMCKCFFVGGMTERGAAFEPAYGRLRKPFNINVAAHFYARHRVKLHYPYVPCIIEGFTRGEDRYYPRELLEIVDDKKGGRLFGRLFTEIEEREEEDTKSEASHSSNSSYLQFNGKGCKWYESIDEIANTGR

SEQ ID NO: 157972 - protein, 65 aa, Heterodera glycines
  Coding regions on vcDNA: vcDNA=SeqID_84395; Strand=-; Position=1 -78,134-177,234-308
NVVLRRAHIVRSSTSWQFTWASEVAPRPRLQLELAIVQRLRRSTNRASANLTWLSLAPHSVPSWR

SEQ ID NO: 157973 - protein, 107 aa, Heterodera glycines
  Coding regions on vcDNA: vcDNA=SeqID_84396; Strand=-; Position=1 -7,821-1137
MSVFIFFNVFVIESGKIRQNFDEIFGDGWDKNEKEELMIKIEQNERNENSQSAAVDQMGEEMGNGPNDQMGNYTDQNLFKGDLNINDHKKREIIKKFEAIKEKLKEK

SEQ ID NO: 157974 - protein, 51 aa, Heterodera glycines
  Coding regions on vcDNA: vcDNA=SeqID_84397; Strand=+; Position=1 -32,117-240
MLFSCLSVRIKTKWKKQLTDSLRQLCQDQMYGSVANGGNGLGQIGMDEDGN

SEQ ID NO: 157975 - protein, 110 aa, Heterodera glycines
  Coding regions on vcDNA: vcDNA=SeqID_84398; Strand=+; Position=1 -253,703-782
MRLSVLLAYLFLLLPGPGGAQFGQLPIGGGALPGGATLRSNPLINGKNGAANIAPPGDEQMCQQPLQQFALLPPSQTSARREERSKTATSASTADYPSAFAAPTAPAAAG

SEQ ID NO: 157976 - protein, 485 aa, Heterodera glycines
  Coding regions on vcDNA: vcDNA=SeqID_84399; Strand=-; Position=1 -226,711-794,1151-1885,1947-2077,2128-2409
MTTTSSSITVTAQKLNDERQRGMAQRQQQQQQQRGAERSSGGEAQDQTQNAKFSSNEPMEVAGIGNGSENNGTDRRVGPSIETSTISAKNSPGRNDTDLPKYWTFTRLPFINRTELANSAPPSVPIVPSSSSNNNNNNNNRPREEESWSAVDLELKPPHLGQADFFTPNEANQSKKQNNGSLAERQQLILDITKCQREGQSADDKVPTEKEAEQSTVALVAPQLVDTVYTEVPEAILPAAVDLSSSGNKAEMLQLATGNGTVTAAPVQTEFKKAANTVIERQELPTAAANTEIEQQQNAINFDAPTECNKTLEGMGNEKQNMVGDEKLQQRDEHPKNKTDKFVKTKNGEDTCCNLLRLLKSNSDNVTTEFAASIDGIGGGEPPELLPVTELRDQQQKPEKNALNGINDNKLDDSIRQTVADGEHEAEVANEESGTVKANWKVIEEGGQREKAAQCQGKANLKFKFSIHNNGNNYNNNTERGTGNS

SEQ ID NO: 157977 - protein, 88 aa, Heterodera glycines
  Coding regions on vcDNA: vcDNA=SeqID_84400; Strand=-; Position=1 -116,190-340
  Homolog annotation: Hit_ID=NP_497455.1; Match level="QueryCoverage =54%, HitCoverage=51%, E-value=1e-10, Identity=63%"; Hit description =putative secreted or extracellular protein precursor (3C853) [Caenorhabditis elegans] gb|AAF60614.2| Caen
MLANHRQLFLHFLFAIAIFVFVIAPLMADSEHEIHADQQSAINPREKRWGGGWGGGWGRPWGWGGGWGRPWGWGGGWRRPWGGWGWGR

SEQ ID NO: 157978 - protein, 19 aa, Heterodera glycines
  Coding regions on vcDNA: vcDNA=SeqID_84401; Strand=-; Position=1 -6,184-237
MGSAVGIGFKIASKWPLPS

SEQ ID NO: 157979 - protein, 86 aa, Heterodera glycines
  Coding regions on vcDNA: vcDNA=SeqID_84402; Strand=-; Position=1 -109,175-326
MSEAYGFLDRLTKRITRRRGTTPAASGFGADSSMDGGGVSKVCIGLCLCILILVILFAILLLVVALTPESFQGVAVLGGLASIFGN

SEQ ID NO: 157980 - protein, 19 aa, Heterodera glycines
  Coding regions on vcDNA: vcDNA=SeqID_84403; Strand=-; Position=1 -36,226-249
MYVMFLENCHFKLYAYINE

SEQ ID NO: 157981 - protein, 15 aa, Heterodera glycines
  Coding regions on vcDNA: vcDNA=SeqID_84404; Strand=+; Position=1-45
MFDYDRDLNIAQQLA

SEQ ID NO: 157982 - protein, 446 aa, Heterodera glycines
  Coding regions on vcDNA: vcDNA=SeqID_84405; Strand=+; Position=1 -94,184-227,280-346,397-521,775-992,1129-1185,1271-1441,1562 -1617,1662-1722,1776-2041
  Homolog annotation: Hit_ID=XP_318820.1; Match level="QueryCoverage =95%, HitCoverage=44%, E-value=4e-66, Identity=37%"; Hit description =ENSANGP00000010112 [Anopheles gambiae]
YARDSMQSGVHLSASSSSGSSTETTRHENVFFLKKLPPLKKLPPNVESAALLVANVSALDRPLSAFVANVSALDRPLSAFVRLKYPTVYPELPDHPIPVRFIYVPELPDHPIPVRFIYVLLNPMDNYPNETINIGRAMGALLSDEIFQSVAFHCLERHTLSDAVDEFLSQIVLIPPGNCSLETRWKPADRDAGGAVRKRAKNSKRKIGARLDGTPRRKDARPYRTGRLFGGLMADLRRKRKLPWFPSDFSDFFRGRLSQSLAATILLFFANLSNIITFGAIMERSFHHQIASIENTICGALSGLLFGLFSGQPLNVLSATGPTLIFVLSATGPTLIFEKILFDFCTTNHWEFLPFRFYVTNHWEFLPFRFYVGLWMSFYLIILVATDASALVALITRFTEEAFATLISIVFIIQAFEKLFEISYEAPINSPRGRDQIEKRKNIVEG

SEQ ID NO: 157983 - protein, 55 aa, Heterodera glycines
  Coding regions on vcDNA: vcDNA=SeqID_84406; Strand=-; Position=1 -94,309-382
MKLIESSDIVKFPDNVTFALNNRVVTVKGPRAAPCAEMVWHPQRSGSHSHSVLTH

SEQ ID NO: 157984 - protein, 104 aa, Heterodera glycines
  Coding regions on vcDNA: vcDNA=SeqID_84407; Strand=-; Position=1-316
EKMRTTKQLVNSIPGKGNTRDPSSEFHWDHWPGNLASVALKVKNIDWILEYTSKLNILCQKFRDGGQCCQGGAQEALEGQQNGLQDGFQDGAQRRQHVRWSAGS

SEQ ID NO: 157985 - protein, 140 aa, Heterodera glycines
  Coding regions on vcDNA: vcDNA=SeqID_84408; Strand=+; Position=1 -83,131-165,224-302,348-535,592-743
HFTLKLYFYDFSEKMRTTKQLVNSIPGKGNTRDPSSEFHWDHWPGNLASVALSEVPRWRSMLSRRRSRSARRSAKRSSRRLSRRRSTSPTCSLVRRVIATSANETKTRIPKKIVIFSTLMRDSSSNLETTKGSRRALKTP

SEQ ID NO: 157986 - protein, 223 aa, Heterodera glycines
  Coding regions on vcDNA: vcDNA=SeqID_84409; Strand=+; Position=1-672
DPGISEDLKAKRHDCLYKERRTVKGILENRPQKVVIENHVPGPNVAPYLGLNNQSKPQETEEPRKIIIPRKRLKEQTPDPESDNDTLEELSPEPQTTSILNPPIPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIAREKKPFKPLIWARL

SEQ ID NO: 157987 - protein, 58 aa, Heterodera glycines
  Coding regions on vcDNA: vcDNA=SeqID_84410; Strand=-; Position=1 -63,351-464
MVVKIISRRLLALSTQYFRNAHVDAYQQIFVTVVMLFQLIKYAQIALPIGMEAARYRL

SEQ ID NO: 157988 - protein, 76 aa, Heterodera glycines
  Coding regions on vcDNA: vcDNA=SeqID_84411; Strand=+; Position=1 -102,519-647
MYLYKFVQVNCKSEIISVYQLHTSATLYTVYFEGLIFLQMYLYKFAQVNCKSEIISVYQLHTSATLYTVYFEGVMS

SEQ ID NO: 157989 - protein, 223 aa, Heterodera glycines
  Coding regions on vcDNA: vcDNA=SeqID_84412; Strand=+; Position=1 -259,311-440,494-576,631-759
  Homolog annotation: Hit_ID=AAN08587.1; Match level="QueryCoverage =98%, HitCoverage=43%, E-value=2e-50, Identity=46%"; Hit description =putative esophageal gland cell secretory protein 21 [Meloidogyne incognita]
VIINQLWRHGDRSPTGTFRTDIYQEDFWPQGWGQLSPRGMSQQVTLGKKLRNRYVEQLGQISGSYDSHELYVRATDVNRTLISAISNFIGFYGKGNGRDNFIGFYGKGNGRDYPNSDWPAGFVPIAIHTVDGNKDFISPSGSLCPRYAELSLCPRYAELSDLIGNTTEYQNTYHQYSSLLKSLLKFLNDEAEKKGDIVDIWLFQDTFFVEVNKFEMALNWEKV

SEQ ID NO: 157990 - protein, 92 aa, Heterodera glycines
  Coding regions on vcDNA: vcDNA=SeqID_84413; Strand=-; Position=1-279
MVKANENRTNGGKKRIASMALSLLEKALRREDEFGDGTKSEIKREMLSKECDEVNIFYVHGIKEEKKYATEKRFSEEANQSEERMKKRGLLV

SEQ ID NO: 157991 - protein, 343 aa, Heterodera glycines
  Coding regions on vcDNA: vcDNA=SeqID_84414; Strand=-; Position=1-1032
MPKKFQRGNPTIQARRLLRRKDVMARWLNEDTMQIFACAEFSMQNVEYQAVNNCYRYIPVQIRIDKKTLNAFLDPELHILTASSPFADCGNFRYHYLQLSQSNWIKIDTRTATIQKIDSSSISEIHEASGDKSLLEITPLVFHRWTIDNETGEGLFAHLDEWLRLDQWKSKEKEHKTARALTLGALPSGVIGLTEEWFMDKLRLLVSYWTTACCIYVTFIFGRDVLIPLVWVYLMGPVIVTIRNLVTGNQWTQRNRATRGTRRAPAISRIEAIELVPPSMPQEMRANETSSSHQEDPEPSPLVMELKRQMVAFRSKRRFQSRGNVAAERQPRMSVERTNEDDG

SEQ ID NO: 157992 - protein, 107 aa, Heterodera glycines
  Coding regions on vcDNA: vcDNA=SeqID_84415; Strand=+; Position=1 -217,506-612
MFSFRMIPRLLDLIDNKKSYSPKTRAGAETAAPKRYRPQRNKLYRKTFVGTEKENIKIVHSYNSEKKQNKRESQARAVKRSRNQRVHQSETMMKSRIFMELNWIGRC

SEQ ID NO: 157993 - protein, 33 aa, Heterodera glycines; identical to SEQ ID NO: 136023
  Coding regions on vcDNA: vcDNA=SeqID_84416; Strand=-; Position=1-121

SEQ ID NO: 157994 - protein, 113 aa, Heterodera glycines
  Coding regions on vcDNA: vcDNA=SeqID_84417; Strand=+; Position=1 -146,492-687
MYVDMGYRTNPARTDTKVPSSPYSLPRQEKAADTRTKRDQQQLKPNRERITEEEVRMFGMDVTDQMDSGDPTESDQEGKAENLLPKTGVENHPNLAVNNCAIPSMAFDECSLL

SEQ ID NO: 157995 - protein, 93 aa, Heterodera glycines
  Coding regions on vcDNA: vcDNA=SeqID_84418; Strand=-; Position=1-282
MPTEPFELVNERTKEKLTLKQEIEALSNEIIYNWLLQRCPIGETATAPVKWKNRENSGANFNYIRFALRHANYSDANLNNIRFDLWGANDPIG

SEQ ID NO: 157996 - protein, 194 aa, Heterodera glycines
  Coding regions on vcDNA: vcDNA=SeqID_84419; Strand=-; Position=1 -11,98-671
MNRRWLCSDVWMDILPSFDRPQLGLKMALLSDRFDVLVDKHFDRKSELTIWRSVVIRKDKGPKANNIGPKPKVSILIGGYGKFVGFPLPDHPLPNKISFKNLQIQSSLTFVYAKAFFSCFRYIDYSVIKFLRSKKRFFDRNGTKLKVFVHSIDTDVQPIWDVFIREIWPIFATNIRHLGFDDGDALDKTSKRCV

SEQ ID NO: 157997 - protein, 76 aa, Heterodera glycines
  Coding regions on vcDNA: vcDNA=SeqID_84420; Strand=-; Position=1 -143,191-278
MPIEPFELVNERTKEKLTLKQETEESSIEIIYNWLLKRCPIGETAPVRFDPRYGNNACANLNNIRFELWGGNSCIG

SEQ ID NO: 157998 - protein, 92 aa, Heterodera glycines
  Coding regions on vcDNA: vcDNA=SeqID_84421; Strand=-; Position=1 -143,192-275,327-378
MPIEPFELVNERTKEKLTLKQETEESSNEIIYNWLLKRCPIGETAPVKFDPWHDNYSGANLNNIRFELWGGNSCIGPLSLPAEEEADESIEK

SEQ ID NO: 157999 - protein, 133 aa, Heterodera glycines
  Coding regions on vcDNA: vcDNA=SeqID_84422; Strand=-; Position=1 -99,467-769
MGMHRIPLLISIPSNISTNGSPNGSKLAHWIPQKTDFLTEQIDLNLFLLIRCIVILSLKYFNALKRFALYGRATLNLQIPNSKMNFNSVGGTNRPMEAPEGILNGKSIPTGNHQFHIFFIGIDLYLSNHFMTE

SEQ ID NO: 158000 - protein, 381 aa, Heterodera glycines
  Coding regions on vcDNA: vcDNA=SeqID_84423; Strand=-; Position=1 -174,354-485,563-640,789-1032,1209-1339,1463-1563,1620-1748,1834-1987
  Homolog annotation: Hit_ID=CAE69786.1; Match level="QueryCoverage =60%, HitCoverage=17%, E-value=9e-12, Identity=23%"; Hit description =Hypothetical protein CBG16074 [Caenorhabditis briggsae]
MPVAQNGGIFGTPPLAHEVQAVQQQHQHHQRQQSSSEAESIVHQRKQSMADHEEQWKEIDELLHSLQHDSQLIAHADQQNQNPSLLMKNSSKNSISSFNSSSSPNSCAGANGVTACAYQPIVRWLRIQVGLSREHRHHQQQQQQQLNNNGCSAQALAELLHRHGFDTVRFMKGSLNTALMDEIGVPRRVQLQICRFLNDNTVPEHIRSAEQFEFVSDWLDSLDLLDHLGSFALANLTSTTDVIAAKLSRGDLEKMNVTQLGHIARIMRSLDLAVQQRKKLHKSRTNSNSSGSSSPNVSVNGSSREACSAMQFMSSLNQNGQQNLRQNIFGVSPQSPIMNIAELRVRLKEDSARFSAHYLGSTEISNVEGTEDCRRAMQSAK

SEQ ID NO: 158001 - protein, 147 aa, Heterodera glycines
  Coding regions on vcDNA: vcDNA=SeqID_84424; Strand=+; Position=1 -22,398-624,736-819,879-989
  Homolog annotation: Hit_ID=ZP_00195689.2; Match level="QueryCoverage =85%, HitCoverage=36%, E-value=5e-17, Identity=41%"; Hit description =COG1926: Predicted phosphoribosyltransferases [Mesorhizobium sp. BNC1]
MDYWFLVPMFLGARSTLFIDRKDAGQKLAKALAHILPQRDNIVRMRALLQFSFRYTFMCTKNPEMLEFNLSNATKDIGICINQVVLALPRGGVPVACEVADAFQAPLDLLMVRKIGAPGHEEYGIGAVVEGNPPELVMVGRRNCCLM

SEQ ID NO: 158002 - protein, 59 aa, Heterodera glycines
  Coding regions on vcDNA: vcDNA=SeqID_84425; Strand=-; Position=1 -70,116-225
MIFGPFPANIAKRAKLAMGSFSADEKSDNNQTQFEIVYVCRRSPSEVANPRSLTVELFS

SEQ ID NO: 158003 - protein, 186 aa, Heterodera glycines
  Coding regions on vcDNA: vcDNA=SeqID_84426; Strand=+; Position=1 -105,784-887,1555-1908
HKIASVSKQLDEKGTKLKEALEQNASLKDRIGTLEDISELRQKCDELWGERTELQSQIDDFQSDKALIVQPIRTEWNGPKVVQHQKKMKTKKKVFHGFSMCENCSQNFLPNQCKVPKICGPIGNMPLPTLASVCAKFNDGATTNPLLADNVGTIEIDGDGTAGANVDAVRPSMSKSEKRALRRSSN

SEQ ID NO: 158004 - protein, 19 aa, Heterodera glycines
  Coding regions on vcDNA: vcDNA=SeqID_84427; Strand=-; Position=1 -55,392-396
MSHFTNMKIELLACILING

SEQ ID NO: 158005 - protein, 30 aa, Heterodera glycines
  Coding regions on vcDNA: vcDNA=SeqID_84428; Strand=-; Position=1-152
LAHSGPIVHHESSNFFVAHFYRLINEYEMK

SEQ ID NO: 158006 - protein, 157 aa, Heterodera glycines
  Coding regions on vcDNA: vcDNA=SeqID_84429; Strand=+; Position=1 -3,344-538,591-794,859-927
MAPPDEVKETPQGDNSEEVPTEAIVVDVVDTPKEADSENGKKESETAEKDQPSSQNSLGNDQKNEKTSPAQGGLPKWMVQNANAPPSPSPEVDGHKEQQQSSASPQKVRGRGRGRRPAAEKTAAPNDKRVQSPTDDKTSQRPRRSTRTRKSTQIPML

SEQ ID NO: 158007 - protein, 26 aa, Heterodera glycines
  Coding regions on vcDNA: vcDNA=SeqID_84430; Strand=+; Position=1-103
FEAYAFFFLRASFDILSIKNTFSTWF

SEQ ID NO: 158008 - protein, 59 aa, Heterodera glycines
  Coding regions on vcDNA: vcDNA=SeqID_84431; Strand=+; Position=1 -78,417-518
MALQQRLTIFIKIRSIGQRHYEKIALARKLREEQVKLEMLEAIRREQLGTDDPDPNCII

SEQ ID NO: 158009 - protein, 55 aa, Heterodera glycines
  Coding regions on vcDNA: vcDNA=SeqID_84432; Strand=-; Position=1 -49,313-431
MSFTVTVYAIRVYYRKDTGSNVEKVNLRIPYLLFFMCHGILFFNLLRKGYIIGDW

SEQ ID NO: 158010 - protein, 47 aa, Heterodera glycines
  Coding regions on vcDNA: vcDNA=SeqID_84433; Strand=-; Position=1 -87,217-273
MIPRLMGFGRQIKKLLWKNLLAPNRARPNLLISKDLLGIQGRMGALL

SEQ ID NO: 158011 - protein, 82 aa, Heterodera glycines
  Coding regions on vcDNA: vcDNA=SeqID_84434; Strand=-; Position=1 -25,502-613,1031-1142
MQKLIAKNTCACTNDHIPFIQKAYALFCSIFYFSNFLAKFCLFSLRQFSKSELGFVLEWQGRPGNWALSLENLKISLNSRCP

SEQ ID NO: 158012 - protein, 192 aa, Heterodera glycines
  Coding regions on vcDNA: vcDNA=SeqID_84435; Strand=+; Position=1 -192,580-762,1010-1213
  Homolog annotation: Hit_ID=AAC48326.1; Match level="QueryCoverage =99%, HitCoverage=55%, E-value=5e-96, Identity=91%"; Hit description =beta-1,4-endoglucanase-2 precursor [Heterodera glycines]
MFVQLVLLAIVGITFVDAAAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVIRWEMKIANILPLKVISAIRAIDKRM

SEQ ID NO: 158013 - protein, 70 aa, Heterodera glycines
  Coding regions on vcDNA: vcDNA=SeqID_84436; Strand=+; Position=1 -168,514-558
MKDFWLGQVKTGQNHRFRAGLTFQENRFPGPVSQKPIKHAKPDFSKKKPRFKFPGQVMKTSLKIHKKHSF

SEQ ID NO: 158014 - protein, 66 aa, Heterodera glycines
  misc_feature (62)..(62): Xaa can be any naturally occurring amino acid
  Coding regions on vcDNA: vcDNA=SeqID_84437; Strand=+; Position=1-199
MLCDLSALKKQFNRNFDKHSHANFIYIYFSQSSHFPFSSVSVDHPDFRLYLAFHTCELLFVXYYCT

SEQ ID NO: 158015 - protein, 205 aa, Heterodera glycines
  Coding regions on vcDNA: vcDNA=SeqID_84438; Strand=-; Position=1 -192,581-763,998-1117,1172-1294
  Homolog annotation: Hit_ID=AAC48326.1; Match level="QueryCoverage =100%, HitCoverage=64%, E-value=1e-117, Identity=100%"; Hit description=beta-1,4-endoglucanase-2 precursor [Heterodera glycines]
MFVQLVLLAIVGITFVDAAAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPIKGFSNLM

SEQ ID NO: 158016 - protein, 81 aa, Heterodera glycines
  Coding regions on vcDNA: vcDNA=SeqID_84439; Strand=+; Position=1 -97,379-527
MIISRSSKKLMRFSVQYFTFQIFWLNFVCSAYDFEVGRRKCEGRAKLGLALEAEGEAQFFSKHEVRSPKNPKFSKLEARSF

SEQ ID NO: 158017 - protein, 168 aa, Heterodera glycines
  Coding regions on vcDNA: vcDNA=SeqID_84440; Strand=+; Position=1 -61,107-136,184-240,307-366,419-463,611-864
  Homolog annotation: Hit_ID=AAP30775.1; Match level="QueryCoverage =100%, HitCoverage=100%, E-value=1e-77, Identity=82%"; Hit description=putative gland protein G32E03 [Heterodera glycines]
MRAILFLAMVCLVMAVILETANSKAVKNKKGAITTPAKGKAAPKGAAKGGIKKDAKSKGKGKKDAKGKKDKKAKPAKGKEVSKNAKPMAAVKAVPKAAENAQKGPSSAEVVAEENNLDTEAIDDLGAEESDFDQLAEDELLEDDAMDGEADEWEGMGEETEMDSQMAL

SEQ ID NO: 158018 - protein, 29 aa, Heterodera glycines
  Coding regions on vcDNA: vcDNA=SeqID_84441; Strand=+; Position=1-88
MLIKKGSNTKLIRSLLHGDLISPFWLGTR

SEQ ID NO: 158019 - protein, 150 aa, Heterodera glycines
  Coding regions on vcDNA: vcDNA=SeqID_84442; Strand=-; Position=1 -137,275-347,442-588,641-736
  Homolog annotation: Hit_ID=NP_502317.1; Match level="QueryCoverage =88%, HitCoverage=25%, E-value=1e-18, Identity=36%"; Hit description =proline HYdroxylase (61.5 kD) (phy-2) [Caenorhabditis elegans] emb|CAA93469.1| Hypothetical protein F35G2
MKEIFYFLLILLNIFHCAKFDVFTAMVDLENLLASEAARTPELLEHLAEEYARGLSEQKQQKQALLTKDKEEASVSNPVSAYLLIKRMARDWKSIKSLMNANQGELFIKNITDERMENAIKYPDSEDLEGAAQGLLRLQAIENSQLNFLI

SEQ ID NO: 158020 - protein, 22 aa, Heterodera glycines
  Coding regions on vcDNA: vcDNA=SeqID_84443; Strand=+; Position=1 -11,507-564
MRSSSTFNSILRIHLNELSYLF

SEQ ID NO: 158021 - protein, 344 aa, Heterodera glycines
  Coding regions on vcDNA: vcDNA=SeqID_84444; Strand=+; Position=1-1034
  Homolog annotation: Hit_ID=XP_472505.1; Match level="QueryCoverage =93%, HitCoverage=19%, E-value=4e-63, Identity=37%"; Hit description =OSJNBb0049I21.6 [Oryza sativa (japonica cultivar-group)] emb|CAD39728.2| OSJNBb0049I21.6 [Oryza sativa (j
KSQYGLGNCVAGEHDIITTTEEPIASKPHRIPFKYRDELQKHIDQLLASGVMVESDTPWVSNIVLVQKKDGGLRPCIDFRKLNEVTVPDHFPLPRLESILEIVGKCRYYTSLDLASGYLQIKLSERASRKCGVITENKIYQMINLPFGLKNATSAFARIMAHVLTGLENVIAYVDEILIFTKSENFDEHLDCLRKVFERFRRFNLKLSPKKCTFASADMEFLGYVVSEKGYTPSLSKVETILSLKNPSTVKEVRQVVGMASFFRKHIPAFSTIVEPLTRLTRKEKSWVWADEQQKAFDQIKKILSEKPVLIFPDYSKPFHIFCDASSVGQGGALMQWDEENKIY

SEQ ID NO: 158022 - protein, 356 aa, Heterodera glycines
  Coding regions on vcDNA: vcDNA=SeqID_84445; Strand=+; Position=1 -570,901-984,1167-1432,1667-1816
  Homolog annotation: Hit_ID=NP_032534.1; Match level="QueryCoverage =87%, HitCoverage=96%, E-value=1e-21, Identity=31%"; Hit description =loricrin [Mus musculus] pir||A35628 loricrin - mouse gb|AAA82152.1| loricrin gb|AAA39444.1| loricrin
RSHNDMLRRASSDRDRAVAHNRGRNSRSRSPIRRSSTRSDKHNISGSSTATWQSKGGSSSASSRYVGGGKQRDGGSGGTGRSNSRTRAGMSSSSSNHHQSSSYDQQQKQQFGSGGGTAALNPFSQPQPFAGGSSVGALSYGKQQQYSIGSGGGGGSSRMTSATSTVSAAGGGGGGYERHGQMQGGFSRFIGGGARDEMYGVSSGGGGAFGDSGYATSSAQFASSRGQSSGGGGGGQPSSSYYNSQSSAWANPANSRATEMVNSRAFGTSAGGTSASGNGGWSRQTDDILSGNSCLSLADFFMNLKSEWNMYGSPSKMTGASSSSGGRYHQQQSMSYGGAGGRSGGSLYSGGGGGGR

SEQ ID NO: 158023 - protein, 319 aa, Heterodera glycines
  Coding regions on vcDNA: vcDNA=SeqID_84446; Strand=-; Position=1 -189,257-478,530-667,726-905,1056-1286
  Homolog annotation: Hit_ID=CAE59709.1; Match level="QueryCoverage =62%, HitCoverage=20%, E-value=1e-39, Identity=44%"; Hit description =Hypothetical protein CBG03141 [Caenorhabditis briggsae]
MCVATGYTLAQKRAFLMKAISIKTPGMATMMKLTYKAKLMWTNGCRCAIIAALSLEHLLKEQRTLQLPEDEENTLNGSSLANSSTSTSFVSTIHSLLVFLEQSNNNNCYRLINCLETMRPKHLIMYSSDLASTRAIEVFKAVNKDHQMTVHSFVCALSSEEERFLSSIQRETDAIEMLIREQGVLMVPREFDVSRDSVSQLRRLTMNRTDSRKRTATSSTQRIVDEEFEEQLRPLVIFISFQAVIVDMREFNSELPITLYRRGIDLHAATLEVGDYVLAPQICVERKSLDDLAQSLLNGRLFKQIEQVKQKKWQINEKQ

SEQ ID NO: 158024 - protein, 205 aa, Heterodera glycines
  Coding regions on vcDNA: vcDNA=SeqID_84447; Strand=-; Position=1 -135,510-594,652-773,881-984,1028-1148
  Homolog annotation: Hit_ID=CAE60268.1; Match level="QueryCoverage =92%, HitCoverage=35%, E-value=7e-54, Identity=53%"; Hit description =Hypothetical protein CBG03845 [Caenorhabditis briggsae]
PFGHGHLHPYHHRFLRMLNLRFYEAYLTFLYMGIKLLFLSNVCMQMFLMNWFLQTSNYRYYGLGVLQDLFDGRPWSDSGNFPRVTWSDSGNFPRVTYCDMDIRILGNVQKHTVQCVLVINIFIEKIFVLLWIWYSLLVVVTIFSFINWLMSSLPFEARKRFIARRLFIARRLELADVEFRQKDFEGELDEVSFSIIFSVFLQSQL

SEQ ID NO: 158025 - protein, 277 aa, Heterodera glycines
  Coding regions on vcDNA: vcDNA=SeqID_84448; Strand=-; Position=1 -152,210-358,497-940,989-1078
PRPLSTTPIRPHVRTRPTTTDQTTGTDFRATVQSTQTVLETADGATQTETEQGPIQRLCTELNKAKRRIGTLERQLQKKTEEVKLLKTRPTEQNGHRIKRALQYPKSTKLCARPSPGQFHLAQKTARKMDQKGPNKETRTNQSTPGHPSHTDVGIQLATKAAASTISQINAHPFMAISRQRYFFSHFPLFKKLWETHPAKFDTNNAAGFTPKLHWLLAHGPDFAKRWGWFAWISEQGIEHLHHVLNKQSERFMRYKGNELLLKIGEHQTLLNSIFDR

SEQ ID NO: 158026 - protein, 69 aa, Heterodera glycines
  Coding regions on vcDNA: vcDNA=SeqID_84449; Strand=+; Position=1 -120,578-667
MDIGEMTPPPLVIDDRSERIEQLEMELKDRDDTIQFLREQRLEEQKEDDNFSEHSDGENDEDSVIDVIG

SEQ ID NO: 158027 - protein, 32 aa, Heterodera glycines
  Coding regions on vcDNA: vcDNA=SeqID_84450; Strand=+; Position=1-114
SGGIEPGTPFLVANSQTTKTKNQLVFELGTQN

SEQ ID NO: 158028 - protein, 144 aa, Heterodera glycines
  Coding regions on vcDNA: vcDNA=SeqID_84451; Strand=-; Position=1 -73,114-349,813-938
MANFAAAAASTQQSATAAEQFAGGDADPPPVASPSSSLPSHNQSNSRKFITSQMANDDKPPNSANFRPFHSFESERTNSIGEGEITEKDKRSGGEAQNKQQQQQPMVKNEGEKREEEENGRERRKRKRDKEEEEETKKKTNIEG

SEQ ID NO: 158029 - protein, 112 aa, Heterodera glycines
  Coding regions on vcDNA: vcDNA=SeqID_84452; Strand=-; Position=1-339
MAKPPLFALFPPHAALLGPVSSAIYSSNSLPNCAQIPEDQLQQIKNVNEKKMTAFLEKNERRGGDGKETANSSNKSAMDGDETAPLRGEGAMSKLEAMPTQEGGDTEERERG

SEQ ID NO: 158030 - protein, 33 aa, Heterodera glycines
  Coding regions on vcDNA: vcDNA=SeqID_84453; Strand=+; Position=1 -91,374-384
MHLARHLNILEFADVLFYSNIFVIFNLQINGFI

SEQ ID NO: 158031 - protein, 46 aa, Heterodera glycines
  Coding regions on vcDNA: vcDNA=SeqID_84454; Strand=+; Position=1 -103,365-402
MILLLKPLIVQPMFGIIRFLFVPLASIGVCLKRRGCFVLMNIFNFR

SEQ ID NO: 158032 - protein, 53 aa, Heterodera glycines
  Coding regions on vcDNA: vcDNA=SeqID_84455; Strand=+; Position=1 -113,493-541
MTKWFATVRKRAMFAREFVKIWAPNVPTDKGRVIVGERFIQNTFKMIKFCIFD

SEQ ID NO: 158033 - protein, 135 aa, Heterodera glycines
  Coding regions on vcDNA: vcDNA=SeqID_84456; Strand=+; Position=1 -128,170-446
MSEGIEAAQPSPAHEQIQQQSVDRQSEDNEHQPSDVSQAPQQLFDARLPFPPHQMRPGFHPRFPPFPPNGMGGPPMRPPFRPPPNFSQQPGGTQPDNFPPFFNSPAHRSDLFFFILTVSSISTGFLNLSSPVYLK

SEQ ID NO: 158034 - protein, 51 aa, Heterodera glycines
  Coding regions on vcDNA: vcDNA=SeqID_84457; Strand=+; Position=1-153
MEQNEPQQQQGQEQGQGQQQGQQQGQEPQGQGQEPQGQQQGQRPEMRKTPS

SEQ ID NO: 158035 - protein, 75 aa, Heterodera glycines
  Coding regions on vcDNA: vcDNA=SeqID_84458; Strand=+; Position=1 -70,126-283
MHNDIHLGNGGGNHWRQNAPGHGVPFGGAVANNGGQGGYGQNIVPGLNGGQGGYGQNIVPAQGDLLKTIQFIIFI

SEQ ID NO: 158036 - protein, 97 aa, Heterodera glycines
  misc_feature (7)..(7): Xaa can be any naturally occurring amino acid
  Coding regions on vcDNA: vcDNA=SeqID_84459; Strand=-; Position=1-570
IPPLTQXSNFFFFCFTTCRCLSPSAASSASRKESFIIMCCIVKRKYYMSMYVCIMIVFCKPSLIVISRSLPFPSLISPLFSPSVLLLLLVPVCWLHS

SEQ ID NO: 158037 - protein, 114 aa, Heterodera glycines
  Coding regions on vcDNA: vcDNA=SeqID_84460; Strand=-; Position=1 -39,124-239,1065-1176,2332-2409
MSLSHSEGHFALFLTSNKSASVRSPLLGPRMLSLNFYLVYFPIPYDLPCFCFSSSTVWHDREATAQVALLIAGQSTAFRIEQSPEATDWRKEAFKASFQFTSYDFVGQTVKTGV

SEQ ID NO: 158038 - protein, 387 aa, Heterodera glycines
  Coding regions on vcDNA: vcDNA=SeqID_84461; Strand=-; Position=1 -192,424-549,804-905,1314-1421,1468-1734,1839-1856,1908-1967,2245-2535
  Homolog annotation: Hit_ID=AAH69058.1; Match level="QueryCoverage =66%, HitCoverage=21%, E-value=1e-09, Identity=24%"; Hit description =Proline-, glutamic acid-, leucine-rich protein 1 [Homo sapiens]
NAQQPPTVYTVRIDGRDYVTSGQHATHFSFRGSNLYINRKYYENHPPPMKRIGSRATDLENEENANRLKQQQSLNKASSSKNTEEAGTCSDDETYFSLSESEDEETGDGYYIFVPDEPAQGNVSEMPPTHPTTSTSLANMEISSDEEPENEAPDSEDEEYIPSIQPIMPPAFPTHSDDGYHIFVPNEPAQSNFLKMPSMRSMPSFLSLPSLPSLSSLPSLPSLPSLPTMPSMPTMTSMPRMPLTMPSMPRMPEMLPTTSTFPMHNSEDEEVEKSSDEETDNESSDSEDEDAKVYFKQIKREVDEYAKELPPQMKQAKLDAEKHMKELKSHLEDAKNTVTGYMKGLKMEMSKSKIHKIMPTPETPGLPPLSSPPALPSIQQLTSVSTT

SEQ ID NO: 158039 - protein, 63 aa, Heterodera glycines
  Coding regions on vcDNA: vcDNA=SeqID_84462; Strand=+; Position=1 -98,500-593
MPAALSAGSMGYILHLPSLGLHFQALHPMIFPLSLFARDVDVVGCVGGISETLPCAGSSGTKI

SEQ ID NO: 158040 - protein, 138 aa, Heterodera glycines
  Coding regions on vcDNA: vcDNA=SeqID_84463; Strand=-; Position=1 -61,110-301,565-728
MHTFLFSALVWIVLVCFLHNGNAQQPPTVYTVRIDGRDYVTSGQHATHFSFRGSNLYINGKYYENHPTPMKRIVSTATDLENKESENRLKEQQSLNKASSSKNTEAAGVCSDDESYFSLSSESEDEESLAINFTKISK

SEQ ID NO: 158041 - protein, 101 aa, Heterodera glycines
  Coding regions on vcDNA: vcDNA=SeqID_84464; Strand=+; Position=1 -120,457-640
  Homolog annotation: Hit_ID=NP_908404.1; Match level="QueryCoverage =76%, HitCoverage=4%, E-value=3e-12, Identity=46%"; Hit description =putative co-repressor protein [Oryza sativa (japonica cultivar -group)]
MPIDEGNDDQTKPAVDVEKSVGRKRKKNFEDAINFVNKIKQRFIDHEDVFKNFLNVWNNYRRGNLKNKNPNEVFWQVATLFHGHDDLVKEFEDFLPEQTIR

SEQ ID NO: 158042 - protein, 17 aa, Heterodera glycines
  Coding regions on vcDNA: vcDNA=SeqID_84465; Strand=-; Position=1 -11,461-503
MPILKFLNTSSWSMNRC

SEQ ID NO: 158043 - protein, 260 aa, Heterodera glycines
  Coding regions on vcDNA: vcDNA=SeqID_84466; Strand=+; Position=1 -172,386-582,641-724,987-1316
MSVFFLTIDRICIIRFGHNYGYQIKRVLKLSFLSALSVGILFNFIGMLSAMPVPTKTECEIFGCILGTAVQLYLGWRAFCAILNTISGIWFFVVFYRSNRKMASTAKMLNNAGQLQIRRANRANNLLTSVAIVSELFLSFLPHFLPFIWERIFGAGSSLGTGPLSELMSSIEALLFSSIYSHMFSARDATSMHGTGGTLQQQQQPYHMEMNYSRQNMERRRSDRVVPMAPGQHQPVQILVRQVTPVENINNRPGTSMARY

SEQ ID NO: 158044 - protein, 48 aa, Heterodera glycines
  Coding regions on vcDNA: vcDNA=SeqID_84467; Strand=+; Position=1 -56,102-192
MKPKQFLKSSIYPHLNDFRKLADNLDPTHKFRNKFINENIFESEQIDD

SEQ ID NO: 158045 - protein, 119 aa, Heterodera glycines
  Coding regions on vcDNA: vcDNA=SeqID_84468; Strand=+; Position=1 -249,371-483
AAETEEGEYDVKNLMNKFLNIDLTPKERASKLDELEALRVEAKNLTKKVTTEPPRGGGLEKKTFFENFARFTVRAGQPGLSGEDRHRARQEYEQEMATAAAQGGEKEEIQVWPIQNDPS

SEQ ID NO: 158046 - protein, 56 aa, Heterodera glycines
  Coding regions on vcDNA: vcDNA=SeqID_84469; Strand=-; Position=1 -121,1064-1110
  Homolog annotation: Hit_ID=AAB96842.1; Match level="QueryCoverage =100%, HitCoverage=5%, E-value=2e-23, Identity=94%"; Hit description =vinculin [Brugia malayi] sp|Q17162|VINC_BRUMA Vinculin
GTEEDEEAMEQLVLNAQNLMQSVKDTVRAAEAASIKIRTNSGLRLRWIRKPMWSNY

SEQ ID NO: 158047 - protein, 51 aa, Heterodera glycines
  Coding regions on vcDNA: vcDNA=SeqID_84470; Strand=-; Position=1 -4,278-429
MGLANVKGFFLFFFCNHFNNTDKKQLLLASVCDCLDDETTREIIKEMFIKK

SEQ ID NO: 158048 - protein, 75 aa, Heterodera glycines
  Coding regions on vcDNA: vcDNA=SeqID_84471; Strand=+; Position=1 -39,326-514
MGINPQICEPCFNDNFQEDPHANITWHKAAPKFDDEMVFGDKEKKRRKRKIASPSKVSGAEQASEWKSGEEKGII

SEQ ID NO: 158049 - protein, 129 aa, Heterodera glycines
  Coding regions on vcDNA: vcDNA=SeqID_84472; Strand=+; Position=1 -228,487-648
DEDYDPSAQMADKIASLGLDDVIRQQQPKGEKVPTQATNNSRKEGTAKEGATELSEREKREAQMRADGTAAMDLFGLAVERKEPTFDDLRTKDDFQAFADKLGEQIGARNDHANYSLFVSALVDHMTKP

SEQ ID NO: 158050 - protein, 238 aa, Heterodera glycines
  Coding regions on vcDNA: vcDNA=SeqID_84473; Strand=-; Position=1 -187,770-1025,1640-1910
  Homolog annotation: Hit_ID=CAE59855.1; Match level="QueryCoverage =50%, HitCoverage=10%, E-value=1e-19, Identity=42%"; Hit description =Hypothetical protein CBG03329 [Caenorhabditis briggsae]
LVAAALDSLREIYFKRNISAEQQRDAALLSLVAHPKQMLYAAQTGTIACEYLSLDTMDQWIIFGLTVCHRLLVDPAHSANLGPLYQRAVQHCLVVHLFRDECIVVQPLVHTVLEHIKQQQQHNHQSQQQHQQQYGMVKQLVGELKDGQCAHAARGWPPACPSTALFADGTARAVPADWRPARAAWAQVSIRLDGLGLRPGRGAVAVAAQRTVASADASRILQQKGDGQERVGHHCGGQ

SEQ ID NO: 158051 - protein, 151 aa, Heterodera glycines
  Coding regions on vcDNA: vcDNA=SeqID_84474; Strand=+; Position=1 -331,384-508
  Homolog annotation: Hit_ID=CAC21848.1; Match level="QueryCoverage =94%, HitCoverage=48%, E-value=2e-09, Identity=32%"; Hit description =hypothetical protein [Globodera rostochiensis]
MPLDGAIGQHLNSYGYRSDGSFGCNGISRPYKMGFGTMPMPFNAAIGQQRDRRYVGSANWPFPLEFVPVPMPSDGALAFQSPAFSTGDVVGCGVCLATRQIFLTKNVRRTDDSSFFTTTPINSLFPCVSLWTGDKIEANFGPSFKFNLATL

SEQ ID NO: 158052 - protein, 230 aa, Heterodera glycines
  Coding regions on vcDNA: vcDNA=SeqID_84475; Strand=-; Position=1 -264,541-750,1004-1125,1171-1264
  Homolog annotation: Hit_ID=NP_502142.1; Match level="QueryCoverage =100%, HitCoverage=11%, E-value=3e-62, Identity=59%"; Hit description= kinesin-like protein (klp-12) [Caenorhabditis elegans] emb|CAB05214.1| Hypothetical protein T01G1.1 [Cae
LYNEELIDLLSPDRDSSSIKIMENPTSHEILLMGASSRSVNSQEDILSALAIGAQNRTTAATNMNKQSSRSHAIFTLNIKQTRVVPVDDDSDEKENNTADEGGDDEEESSEKMGTGGTELETLHAKFHFIDLAGSERLSRTGATGDRVKESISINSGLLALGNVISALGGAKGRIGTVHVPYRDSKLTRLLQDSLGGNSRTLMITCVNPNQIDAIETLGSLNYANRIKNK

SEQ ID NO: 158053 - protein, 68 aa, Heterodera glycines
  Coding regions on vcDNA: vcDNA=SeqID_84476; Strand=-; Position=1 -34,90-262
MPIRGYQFLHTELNGNSLSKVILPEENEKSPARLILLDMLRNTCPKGNITTLQRRYFNDSLGNRLVTQ

SEQ ID NO: 158054 - protein, 31 aa, Heterodera glycines
  Coding regions on vcDNA: vcDNA=SeqID_84477; Strand=-; Position=1 -31,257-321
MAIICIQSIGAKGTLTKKLQIDVPFIEVIRV

SEQ ID NO: 158055 - protein, 134 aa, Heterodera glycines
  Coding regions on vcDNA: vcDNA=SeqID_84478; Strand=+; Position=1 -46,109-309,441-598
KLTEQFGKILCEICRELVNDVELLRRLQAEHFDVILAELYDPCPMALFHRIGAKTKLGTLALPLYQMTVRPFGIPTLSSYVTNVITPMNGGHKMNFVERFVNFVNDLCDWLFLSDLVVSYEVSTKIKIKMSIYI

SEQ ID NO: 158056 - protein, 129 aa, Heterodera glycines
  Coding regions on vcDNA: vcDNA=SeqID_84479; Strand=+; Position=1 -143,247-522
IGQFKNDQFLIIHFKFASNKSSRLLHSDTKRVNLCNSVELSKEWKMEPKETVPILAKASHKTGTILASGRDSFDAAIASSRNFITSSKYLSPNSFTNCRAFLDLITSIKFCIKILKWAFSIAPKFAKWT

SEQ ID NO: 158057 - protein, 327 aa, Heterodera glycines
  Coding regions on vcDNA: vcDNA=SeqID_84480; Strand=+; Position=1 -69,112-219,449-808,957-1046,1094-1334
  Homolog annotation: Hit_ID=CAE73665.1; Match level="QueryCoverage =85%, HitCoverage=89%, E-value=7e-65, Identity=45%"; Hit description =Hypothetical protein CBG21174 [Caenorhabditis briggsae]
RNLMREKKRLLKFAEYLGHCSREATDYGKCVATNAERIRKGDCSTESREATDYGKCVATNAERIRKGDCSTEFDRLIACLKKRRKKRLKRAAHILTFYRYNFHFLPPFSVLLDGTFCQAALQSKINLREQMLKYLAQSVEMVVTKCVLNELHQLGKPLHGALVICEQFRIAFCPHKPMRTASECIAHLARRSREEGNSKHIVGTQDDQLMEKLRKVGGVPIMSIRFNTILLEKVKESKKMAEEKPSKELEESKKMAEEKPSKELERVKELKDEAFASGKRRKRKAKGPNPLSCKKKKKRRGKKTETRGKCPGHLDRKRANGKGKATK

SEQ ID NO: 158058 - protein, 46 aa, Heterodera glycines
  Coding regions on vcDNA: vcDNA=SeqID_84481; Strand=+; Position=1 -70,1218-1288
MLGPILMAIRFPLMAQDEFVKSIAETQPSVDNKLDKLKNSRSETQL

SEQ ID NO: 158059 - protein, 124 aa, Heterodera glycines
  Coding regions on vcDNA: vcDNA=SeqID_84482; Strand=-; Position=1 -142,172-404
  Homolog annotation: Hit_ID=XP_522969.1; Match level="QueryCoverage =97%, HitCoverage=76%, E-value=5e-13, Identity=35%"; Hit description =PREDICTED: similar to putative protein family member (XC187) [Pan troglodytes]
MVIKSATTVIRRGTTVIRRGATVIRRGTTVIRRGTTVIRRVTTVIRRVIRRGTTVIRRGTTVIRRGTTVIKRGTTVIRRGTMVIKSATTVIRRGTTVIRRGTSVIRRGTTMIRRGTTVIRRGTT

SEQ ID NO: 158060 - protein, 276 aa, Heterodera glycines
  Coding regions on vcDNA: vcDNA=SeqID_84483; Strand=-; Position=1 -452,497-777,838-936
TSITPSSLFFVQITKFFDKRGTNLDLWIPSSRDMDGQQLVWDIFVREIWPIFSENIRHLGFYDGYHLDNLRRLISPTILTDLNQLTSIYSCGLFPAAFGDDFDVPNSTISAGQALSKWLHSPRKDGQPKRLRCIGYNKQTNFDWINNFKEQFLRANAISSVSYEIHFYVQLSSMPMVPFELVNEWTKEKLTLAKTKGWDNRWIMKRCKIIGETAAVQQQKNDENWDNNLNSVFVWLFRTTNCIGPLSPPPAEEAGQNITKGPSSELTMSDGQNEEK

SEQ ID NO: 158061 - protein, 184 aa, Heterodera glycines
  Coding regions on vcDNA: vcDNA=SeqID_84484; Strand=-; Position=1-555
  Homolog annotation: Hit_ID=NP_494890.1; Match level="QueryCoverage =91%, HitCoverage=36%, E-value=9e-28, Identity=36%"; Hit description =reverse transcriptase like family member (2F187) [Caenorhabditis elegans] gb|AAA83167.1| Hypothetical pro
GRVLKSLPNKNNTSPDGINFRLINSFAPYVTELFRISFDTGKLPTFWKKSIIIPLFKKGDKSCPTNYRPIALTCSLCKIFEKFVVRAITSFLLKHDLISLHQFGFVKGRSTVTQLILTLENWFDGIYNGKNIDCVYIDFRKAFDVIPHSLLYIRFIKLGLKVKPLWISDFLAIRSFLIRVENSF

SEQ ID NO: 158062 - protein, 51 aa, Heterodera glycines
  Coding regions on vcDNA: vcDNA=SeqID_84485; Strand=+; Position=1-156
VVKRIREKFTSLQNDQQFMLKRQRHTDLHAKLNAIKKALEEWNKREENDLY

SEQ ID NO: 158063 - protein, 21 aa, Heterodera glycines
  Coding regions on vcDNA: vcDNA=SeqID_84486; Strand=-; Position=1-64
MQLMRKVELRNQFKGFPTNRS

SEQ ID NO: 158064 - protein, 57 aa, Heterodera glycines
  Coding regions on vcDNA: vcDNA=SeqID_84487; Strand=-; Position=1-171
MPKNCAEFDFVFLCLIKVSSVDGKEDNATVNVCSDGTVTAAADHDGAALGQKQSDIQ

SEQ ID NO: 158065 - protein, 32 aa, Heterodera glycines
  Coding regions on vcDNA: vcDNA=SeqID_84488; Strand=+; Position=1-99
SRTKRRQPKRRRTNFSTITFFFLSSIKHSWYY

SEQ ID NO: 158066 - protein, 38 aa, Heterodera glycines
  Coding regions on vcDNA: vcDNA=SeqID_84489; Strand=-; Position=1-116
MPQFAFFVHFRRLNGFGFAVQKTKIELNCSESMKTFYF

SEQ ID NO: 158067 - protein, 158 aa, Heterodera glycines
  Coding regions on vcDNA: vcDNA=SeqID_84490; Strand=+; Position=1-477
MPQNCQCLSSAHPPMGGGGGSDQQQHKDGQRKINGMTQRCAVKSVGRVCVLRGRNKMPTFVPKVKDDVAHFGYPMEFTLNYDGPPANISEEAETKPNNVWPRMTFTVTAEDSWGRIFVEGVGIVPIFGYLSARKQCQKPSDKRQADKIPTKQNLNLIN

SEQ ID NO: 158068 - protein, 111 aa, Heterodera glycines
  Coding regions on vcDNA: vcDNA=SeqID_84491; Strand=+; Position=1 -129,179-385
  Homolog annotation: Hit_ID=NP_491713.2; Match level="QueryCoverage =97%, HitCoverage=40%, E-value=1e-20, Identity=40%"; Hit description =conserved hypothetical ATP binding protein (1G512) [Caenorhabditis elegans] gb|AAB52461.2| Hypothetical p
MVNLEVAQINVLSKVDLLTDNAPFRLEYFEELPNLTHLTDCLNDHPALIRYKKLNQSLCEMIESYGMVNFVSLDVQNKDRMGFLLRLADNANGFNLANVEDFRKVVMNDFS

SEQ ID NO: 158069 - protein, 154 aa, Heterodera glycines
  Coding regions on vcDNA: vcDNA=SeqID_84492; Strand=+; Position=1 -172,772-1064
MLFGLFLIHNMQLTSEKGEGKRKREGEESDEGQWRDEAKKREKVREKIGENEQFKAEDAPAKREGLKEKNEYFGQSEHNPWRPIGTVPEGEEEEGEEAAGEGTARGGANAAEEAADEETLRQLLLVRAKQWQTKCRKEFRSCRSATTTTPTAPN

SEQ ID NO: 158070 - protein, 96 aa, Heterodera glycines
  Coding regions on vcDNA: vcDNA=SeqID_84493; Strand=-; Position=1 -38,99-202,248-396
MNNLALMYSNCRGLLIAHISALNCAVLRQHRAVKSGGSKPEPYKQMPEPEMDGGPKEKKHEQTDVAAKRMKRGAKGGGSSIGKALVKKEQRLWGLG

SEQ ID NO: 158071 - protein, 50 aa, Heterodera glycines
  Coding regions on vcDNA: vcDNA=SeqID_84494; Strand=-; Position=1-210
LYFINIEHSLCIKFLKSPFVIASLLLLLLLVAIVCRCVRADVTFIVKADH

SEQ ID NO: 158072 - protein, 56 aa, Heterodera glycines
  Coding regions on vcDNA: vcDNA=SeqID_84495; Strand=-; Position=1 -43,203-368
SPQQESSNSVNTQRREHKRRNDQPIAGSLLDGSEHTRNTTAELHGDGDLYVMFSIN

SEQ ID NO: 158073 - protein, 356 aa, Heterodera glycines
  Coding regions on vcDNA: vcDNA=SeqID_84496; Strand=+; Position=1 -155,199-513,562-778,831-1011,1053-1255
  Homolog annotation: Hit_ID=CAA91234.2; Match level="QueryCoverage =82%, HitCoverage=52%, E-value=2e-09, Identity=23%"; Hit description =hypothetical protein [Chelonus inanitus bracovirus]
FRFTHHSGNRWRCTNRSCSAYINITNNGETGASGTLSQKEHNHLPAPQKQQAESRRQKIKESVLAEPCLKPTRLLAKVRRSATDEAFVAMSSNNALTEMMRREKKKLLGNVDVQDPLAFVIPATLREKRGEDIVLYDSRNVRQGEKDVVLIFGSVKTLDILRQCGTWHLDGTFKCAPAMWEQCFVIGASVHQRMCISMWCLLPGKQRRYYEEALNFVRERTSPEVPGKVLCDFEKAEMAAVRAVFPTALIKCCMFHYGQSLYRNFKRLGLVHLYGEKTEYGEAVRNTFRRVLSLPLLPPDIIRRAFSIIVASSPPGMPVFFLYFSRTYIGLTQRQLLDGVNAFGDNPLNFSPIGNH

SEQ ID NO: 158074 - protein, 143 aa, Heterodera glycines
  Coding regions on vcDNA: vcDNA=SeqID_84497; Strand=-; Position=1 -73,149-248,366-407,499-592,1193-1315
  Homolog annotation: Hit_ID=CAE66660.1; Match level="QueryCoverage =62%, HitCoverage=12%, E-value=1e-27, Identity=59%"; Hit description =Hypothetical protein CBG11997 [Caenorhabditis briggsae]
MATVSHSMPTRDKNVLSERAGPNYGLRFQVFVNVSDYLPSTEAAGVRITVHKSMRGVLAPTGFVSSFGIRLKCVNRLPSPYGECVEQGKTDEYIYRDKEYSTEESVSVVKCTAAARSATQPDCVCRQPCRCDQIKQLILIAFN

SEQ ID NO: 158075 - protein, 274 aa, Heterodera glycines
  Coding regions on vcDNA: vcDNA=SeqID_84498; Strand=-; Position=1 -132,178-547,792-851,900-1161
  Homolog annotation: Hit_ID=CAE70572.1; Match level="QueryCoverage =100%, HitCoverage=39%, E-value=7e-28, Identity=30%"; Hit description= Hypothetical protein CBG17226 [Caenorhabditis briggsae]
APMPYLIGIPKETFQTQNKAELGDVVIMDVDEKLLTSPYDDKLPDIFISDSLARAFLQTNALIFGNYVSGLVVGMSDQFEFDHFQLLLIDPHGSYSWDRKLFTEKQRPSLRQFLSSLIGKDGVQYFERFIDEKLSELNENRTTIDEFEREAQSMGVRGQLDKNGAVTVKGNATDVIGALKDQIHSLSVRNKLSVRRKEDAISSVKKRRLSSSVARSRSKYKQKLDPLTIDTSQFNLDKFSPSSKTRSVSPPSIESAHSVGDLIDLSDQNNSTIT

SEQ ID NO: 158076 - protein, 166 aa, Heterodera glycines
  Coding regions on vcDNA: vcDNA=SeqID_84499; Strand=+; Position=1-516
  Homolog annotation: Hit_ID=NP_502765.1; Match level="QueryCoverage =100%, HitCoverage=48%, E-value=2e-39, Identity=45%"; Hit description= predicted CDS, transposase (4P302) [Caenorhabditis elegans] pir||T25365 hypothetical protein T27E7.7 - C
EDPILVPRPNLHQKKRMLCIFWSVHGPLYWELLAPGTILDSNRYINQLRAVVRRQQGQFDGPLLFHHDNAPPHRSHLTTQYISQTLNWNELPHPPYSPDLAPSDYHLFLSLKNFLRGRRFTEDAEVEEAVGQYLTSKSTDFFRRGIRKLPSRWRKVVRVQGNYFVE

SEQ ID NO: 158077 - protein, 172 aa, Heterodera glycines
  Coding regions on vcDNA: vcDNA=SeqID_84500; Strand=+; Position=1 -268,2094-2290,2803-2855
MARPPPAALSGRKAVPISFVFGSSTPREISHHVNECAKKGLKAKLDQGGGDTAKRRGDIIYYMRQAKSTDAKGPAEQANFKWSGVIFVLQRWITAGGGGGRSISTESRNEEDEAASEPDILQDRMIDFMRHKKESTTTPTTATTKMEDGGGSRGRANREKASLSNGTKNVKS

SEQ ID NO: 158078 - protein, 370 aa, Heterodera glycines
  misc_feature (250)..(250): Xaa can be any naturally occurring amino acid
  Coding regions on vcDNA: vcDNA=SeqID_84501; Strand=+; Position=1 -36,508-1596
  Homolog annotation: Hit_ID=NP_508646.1; Match level="QueryCoverage =97%, HitCoverage=18%, E-value=8e-52, Identity=35%"; Hit description =predicted CDS, RNA-directed DNA polymerase  and Integrase, catalytic domain containing protein family mem
QFLDLEAKLHFYVGRFWALESIGITDCPKLNDDEKALKNLMSQFCYPEGRYEVALPWKEEGEYPAENFRLAFSRLSALIRRLKESPQLFSGCNDIIQEYLEKGIIEKAHRAKSPQHFLPHHTVMGKKLRIVFDASSHEKGAQSLNEMLFSGPNLYPDLAGKLIQFRATKYPIWADIEKAFLMVSLKESDREFSKFLWVKNIFAPLSGENLLVFRFRRITFGIVSCPFLLAATLQHHLEAFPSELAEEIRXKSLLYVDNLLLLADSPEEACRKAAEAQKIFAAAKMRLCEFIAADPSSLDEIPENDRLRNEAPTVLGLKWTICEDNLSLTFPVPSPDGLTRRTVLKTVASFFDPLGLCSPCLVGAKLFPKL

SEQ ID NO: 158079 - protein, 510 aa, Heterodera glycines
  Coding regions on vcDNA: vcDNA=SeqID_84502; Strand=-; Position=1-1532
  Homolog annotation: Hit_ID=CAE67471.1; Match level="QueryCoverage =84%, HitCoverage=30%, E-value=3e-14, Identity=23%"; Hit description =Hypothetical protein CBG12974 [Caenorhabditis briggsae]
MAKRCTEAVDVQAHLSSMYMHEVVPAEVDLTRNYARLGGNYVLNTEAPKEAHRMLTMHFSKLASTEKHRVRVPHKQRIGFASMRLLESTQENVSLILNLQRQADARNAEMMQICAQRGMPMHAKMREAGDEQQTVNYELKAKRELGLDMHARATVDIASFGNDARLDADAAEDMHFSVSRELERDTAFAHHAFTVRIPNELSTPLPVLRTRTATEEHAIVIETRHRPEQNQRVELIRWIAHALPAQKYRCREAGDVHQGIYLRYDRPVSLHAVELTRQLARWGGEIRMRTDASGDEQLELVRELESSHERVSHSFCTIKTANKATRQQLRTGQSEGVEQVMHAMLQRQAEAERATPLTVWLKNTISHGPLRSRESTEEQQRVHCQWARREAPQLAELVNWIALFGGHIILHTQATGQAQFSHEIRLQKQREASPAPARRCIRCAREIVPAHSRVKEPLHEQYNVSEQWRRGSASEEVQLMMLCPNLGPPGIQIRTRESQTQTENSYSQHT

SEQ ID NO: 158080 - protein, 261 aa, Heterodera glycines
  Coding regions on vcDNA: vcDNA=SeqID_84503; Strand=+; Position=1-783
MQTKLGYLDEKVMQAMKLAFTQALKSICEYMVETRRWASSALLSNPTNFARSVFNSGKLLAKGIGPNLIRIWPCVELAKADYQFFPLEQDQSQTECYELIPIKFGTSSGTKLAFVDPKTMIVSSESKIAPCSEFRKQLIFINDALYEVDQWTAQVKQVKVDKIGKVGEFAPEIPSFKPHTFHYLALVNLSDILEQVYDANSPKISEITYGLRSTDTIVTKTMSSQWKAVKQELKDAIFGGWISTYQTVIAIMVAIVFADFL

SEQ ID NO: 158081 - protein, 214 aa, Heterodera glycines
  Coding regions on vcDNA: vcDNA=SeqID_84504; Strand=+; Position=1-643
  Homolog annotation: Hit_ID=NP_500013.1; Match level="QueryCoverage =46%, HitCoverage=6%, E-value=3e-19, Identity=49%"; Hit description =predicted CDS, polyprotein family member (4B673) [Caenorhabditis elegans] gb|AAC02594.1| Hypothetical prot
MGAIIYALREFRPFIFMSDIELHTDHNPLALLLKKADNSPHLARWLIELQNYQIKIVHIAGSQNSLADALSRAAEDKPLSEFRKLQELDDIVEFPVCLAISQYDRVVLDPFVNTVTIRHKDGNSYEVNLEKELKNDPEATAYIDFLKIGKFPDCLDEKEKDEFAVATVNFQLDSGILYFKESGCQPRIYVPISLRGLIFESFHSSLLGGGHLNY

SEQ ID NO: 158082 - protein, 69 aa, Heterodera glycines
  Coding regions on vcDNA: vcDNA=SeqID_84505; Strand=+; Position=1-209
  Homolog annotation: Hit_ID=NP_001003617.1; Match level="QueryCoverage= 92%, HitCoverage=21%, E-value=1e-11, Identity=46%"; Hit description =zgc:100962 [Danio rerio] gb|AAH77138.1| Zgc:100962 [Danio rerio] gb|AAH81618.1| Zgc:100962 [Danio reri
MATLRSPFFGEKSNITSLTQKISDAEYPPVPDDSYSQPVTALIQYCLRPKAEERPSAAQVHRMALLMAQ

SEQ ID NO: 158083 - protein, 97 aa, Heterodera glycines
  Coding regions on vcDNA: vcDNA=SeqID_84506; Strand=-; Position=1 -3,197-487
MAIISEVKSVMPFVIGMVIGACLLFILLKVNGGKKKRGEMEENKEEEGREEELAEENNGEEEGGGGMEDNEPWTFFTHNYKIDYLLEFNLIIYKIKL

SEQ ID NO: 158084 - protein, 26 aa, Heterodera glycines
  Coding regions on vcDNA: vcDNA=SeqID_84507; Strand=-; Position=1-78
LLLPLCYCLCHLSNKYLPMRNMISLD

SEQ ID NO: 158085 - protein, 48 aa, Heterodera glycines
  Coding regions on vcDNA: vcDNA=SeqID_84508; Strand=-; Position=1-144
EAFILEACRTPIGSFRSQLASVSAPALASECIKELLKRTKVPAKEVQE

SEQ ID NO: 158086 - protein, 40 aa, Heterodera glycines
  Coding regions on vcDNA: vcDNA=SeqID_84509; Strand=-; Position=1-119
RKDFFFFYYSGGTSFLDNCLEMSVSPPIAFPSPSHCHFSS

SEQ ID NO: 158087 - protein, 183 aa, Heterodera glycines
  Coding regions on vcDNA: vcDNA=SeqID_84510; Strand=-; Position=1 -82,222-349,784-900,957-1046,1343-1477
  Homolog annotation: Hit_ID=NP_644803.1; Match level="QueryCoverage =97%, HitCoverage=29%, E-value=3e-71, Identity=68%"; Hit description =acetyl-CoA synthetase 2 isoform b [Homo sapiens] emb|CAI19727.1| OTTHUMP00000030714 [Homo sapiens] emb|CA
MCYVYMTTKCSFDAHADHDVYWCTADCGWITGHSYVVYGPLLNGLTSVIFEGVPSYPDTSRMWAIVEKYKITKLYTAPTAVRALMAFSDEMVTKHDRSSLQVIGSVGEVPINPSAWKWLYTVVGEERCAIVDTYWQTETGGHVLTPMPGATPTKPGAATLPFFGIVPRILDAEGRHLEVGIYF

SEQ ID NO: 158088 - protein, 144 aa, Heterodera glycines
  Coding regions on vcDNA: vcDNA=SeqID_84511; Strand=-; Position=1 -42,417-593,1047-1151,1651-1759
  Homolog annotation: Hit_ID=NP_497782.1; Match level="QueryCoverage =100%, HitCoverage=21%, E-value=9e-46, Identity=59%"; Hit description= acetyl-CoA synthetase (74.3 kD) (3E955) [Caenorhabditis elegans] emb|CAA91274.1| Hypothetical protein C3
LLAGAHVNGMATYVDMYRHSLDDPKKFWHSVAEQLHFEVFSNNGLEWNFDHRKGEVFVHFMVGSRTNIAYNCLERNIKAGIGDRVAYRWEGNEPGDERTITYQQLLDQVVTFAAVLRARGVRAGDVVSIYLPMVIELPVAMLAC

SEQ ID NO: 158089 - protein, 56 aa, Heterodera glycines
  Coding regions on vcDNA: vcDNA=SeqID_84512; Strand=+; Position=1 -90,176-256
MSKVCADEKSVGIERFLNEHTAERATAAGVIFRMDFSKCRLGSDKIKYLYSAKKIR

SEQ ID NO: 158090 - protein, 72 aa, Heterodera glycines
  Coding regions on vcDNA: vcDNA=SeqID_84513; Strand=+; Position=1 -15,890-973,1398-1517
  Homolog annotation: Hit_ID=NP_001006464.1; Match level="QueryCoverage= 93%, HitCoverage=84%, E-value=8e-21, Identity=70%"; Hit description =similar to chromosome 11 open reading frame 10 [Gallus gallus] ref|NP_055021.1| chromosome 11 open rea
MAEVCVSHALFPHLTTVLLSIGLIFTAWFFVHGVTSTKKTRNLVKELFIGTLASLFLGFGTLFLMLWVGIYV

SEQ ID NO: 158091 - protein, 135 aa, Heterodera glycines
  Coding regions on vcDNA: vcDNA=SeqID_84514; Strand=-; Position=1 -79,1249-1350,1947-2170
  Homolog annotation: Hit_ID=AAP30763.1; Match level="QueryCoverage =80%, HitCoverage=35%, E-value=2e-46, Identity=71%"; Hit description =putative gland protein G8H07 [Heterodera glycines]
MGPVAGTIVSILPVQFPHLLNQPLRAAPTIFLKCADNVEVEVELDRNIFRFSTTLDTMMEDASIEPIYEEIALDVPTGKDAEASAPNAQAGEVAEAAESNAKPKELANNEKRLVFPSWDENFLDKEWPELVDIIL

SEQ ID NO: 158092 - protein, 137 aa, Heterodera glycines
  Coding regions on vcDNA: vcDNA=SeqID_84515; Strand=+; Position=1 -171,367-499,906-1015
MEIEKVSEFAREIDRSERKSESRHLHKWASMENKLKRKMEALTMRNGWAFTLCVNKKLNNHFVSLQAILGWFEASYKRPSWTVIEEAADAETQANGVQLSFDKLAHRNIEDSYTVKQREAIAFDLVGERNSYRDANK

SEQ ID NO: 158093 - protein, 35 aa, Heterodera glycines
  Coding regions on vcDNA: vcDNA=SeqID_84516; Strand=-; Position=1-107
IRVFLSSISLIVYDLSSVFASFTVTSMAKVTLPRF

SEQ ID NO: 158094 - protein, 77 aa, Heterodera glycines
  Coding regions on vcDNA: vcDNA=SeqID_84517; Strand=+; Position=1 -108,432-555
  Homolog annotation: Hit_ID=CAE74692.1; Match level="QueryCoverage =75%, HitCoverage=4%, E-value=2e-17, Identity=72%"; Hit description =Hypothetical protein CBG22506 [Caenorhabditis briggsae]
VRQAGGRDIGGVAAPGAAARPGQILWLLGLTRLQTQMRVVKAFQATVQNSHPSSLSLQAGDRLRQSYRRLRIAKEIE

SEQ ID NO: 158095 - protein, 259 aa, Heterodera glycines
  Coding regions on vcDNA: vcDNA=SeqID_84518; Strand=-; Position=1 -85,224-312,482-571,692-881,929-1050,1181-1384
MKYAFYYSIIFSAFANLHVKAFPPKDKEGTSNGKIVNSLADQMEKVLKKGEYSDVHFLFNDQQNFNVDKTNKYASVAQWSDAHGLGFRIVTAHRAILSSASDVFKAMFRYNEGQIVIPDIEIGAFKTMLTFIYTKHFNGLDANNLLEVLKAADKYNISGLVKECANFCAKVSIKKLPNVFVAFEQALLLNMELFYFYRVVRDRDLILKERTTEYLRPGFDRDREKSRVFPCFASQKFPVFQPGKYLVPFFYGTIPDELK

SEQ ID NO: 158096 - protein, 129 aa, Heterodera glycines
  Coding regions on vcDNA: vcDNA=SeqID_84519; Strand=-; Position=1 -74,184-498
MSFKRVNSFQPAVPMAKKWDFRSIGNNFAEEMENYKLMDYQSTTCEKFGFTKNITEFRVNPDVERPDEAMKDAIDNMIKVALKTTEEKMKRKVRMFGVAITGAGLASPVWVPYRAYPQNNADVIMQEIN

SEQ ID NO: 158097 - protein, 194 aa, Heterodera glycines
  Coding regions on vcDNA: vcDNA=SeqID_84520; Strand=-; Position=1-585
KKAMQMLKRELDINIDDIKLKSRQSPGSYDMFFEQWYTMEQYEIKEGAVIYVCYEYHYKTLVEFDIFIEYNQKKYPVRVKRADTVRDLKTKIGNIQEIGILPNQQQKLICQKADGKVLVDFEKIVAYNIEKNSTIFLTLAEIERQMEKHSLSNKQQEEEKHSLSNKQQEEEKPSSSNFASPQLKKRKGRNYRQK

SEQ ID NO: 158098 - protein, 62 aa, Heterodera glycines
  Coding regions on vcDNA: vcDNA=SeqID_84521; Strand=+; Position=1 -19,174-296,856-902
MTLSEKVKSEENIHKITFFSNAAPIAARGELRLANSISAKLKSIFFLDTRNDFHVITVSATF

SEQ ID NO: 158099 - protein, 24 aa, Heterodera glycines
  Coding regions on vcDNA: vcDNA=SeqID_84522; Strand=+; Position=1-73
MTPDECRSIASEGERSLREGDAVN

SEQ ID NO: 158100 - protein, 55 aa, Heterodera glycines
  Coding regions on vcDNA: vcDNA=SeqID_84523; Strand=+; Position=1 -53,259-373
MPIFTWENMNFRLDTTKRLALALAREMNIPELVDQLDADLENLSHIMAKNKSEFH

SEQ ID NO: 158101 - protein, 162 aa, Heterodera glycines
  Coding regions on vcDNA: vcDNA=SeqID_84524; Strand=+; Position=1 -195,333-625
NEVPMEMPTAMRTLREVRESKGHQLHTFAQQLVQLTQHVHVARKEYDMAQLSTETKPLREIRRDAVCKQLREFLSENEWCAVLMENRAALGERVHTDWHDSVHGGRMSDLLQRPALRVQHAAVLSAAWGTTSGTYYRRARTGSTVTTTTTTAIRLPVTIQHI

SEQ ID NO: 158102 - protein, 415 aa, Heterodera glycines
  Coding regions on vcDNA: vcDNA=SeqID_84525; Strand=+; Position=1-1248
MDTVVHERHSAEESVHYTTGQPVMEQRTLQVDIDRRTSRAKTQVQDVAETARATRRFSVENTKQNVSLSPLQVNNKEWPKRREEKACVTIKNGKGTRPDAAAVCQYLMVPEKSERAMSSRAALASSGSSYVKRLSTASEDEAVGTTSAPAPRVIGIETRIEQQPTPYIRREKTVLRTESWPKLDSRAKVEEWLRGTEEGMPEEMGEEQFGEEQDQLQNHLTVTKAELARPEEALGVSVEKPERREAKEERRMRLERQEMAFQLVQQLLSAGRSEASLSEKQRAMVSEQFKQFGLEEMSTSIVLEQLEEVAGRPEAKVALKAWKSLEEGLRVLAVMEERVGFEATWTTGETESGAEKTVQLARVEAAQKRVEEAQEQLRTFLTVLVGPEQFEEAKLLQKIPWHTSAEYRGPESREE

SEQ ID NO: 158103 - protein, 90 aa, Heterodera glycines
  Coding regions on vcDNA: vcDNA=SeqID_84526; Strand=-; Position=1 -24,346-488,604-706
MDGFEQNQVAVSQVPPQGDEPQPSLTTMGTEQSAMGLYKRGLEMVQQGEVRFRKSRAESCECESEQDFAAKLYGVRLALRQIMDEPQMIQ

SEQ ID NO: 158104 - protein, 380 aa, Heterodera glycines
  Coding regions on vcDNA: vcDNA=SeqID_84527; Strand=+; Position=1 -212,308-514,609-850,902-991,1429-1553,1605-1868
  Homolog annotation: Hit_ID=NP_497276.2; Match level="QueryCoverage =68%, HitCoverage=91%, E-value=2e-37, Identity=40%"; Hit description =RNA-binding protein S1 serine-rich domain like (rnp-4) [Caenorhabditis elegans] gb|AAK21429.2| Rnp (rrm r
MVERRKESPKRRRRSSSSSSSGSSSSTGSSSSGSSSSSSTTASRSPSPKKQRAAARPSARDDRTTRRSPRRTGGRLTHSYSFRLIGRVLPIVSNRKQRKALSALAVHRLPVVVVRRLPAAARVAVRARLVMNARLHHHHQNLSRNITKAHMEEIFALFGALKSCELPMDRVHVHLPRGYGYVEYEKAEDAEKALKHMDGGQIDGLEIQCEMTFPFKGTGGGRGHSPVGINSMGIGIKRERSRSPARRFAAHDAQSDDATNAEIVDRLVERLETGSSIEDRRDALKALRSLARNLRLHVATRGMSAYMDILEKEANLQDLVALTLDILDIVLNDSANGGEQDATTVAENEDEVGDRLAEVFLQKPTFMVSLIKLLECYDFA

SEQ ID NO: 158105 - protein, 23 aa, Heterodera glycines
  Coding regions on vcDNA: vcDNA=SeqID_84528; Strand=-; Position=1-70
MLFLLLIVRLLLLLRNFQLFQFP

SEQ ID NO: 158106 - protein, 216 aa, Heterodera glycines
  Coding regions on vcDNA: vcDNA=SeqID_84529; Strand=+; Position=1 -103,150-361,415-567,1018-1200
  Homolog annotation: Hit_ID=XP_395962.1; Match level="QueryCoverage =95%, HitCoverage=27%, E-value=7e-13, Identity=28%"; Hit description =similar to ENSANGP00000015142 [Apis mellifera]
NFTYERPNALQPLAKGPSDLLLDYQFTKFFKLMEGHLLKFFRPNGELSSSVNTQLEGALVPYKKLIKKQDETIAELTRELKELKVAQKQQKTDNEQQKEHTNCNGVIPTEEFASTTVQADASANGEQLALLRAELAEKNALNERRADAETKLQQLTSQQNVPQGSAVATHSEELTLLKREHEDLLLLLAEQDRKIHDYRRRLASHGEALSDADEEP

SEQ ID NO: 158107 - protein, 33 aa, Heterodera glycines
  Coding regions on vcDNA: vcDNA=SeqID_84530; Strand=+; Position=1 -75,261-287
MGKNESAQSRDKHSLTHFPFTYGAVTKANNFIH

SEQ ID NO: 158108 - protein, 60 aa, Heterodera glycines
  Coding regions on vcDNA: vcDNA=SeqID_84531; Strand=-; Position=1 -98,346-430
MSSLSTIFVVLLVIAICLSLTIAMPAVDNQIESVPLRKKRYGYGGGGFGGGFGGGMGFDG

SEQ ID NO: 158109 - protein, 115 aa, Heterodera glycines
  Coding regions on vcDNA: vcDNA=SeqID_84532; Strand=-; Position=1 -48,127-426
MLDPSMPILIPNKAFGKRVFDFHIKLSFNDVQQREQHEQFLVSVAIRTLTRPFGQAMLHFRTRHCFSEENSDPAMGMRQICLNGRVHSGRNQVDYPLNDSFPVCCSSGFTKIQII

SEQ ID NO: 158110 - protein, 19 aa, Heterodera glycines
  Coding regions on vcDNA: vcDNA=SeqID_84533; Strand=-; Position=1-61
FGREILFFETKLKTYITYI

SEQ ID NO: 158111 - protein, 104 aa, Heterodera glycines
  Coding regions on vcDNA: vcDNA=SeqID_84534; Strand=+; Position=1 -41,130-269,349-482
MRELHLYYLFNLNRCTNNQKPYFNISTFLIPKMLLISTDIFMSLSLVAAFSHSAPVTQGKQNPPTSAGAVSSVAQVATAVLAVTAAGLPDADCARRPIGYAKEA

SEQ ID NO: 158112 - protein, 260 aa, Heterodera glycines
  Coding regions on vcDNA: vcDNA=SeqID_84535; Strand=-; Position=1 -234,708-763,823-1313
EWTLFVEGPMVQTTTSAPNGGGAFSASGGSSGVSSSSSTATAPVARPLATAELNVRVLIGPADCVAQVHLELRPIHEGVLGCSLDLVVYCFPFDNECVSPFSHHLLASTPNSVRGPPPSAAVVEHHHNAEDANVGDDIPIELVPPNDDDEENGGGDGTDGCCGIVAENVAQQQQQIVGDGISIELVPPNDDEENGGEVSDGTGTVAESVAQQQQQIVGDGISIELVPPNDDEENGGEVSDGCCGTVAESVAEQLKHHQEP

SEQ ID NO: 158113 - protein, 57 aa, Heterodera glycines
  Coding regions on vcDNA: vcDNA=SeqID_84536; Strand=-; Position=1 -51,211-333
MPALFTSIFNIFLILLLKSEDGKESLSPTLPPYDKWAAGVCFAMRFTQYFIYTNLET

SEQ ID NO: 158114 - protein, 347 aa, Heterodera glycines
  Coding regions on vcDNA: vcDNA=SeqID_84537; Strand=-; Position=1 -135,183-254,307-465,516-644,691-709,762-850,894-977,1025-1195,1242 -1348,1517-1595
  Homolog annotation: Hit_ID=NP_499188.2; Match level="QueryCoverage =100%, HitCoverage=92%, E-value=1e-126, Identity=64%"; Hit description=NAD-dependent glycerol-3-phosphate dehydrogenase (3K944) [Caenorhabditis elegans] emb|CAA80176.2| Hypot
MTKKQVTIVGSGNWGTAIARIVGKTVQMHNSEFDDSAVKMWVFEEVVEGRKLSEIINEKHENVKYLPGKKLPTNVIAVTDVVEASKNADVLIFIIPHQFLHKVCEQLKGNIKKSAIAISLIKGLATFHEKDIGLRLISNEIATSLGIDTSVLMGANLANEVAEDHFCEATIGTKNPQHGNELKKLFHTDNFRINVVEDAATVELCGALKNIVACGAGFSVGLGYGDNTMAAIIRIGLMDMIKFIELFYPGANLKTFFESCGFADLLTTCIGGRNRRVCEAFVKSNKPLAEVEKELLNGQSAQGPLTAKEVFEVLQAKNLTKEFPFFVAIHKVCSGETPAKNFLDLIR

SEQ ID NO: 158115 - protein, 125 aa, Heterodera glycines
  Coding regions on vcDNA: vcDNA=SeqID_84538; Strand=+; Position=1-376
MLLPSAAMKMRRKCSFNPAWQHQYAFVRRSKKGNGFFYCAYCEKDINVQTMGISAVKSHIDNNKHRQMEQQQIVMSAVIGNAENGAIVAAHQQQQQYQMNNHNCNAVGGVKAEEPPLQQLHQQLF

SEQ ID NO: 158116 - protein, 38 aa, Heterodera glycines
  Coding regions on vcDNA: vcDNA=SeqID_84539; Strand=+; Position=1-115
  Homolog annotation: Hit_ID=AAC69868.1; Match level="QueryCoverage =100%, HitCoverage=10%, E-value=5e-15, Identity=100%"; Hit description=dorsal esophageal gland-specific protein [Heterodera glycines]
EQFLQDERQRVDKLFNNNNNNSKSNNKPLEKAYGGAFA

SEQ ID NO: 158117 - protein, 454 aa, Heterodera glycines
  Coding regions on vcDNA: vcDNA=SeqID_84540; Strand=-; Position=1 -373,522-1160,1405-1754
MAKRSFGALLSPTFCGVPSERTAMLAASATAAATAVPHSLSQQSPFVVVVNSRSDYRHFVELVEQPDDNNNNNRPKLLATSLSSLAEDGICQQQKLANLARSLADAVGNVAATVAERLEYIDDHEPSSTAVEHHQSLAHIANNKNNNNENIATTVSQRWDSSGEPCPARESLPAGEPDNNHLPLMMREMPSCKMDDDDDDDDADDEQSSMGAAAEQLELQLVDSWSMEDDSQCTELAVGDGSVPLRHKDTLERLDGGNNERRLGMFLAERLAHGLERNERAMARASRQRNSLLDALISALILSEEGDDRKGEHQQQDGDEQCQDELQLNNKLRRVCRADQQHNAKKKNGLLMTPTANYINNSNNNNYANEHDDQQHSDHHQQQQHQQQQQQNWCTTTKNGSKKSRSMDLLQQQAHTTTTTTPATTTTWSSTNNTTKQPELLLDAAAAEHWQIGQ

SEQ ID NO: 158118 - protein, 122 aa, Heterodera glycines
  Coding regions on vcDNA: vcDNA=SeqID_84541; Strand=+; Position=1-434
SFPRRYDNYYTIPNILCNTEPSSTAVEHHQSLAHIANNKNNNNENIATTVSQRWDSSGEPCPARESLPAGEPDNNHLPLMMREMPSCKMDDDDDDDDADDEQSSMGAAAEQLELQLVDSWSM

SEQ ID NO: 158119 - protein, 473 aa, Heterodera glycines
  Coding regions on vcDNA: vcDNA=SeqID_84542; Strand=-; Position=1-1419
  Homolog annotation: Hit_ID=CAE57029.1; Match level="QueryCoverage =99%, HitCoverage=49%, E-value=3e-25, Identity=22%"; Hit description =Hypothetical protein CBG24906 [Caenorhabditis briggsae]
MGYAPSKCPKYPTPGARRRRLADQHRCFNCLMQGHNSQQCSSPKRCPKCGEKHHFMICYSEGDAPRGTTPQQTSKGGAVQKKQSSNRRGEPPRPTQNHFSALNEPLRIRENPSEISIFDGKRTNVLTSVVTKKSHAFLMTRRLRVRSSRDPRRMIKAMFLFDPASQTSYMSDPLIEKLKPHKVTSEEMEVYGFGGERNGPIRFHSPVYSVQIQRSDNKWEEILLNRTEQISTPFKMVEWNSDDYTSEEQDVFQALSFSQDEPEILISARHFWKFFQSKKEVLPGLFVIQTTLGPLVNGESDFGPKVPNTGVSMVAIDESNQGQMPAVKEIEYFFNLESLGIKEDPNEDDDQTAMQLFDKSIRRENGGRYSVKWPWKEETPNLPSNYRMAFSRLMSTLNKLRHSPELLQQYNSTINDQLSKGIIEEAREAPGTLEHYIPHQGVLAKGKKLRVVYDASAHTRGTNSLNDCLYRGP

SEQ ID NO: 158120 - protein, 355 aa, Heterodera glycines
  Coding regions on vcDNA: vcDNA=SeqID_84543; Strand=-; Position=1 -200,276-370,576-750,915-1103,1159-1236,1287-1397,1440-1531
  Homolog annotation: Hit_ID=CAE66400.1; Match level="QueryCoverage =95%, HitCoverage=24%, E-value=2e-88, Identity=52%"; Hit description =Hypothetical protein CBG11664 [Caenorhabditis briggsae]
FLPSFPISSTPSSFFFFLLFLLLQIVLFLLAMCLICTMMSGLWEHVTGRQFRVFLPWDEFVVSTKQVGPSKALIIAALQFFSYMILLNTVVPISLYISVEMIRLAHSKFINNDIKMYDDTDTPARARTSTLNEELGQVQYVFSDKTGTLTQNIMAFKKCSINGRSYGDVMTERGEIVPIDEETPALDFSDNHWHEPHFRFYDRTLVEDTRRGVEEVHEFWRLLAICHTVMPERKPGEVHEFWRLLAICHTVMPERKPGKVLEYAQSPDEAALTSAARNFGFAQSPDEAALTSAARNFGFVFKSRTPKSITIEVNGAEEVYEVLHIVYEVLHILDFDVRRRMSVLVRNATRTVLYC

SEQ ID NO: 158121 - protein, 170 aa, Heterodera glycines
  misc_feature (21)..(21): Xaa can be any naturally occurring amino acid
  misc_feature (169)..(169): Xaa can be any naturally occurring amino acid
  Coding regions on vcDNA: vcDNA=SeqID_84544; Strand=+; Position=1 -207,249-481,1611-1645
  Homolog annotation: Hit_ID=NP_507845.1; Match level="QueryCoverage =78%, HitCoverage=17%, E-value=2e-32, Identity=49%"; Hit description =transposase family member (5U321) [Caenorhabditis elegans] emb|CAB81975.1| Hypothetical protein Y116F11B.
TKFLKKVQIFFFFLNKLVIYXVAFQFSFGKRLLIWNTFRFHISDDTNQPFRRLSIKSAVIPGGTTKFIQPPDVCWNAPFKNPPDVCWNAPFKNKIRQIYDEWMVNGEKETTASGNMKAPPMETYLQWIVTAWNSLSKELIAKSFLSCGITEEINGSKDDQKFSQKIHPXE

SEQ ID NO: 158122 - protein, 33 aa, Heterodera glycines
  Coding regions on vcDNA: vcDNA=SeqID_84545; Strand=-; Position=1 -75,285-311
MDKNESAQSRDKHSLTHFPFTYGAVTKANNFIH

SEQ ID NO: 158123 - protein, 21 aa, Heterodera glycines
  Coding regions on vcDNA: vcDNA=SeqID_84546; Strand=+; Position=1-63
SPFWSLNPFAKGFNSIFLRVT

SEQ ID NO: 158124 - protein, 183 aa, Heterodera glycines
  Coding regions on vcDNA: vcDNA=SeqID_84547; Strand=-; Position=1 -49,217-318,527-624,696-998
MSFSSASTDDEFTADHGISENFLKFEQLRRSRRIIEQRERILEMPAQKGNDEIPRKNLPKPEKLVDRMKVLLSTANGADIHFLLFRAHKHILMLASDVFEAIFRIDEKNPTDKGKMKIKNYYFHWIFSLNLAISAELSDPVELPDVEAAAFKVLLSFIYAEDLSELNGDDAIAVLYAGENNFN

SEQ ID NO: 158125 - protein, 27 aa, Heterodera glycines
  Coding regions on vcDNA: vcDNA=SeqID_84548; Strand=-; Position=1 -58,96-121
MAFGMSYQISVRFVKSKELEKLVKCAK

SEQ ID NO: 158126 - protein, 160 aa, Heterodera glycines
  misc_feature (2)..(2): Xaa can be any naturally occurring amino acid
  misc_feature (155)..(155): Xaa can be any naturally occurring amino acid
  Coding regions on vcDNA: vcDNA=SeqID_84549; Strand=+; Position=1 -278,1000-1100,1182-1284
  Homolog annotation: Hit_ID=P31729; Match level="QueryCoverage=93%, HitCoverage=81%, E-value=3e-34, Identity=49%"; Hit description=OV-16 antigen precursor
FXINAIILYFPGRLSVSKAFAANEIVPDVVSKAPEKLVTVEYAVGVCAKLGNELAPKNLTNAPKLSWDADMGKKYTVAMVDPDAPSRDDPNIREWLHWLIVNVSGTDLAKGDKLIDYMGPAPPQGTGLHRYTFLVYAQKEGTVVNGTQKPGNQCXETENA

SEQ ID NO: 158127 - protein, 41 aa, Heterodera glycines
  Coding regions on vcDNA: vcDNA=SeqID_84550; Strand=+; Position=1 -55,122-192
MLIYRFAIPYLSSSICVASIHRLPRQISIVSIRVDPRSRAT

SEQ ID NO: 158128 - protein, 39 aa, Heterodera glycines
  Coding regions on vcDNA: vcDNA=SeqID_84551; Strand=-; Position=1 -41,398-476
MHCLQIRRRNRSKINEQKEVMRSNTEKRKEEKRKEEKRK

SEQ ID NO: 158129 - protein, 101 aa, Heterodera glycines
  Coding regions on vcDNA: vcDNA=SeqID_84552; Strand=-; Position=1 -48,823-964,1111-1175,1237-1287
MSPQTIYAMGENPSDTWASRRRWHCVQCRHAAWAAARIGLATILRTLTSTTRPDCVTPCRCVTDCRLLEEILRFRHDATVGIRGLLRMEGPSECGGCNAQF

SEQ ID NO: 158130 - protein, 106 aa, Heterodera glycines
  Coding regions on vcDNA: vcDNA=SeqID_84553; Strand=-; Position=1-318
  Homolog annotation: Hit_ID=AAQ89162.1; Match level="QueryCoverage =72%, HitCoverage=61%, E-value=5e-10, Identity=42%"; Hit description =VLGN1945 [Homo sapiens]
MIVLFLTIVVPFQQFLYLSNNYCTFSTVVVPLLITFVAHLITFVPLLITVVPLLITFVALLITFVPLLITVVPLLITFVALLITFVPLLITVVPLLITFVALLITF

SEQ ID NO: 158131 - protein, 20 aa, Heterodera glycines
  Coding regions on vcDNA: vcDNA=SeqID_84554; Strand=-; Position=1-61
GSGLGEARLCTRSRSRRRSP

SEQ ID NO: 158132 - protein, 29 aa, Heterodera glycines
  Coding regions on vcDNA: vcDNA=SeqID_84555; Strand=-; Position=1 -35,139-193
MYGFVLKWTELCLLDAASPGPSDQQKKDE

SEQ ID NO: 158133 - protein, 159 aa, Heterodera glycines
  Coding regions on vcDNA: vcDNA=SeqID_84556; Strand=+; Position=1 -264,400-615
MNSNSIRATSALSPTILTDLDQLNSIYSGDLLPDATVDDDFDGPNATISAGQMLSKWLHSPRKDGMPKQLHFFLKEPPNMEWANTLKKQPSTQIVPFELANEQTKEKRTLIKASANVWEDRWVMKRCQYWETAAVQWAAQNLDGFSTVEFHYYVEAGIG

SEQ ID NO: 158134 - protein, 282 aa, Heterodera glycines
  Coding regions on vcDNA: vcDNA=SeqID_84557; Strand=-; Position=1-849
MIDCRLYIPVTAHFPDRAIAAFLDPELRILSLTAQHASCNSYRFHHLQLRSNPNIWLWIVSRTGTARRMPKDYVHELYETTINQTNSNLELHPLIFHAWQLDNESDATRFPHINEFINSEQFKDKLEQHITARTEALGALKGGIEGFTMRWLKGLIDEAITWWIRVACVYSTFLMLRDIVLPCTLAYLLNPIRVTLLSLVGVRPHPTFRPTVSKPLGIEEGMPLREMPRTPKPPARRAEHRSMSPIKLDMIARTARYQQPRTQSHLDLTEDSPFGRPRRKEF

SEQ ID NO: 158135 - protein, 276 aa, Heterodera glycines
  Coding regions on vcDNA: vcDNA=SeqID_84558; Strand=-; Position=1 -462,747-1115
MPKIQSKSAFIRDWIKKVEGEEIYSINGKIIFCQVCEQQVKTTTTCNKQHQQHDNFPQIPCSQYCHLKQHAKHRANLDRFSKKKSKQHQPFLTTNENKQDQFSADFCKALVSANIPFFKLNNAVLSSFLEKYCQRAVPDQSTLRKNYLVQLFSEVVNSFNSDDAVCIKECQLTFNNSVWQDLAYIHSNFGQLATAITKLETQGMTIFDAMDVFTGVHNQMDNVYGEKANEIRKKFADIVDKNHGIEKISQFCQILSEKNTESDVSPNLSLFTNLLL

SEQ ID NO: 158136 - protein, 111 aa, Heterodera glycines
  Coding regions on vcDNA: vcDNA=SeqID_84559; Strand=-; Position=1 -36,749-1048
MILIKCLLYNTWLNLRVIFSCKRSLKCMISNYCLFKRLIQRMDQISTQFQSTLHDVLPNIRSFLQLLSFSHSQSLVLLSRATDRARNAILEWKSAAIANSIIFSKMSKNKR

SEQ ID NO: 158137 - protein, 137 aa, Heterodera glycines
  Coding regions on vcDNA: vcDNA=SeqID_84560; Strand=+; Position=1 -162,830-935,985-1129
  Homolog annotation: Hit_ID=CAE63705.1; Match level="QueryCoverage =59%, HitCoverage=11%, E-value=3e-19, Identity=61%"; Hit description =Hypothetical protein CBG08220 [Caenorhabditis briggsae]
MDRFFPIRLELLSDPADDVLMLDIMLITEICGQPKQQQQLDIRTLRLGEELNQEPALELVPRLSEIEITFDLLTEVDRLVQLIESPILAYVRMDLLHPDHQKSLSALLSALLMLLPQSEAFNVLQKRLQAVPHLAVL

SEQ ID NO: 158138 - protein, 134 aa, Heterodera glycines
  Coding regions on vcDNA: vcDNA=SeqID_84561; Strand=+; Position=1 -20,53-437
MCVKSIILSLGPRRPSLTEGKSQCFRFEIASMVGDINAFPCSDDPSIDGKDEETIGGGTNDISQQRNDCGDGDKRCFELSVMVAEPGFRRRGIALEACKLMIAYILQRIRGKPNFIAKISALGGPQVWHSSEIG

SEQ ID NO: 158139 - protein, 82 aa, Heterodera glycines
  Coding regions on vcDNA: vcDNA=SeqID_84562; Strand=+; Position=1-251
DSQYYILHGSGSAFKSAAHAHASIKAHPCPFRRQLDSSAAVAVAIAIAITLLTKRVKLEIPAPKSAAIGHAQPLGEKWSAKN

SEQ ID NO: 158140 - protein, 57 aa, Heterodera glycines
  Coding regions on vcDNA: vcDNA=SeqID_84563; Strand=-; Position=1-218
SISDDSQYYILHGSGSAFKSAAHAHASIKAHPCPFRRQLDSSAAVAVAIAIAITLLT

SEQ ID NO: 158141 - protein, 45 aa, Heterodera glycines
  Coding regions on vcDNA: vcDNA=SeqID_84564; Strand=-; Position=1-138
SNIYYYFYSIIFLLTIRLLVQLISRISVQIPCPFRCPCPCPFRRP

SEQ ID NO: 158142 - protein, 33 aa, Heterodera glycines
  Coding regions on vcDNA: vcDNA=SeqID_84565; Strand=-; Position=1-101
MSSSSTIFVVLLVIAICCCSLTIAMPAAVNEID

SEQ ID NO: 158143 - protein, 52 aa, Heterodera glycines
  Coding regions on vcDNA: vcDNA=SeqID_84566; Strand=-; Position=1-160
EQLKREKRWGYGGGMGGGFGSGFGGGMGSGFGMGSGMGMGFVGGMPMGGFFD

SEQ ID NO: 158144 - protein, 85 aa, Heterodera glycines
  Coding regions on vcDNA: vcDNA=SeqID_84567; Strand=-; Position=1 -92,360-525
  Homolog annotation: Hit_ID=AAH79755.1; Match level="QueryCoverage =62%, HitCoverage=80%, E-value=3e-13, Identity=67%"; Hit description =Unknown (protein for IMAGE:6951677) [Xenopus laevis]
MTAMKVSIILLILGIVLLSLAVAMPVAEAENMQLIRQKRWGYGGGMGGGFGSGFGGGMGNGFGMGSGMGFGGGMGSGMGMGFGRR

SEQ ID NO: 158145 - protein, 83 aa, Heterodera glycines
  Coding regions on vcDNA: vcDNA=SeqID_84568; Strand=+; Position=1 -92,221-380
  Homolog annotation: Hit_ID=KRXL2B; Match level="QueryCoverage=51%, HitCoverage=13%, E-value=1e-09, Identity=67%"; Hit description =keratin, 64K type II cytoskeletal (clone pUF164) - African clawed frog (fragment) sp|P04265|K2C2_XENLA Keratin
MTAMKVSIILLILGIVLLSLAVAMPVAEAENMQLIRQKRWGYGGGMGGGFGSGFGGGMGSGFGMGSGMGMGFGGGMPMGGFFG

SEQ ID NO: 158146 - protein, 62 aa, Heterodera glycines
  Coding regions on vcDNA: vcDNA=SeqID_84569; Strand=+; Position=1 -148,348-388
MRIMRKAKCEKRNLGPSLMFSYQKLTQLKRAHHFHSLAFDLINSTGDGPEFFQDYASFNICS

SEQ ID NO: 158147 - protein, 56 aa, Heterodera glycines
  Coding regions on vcDNA: vcDNA=SeqID_84570; Strand=+; Position=1 -98,216-288
MSSLSTILVLLLIISICLSLTIAMPAVDNQIESVALRQKRYDYGYGYGYGYGGRRV

SEQ ID NO: 158148 - protein, 115 aa, Heterodera glycines
  Coding regions on vcDNA: vcDNA=SeqID_84571; Strand=+; Position=1 -89,401-659
  Homolog annotation: Hit_ID=XP_239780.2; Match level="QueryCoverage =72%, HitCoverage=12%, E-value=3e-18, Identity=53%"; Hit description =similar to RNA helicase A [Rattus norvegicus]
MNSSMTVSLLLMLIIGTALLALTNGMPNADVSLTREKRGSYGSGSYGGSSYGGGPSGGGDAFGSGGAAGFGSGIGNGFGSGGGSGFGSGGGNGFGTGGGSYGGGSYGGGSYGKRR

SEQ ID NO: 158149 - protein, 296 aa, Heterodera glycines
  Coding regions on vcDNA: vcDNA=SeqID_84572; Strand=+; Position=1 -203,247-409,455-627,970-1200,1242-1364
  Homolog annotation: Hit_ID=AAS21248.1; Match level="QueryCoverage =64%, HitCoverage=31%, E-value=1e-21, Identity=31%"; Hit description =transposase [Anopheles gambiae]
QWSKEGAYTISANRALMEMLATQLLPFNFVDGEGFRCFIEKLQPKYTIPHRKHFALHELPGSFDAIKKFVIAELDSIYKIGLTSDGWTSKDNRHSLISVTGHFLDKKFRPTFYVLSTKPIKGRHTADAISAFIRESLNEFKISEDKISAITRDTENTMKKVSKDLGFESIDCAAHVLQLAITFALRKEGENRFSNIKNTIALAIEKRLNQFENQKYLVISTLLDPRFKAVYLDCNHVDGYKNWLISEIESYHNENYYTDELLVENNASGSSSTDIFSQFEKDAEFDQLINTVKLSF

SEQ ID NO: 158150 - protein, 176 aa, Heterodera glycines
  Coding regions on vcDNA: vcDNA=SeqID_84573; Strand=-; Position=1 -249,580-738,1755-1877
  Homolog annotation: Hit_ID=NP_496564.1; Match level="QueryCoverage =85%, HitCoverage=33%, E-value=3e-22, Identity=37%"; Hit description =putative cytoplasmic protein of eukaryotic origin (2M337) [Caenorhabditis elegans] emb|CAA19460.1| Hypoth
MYDFCPLALYSGVRARMQRALRSLLHQPHHNLRLFVDGNVVHEDGCAFEPHALGAALFPAGASDGGGGHGPSDGANIDTFVSAICCILAGVADDRREKFRLTEGSVLNNLLTAQRIDTVGMVRAFELYKSLPDDVQIRIVDLDPKSAKNLENSYKRLMAGIRLLHANPHIHPPCVA

SEQ ID NO: 158151 - protein, 131 aa, Heterodera glycines
  Coding regions on vcDNA: vcDNA=SeqID_84574; Strand=+; Position=1 -43,102-249,771-975
  Homolog annotation: Hit_ID=NP_504459.1; Match level="QueryCoverage =48%, HitCoverage=14%, E-value=7e-23, Identity=78%"; Hit description =growth factor receptor family member (5G9) [Caenorhabditis elegans] gb|AAC19211.1| Hypothetical protein C
MRAENSLVAVKMLPEYADDLSKSDFLREIGLMKSLGFHERLVNMLACVTQSEPYCLIVEYCCDGASPIRHGMELLLVDSDLTIVDGEVTPTAAEALAVGGNGERKWKKCRRTKCQRMVINGGHLNFNFSHF

SEQ ID NO: 158152 - protein, 153 aa, Heterodera glycines
  Coding regions on vcDNA: vcDNA=SeqID_84575; Strand=+; Position=1 -333,686-812
MSSSNSHNQSLLLSAAAGGGHQLQRPPPPPVSVQSAATHSSVATNATTQQHQQQQHRFLTNHQQQQNVSGTTAAVVKQQQQQAQQQLLNSSSTMGAAELSSILQQTHQQQQLQNAGVPLLGLPAQLLASGIENSNILQPNALRMVPGTQYAIM

SEQ ID NO: 158153 - protein, 37 aa, Heterodera glycines
  Coding regions on vcDNA: vcDNA=SeqID_84576; Strand=+; Position=1-112
MFGINAKILSSKSGADLAEHARALIYHFENGGAPVMI

SEQ ID NO: 158154 - protein, 130 aa, Heterodera glycines
  Coding regions on vcDNA: vcDNA=SeqID_84577; Strand=-; Position=1 -118,253-527
  Homolog annotation: Hit_ID=NP_492381.1; Match level="QueryCoverage =53%, HitCoverage=10%, E-value=9e-20, Identity=59%"; Hit description =fibronectin, type III and ion transport protein family member (1J386) [Caenorhabditis elegans]
MVYWTDNAEARLIEWQKMTVYGRRVIFPELKHDWFYLYCANACFQNGQRSPLSRAIFVKTDKMETNKKCEKDGTEKERIPFPPIHSLPRHWPFAHHRSDGSDWTARGMGGRKNAAAKACQIRLIRRVTAN

SEQ ID NO: 158155 - protein, 38 aa, Heterodera glycines
  Coding regions on vcDNA: vcDNA=SeqID_84578; Strand=+; Position=1-135
ILLNGQPKDKNEYIIYSFENGESGANEINIIIIVHYYF

SEQ ID NO: 158156 - protein, 80 aa, Heterodera glycines
  misc_feature (11)..(11): Xaa can be any naturally occurring amino acid
  Coding regions on vcDNA: vcDNA=SeqID_84579; Strand=-; Position=1-239
DGSAIAVLRFXDRSLGGDALGHLCDGVPPTPFVSPTELGFTVFKHLCLSPDQRALYCLASGPRRASSLIRLDLSTDCHTV

SEQ ID NO: 158157 - protein, 54 aa, Heterodera glycines
  Coding regions on vcDNA: vcDNA=SeqID_84580; Strand=-; Position=1-162
MPDVDGTLLRHADIAAHGDFVYAVQEIHSKKDESAEPTNKLVRVNVRDGHSEVV

SEQ ID NO: 158158 - protein, 24 aa, Heterodera glycines
  Coding regions on vcDNA: vcDNA=SeqID_84581; Strand=-; Position=1-80
RTLSTAVRQRSSKIYSMPQILWAG

SEQ ID NO: 158159 - protein, 24 aa, Heterodera glycines
  Coding regions on vcDNA: vcDNA=SeqID_84582; Strand=-; Position=1-80
RTLSTAVRQRSSKIYSMPQILWAG

SEQ ID NO: 158160 - protein, 235 aa, Heterodera glycines
  Coding regions on vcDNA: vcDNA=SeqID_84583; Strand=+; Position=1 -34,65-450,515-800
MKNTVNNSKFYYYSNNENEELAEMLMTFLKGVALNGFISSDFERTFRINSTICFLKRFIQEMINLESSQNRKISKENTKLINNYWAVMVKKETEDEKREQICKLWQFGAQMYRNLAQIMAQNEIFEKFSFENRIDKIFGELNNSYENDCGTAGQKQQIFNRLCEPDLIFIINGLNLAKLLEINENLRYFFCHEIEMGNAKMFLGNFIEDEAMTRLDDQFPQIMRLGMDFNLKKGI

SEQ ID NO: 158161 - protein, 21 aa, Heterodera glycines
  Coding regions on vcDNA: vcDNA=SeqID_84584; Strand=-; Position=1-65
NFYFFPEIEKILGLSGTFESR

SEQ ID NO: 158162 - protein, 311 aa, Heterodera glycines
  Coding regions on vcDNA: vcDNA=SeqID_84585; Strand=-; Position=1 -522,1154-1567
MAELDKLGQSDGDDGNVGAAEHGAADAIDKRSLLLSEPVEITVTCLTPPTGAGRPRFYPYQHWGYNDQHRIRIKNLGDNYCLFHALVAVRAYHDPALFKEWMSAGRQLQQPQQHNMGQLTLMLDFCENKEAFELMINNRQMMCSAVRRLMNYAGIAEGLAAYGLDHIQIVQDYWVYHGKDTGCYIKKLRIPMEKQRYRMVFWDTETRLEPAEGGQQQIHKVNFLSARVSCTECADSNLGQFDDCEICMNEDGEVERNKYWYLDRFFPKNYTISPKRSEAEEDEPIASFVEWIMRAWNEKFNTYIWVKMDHC

SEQ ID NO: 158163 - protein, 122 aa, Heterodera glycines
  Coding regions on vcDNA: vcDNA=SeqID_84586; Strand=-; Position=1-366
MKRHWDFRSMSCPPAQQSASLLPQQQLEEIQQGEGSATGAEGSSQSDSSDQYFRQIAHSVHKLERFSVSRHITEFVLNARVEEPDEVLRNALEMLMARAIHNSEQQSGRKVVKIGITLQGRG

SEQ ID NO: 158164 - protein, 233 aa, Heterodera glycines
  Coding regions on vcDNA: vcDNA=SeqID_84587; Strand=-; Position=1 -174,225-527,580-804
MSTALDRFKLESGTAGQKRTSEGIPAKTKQLKEVIDFKSPGIFFVEAKIANLQYKIYNACPLKQRGLCCRRKLNDEMYCETCEHTAKSPLKNLFLRIEFKDCAHPECTQYATMFAHSAEKYLQLKAVEIAEMSEREPEKLANALEAKLEKQVVAKLTIKESKGDFENRDFDWIITSIFTDSNNKDHEKAAEATKKTAEKEDGEESEDEDGQEIQLVGEVKPINSEAFKKAKKN

SEQ ID NO: 158165 - protein, 127 aa, Heterodera glycines
  Coding regions on vcDNA: vcDNA=SeqID_84588; Strand=-; Position=1-384
MVVRLKMYIETAQENLGKELADQSVRADLIAERQNLCKTISLLEKYNGKWEAIFLRVKGQALQDEEQNYRDFKPEGKAFMHWGSTKPGGLVDTIEGALGLSELGGCNSPAKSASTSCAAGTSGASAS

SEQ ID NO: 158166 - protein, 130 aa, Heterodera glycines
  Coding regions on vcDNA: vcDNA=SeqID_84589; Strand=+; Position=1 -244,802-950
KQLLIIAKRELSKVTKKLLDDELSLISASIGCSFYVGSNHGVTGTDFLGLTSLEVFNKKLEKVLAERVDYEDPNEIERAVRILVCQVNIGIGFLDIRTETDFVNGPEHIFLHYPSFLYLPFSIYKKFTRL

SEQ ID NO: 158167 - protein, 96 aa, Heterodera glycines
  Coding regions on vcDNA: vcDNA=SeqID_84590; Strand=+; Position=1-455
KTKILITDTVAQHPLPQCTLRFVNGSKQLMSLFGFFFKQFSVIAHQLLGVQQRRYLHPIQLFMGSLNLFLFFFFYLFSEWSYNNFSQQYGIYQHTF

SEQ ID NO: 158168 - protein, 176 aa, Heterodera glycines
  Coding regions on vcDNA: vcDNA=SeqID_84591; Strand=+; Position=1 -157,210-322,370-508,591-712
MVNGTLAKMIHFVPPSNDDKMLPFFQIEKPKYSKFITNRTKLLPYQDDPNKFNRPDPCDEYGADCVPIRNLLLKIEELENCGKNESENDAMFEMPEWAPPLPPPMTMKKPSETLICEGDLFCDKQTLREQYNRLREICGMKPEEVESQREKRQYNPYEKWTESPIKIAFDERARNN

SEQ ID NO: 158169 - protein, 76 aa, Heterodera glycines
  Coding regions on vcDNA: vcDNA=SeqID_84592; Strand=+; Position=1 -125,189-294
  Homolog annotation: Hit_ID=CAE64902.1; Match level="QueryCoverage =76%, HitCoverage=3%, E-value=4e-12, Identity=51%"; Hit description =Hypothetical protein CBG09719 [Caenorhabditis briggsae]
MPLLIYPCLKSVNSPIIIIIIVIITQMCRALILSGSPDSFARYPKWAQTFENELSFEFKTRMPNALLLYTDDGKFK

SEQ ID NO: 158170 - protein, 87 aa, Heterodera glycines
  Coding regions on vcDNA: vcDNA=SeqID_84593; Strand=-; Position=1-264
MPLDCFVGGFPGSFSYTGDGYFWTNASYRGNMLPAFSRDDVIGCGICLTTRRFIFTKNGQRLGWNNCKLNRQITYQLIKPIRLIGII

SEQ ID NO: 158171 - protein, 52 aa, Heterodera glycines; identical to SEQ ID NO: 126512
  Coding regions on vcDNA: vcDNA=SeqID_84594; Strand=-; Position=1 -46,108-220

SEQ ID NO: 158172 - protein, 109 aa, Heterodera glycines
  Coding regions on vcDNA: vcDNA=SeqID_84595; Strand=+; Position=1 -16,106-306,397-509
MRRREALIKCKSAKGSEEGMIEGSEYQCYDDSKCGAIFCSADKNEFRRIFLLTFGKNGGQPKKKKTRRLSRMGNILGNEWSCYIGYYGEQYYIGLRTVEFKLRPRANND

SEQ ID NO: 158173 - protein, 76 aa, Heterodera glycines
  Coding regions on vcDNA: vcDNA=SeqID_84596; Strand=+; Position=1 -13,135-269,762-844
MAGGAMKCKKAKQSEEGMLVKDNEEQISSSNICYSYNGKCGVIFCSAENECECAGIRNSVESALMMMMIGLITSIN

SEQ ID NO: 158174 - protein, 60 aa, Heterodera glycines
  Coding regions on vcDNA: vcDNA=SeqID_84597; Strand=-; Position=1 -66,165-281
MGALCTHKVSFGNPTDTWGPSFNASQLMHYDFRNKYLLSKNAKIVASLELIQQGKTSQRN

SEQ ID NO: 158175 - protein, 340 aa, Heterodera glycines
  Coding regions on vcDNA: vcDNA=SeqID_84598; Strand=-; Position=1 -138,488-914,1065-1201,1246-1563
MNEHSMELSSKSDIWAIGIIAIEMAAIGTEFKGTHDEEPEKDAKEIAVLVYDPERRPTANGILDFLDGKCRFESMQNAPRLLPWLTLDQFKMHLRKRKILLKKESKESDGSSSKELLKKQMEELKTLLRLANAKEWVPGEKQREKPCDTTTNKAMNSQRHNQRKNGGDTTPRATNARSAKTQSARWKDRLANIEKTIGLSLSPRIQYELDKIITEEFLGIFENLQESFYNSNFEIFELMGQNFAALLWSMGYGKLLEQLDKVSERNKSEAEMLKSVVDSVRGQLGTEWEEIYQMAAQYECDEGDKTYTDIIHQISALYLYELMNKQLLDQFSAGSELNDA

SEQ ID NO: 158176 - protein, 177 aa, Heterodera glycines
  Coding regions on vcDNA: vcDNA=SeqID_84599; Strand=+; Position=1 -94,189-394,441-674
MDDEEGKLAPESELDYDELNRGDFYLIGGVHDPISLRFEAAIRDQNAVEHKSAERYYWYKMAECFGDEEAMKNILHAQNVQQAEEAMKNIKGFDVAEWDKVKLKHWEDGQRLKLEQVRWIENLLVLTKTTYLAIASEDKVSPPPSVHFLLSIFAVFRHWMAQESRRGQQTDLLGWEE

SEQ ID NO: 158177 - protein, 196 aa, Heterodera glycines
  Coding regions on vcDNA: vcDNA=SeqID_84600; Strand=-; Position=1 -44,92-288,544-893
MASALGALPPQSLPAGGGNAQHLMANPLDSSAAAATLAAAAMQAMQQQQQHNHNNNSRTETNGEAGGGTSNSNNTTAEAQIRTMKQSQQNDDIFGEALLKGTMAQLQRTCPSGEEMLERKAPTDIERIAGSGENGTGVIRHGFCTKAMKMAPTERTNDGTTESRGMGAMEMFSRMPPTGEMGAIFYLSNSNRITEN

SEQ ID NO: 158178 - protein, 29 aa, Heterodera glycines
  Coding regions on vcDNA: vcDNA=SeqID_84601; Strand=-; Position=1 -78,120-131
MPMPMPLPSFGFIVFSVSTITIIVVYCLL

SEQ ID NO: 158179 - protein, 99 aa, Heterodera glycines
  Coding regions on vcDNA: vcDNA=SeqID_84602; Strand=+; Position=1-300
MNAQFAAVPMLTTVLLVCVLLLFPTICEARPKEDKAKGKTHKTENTDSRPVILESWDCNTNAKTTAPSTSENLQPHHTTNSPVSNQINGLPKSMFMPRK

SEQ ID NO: 158180 - protein, 234 aa, Heterodera glycines
  Coding regions on vcDNA: vcDNA=SeqID_84603; Strand=-; Position=1 -198,240-632,677-791
  Homolog annotation: Hit_ID=NP_507780.1; Match level="QueryCoverage =81%, HitCoverage=13%, E-value=1e-11, Identity=29%"; Hit description =predicted CDS, DNA polymerase type B, organellar and viral family member (5T899) [Caenorhabditis elegans]
KVFDENCLNKNAVIDRASEFYKIACDHKIELCDIVEYSEEAIRLIYRDKEDFVMEHKSSNIIISLWTTSMARLKLLEFMREAESHGGEILYTDTDSIFVRHDRDVEPITTGKYLGEMSEEYGGYEIEEYCCGGAKQYALKMRSKQTGEIEYVMKIRGITFDVDNKKTLHYDTFKEMVLNYGKGEVDPAFFVYKNDFGPTRDSKLVTREKHKMYKPVCQKGIIDEELNVMPFGFC

SEQ ID NO: 158181 - protein, 211 aa, Heterodera glycines
  Coding regions on vcDNA: vcDNA=SeqID_84604; Strand=-; Position=1 -65,124-320,425-502,554-608,667-714,929-1023
  Homolog annotation: Hit_ID=AAF64251.1; Match level="QueryCoverage =96%, HitCoverage=57%, E-value=2e-59, Identity=39%"; Hit description =calcium-binding protein CBP-1 [Onchocerca volvulus]
RHFFSLFNEIDQNKDTYLNSLEFNDIRPLVLAKAFNDIRPLVLAKAENAALRYLQNVDTDHNGQLSLTEAQNYILKEYGISNRDVERIWRLVVPSSGDEMDAVLFSKLRRRIRGMSIRLARQILKGADRDEDGQGADRDEDGQVNLREAQLIAFEQEGIGPGEVFEQEGIGPGEVVEMLASVDDNNDGMLNAPEFADFERIVRARAGKRRK

SEQ ID NO: 158182 - protein, 105 aa, Heterodera glycines
  Coding regions on vcDNA: vcDNA=SeqID_84605; Strand=-; Position=1 -78,516-752
MASGLQMGPTSPVPLWPPNWRPLPSTRQIMVKETNSRSFYWIALVSDQNASSSPPPIDGVPPSEVPPSPPDESASTTDTLPTSPLSAPVDKSVDLDGDGALSLGE

SEQ ID NO: 158183 - protein, 109 aa, Heterodera glycines
  Coding regions on vcDNA: vcDNA=SeqID_84606; Strand=-; Position=1-330
MNSGQANLISTCSVMQKSISHAPREPSIKEEPMGGESAKDDDNGSDKFWSMATKTTSQHGEAPAIPTMTKKRTSIELCEATQIGHREELGQLVSPKPATDRTAPTADFM

SEQ ID NO: 158184 - protein, 215 aa, Heterodera glycines
  misc_feature (1)..(1): Xaa can be any naturally occurring amino acid
  misc_feature (213)..(213): Xaa can be any naturally occurring amino acid
  Coding regions on vcDNA: vcDNA=SeqID_84607; Strand=-; Position=1 -42,164-280,499-631,1089-1393,1779-1828
  Homolog annotation: Hit_ID=NP_497055.1; Match level="QueryCoverage =94%, HitCoverage=53%, E-value=3e-82, Identity=69%"; Hit description =glutaminase family member (2P6) [Caenorhabditis elegans]
XIRAQVNMGDRFEYMINEYKKMAGGEYVGFNNADFLSEAATADRNFALAYFMKENGCFPEESKHTSLKETLDFYFQLCSLEVNCEGAAVIAATLANGGVCPLTGERCIGSRPCRDVLSLMNSCGMYDYSGQFAFHVGLPAKSGVSGVTIVVVPNLMGIALWSPPLDRMGNSCRGVHFCKKLIDRFNFHNYDSLAHNESQLKILPRTLTALLEXST

SEQ ID NO: 158185 - protein, 321 aa, Heterodera glycines
  Coding regions on vcDNA: vcDNA=SeqID_84608; Strand=-; Position=1 -32,488-763,815-1235,1289-1522
  Homolog annotation: Hit_ID=AAL78214.1; Match level="QueryCoverage =42%, HitCoverage=72%, E-value=1e-14, Identity=33%"; Hit description =putative esophageal gland cell protein Hgg-20 [Heterodera glycines]
MKLIISNVSSGFICGDCWLLVFDFLAPSQLGLEIALVNRRFNCIVDEHFKTRKWKLGGMQIYHEIGENGTKQMQIVNSDGNPLPILQNPLSNKVIGFRGISIAYIDQNVIAFLRRFHRFFAICSTDLYITTGNDRILEFILLNIWPMLRHSMHLMMFLNTIAFRRLRQLAPSLLNDCPSLHYVSFGDVILPEFPPDESANASDGQAVTKWLFTPRPDGLPKWLRYSVNSPVNQWSSTMEQFKAAFSNASSPVTFRICFHFPPSPLDSVVPIDRINEVTGEKLYLLQSANDFWLTRCPIGWDGRKWEDMSDAFKARQNPFDI

SEQ ID NO: 158186 - protein, 72 aa, Heterodera glycines
  Coding regions on vcDNA: vcDNA=SeqID_84609; Strand=-; Position=1 -187,328-359
MWSNPPDDDHNHADPTDHCRCFGERLKQCHEHGAGVPKVLIIPRRGARIAHDQHEGERERGKAPGEKKNRNL

SEQ ID NO: 158187 - protein, 117 aa, Heterodera glycines
  Coding regions on vcDNA: vcDNA=SeqID_84610; Strand=+; Position=1 -180,1149-1299,1403-1425
  Homolog annotation: Hit_ID=CAE74250.1; Match level="QueryCoverage =81%, HitCoverage=19%, E-value=6e-23, Identity=62%"; Hit description =Hypothetical protein CBG21936 [Caenorhabditis briggsae]
MIGEVEANDILGRKAWVANFLLILFEIITVILLMNLMVSLAVGDVNELRMNAEERMLRIKVNFCIEALHLSEQISFLNGFVQVLHRSQTNNILVIYKAENIVHSRLMPNIQFMVSET

SEQ ID NO: 158188 - protein, 349 aa, Heterodera glycines
  Coding regions on vcDNA: vcDNA=SeqID_84611; Strand=-; Position=1 -145,423-723,1076-1327,1869-2218
  Homolog annotation: Hit_ID=NP_705510.1; Match level="QueryCoverage =58%, HitCoverage=15%, E-value=4e-14, Identity=24%"; Hit description =hypothetical protein [Plasmodium falciparum 3D7] emb|CAD52747.1| hypothetical protein [Plasmodium falcipa
PFTKRSSSTTAATMLTMMALARRHLPPLLDCVKRVLEFVNKLNSEKVEVLTQLYDWFLSNCSVNTTISSPMVADRLAKAYTLAHGLSSALCHLHHHIGTFVAQLASFHAHWSAVGCHLLTNGFVNPIPIADRQKGGDEADAKRTEAGDEDSNLHAFFFVFLTDPFSNLQQNDGNDQQQQQQMNDEQNNADADQQQQQQQQKMDETDQPIDVDDDFAGCLEALDAGEDDEQGIGDQRQMLDDDDACAKNDDTNADQQQMDQSQVEGADKADWTAAQDEAGDKAKPTAADEHADEEHGDAEGDDQQQNEGDVDNEQQQQEIDEANQQQQQKVDGEDNFAGQLDCRARRREM

SEQ ID NO: 158189 - protein, 146 aa, Heterodera glycines
  Coding regions on vcDNA: vcDNA=SeqID_84612; Strand=+; Position=1 -279,551-712
MAPPKRTNAFKSEYANEFQGITKSKAGDEFAHCIPCNFDISLLSTGKTAIPHHLKTEKHKKAAKAANSAKAITAFMPSKSAPTNLDRQTAAAKEMTGLPFSLSIDSSNHKTTKLFPLVVRYFNPKKGIAVKLIDLEELSGETSAEV

SEQ ID NO: 158190 - protein, 399 aa, Heterodera glycines
  Coding regions on vcDNA: vcDNA=SeqID_84613; Strand=-; Position=1 -245,285-576,617-896,945-1232,1275-1366
  Homolog annotation: Hit_ID=NP_001004509.1; Match level="QueryCoverage= 96%, HitCoverage=26%, E-value=2e-51, Identity=32%"; Hit description =si:busm1-180o5.3 [Danio rerio] emb|CAD60788.1| novel protein similar to DNA polymerases [Danio rerio]
MDFILTKVPNVEIYWQCEIEEMLTKDQQMKQKFNEYTGDGGPINIRACFMGGRTGALKLYHEVKADEEISYYDFTSLYPFINCVTNYPVGHPTLHVPCEEVDWQRPEDNPYPLAILKVFVIPPRKIDIPVLPVKVGDRLCFPLCMSCCKKYPNGGVKEAYSCQHTDKQRGWISTCTSLELNVALEEGYRVNMLLRVLEYDRSDNKLFRPYMSEFMVQKIHASGFDENIHGNFEVEEQFIAECWDQFGIKIDRTKMVPNKGKRALAKLAVNNLWGRFSLRNYGLSQTLITDDPSELGNYLDNRKIEVTGLDMLTPERILISYNQKKDWVQEHPCSNVVISLFTTSAARLHLLKAMQIVARTPGCILLYTDTDSLIYVHPKGRNPLKTGPHLGQFTDEFPK

SEQ ID NO: 158191 - protein, 673 aa, Heterodera glycines
  Coding regions on vcDNA: vcDNA=SeqID_84614; Strand=-; Position=1 -573,618-1105,1146-1341,1439-1918,1960-2243
  Homolog annotation: Hit_ID=NP_507780.1; Match level="QueryCoverage =54%, HitCoverage=27%, E-value=7e-24, Identity=25%"; Hit description =predicted CDS, DNA polymerase type B, organellar and viral family member (5T899) [Caenorhabditis elegans]
MKNSSSSPPSKRSRRFFIEELLREPYNELSPPRKNPKDYIKKLDSEIEHVPKFQWVKNKSRFIIKDVPADPEALLSGIFQHCMDEAIVDSHQSGVEPTHLGCIVSSQLLTSDIWIPIRQLTPDTINTILNRFNDVAQSKKQDGVTLWGEPFTVTVTTVNRNGLPEKRQLKGGAARKLAPVHHRIHPNCLIKIQNFDADNYCLFYSMQAAMVRAVGDLDFRRFHDYINGNNGMRGKLKHDALEMMRAINAPAGQPNYDAEVYVPRIVDWWNGEKFSDQWKVKTFVFGSTGHYKPLFKYGPVDYGVPIILYFEDGHFNGVQKSGNLFGVPYCLSCEKTYDRPKRHMKSCKARCIKCSQMGPKFPCKPTHGFRQKCNGCNKLFFNNICYQHHLSSEYCKMSKECKHCGVVWDLRNNTQNGRERGCFIRPLEPNLKKETQDWRLVVFDLETMQHEPVNCEIPERRKHQVNFVTAKVACPGCISSGQWKNTLRGKKCNICGHHRTITFSQMPFHGTMVDKQVIDRHPLVSFVKWILYNLPKQCDTIAYSHFGGRFDMVLVFRELFMEGLNPSMIKNGNRLLEMKVKCRKSLNPNVIFRDSWNLVPGPLASMVPMFGLDVQDKPFFPHLANRPENYGCQIFPTKANYLADGMNPEKRKEFDRWHSQNHNMPFLLDEALA

SEQ ID NO: 158192 - protein, 377 aa, Heterodera glycines
  Coding regions on vcDNA: vcDNA=SeqID_84615; Strand=-; Position=1-1132
MASKFILVPEEIYHGLTSSDSGNINLGFTKHALERTKRKRENVTAKNIHYNQELSRYLHLRDEHQNHPSKVEIAKGLKALIKKGDESDEDEQIFNLGSERSQPPASQIRRQRRPHHHYHDDEEMPLLPDSPPFQAVNRGQKRKANEYYSSWEEGAKRQLIQQYEPASSSKIAKRQRRKLPPISWRSEEKIPAEVQQEEPFQPAPQPSIPIHSQVNRKRKAQQNLNDVREAKKSLIDSEELRHPPLQQEASLRFKQKTTNKPRVTQPQHSTSSTLATRSNPPRDLLAEAAAAPLPDDDDHDLELLQQPNNSTQNQPLPPEPPLPSKTKKRKSSKNEEETEKKRIRVGSRKRLSSPNVIKNQPKRQKNPFGEALSEEQR

SEQ ID NO: 158193 - protein, 78 aa, Heterodera glycines
  Coding regions on vcDNA: vcDNA=SeqID_84616; Strand=+; Position=1-285
MRAPNSALAIRNIGVQLFPGKLDYFLSAYRIATNKPYGYLVVDMHAASNPLLRLRSGIFKDDEEEGKKIIFIPKNGLL

SEQ ID NO: 158194 - protein, 323 aa, Heterodera glycines
  Coding regions on vcDNA: vcDNA=SeqID_84617; Strand=-; Position=1 -17,341-622,672-1095,1150-1398
  Homolog annotation: Hit_ID=AAL78214.1; Match level="QueryCoverage =46%, HitCoverage=78%, E-value=2e-14, Identity=33%"; Hit description =putative esophageal gland cell protein Hgg-20 [Heterodera glycines]
MSSGLLFICADCWLLVFDFLAPSQLGLEIALISRRFDFYVDEHFKTRKWMLNKKLLITWKIVGNGPKQMQIDDADGNPLPIPQNPLPNKVIGFSKCIQINYIDQNVIEFLHRFHRLFPICSIFLDITTENVRILDYFLLHIWPMFRDSIRFLFLNAFIFRRFRQLAPSMLSDCPSLFGVAVSNNDIVPAFPPDDSAMASDGQAVAKWLLTPHPNGVPKRFKCSVNSMEEEQWTSTMEQFKTAFSNASSPATFRIHFPSSSPLDFVVEFDLINQATGEQLTLEEYEGGFWLERCPIGWDDKKWDVLNETNPIDIWIEDGGYDDG

SEQ ID NO: 158195 - protein, 31 aa, Heterodera glycines
  Coding regions on vcDNA: vcDNA=SeqID_84618; Strand=-; Position=1-93
MPNPFLFVLFTCPLSVIWATRKSATRNTFEK

SEQ ID NO: 158196 - protein, 78 aa, Heterodera glycines
  Coding regions on vcDNA: vcDNA=SeqID_84619; Strand=-; Position=1-300
MDRENERVEVKGKSTNYRSSSSFVHLNVCVSSPNFPPNNAPMTTPRKKRNTRPSVSQMPSAHTQSHCDQKPNFTYRMI

SEQ ID NO: 158197 - protein, 124 aa, Heterodera glycines
  Coding regions on vcDNA: vcDNA=SeqID_84620; Strand=-; Position=1 -61,127-240,292-354,726-861
  Homolog annotation: Hit_ID=NP_496503.1; Match level="QueryCoverage =100%, HitCoverage=55%, E-value=2e-28, Identity=45%"; Hit description= lactate dehydrogenase (36.1 kD) (ldh-1) [Caenorhabditis elegans] emb|CAA88944.1| Hypothetical protein F1
MDLQHGVAFTRQGVVVNASIDGYSGTVGSKVCVITAGCRQREGESRLNLIKRNVEIFKGIVPELVRYSPDTIILVVSNPVAVWSGVNVAGVSLSLLDGQNEATNWEKEVHQKVVDSAYDIIKLK

SEQ ID NO: 158198 - protein, 28 aa, Heterodera glycines
  Coding regions on vcDNA: vcDNA=SeqID_84621; Strand=-; Position=1-101
MFVVTMAYCFDSYCISLRCSLFLVIFPY

SEQ ID NO: 158199 - protein, 217 aa, Heterodera glycines
  misc_feature (184)..(184): Xaa can be any naturally occurring amino acid
  Coding regions on vcDNA: vcDNA=SeqID_84622; Strand=+; Position=1 -106,149-304,355-383,613-918
  Homolog annotation: Hit_ID=CAE58004.1; Match level="QueryCoverage =84%, HitCoverage=36%, E-value=4e-41, Identity=51%"; Hit description =Hypothetical protein CBG01072 [Caenorhabditis briggsae]
SAKFLITLQFVVPMPFITYCYWRILRKVHKDMIVQNVQFSKSLSNSQRQNVQFSKSLSNSQRTDALNRKKRVNYILIGMVIAFIGCNTPITAVNLAKDFKQEPNWLQEPNWLKKQPYLWPLVAHVIAMSTIVFNPFLFFWLTAKDKGQKGNLTGIGTTTSEIITSLMSRMHSLRSTGGNEESRXRKKAGEIVGKESTQIDREREREGEKEGMRNKER

SEQ ID NO: 158200 - protein, 50 aa, Heterodera glycines
  Coding regions on vcDNA: vcDNA=SeqID_84623; Strand=-; Position=1-185
SLMSEWTRTDQTDCETDHFFPNPTKYFFNIFARLLSFLKSFVRFKVKQCC

SEQ ID NO: 158201 - protein, 254 aa, Heterodera glycines
  Coding regions on vcDNA: vcDNA=SeqID_84624; Strand=+; Position=1 -177,227-428,477-862
MDEAIDRKRGILSSPQEDNALISAYLARKSIIEGSFSATLTTKEKKNAWDEVTQAVNAVDARSVRDQEQIKQRYRNKLKQYKNFIAETKMPPTGGGRPTERKPFFDQFMAEDTRIVGIIGENPIELGERPKSSPAIIDSSFCSGSETYSAAAVPPSFTDLTPIRHQSGGVISSKKRKFSTASADYMSAERKEIVEIFPAASSTATARDLQIKVLEKESAKLDLEMEKLKLEIELLKLKKDREMRHHLGYNIEEL

SEQ ID NO: 158202 - protein, 728 aa, Heterodera glycines
  Coding regions on vcDNA: vcDNA=SeqID_84625; Strand=-; Position=1 -127,181-275,328-464,521-707,844-1023,1063-1230,1274-1405,1449 -1598,1644-1745,1796-1924,1969-2075,2121-2277
  Homolog annotation: Hit_ID=CAE61979.1; Match level="QueryCoverage =100%, HitCoverage=60%, E-value=1e-154, Identity=44%"; Hit description=Hypothetical protein CBG05984 [Caenorhabditis briggsae]
MKICLIGKQAFGAEVCRQLISSGHDIVLVCTELDKNGRADLLALEAEKHKKPILKTKSWRRKNLEAEKHKKPILKTKSWRRKNKKTGKFELENELFNEYKKYAAELFNEYKKYAAEVNVVAFCTQFIPQEVMDFPRHKTIIYHPSILPKHRGASAINWGASAINWTLIEGDEEAGLTVFWADEGLDTGPILLQRKCAVEETDTLNTLYKRFLFPEGVKAMVESVNLIAAEKAPKIPQPTEGASYEPFITAKPELAEIVWSKIGTQRQLHNFIRGNDSVPGAWTRLNGEKVTLFGSSLWKRIEPPATGAWTRLNGEKVTLFGSSLWKRIEPPATAREVPAEEVPGGKLWAHPRGILLRTADGKFVNVDTMRIDGRTIKAVNVDTMRIDGRTIKAANYGMVEEIAEEKLEMSKEEKEMVPSLKNIWRGILNFSASDQIDDQNIWRGILNFSASDQIDDQMNFFDAGATSADVTRLVEEVRTVCGVEMRNGEIFMNSQFGDFLIAIFMNSQFGDFLIAIIRKIRGEDLERLEFEKVKQNFNGTKICVPTQMYINGKFCESNNFNGTKICVPTQMYINGKFCESNSARRMQTIDPSNEKSICTVPKGDAGDVDFAVRCAEEAFYHGEWSRKGDAGDVDFAVRCAEEAFYHGEWSRISARERGKILYRLADLMDQHRTELALADLMDQHRTELATIESIDSGAVYTLALKTHVGMSIDVWRYFAGWCDKIHGK

SEQ ID NO: 158203 - protein, 168 aa, Heterodera glycines
  misc_feature (1)..(1): Xaa can be any naturally occurring amino acid
  Coding regions on vcDNA: vcDNA=SeqID_84626; Strand=-; Position=1 -147,209-257,381-422,480-514,572-656,865-921
  Homolog annotation: Hit_ID=CAE60735.1; Match level="QueryCoverage =97%, HitCoverage=18%, E-value=6e-35, Identity=51%"; Hit description =Hypothetical protein CBG04419 [Caenorhabditis briggsae]
XSCNCPSFSPKVPSSCLALFELKRDSARYVAERYMPSILAMIFSWVAPYVPYNYEEVRIITPYVPYNYEEVRIITPITVLLTLVQMEKGNQEVITSVITSYLTSLDIWFVVIKAFTVLSLIFVVIKAFTVLSLIESLAVMAYIKKGRAVESEAQRAPSEYRRDLLQAE

SEQ ID NO: 158204 - protein, 349 aa, Heterodera glycines
  Coding regions on vcDNA: vcDNA=SeqID_84627; Strand=-; Position=1-1050
MEDGETETAEEDYDDDAEDDGWTIIEFDNSEEKRNTTEEKLRKQNDRINGSGRDEDGKWKEWDIGRDEKEERGKEKGRDGEEDARRKIEDDQTDDARKMKQGRDKAKEGGRDEEKGLLANDQRPDVALFKQLIIPWVPHRLRHHHHPLHHSHSSQIQGTHTEQSSNGTIIVTEQNVNKTMPEQNANVSEEVAQRETGSTKTPSTTGGTAKADVKLHLEDILIFGAFVTPSGEETKETAKAETENGNGTIWGQDRDQKDDPMAPLRNDLSNSGQKVLLNGTSLGKPMPATTTTGTSTTWAPINEEELAMNQHVDPLGRDRQQLLAQLIARWAIDWIMKWFGKRRDGLPSD

SEQ ID NO: 158205 - protein, 208 aa, Heterodera glycines
  Coding regions on vcDNA: vcDNA=SeqID_84628; Strand=-; Position=1 -76,141-288,396-573,661-734,799-928,973-993
  Homolog annotation: Hit_ID=NP_505905.2; Match level="QueryCoverage =97%, HitCoverage=34%, E-value=2e-42, Identity=46%"; Hit description =amino acid permease-associated region family member (5L944) [Caenorhabditis elegans] emb|CAA98529.2| Hypo
MLAMIAKVIASGIIIIVGLWLLISKEVQSGSFRQPFANTSDKPGNWVLALFAGLFSYDGWDILNFGAEDVKKPHRSMPFAIIVGMSTVAALYLAMNVSYFVVLSVTEVQSSNAIAMASQCQYIKLKIAYFVAFVTFAERTLGGFLQYAMPFLVCIVLIGSLNATLFQGSRYIWASARERHFPSFISCINRQHDSPRAALFVHNVWGSE

SEQ ID NO: 158206 - protein, 58 aa, Heterodera glycines; identical to SEQ ID NO: 128482
  Coding regions on vcDNA: vcDNA=SeqID_84629; Strand=-; Position=1-282

SEQ ID NO: 158207 - protein, 394 aa, Heterodera glycines
  Coding regions on vcDNA: vcDNA=SeqID_84630; Strand=+; Position=1 -180,301-556,823-1114,1237-1467,1552-1776
MATANNYQPRVSSASSHAPQMFMSGQQQQMPGGGAQIRAVTTTAPGTVNQSQQFVQQQQQMSQQQFHRQQQQQFEQMSVHMAAQQQIKSDNGMVGSYQIGTPTAPSAGDSGAASQNRMTTSTIVVKTESGLTTAMGSTSVRTPAGAIDGPPSADSHPPSVGTANGMATGRPGSVQQQFGTAASQVDTEEPEYKMLLKKLCKYHADVKRLLGRFELDTLPGVEMKIKASLVNVIQVMEGTRKGGPVTKTLLQKLLSNVQTVLERHHISRHLFSIAKKLSTLAPPHNGTSANGGGGTTPTTAPKEEPFETDPWRNVRHMAIKLPDAVLTILEDEKKSTAAEKQQKKADDGGQETADSESGGNEWTGRKRIRQQNEQKEDEKGEGPPTKKSLWKEGR

SEQ ID NO: 158208 - protein, 84 aa, Heterodera glycines
  Coding regions on vcDNA: vcDNA=SeqID_84631; Strand=-; Position=1-470
YIRPSFQRLFLVGGPSPFSSSFCSFCCRIRFRPVHSFPPLSESAVSCPPSSAFFCCFSAAVLFFSSSKMVSTASGNLKSEKQLD

SEQ ID NO: 158209 - protein, 219 aa, Heterodera glycines
  Coding regions on vcDNA: vcDNA=SeqID_84632; Strand=+; Position=1 -358,679-980
MAVQLHFWHAEKFRIICGQIAYVAYLVQKKSIPFTFWRSPTECFLMDREDILSSMRTLLKPSHLNFVMSRVIGTVWDTISDTVRQKRGALALLEKLIGGTALVKLWENKEARAKLMEANFFFDKNRLVDHYVSILLNANIVPDSVDRMRRDIKSADLIVWAQWFQSLIEQQHKGKSRYSLHRDYVWMYLRIAYDMYDLGTEKSEFEHTFTKMETMMRSN

SEQ ID NO: 158210 - protein, 50 aa, Heterodera glycines; identical to SEQ ID NO: 145164
  Coding regions on vcDNA: vcDNA=SeqID_84633; Strand=+; Position=1-153

SEQ ID NO: 158211 - protein, 261 aa, Heterodera glycines
  Coding regions on vcDNA: vcDNA=SeqID_84634; Strand=-; Position=1 -460,541-800,860-926
YIDHSVLTFLRSNKHIWDRSGTKLDLYAVFNSETNVQPIWDVFVRQIWPIFATNIHHLGFLCHNHFDTLCRHISPTFLTDCTRLHSVFSDQLCPGVIVADQFDDGQPNTATASSAGQALSKWLHTPTTNGQPKRLRCCEHQISNFEWVNNFKGIFLRATTTTSVSYTIRFGVLWPTTQIVPFELENERTKEKLTLKEGDNIYWLLERCPISEKAAAVKWEDDENLNNVELNLWAGSDYIGPLSPPAEEEDEETDESNENYI

SEQ ID NO: 158212 - protein, 25 aa, Heterodera glycines
  Coding regions on vcDNA: vcDNA=SeqID_84635; Strand=+; Position=1-76
SKSSLTTAQKNMFFVRFRPRGAQEK

SEQ ID NO: 158213 - protein, 26 aa, Heterodera glycines
  Coding regions on vcDNA: vcDNA=SeqID_84636; Strand=-; Position=1-78
SMEVIRSRATTINRQTYFNCDVACLL

SEQ ID NO: 158214 - protein, 84 aa, Heterodera glycines
  Coding regions on vcDNA: vcDNA=SeqID_84637; Strand=-; Position=1-579
VHLPPLRRRPTAVAAFVPRPCRNISSFPLAEAVINGTFDGLMMAKKRKKFLQKLLPYYFYYHIILTHHSFLCFHWFCVTFSHQF

SEQ ID NO: 158215 - protein, 162 aa, Heterodera glycines
  Coding regions on vcDNA: vcDNA=SeqID_84638; Strand=-; Position=1-490
  Homolog annotation: Hit_ID=CAE71161.1; Match level="QueryCoverage =99%, HitCoverage=41%, E-value=1e-39, Identity=49%"; Hit description =Hypothetical protein CBG18017 [Caenorhabditis briggsae]
LGGVCGTVVEMETKVYRAKYHRGRMLNRPYEWVFGMIQRGSNKVRFFPVPDRSADTLLPIIAENIEVESTIVADGWAAYGGINNMQQQYNHEWINHQIYFVDPANPKIHTQGIEATWRAFKQLKHLHGTTPELLPTYLFQYAFRRYQQNTKIFQHILEEMRL

SEQ ID NO: 158216 - protein, 83 aa, Heterodera glycines
  Coding regions on vcDNA: vcDNA=SeqID_84639; Strand=-; Position=1 -51,242-442
MTHFGSGKNKCCQMIIKESDVVRSEYGAFSVQCTANVFICSLDESPHPTTWKGSTTCQHNVSTCQFSAKLSIGIQPTVAPFKF

SEQ ID NO: 158217 - protein, 495 aa, Heterodera glycines
  Coding regions on vcDNA: vcDNA=SeqID_84640; Strand=+; Position=1 -354,404-578,625-748,789-1038,1087-1232,1279-1717
  Homolog annotation: Hit_ID=CAE70715.1; Match level="QueryCoverage =34%, HitCoverage=34%, E-value=1e-09, Identity=25%"; Hit description =Hypothetical protein CBG17457 [Caenorhabditis briggsae]
MMNRQIDTKKQKPKITYEGQLYTFDKSSADGTRKFWRCEYKNSCKGRIWRDLDDQFIRLATPHTCPVNAANVEAQKVKTAIKRRALTTLEPPAVIRSEALQNVPSPAGLLVTQDASKLVIKRARHEVNAPPAVPQSVDQLLFLPHTRRTSQLTAKWSSFCWLTLVCITRPETKTRRGFCCFGRESFGRWADRMKDCFGDGTFSLAPPMFYQIYTILAKRGSWVIVVCHCLLTSKSQASYERMFGLLRQAWPTFSPASFNMDFETAARNAAVATFPACEIKFCFFHFVRNLQKKIKEQNLWQRYCTDTVLAENLRMLTSVAFLPLSDIRTAVIALDTEFGNVTALRPLIDWLLNNYIGQPRPNGTWSQPLFPPEQWNVYTRTLNGEERTNNHAEAEHHRLQGAFNCRHPSIWHFIDVLRREQKGTDGKYASFLAGLEPPRKAKKYQAADERLFNLVQNYIPVNPNNENDHNYHINPNFHIILEFLRGISRNYHMNP

SEQ ID NO: 158218 - protein, 245 aa, Heterodera glycines
  Coding regions on vcDNA: vcDNA=SeqID_84641; Strand=-; Position=1-738
MGLPTCTAQTTASAAATASSTPPSTTVRPGAAAVQLAALFDPNRPPPTLTPEMLSAGAGPTTQPPTATTPAVTAPTTTLISGGVAGGAVLSAPPPMYSTTTTMALSAEDSLSVWENFLKRKENEKAERNFQLMRNNSAGGSGIYQQQQPHQHKHHRTEHRDYHHRERDRDRDRERDYHHRSRGGEGRGTTRRDEQNGGSGREGNSSSHQPKMTVEEKSTVWKLFEKHYEKKDKKGEEKNEEEERE

SEQ ID NO: 158219 - protein, 83 aa, Heterodera glycines
  Coding regions on vcDNA: vcDNA=SeqID_84642; Strand=-; Position=1 -48,137-340
MAQDQRQQQQTPPPTVSGANKPSVLTDTHSLLHKLLPGLAAAQAQRELDTTTRPTATSTAAPDGTPMVGKTLGSRALGKARNN

SEQ ID NO: 158220 - protein, 68 aa, Heterodera glycines
  Coding regions on vcDNA: vcDNA=SeqID_84643; Strand=-; Position=1-204
MAATELSAGVWASAAAAYTATKCKNEHMLISNGFLLFEILQPLSRPSTFNTYRRPRTAANFSGKLKKQ

SEQ ID NO: 158221 - protein, 14 aa, Heterodera glycines
  Coding regions on vcDNA: vcDNA=SeqID_84644; Strand=-; Position=1-63
LITCKFIKFNIYLY

SEQ ID NO: 158222 - protein, 178 aa, Heterodera glycines
  Coding regions on vcDNA: vcDNA=SeqID_84645; Strand=+; Position=1 -171,217-348,395-628
MNRCNYNQKIKTSNPLYGRGYFIEQKEYSNSNGCGFRKANRPLVPSNAADIESWEPKVMSTQEISKLTARCVGVTDAFIKLDNYVDSVKKYNPSNHDLLRVMQRMQHQSKTLTEDPDKYAELIVQCVANPNKFNGTRHCLELVIGRRALEEFISRNEWTEERLKDYDIKCVWPSDGFV

SEQ ID NO: 158223 - protein, 131 aa, Heterodera glycines
  Coding regions on vcDNA: vcDNA=SeqID_84646; Strand=+; Position=1 -66,288-571,623-668
MASDKQAVTKWLFTPRPDNVPKAFASASSPANFIIYVWFPSSFADSDVPFELINELTREQLTLERINNSNRFLLIRCPIERDESKWTKWEEEAIDWRIYNQCNLHIGIYNDDNIGKRLLNATLEPSDQQQK

SEQ ID NO: 158224 - protein, 69 aa, Heterodera glycines
  Coding regions on vcDNA: vcDNA=SeqID_84647; Strand=+; Position=1 -104,229-334
MATFKTAPLIAVALLIHFGCLMFLMEVNGEVHVQSSLAPSHQVVKRHCSCGGSWGGWGGGGGACKTNFL

SEQ ID NO: 158225 - protein, 53 aa, Heterodera glycines
  Coding regions on vcDNA: vcDNA=SeqID_84648; Strand=-; Position=1 -71,195-285
MLPHWPQEQPEIVATLDMLGALKLLAYFRRSIPEPNSPPEIIATTHMLGVLKL

SEQ ID NO: 158226 - protein, 92 aa, Heterodera glycines
  Coding regions on vcDNA: vcDNA=SeqID_84649; Strand=+; Position=1 -48,224-454
MDILKEVGLHGRMAQWDMEAELLLCHERMNALETTCNNLALLLGGHLGGSESNKSCALEENEKGDYLAQFANECSRIRKELQKLKKRWRERK

SEQ ID NO: 158227 - protein, 116 aa, Heterodera glycines
  Coding regions on vcDNA: vcDNA=SeqID_84650; Strand=+; Position=1 -147,399-602
MAVRSIILLYLKVEHLQLTTNGTTSKCEKVFLIDNDERYNSQPDELTEEFEFVDHCNNNNNSNTLNNLCERRMIVSSEIKADHHFNESVSIFPLSDREHSLVAVVNFGPFWHRHQK

SEQ ID NO: 158228 - protein, 154 aa, Heterodera glycines
  Coding regions on vcDNA: vcDNA=SeqID_84651; Strand=-; Position=1 -354,471-580
MDENEDDGNNTDCSISRQLFQICLTLLQQVQSQQSELFTLKQRQIADEAVQDHERRRSVVVMGLPESQKQKPSERVAADRTAISGVLDELGIESPITVYRMGSPDQARTGQNRPRLMKPRGTQGPARRVLQEECSRKRKEDGGEWVVYADKVML

SEQ ID NO: 158229 - protein, 41 aa, Heterodera glycines; identical to SEQ ID NO: 151443
  Coding regions on vcDNA: vcDNA=SeqID_84652; Strand=-; Position=1-125

SEQ ID NO: 158230 - protein, 73 aa, Heterodera glycines
  Coding regions on vcDNA: vcDNA=SeqID_84653; Strand=-; Position=1 -129,254-346
MTNNEMAEQSAFQSKLMLLRLKKVTHLTIDTDIKGNGEKEAEFPLTDFTSIMMYLILENIWDNRSIDVMAIED

SEQ ID NO: 158231 - protein, 63 aa, Heterodera glycines; identical to SEQ ID NO: 130392
  Coding regions on vcDNA: vcDNA=SeqID_84654; Strand=+; Position=1 -97,317-411

SEQ ID NO: 158232 - protein, 170 aa, Heterodera glycines
  Coding regions on vcDNA: vcDNA=SeqID_84655; Strand=+; Position=1 -134,464-842
MNSVPRYGMPKFLAFIIGKELIIFISVRSHWCRDSALVKSFLSHRVSRNCRVFTRLTAEALGFHYFHIYFFLDLISLFTNCTALPAIHFSLVFNVRLFKRTELSRPENKATYCVTSECGKATPGLITPWTHPSGICGTFPFPPHSEFQFPTPARPPRPAALLVAPDGSLL

SEQ ID NO: 158233 - protein, 77 aa, Heterodera glycines
  Coding regions on vcDNA: vcDNA=SeqID_84656; Strand=+; Position=1 -215,734-752
MEMIWLGTKRIGPPLRRLKKPNLQLAEVKMRCEHQHVPRGHLSDWTWTRRSRSTTSSGHDISRRRDFSKEGRIVNYY

SEQ ID NO: 158234 - protein, 135 aa, Heterodera glycines
  Coding regions on vcDNA: vcDNA=SeqID_84657; Strand=+; Position=1-406
MPIESANEKLQQKSFDEIFGEKWQEKEEERRNELKKREIIGKFYKIKEKIKQKGRKYSAKEWNKIGEKIAKKMGTNRKKIYKWIKEFGLQKRKSYKSKTDEEKIEIVLKFIEMTKEYKQKSKYSQKEWNQNYAEI

SEQ ID NO: 158235 - protein, 22 aa, Heterodera glycines
  Coding regions on vcDNA: vcDNA=SeqID_84658; Strand=+; Position=1 -21,202-249
MQIVWITRVSAFLCQTFDSKIF

SEQ ID NO: 158236 - protein, 144 aa, Heterodera glycines
  Coding regions on vcDNA: vcDNA=SeqID_84659; Strand=+; Position=1 -184,279-424,477-581
MDPSNGLYDKKENKVTLAIDVITVDEPKMEKFISDPNKSNGTLSMEIEKVSEFAREIFESEPENWSCKCSSTFRIVSQKSGVKDLRRELNDDVFDNKNRGWGYANFISFAELMDPSNGLYDQSEDKVTLAIDLSVKEANIEENS

SEQ ID NO: 158237 - protein, 111 aa, Heterodera glycines
  Coding regions on vcDNA: vcDNA=SeqID_84660; Strand=-; Position=1 -113,269-491
MDLAKSLLTECQAENVQRIVAALSDGQQTLLGHVESERARLTSRDAEERSAALNELCAVVLQMLPSAAAGGKQKAEGHVKIVAWENVPITRPQIDQLLPFLLSKVRQNAGD

SEQ ID NO: 158238 - protein, 481 aa, Heterodera glycines
  misc_feature (183)..(183): Xaa can be any naturally occurring amino acid
  Coding regions on vcDNA: vcDNA=SeqID_84661; Strand=+; Position=1 -1176,1207-1407
  Homolog annotation: Hit_ID=XP_318550.1; Match level="QueryCoverage =99%, HitCoverage=48%, E-value=1e-101, Identity=42%"; Hit description= ENSANGP00000020240 [Anopheles gambiae]
FHKYLFGRHFVLLSDHKPLLSIFRNNKGIKACTANRLQRWAITLLGYDFELEYQNTDFGQAEVLSRLIAKTPVPDNKVIIANIRESNETGVLNFVAKTLPLDHSDLANAAKSDQVIKNVKKFVCSHWPTKNKMTADIVPFHRRRDALTIEDECLLYADRVLIPASLQKDVLQLLHRGHPGMKXMKGLPRQYVYWPGMDEQIENFVKMCNECTMEAKMPVKTELQSWPKADGPWKRVHLDYAGPFYGKMFLIIVDAYSKWPEVFKMRSSNSAATIDKLRSLCASYGLPEILVTDNGTQFASKELKEFVTENGINHLFSAPYNPMSNGQAERFVDTFKRTCRKIKGEGASEMLTTFMATYRTTPCEGKSPDELFLGRKPRTTLDLLRPAIEKQFNRRHGAKPRSFAVGDKVLARHCAIEKQFNRRHGAKPRSFAVGDKVLARHCLSQPWRPGKVTKCKGVIYDVEFFDGKFGRFHANQLLVRS

SEQ ID NO: 158239 - protein, 78 aa, Heterodera glycines
  Coding regions on vcDNA: vcDNA=SeqID_84662; Strand=-; Position=1-237
MSNYYGRIGHLVGFNPPSNRNEAEEMIIEEDARLLLEQSLDENGLLVDQYFEEMGLNEVQDENSPDVNSEDGEVDIMN

SEQ ID NO: 158240 - protein, 83 aa, Heterodera glycines
  Coding regions on vcDNA: vcDNA=SeqID_84663; Strand=-; Position=1 -99,133-285
MCAFHVKQAINRRIQSMGFMQLYSSKEPNGLEFELSHAEEETAVAVDEGRQLPARPLELLLNWTEELPQRGGYFGFFEHGLLQ

SEQ ID NO: 158241 - protein, 60 aa, Heterodera glycines
  Coding regions on vcDNA: vcDNA=SeqID_84664; Strand=+; Position=1-183
PITIGKGRRVTSAAFMCGYKSMPFLSPDSPLKLFVKGKSEGFPLPDRPLSNKIRIKCLQI

SEQ ID NO: 158242 - protein, 137 aa, Heterodera glycines
  Coding regions on vcDNA: vcDNA=SeqID_84665; Strand=+; Position=1-414
MELGSQKYKLNKNSSSLSPSPLSKKRWLPVELQFEIAHWLPITESIERPLIQAAKFPLVIAKCVLSRIEKRNILLFPEVYLKRIQTQIFKIQQDTFYQIEGIETSRKIGKKRELFIKWVGYPYSQNSWEDEEEIKKV

SEQ ID NO: 158243 - protein, 32 aa, Heterodera glycines
  Coding regions on vcDNA: vcDNA=SeqID_84666; Strand=-; Position=1-113
SGGIEPGTPFLVANSQTTKTKNQLVFELGAQN

SEQ ID NO: 158244 - protein, 101 aa, Heterodera glycines
  Coding regions on vcDNA: vcDNA=SeqID_84667; Strand=-; Position=1 -44,177-438
MGIDKTHKEMAVMIRKFLFGSVSPANVLPNITVSAERHGMQVRNALGENLIVPHTAQMYQRQLAQSWGQRPSPAATASDNGQVDRSEATSQLQRMASFHFW

SEQ ID NO: 158245 - protein, 120 aa, Heterodera glycines
  Coding regions on vcDNA: vcDNA=SeqID_84668; Strand=-; Position=1 -98,427-538,588-627,676-788
MGNIIQPMEHTAKNCSDAYEMDSTRLGLCIFEINTLITLAITMEFFVYSIWPNPTKSTTITLSAINTFWPWSTTIVIYWLEQNGIIETVPQFAVLEVINIISWMVVSFQLNIFELPFLSK

SEQ ID NO: 158246 - protein, 70 aa, Heterodera glycines
  Coding regions on vcDNA: vcDNA=SeqID_84669; Strand=-; Position=1 -64,363-511
MAKWTEAEQQANCRGWQVFISENNIKSEGTFRDQFAFGQKQKPIGLQKEKHGQRGNRGDFSFSAGVLDFN

SEQ ID NO: 158247 - protein, 160 aa, Heterodera glycines
  Coding regions on vcDNA: vcDNA=SeqID_84670; Strand=-; Position=1-481
  Homolog annotation: Hit_ID=NP_608540.1; Match level="QueryCoverage =98%, HitCoverage=63%, E-value=3e-16, Identity=29%"; Hit description =CG2839-PA [Drosophila melanogaster] gb|AAF51469.2| CG2839-PA [Drosophila melanogaster]
MREKEKLTEKEEKRERKKRERKHADETMEQVIEEEKRKEELKKRMEEIQREKRDRKLRQRQLQRNKDREPKKDNEKQRDDDKDEKNRKSEDREMSEESQSEGKSSNLAEDFIITPKNAQKGRKNRTFENKQTREEEGKEEKSEILFEKEWQKAMENTKLI

SEQ ID NO: 158248 - protein, 256 aa, Heterodera glycines
  Coding regions on vcDNA: vcDNA=SeqID_84671; Strand=-; Position=1 -177,289-882
  Homolog annotation: Hit_ID=CAC37683.1; Match level="QueryCoverage =76%, HitCoverage=51%, E-value=1e-10, Identity=25%"; Hit description =putative recombinase [Chironomus tentans]
MLDWMSTRIANHIIPDRLRDRTIYDQTVNGEQMIIFCSRFDLDLLVNYQNEVPIDGTFDTCPRGFTQVYTMAVVIDHCAVPAVYGLLPSKTLATYTRFFETIRQSVGNNWFPYRIMSDFESGAIAAAGNVFPNSIRTGCLFHFGQAIWRRIQRLPNLLTRYRDDELVRTSLRSLQALAFVPTDFVYNYFCIVMSILEPTPELQELIIYFINTWIGPRRIIQNEEVLVRDAGGAADNWIRECSGQSSRRAWKNKQFA

SEQ ID NO: 158249 - protein, 210 aa, Heterodera glycines
  Coding regions on vcDNA: vcDNA=SeqID_84672; Strand=-; Position=1 -87,509-798,1040-1295
MSYLFTFFFIFNLSISNGSKLTLQIAPTLPLIYDGLIDADQSHNADLPIDFGKYFVLQVDPMLEEDEAFYEVDVICHENSVRFYYGEMFCDLKCSTMVFSQNESCLNSEFDITIWKWHNKREVIKRKKKSAEGTAAFTVPKFTLETEKNGQLSTKSKSNESEKSSECTNWSAGLKWQCSILLQFVPFNHFPVQKGRFQHFTEKNQQMLLN

SEQ ID NO: 158250 - protein, 185 aa, Heterodera glycines
  Coding regions on vcDNA: vcDNA=SeqID_84673; Strand=+; Position=1 -147,476-597,870-977,1022-1121,1224-1301
MFDKELESHGTGNKSGTKHLAKLLPEATTVRDETLPRIGLPSLVNRPNKDANSIPRGPLRSLFVNDSLTNDHEASSVQESPTKDELNTQISFSDDKPQRLRKYPSLHSVDYDYEYLEEAKIPEKFRSNIDDVQNDQKHKIVKDYEASSIEQGHQQTQGKAKDAGGQIEFVKRLPFLQESSPEVVE

SEQ ID NO: 158251 - protein, 51 aa, Heterodera glycines
  Coding regions on vcDNA: vcDNA=SeqID_84674; Strand=-; Position=1 -50,85-190
MVPSWAYYAYEGITLYLASPPECQQIVYRRHRYELCLPFVRVVTKTRTGSV

SEQ ID NO: 158252 - protein, 55 aa, Heterodera glycines
  Coding regions on vcDNA: vcDNA=SeqID_84675; Strand=+; Position=1 -88,209-288
MLIKKGSNTKLIRSLLHGDLISPFWLGTRGPEKSRPVSRPTSSSSKYIFSWVLML

SEQ ID NO: 158253 - protein, 107 aa, Heterodera glycines
  Coding regions on vcDNA: vcDNA=SeqID_84676; Strand=+; Position=1 -308,554-569
MEGKGSKKRRATAAAPPLKPLFSTVKHGTGGTIVVVVPLIRPAGTVVLLLLVTPLLSGPPNGAAGTMVGLMMAHLAIIMAIVSIIALLTARRANVQSVQLDHLFLIS

SEQ ID NO: 158254 - protein, 182 aa, Heterodera glycines
  Coding regions on vcDNA: vcDNA=SeqID_84677; Strand=-; Position=1 -314,404-638
MFGWLPPFHHFFRSRTFLSRRFFPVISFPPLLSRHSFVFHRRVKRVQKNRDKLYEEFVRGDDAAKKRLVYQRTDERIRNIVVGGLGERTIAEYLRGIANNFEMDQINSNFGKEKSRERNGGKEMSRTAFFPILKGRTSAEHFRLFVHHHFLLRAVLRFRVSAVVVRRGRRIRRFPPPQPTTT

SEQ ID NO: 158255 - protein, 154 aa, Heterodera glycines
  Coding regions on vcDNA: vcDNA=SeqID_84678; Strand=+; Position=1 -117,195-542
MPSNSFYVVVPSNTNIEGNRTNSFLVRLPRKLQFNSEWEIEWQTGNKVRIELPPSNVTNPHELSKNLYRLLGDGSDPLAKKVRSTQNSFMLTINKARRWAREEYIKRKTKEKRGVRDEELLLQALLTDTGTLVELNTRKDFWHAKSMLKRAISR

SEQ ID NO: 158256 - protein, 124 aa, Heterodera glycines
  Coding regions on vcDNA: vcDNA=SeqID_84679; Strand=+; Position=1 -172,794-996
MLILLPVQPAYAQNAWPLRRRREDAVALTVKVPMTLALSMSKVRRHGAAHPRGMVVIETGTWKKEFFVQSAYFLIIIISSIPSKKLTHGLRQLGPHVWAPACFWLNFFIYHPNPTNVFYGFYFF

SEQ ID NO: 158257 - protein, 618 aa, Heterodera glycines
  Coding regions on vcDNA: vcDNA=SeqID_84680; Strand=-; Position=1 -873,1062-2045
  Homolog annotation: Hit_ID=NP_494302.1; Match level="QueryCoverage =92%, HitCoverage=38%, E-value=6e-30, Identity=26%"; Hit description =predicted CDS, putative protein of ancient origin (2C878) [Caenorhabditis elegans] gb|AAB95006.1| Hypothe
MFRLACSAPASIGPQSAAKLQMQRLDGPMAVILNGEFHRRISSMQAGTTQIPGFGQLYILDPVQAMEQRRNNPTFTGEKITNEDEFVQGHELNEATLELLEKMIQEHHPAAQAYKQAREQLQELLKKQKPEELRFFRMTLLNERMTPAALKDPKLHPHQIITPSTGEGMFAIHADPSGAPPPRGIWVENKQGQLNEIAAFSPWTDSLTYPLIKPMGDDGYITGIKYAKPSSRKRKSDQDVAGLFDSEAESDNGSCETQSVASSDARVGRFHFLHFMAALTNRKDLSPCGITYLVNQYNKQQARQNPNAQQKTVDDIGSVVRFSEHNVNSLQYWKKMYEDCNTIFARHHDAKKARLFITFTNNREWPEFKENMYNNGQVFTDRFDLWMRVWSSKIAEFHEELYEKKFFGTILGSGESMEFQGRGGPHAHIVAQTDLDAIPDVIQQYIWAHIPPLPDKGDGTPIAQMHREVRELMHFQLHRCSDSWCGPRDPYGRCKKGFPALYSKCTILRPDRPALYYRPSSVDGGANIVVNGLIYDNSQVVPYNPYILLRYRVHHNVLFAYGNKANIKYALKYPFKGPGHCYVECKEESGNKIGIDEPAQYAKMNFRGATELYAVVNS

SEQ ID NO: 158258 - protein, 143 aa, Heterodera glycines
  Coding regions on vcDNA: vcDNA=SeqID_84681; Strand=-; Position=1 -146,672-720,1348-1584
  Homolog annotation: Hit_ID=CAE67382.1; Match level="QueryCoverage =71%, HitCoverage=34%, E-value=4e-11, Identity=38%"; Hit description =Hypothetical protein CBG12865 [Caenorhabditis briggsae]
MAVAKKRSPAEYYAFSKLANCLHAVGLANRLASPAVACSFRDVKVVAIRMLAYPLIWMVAKDLDQGISSMLHCAQCDLAQLQNGALYYEGRVVPYKNEMVTNEEAEKLWQMSEKMTKLEENGEKGQPQQQNSEEQQQQKSPIK

SEQ ID NO: 158259 - protein, 134 aa, Heterodera glycines
  Coding regions on vcDNA: vcDNA=SeqID_84682; Strand=-; Position=1-405
MPQVLLAKNALRHNFVGQIMHNVPTKTSSHSGSSFPPDKGTVGIGVITAIFLFRCSMGCSPLCGECRNENFKRGDKRFLLNTGSGQEKLEFTQTFCQDCAKLNFDCTDLIMKHQKKDDVPQKNGGRNTYFKMEK

SEQ ID NO: 158260 - protein, 166 aa, Heterodera glycines
  Coding regions on vcDNA: vcDNA=SeqID_84683; Strand=+; Position=1 -91,359-538,591-820
MHQGLHRRHNHQQHIIIIITINKFKQYNSSTSASIHAAWLQVHDHGNTPPHDVEMPIRPATWMSTVRSGRHLPVVESVYPGRNPARRRLFDAQPAAEGKEAQNLLRAPAAAEEEEAALIVDQMQPQAAAAAMMEDEDDDDDEIVFINEVQREARRRHHQQQQQQMK

SEQ ID NO: 158261 - protein, 182 aa, Heterodera glycines
  Coding regions on vcDNA: vcDNA=SeqID_84684; Strand=+; Position=1 -292,1384-1465,1565-1739
MDTSKGLYNKKEDKVTLTIDVIVEGMKTDIADPPKSKGKILWTIQKLSEFAREVLMSERNSETVHFKGIEWKICAEVVKNGSNEKALDISLACVPTKESKNNKNSRILNKMSNQSAAELADEYERVDGEAIKSNEDRRTEAEQVGLLNTFFSNSLENRRMTTDSSLSVRRPKWTNRRTAAEK

SEQ ID NO: 158262 - protein, 633 aa, Heterodera glycines
  Coding regions on vcDNA: vcDNA=SeqID_84685; Strand=+; Position=1 -124,263-358,412-453,504-596,645-688,740-827,872-924,955-1016,1063 -1156,1253-1321,1478-1550,1606-1691,1739-1777,1819-1898,1988 -2080,2134-2239,2298-2426,2480-2509
  Homolog annotation: Hit_ID=NP_499043.1; Match level="QueryCoverage =96%, HitCoverage=74%, E-value=1e-164, Identity=53%"; Hit description= dopamine transporter, antidepressant and cocaine-sensitive (69.3 kD) (dat-1) [Caenorhabditis elegans] em
PLLCSRQRYDQKMAKSSTELVLQTADEGENREAEGTERETWERKIDFLLSVVGFAVDLANVWRFPYLCFKNGGGAFLLAFLLPYTMMVLLAGIPLFYMELALGQFHIPLFYMELALGQFHRKGAITTWGRICPLFKGIGYCVIMIGYCVIMTAFYTDFFYNVIIAYALHYFYASFYNVIIAYALHYFYASFSTQLPWSSCSGKHNSPACYEPSWSNSPACYEPSWSDQSQQCTRNGTSPRIDRPVSAAEEYFYDQSQQCTRNGTSPRIDRPVSAAEEYFYKYFLGLHAKYFLGLHAEKEAIPHVTQSVGQLGPINWEIVACLFVACLFVVYIICYFSLWKGIKMSGKVVWFTAIFPYVVLFCLLIRGVTLPGSEKGIESEKGIEYYLRPNLEKLKDPNVWQDAATQVFFSLGPGFGVLMTQVFFSLGPGFGVLMAYSSYNEFHNNVYFDAAYSSYNEFHNNVYFDALLTSTINCATSFLAGFVIFSVLGYMSCKSGKPIHDVAQEGPGLVFVVYPEALALVFVVYPEALATMPGATVWSLIFFLMLLTLGLDSSFGGSEAIITGLSDEFPFGGSEAIITGLSDEFPAIKRNREVFVAVLFSFYMIIGLTMCTKGGMLVMEWLMGGMLVMEWLM

SEQ ID NO: 158263 - protein, 320 aa, Heterodera glycines
  misc_feature (18)..(18): Xaa can be any naturally occurring amino acid
  misc_feature (29)..(29): Xaa can be any naturally occurring amino acid
  misc_feature (314)..(314): Xaa can be any naturally occurring amino acid
  Coding regions on vcDNA: vcDNA=SeqID_84686; Strand=+; Position=1 -246,319-359,415-463,514-618,675-704,754-799,845-870,970-1098,2214 -2313
  Homolog annotation: Hit_ID=NP_505897.1; Match level="QueryCoverage =82%, HitCoverage=35%, E-value=8e-77, Identity=61%"; Hit description =DEGeneration of certain neurons DEG-3, DEgeneration Suppressor DES -2, acetylcholine receptor (64.9 kD) (d
HMISRYYKLIVLILFINXIIIIIIIIVLXLLRNSLQNCTLTISSWTNSKSALDYYADEKVNLASFIPNEEWEVASFRIFRHEYKYACCPEPWVILYKYACCPEPWVILEASIVLRRKPLYYVINLEASIVLRRKPLYYVINLIIPTSIITIIPTSIITLVAITGFFTPASTADDRTEKINLGITTLLAMSILMLMLLAMSILMLMVSDQMPTTVSDQMPTTSEFVPLIAWFYLSIIIWFYLSIIIIISIGTFLTSVILSVQSRRQYGQLPSLPLRFIFFVKLVHRILMSVPTPRQTLFVGAFKRVVRSTFGRSXHILTLH

SEQ ID NO: 158264 - protein, 157 aa, Heterodera glycines
  Coding regions on vcDNA: vcDNA=SeqID_84687; Strand=-; Position=1 -116,165-599
QKLAKMPFFCFWASPSLRPFVARLRFRRFCRCARTLSSRRFRPLFSWRSFADRAPIAGRSGRRARRLFTRRKFKSQQRTKPKVEGFSILRNIAHQTAQRVLQKPTAEEIRRENAILECQSEGGEELVLTDSCYLLGHGLAVELARHLQLIIVQKLCH

SEQ ID NO: 158265 - protein, 188 aa, Heterodera glycines
  Coding regions on vcDNA: vcDNA=SeqID_84688; Strand=+; Position=1 -172,302-696
ISAESFLEWCDLNENCEVGKECILSGLVYDGDSLLRIGNGICASTFPIDRKPSGGHAVDNSTVSAFVTVAFHRDDDIKRSSAECPLLWFGHRLATIAQGHAQFHSLWHFPLFSAHPNPSESLQETLDTINRLGQNEPQKSDKTRPRSDQQLLSIEEVLQKVDAKKLREMREKFIKMPMEEKESGKPSK

SEQ ID NO: 158266 - protein, 346 aa, Heterodera glycines
  Coding regions on vcDNA: vcDNA=SeqID_84689; Strand=+; Position=1 -47,116-391,440-824,1046-1329,1384-1432
MSDRRKEAEEKMAKAIFISADCWLCVFDLLEPSQLGLGISMISHRFDFYVDEHFKTRKWALKIIGIRIKNGENGTKEMEIVNFSGKQIPIPQKPLPRGVIGFERVDFVYIDHNVITFLGYFRPLFAACQINLFIHTDSDRVLELILRNIWPMIATNICAIQLSTEIFRCLRQMAPSILDDCPSLRVVNAYSGRFFAEFPADDWLFTPLQNGVPKVFRCWMGNDEGTYPSIIEALKTTFASVSSPVNFIVVIWFPSSFASSVVLFNLTNELTREQLALKRTDNSDRFLLVRCPIARDENKWTKWEEEAIDWRIYNQWNQILMLINENDIGDGLLDATPGPSDQQQNE

SEQ ID NO: 158267 - protein, 153 aa, Heterodera glycines
  Coding regions on vcDNA: vcDNA=SeqID_84690; Strand=-; Position=1 -20,759-1200
MQPPKSWFLDNYTGRMRFNVPMTAPLFDPHEWSVHQRTLDGADRTNNFAEAFHRKLQRQFSCTHPTIWRFIDTIRCEQKALDADMARCMMGEAAPQKKRKYRDADSRILRLVQRYNDVNIVPQNDHNYANPNVNPENINNFLAGISRNYEMRP

SEQ ID NO: 158268 - protein, 90 aa, Heterodera glycines
  Coding regions on vcDNA: vcDNA=SeqID_84691; Strand=+; Position=1 -10,183-244,401-476,519-643
MRRTAGGTVQKDKPKKEYLLKCIQKNVPFFIICDKNTLCSYQFLMDSNFPIFNEDFILVAILRHKIDVSEEFHAFSLNSTQTSKPKKADE

SEQ ID NO: 158269 - protein, 44 aa, Heterodera glycines
  Coding regions on vcDNA: vcDNA=SeqID_84692; Strand=+; Position=1 -34,89-189
MFKEWYERECQGEKNAVIQSIDANELEELLQTCCAYGSTPTIHR

SEQ ID NO: 158270 - protein, 29 aa, Heterodera glycines
  Coding regions on vcDNA: vcDNA=SeqID_84693; Strand=+; Position=1-87
MAVLGSGGHTTEMLKLLAAQDDLFPGRLY

SEQ ID NO: 158271 - protein, 94 aa, Heterodera glycines
  Coding regions on vcDNA: vcDNA=SeqID_84694; Strand=+; Position=1 -40,86-162,219-427
KILEIADKEKISGLLRIVESFIIDSECIHPIRKLEYAAEYRMSRLADTVLRLFPTQIDRLDSLFLYLAENGETLADVHLDVLKMLDIHDSYIVM

SEQ ID NO: 158272 - protein, 130 aa, Heterodera glycines
  Coding regions on vcDNA: vcDNA=SeqID_84695; Strand=-; Position=1 -46,172-239,410-637,694-741
MAVHTVQLVGEASYKASIDVETVTGMPRATAILYQQRKAILANVLTASDAEQFAKLEYEQNKAQQTLVDIKLKREIKALRVEMYASEQKLHKQLVHAEQKLHEQQQKLHEQLVHLTNAVQQIRHPENNTS

SEQ ID NO: 158273 - protein, 139 aa, Heterodera glycines
  Coding regions on vcDNA: vcDNA=SeqID_84696; Strand=+; Position=1 -126,191-337,813-959
MRDRASDSYEDAKQGAQDRYERAKEYGSEKTEQLKDYATDKKEEAGEKMEQNREKAAEKWDETKEAGGGGERDSKREAFGERANWQSMGLKFGQYVFVRIVQENEGGECIEQILFLFEETRNLQIDLVESRFLLEMIGT

SEQ ID NO: 158274 - protein, 251 aa, Heterodera glycines
  Coding regions on vcDNA: vcDNA=SeqID_84697; Strand=+; Position=1 -103,462-1114
  Homolog annotation: Hit_ID=XP_528877.1; Match level="QueryCoverage =47%, HitCoverage=45%, E-value=6e-09, Identity=35%"; Hit description =PREDICTED: similar to endoplasmic reticulum membrane protein family member with at least 5 transmembrane
MREIADIFERVFQRYTSAVPCNVFGPRDNYNLENGLNPPAFNHWDSTHQHSNRRDSTQQHSNHWDSILLHFNHWHSILLHFNHWHSTQQHLNHWHSTQQHLNQQDSTLQHSITGTQPTNIPINRTQPSSIQSLGLNPPTFQSPGLNPTAFQSLGLNSPAFQSLALNSPAFQSLALNPTAFKSLGLNPTAFQSLGLNSPAFQLLGLNSPAFQSLALNSPAFQSLGLNPTAFQSLGLNPTAFQSLGLNLSKFL

SEQ ID NO: 158275 - protein, 20 aa, Heterodera glycines
  Coding regions on vcDNA: vcDNA=SeqID_84698; Strand=+; Position=1 -17,600-645
MNRKIIKILIEAKYSIFYKL

SEQ ID NO: 158276 - protein, 84 aa, Heterodera glycines
  Coding regions on vcDNA: vcDNA=SeqID_84699; Strand=-; Position=1 -78,1667-1841
MNGKEKPTNKEEMLLLIGHDQDRTCRMCFLLCNFVPADHHQQQTTQRRSVRPNIRNEIRPSNPRKSQADDSRAAPANIHRPLLI

SEQ ID NO: 158277 - protein, 61 aa, Heterodera glycines
  Coding regions on vcDNA: vcDNA=SeqID_84700; Strand=+; Position=1 -57,113-178,236-296
VFKLKGNVEMNEADRTANEELDNVINISANANANNRTNGDEAAAAVSDGGAQCQQWDKCRN

SEQ ID NO: 158278 - protein, 280 aa, Heterodera glycines
  Coding regions on vcDNA: vcDNA=SeqID_84701; Strand=-; Position=1 -141,196-442,489-773,1693-1859
MNSDIGSQMKDLGGKYRFLRYLFSDLKNMTLNCTSRIELMENWANNERYSPYTSNRATVVSPAMLRETFELLNQQQKQHEAIANRVLQYGNEEVATIAASSLKRAMASSSSSSAATSAKKPKLVSEDDREVAALALAAFTQIKMRLAEDIEGLEMRTRKLEEGAAATTEAQMETMRQQMEQEFRQNLLEAEQRIDHKWATMLNKEQQRTQRIAAQSAAVIGQLMTGLTAREPNQGSKRQKGPTMGPHPKGEPNLGPHLRGEPNQSPKNKKLGPTWAYTPR

SEQ ID NO: 158279 - protein, 131 aa, Heterodera glycines
  Coding regions on vcDNA: vcDNA=SeqID_84702; Strand=-; Position=1 -144,200-451
MNSTDLNSQVKDLGGKYRFLRYLFTDLKNLTLNSTSRIELLENWANNERYSPYTSNRATVVSPAMLRETFELLNQQQKQHEAIANRVLRPGNEEVATIAVSSLKRAMASSSSSSAATSAKKPKLVSEDDGV

SEQ ID NO: 158280 - protein, 121 aa, Heterodera glycines
  Coding regions on vcDNA: vcDNA=SeqID_84703; Strand=-; Position=1 -208,254-411
MKRSAATLSTAAAAPNQHENKIEPIPTHVETEPDHETKGPPPTKKRAVEDRDLWKLAKGKYLLTTYLCPDDWNRLYHNQQKVKRLDDDRFSINFELCQECVRVNCRATDLIAPMKKKPNNE

SEQ ID NO: 158281 - protein, 117 aa, Heterodera glycines
  Coding regions on vcDNA: vcDNA=SeqID_84704; Strand=-; Position=1 -55,99-290,481-587
MVVNKGKRSLAKLCLNNLWGRFSLRNFGLCQTLITDDPVTLAEYLDNKSIEVTSIDQLDETHILITYLHKKDWVDEHACSNIDTDSLILVHPEERCPLKTGPHLGQFTDEYPDHDIV

SEQ ID NO: 158282 - protein, 522 aa, Heterodera glycines
  Coding regions on vcDNA: vcDNA=SeqID_84705; Strand=-; Position=1 -624,671-1168,1212-1519,1567-1703
  Homolog annotation: Hit_ID=NP_507780.1; Match level="QueryCoverage =76%, HitCoverage=28%, E-value=2e-33, Identity=27%"; Hit description =predicted CDS, DNA polymerase type B, organellar and viral family member (5T899) [Caenorhabditis elegans]
MVAKSRGWASWKFHRYLHSQHGQQGCLQRDALQLMQQIGARPGLNAYDAEIVVPRVVDHWNNSQQRHRFAVFIFGSTGQYKPLYKYINNYYDTPIVLYLNNGHFDGVKKEYGLFGQHYCLECEKPYERPSRHLNSCKARCMLCSRVGPRFPCSPLDGFFRECAGCNKAFRNNDCHQHHLTSNFCAQSKRCKECGVIWDTRVHNRDGRKGHKCDERYCQTCNNFHNVERGCYIQQIEPKENDPYRIVAFDLETMQHQAMDPQQPEKREHQPNFIAARVACPDCIENGKWKRATARCQICGPHRTVVFCQRRFMDTQVDKQVVADNPLEPFVNWLVFELPKKCDTYAYSHFGGRFDMVLVFRELFRIGFNPEMLRRGNKMYEMKVQKQKRRNPNIVFRDSFNLMPCSLAALIPSYGLDVEDKPFFPHLANRPENYGREIRPTPNDYLANGMMPGKRRQFDEWYAAHHQEPFMLDEALASYCTNDVEILMAALVAFRREFFEISRRQEYVDGIDDRENHDGIDVL

SEQ ID NO: 158283 - protein, 183 aa, Heterodera glycines
  Coding regions on vcDNA: vcDNA=SeqID_84706; Strand=-; Position=1-552
MVQEGAGTSSSTSKTAKDYVRKLDSTIEHVPRFQYSKAKSRFSIEDVPAAANPEGLIAGIFQYSIDAAVADSRERGIHPTHLGCLISSPLLTGGDIPIPIRQITDNTVNTILNQFVKVAQSKKQQNVTLWGEPFTVVVTTVNRPGLPTKRTLKGGARRALAPVHHRINDRSLIKVRYMIKQQF

SEQ ID NO: 158284 - protein, 388 aa, Heterodera glycines
  Coding regions on vcDNA: vcDNA=SeqID_84707; Strand=-; Position=1-1169
  Homolog annotation: Hit_ID=NP_002448.1; Match level="QueryCoverage =62%, HitCoverage=56%, E-value=3e-22, Identity=30%"; Hit description =mucin 2 [Homo sapiens] gb|AAB95295.1| mucin [Homo sapiens] sp|Q02817|MUC2_HUMAN Mucin 2 precursor (Intest
TKSTTAAPVKSTTAPPPTVKATTAPPPTVKATTAPPPTVKATTAPPPAVKTTTAPPPTVKTTTAPPPIVKATTAPPPPKTTTPVTPVVKSPSVKPTISAPPAQLKSTANAPPPASVSAELAPRAPLADSPPRFDEGEEENKTDKLTAAKPSTKTTITAPPAQLKSSATPHQQKQQVPVKPSAPISVPAKPSGSQQRFEGTEQKQQPPPPPTSAALTLADLNLPENTLSVQIDPLSYVPNSVSIQYLENMERFKLVFNEAIVSHVSFSPQLGYVLGFENPQHVVSNELSKYPVDLRGGISSFAVYSKGLTENMIIGNSLSSLLRVVSISGAIPWEYNEKIYDSPIFARVLPREINEIEIELRTMDKGRLVPFAYGTTMVVLIFKKVINF

SEQ ID NO: 158285 - protein, 331 aa, Heterodera glycines
  Coding regions on vcDNA: vcDNA=SeqID_84708; Strand=-; Position=1 -47,107-382,442-847,1060-1324
MSDNRKEAEEKMEKAIFISADCWLSVFDLLPPRQLGLGIALVSHRFDFYIDEHFKTRRWALKPMEIKAKFEADGTNGWEIVNFNRKPLPTPQKALPKKVVGFKRISIKYVDQNAIAFLCRFRQLFASCPIKLVIYTGGDRTLEFILRKFWPMIAKNICAIQLYGRIFYRLRQSVPSILNDCPSLRIINSYSGGFFAEFPADDSAMASDGQALDKWLFTPRPDNVPKVLMDDGNLSSRIEALKAAFANASSPVNFIVIWPPRLADSVVPFDQTNELTREQLTLKGTDYCYLLLLVRCPIARDASKWAKWEKEAIDWQFNDQWNRIDIQINNE

SEQ ID NO: 158286 - protein, 182 aa, Heterodera glycines
  Coding regions on vcDNA: vcDNA=SeqID_84709; Strand=+; Position=1-546
  Homolog annotation: Hit_ID=NP_002448.1; Match level="QueryCoverage =91%, HitCoverage=56%, E-value=2e-32, Identity=40%"; Hit description =mucin 2 [Homo sapiens] gb|AAB95295.1| mucin [Homo sapiens] sp|Q02817|MUC2_HUMAN Mucin 2 precursor (Intest
MSLFAMGLLPSKTTPSPNGTTPSPPTPPNGTTPSPPTPPNGTTPSAPTPSNGMTPSPPTTPNGTTPSPPTPPNGSTPSPPTPPNGTTPSAPTPSNGTTPSPPTPPNGTTPSTPTPSNGTTPSPPTPPNGTTPSPPTPPNGTTPSLPQQPPPVATAPSPSPPVGNVLPLLANGQYAVGCADIM

SEQ ID NO: 158287 - protein, 397 aa, Heterodera glycines
  Coding regions on vcDNA: vcDNA=SeqID_84710; Strand=+; Position=1 -73,340-1460
  Homolog annotation: Hit_ID=NP_502721.1; Match level="QueryCoverage =91%, HitCoverage=27%, E-value=2e-16, Identity=25%"; Hit description =endonuclease/exonuclease/phosphatase family and RNA-directed DNA polymerase (4O953) [Caenorhabditis elega
MTKDQLSERRKLIEECGKKRQTDNETEKIDILLITETWTKDGEEIDFCPWVKENYNYIFSSRKSKTSGGGCGILIRKEIGFFTKFSDSKFNSEILVIQLQNLQCIRFVLVYRPPKTTLKQTENLFKFLQKFFNENSVTLGDFNLPNKDLVWKNGHPYSMSKYGEIFCDFFNRFSYVLATNEPTRINSWLDLIFTANEKIITDCTVKGGIFSSDHLTQFFTLITPKTKPKTKIVNFRWFCPSNVLHFNIVIASRLNALSYECFSINQKYSAFNSMLLEILNECIPIKRLTKKDLTPKYPQHLLASIKEKAKLFRQAKTDPSKKALYDSISLHIKIQTNKYHSQIEKKAISKGRNSIYKYIQKFNVNPFEIPNLIYENKCYHNSAEKSELFATIICQFI

SEQ ID NO: 158288 - protein, 111 aa, Heterodera glycines
  Coding regions on vcDNA: vcDNA=SeqID_84711; Strand=+; Position=1-333
MAALVEQCLALANILRGYAFLPGHERTLAAHGGLLRLLSALMMLMVDKKQQKRAKPTTKRTAETAAKSGRDNDEIGTDTPVPGDHHQQGIKLNTNCNDTSIATTLEEGVEQ

SEQ ID NO: 158289 - protein, 30 aa, Heterodera glycines
  Coding regions on vcDNA: vcDNA=SeqID_84712; Strand=+; Position=1 -28,569-633
MYETQLFFKFLIYRRCNSRAATDERILIYI

SEQ ID NO: 158290 - protein, 186 aa, Heterodera glycines
  Coding regions on vcDNA: vcDNA=SeqID_84713; Strand=-; Position=1 -219,343-429,476-537,724-766,812-849,1984-2006
  Homolog annotation: Hit_ID=NP_492427.2; Match level="QueryCoverage =85%, HitCoverage=18%, E-value=4e-54, Identity=62%"; Hit description =abnormal ThermoTaXis TAX-2, cyclic nucleotide-gated channel (92.4 kD) (tax-2) [Caenorhabditis elegans] gb
SLLQKASSDMLSHYLQSGVFKLDLLSLLPLDALYFFTGPVSAWRFCRLFKLHSFWEFFDLLDSAFSNPYAVRIAKTFCYMIYIIHCNSCVYYVLSAWQAFGQIPYFYKGKWYLNKWQIPYFYKGKWYLNKWVYNNEGNAYIRCFYFTAAVATSTGNNPMPTNVKVATSTGNNPMPTNVKEKLGFWC

SEQ ID NO: 158291 - protein, 258 aa, Heterodera glycines
  Coding regions on vcDNA: vcDNA=SeqID_84714; Strand=+; Position=1 -210,721-1287
  Homolog annotation: Hit_ID=EAK87696.1; Match level="QueryCoverage =99%, HitCoverage=70%, E-value=2e-31, Identity=33%"; Hit description =large low complexity coiled coil protien with large repeat region [Cryptosporidium parvum]
MDKLATTLEEADKKWQLFNLSKEFFADGELSAFQRTIETVKNWFEGAKKEAEQLKDNQDATFSTDDLKTKTNSIIGEVRFLTSKYYAAALKQREEAEAAAKKAKEEAEAEAKKAEAEAKEAEAEAVEKKEEEGEVKKEEVEAKKEADEDKKEAEEVKKEEAAEVKKEAEEDKKEAEEVKKEEAAEVKKEAEEDKKEAEEVKKEEAAEVKKEAEEDKKEAEEVKKEEAAEVKKEAEEDKKEVEQDKKEAEKDEAVKSEL

SEQ ID NO: 158292 - protein, 374 aa, Heterodera glycines
  Coding regions on vcDNA: vcDNA=SeqID_84715; Strand=+; Position=1-1124
MGQSSSESKRSDDKTEQQNFNEMAALSSPKASNGMPISDFCYEIFGDDQFNNLTSYLDEIDGFESNLFDGLLQENDEQFPITDFKITEKQFSGSNQTLAEQYDEANTSRTVSEQLQQGENIENTQEKSIGSDQGTNSNSENFQGPIPDHNIVVVQSPKQHEYTVLHQEREKEIKIDTVSVQPKRKSPNKGASKKIKENRKKAFDDSQTKPTQKVKPNAEKQHQKIKQVLSVTKGVQKSTSAMANHGQKLKKSNSFSKMLNNENVEHVLTRPIPGSSHTANYQRQSNASSPINIQTAHMTVSSPANPTQIQTGTSNSPDLGWKTQKSLPKLNMTKVAKLLDINQNSPQYSNSPTTVLNPATVPNSPLMSSQPRTP

SEQ ID NO: 158293 - protein, 390 aa, Heterodera glycines
  Coding regions on vcDNA: vcDNA=SeqID_84716; Strand=+; Position=1-1173
MRQTENDNIVNADNNTSDRLQSQHSVSDYLKNSPSYPNLETTVASTSQSVSSTNNNYAEAGHYNSISPTVDATVKSMPPPQFSNPFASKSQNMNATDQLLAINKAARNLWTSQQNSTTNVTISGLRLPQLPITDANVRQLNSQPNNATVYMPPQQLSNPIASTSQNLSATDHLLAINEAARNYLRSQQNPTTNVTVSGLRPSQFAVADTNVKQLNSQPNNATVSGLTTEQMATADAAVKRLNSQPNTVSNATVSDLTPEQWALVEASVKRLTSKHADDANIATVKGQTPTRVATVIDNTVHSSQIQSATNAGRDAQPINSPQNNVLTRQSSLEFINEQSFITAANKTAAKGTYLRKSHSTTVPHSIFTVPPVPQFGKEQFPNCCFSGIIF

SEQ ID NO: 158294 - protein, 152 aa, Heterodera glycines
  Coding regions on vcDNA: vcDNA=SeqID_84717; Strand=+; Position=1 -79,162-504,718-754
MPRYVEKIAKRADFKKRPSTPPQYITGKSTPIGNNPAEAQIQNQIIEPLNTVPTTIIPSLAVGGKVGETSDNLKIEQLSIGLELAKLALNATIPPLIIGTTATHVNDYKQILKMNFACLMLNKSELDIDQLYQNAINSNFSRKCKKFKVFFE

SEQ ID NO: 158295 - protein, 31 aa, Heterodera glycines
  Coding regions on vcDNA: vcDNA=SeqID_84718; Strand=-; Position=1 -23,57-129
MSKIKSLGSSSGYLFLFLRSDLLKFLHHHLI

SEQ ID NO: 158296 - protein, 25 aa, Heterodera glycines
  Coding regions on vcDNA: vcDNA=SeqID_84719; Strand=-; Position=1 -75,162-164
MSNRCAHNVAFVQCILPHREYLFSK

SEQ ID NO: 158297 - protein, 102 aa, Heterodera glycines
  Coding regions on vcDNA: vcDNA=SeqID_84720; Strand=-; Position=1 -157,527-678
MGHRCNQCSACPVRMGCAWKRQFQCRVSHPTNDVPIYFRCIVFLQLRKVMAKAVKNIRRIFRICRTGLVFSKTTGFRIQSLKIRSIYVIRSIPIFQISGSRT

SEQ ID NO: 158298 - protein, 87 aa, Heterodera glycines
  Coding regions on vcDNA: vcDNA=SeqID_84721; Strand=+; Position=1 -82,814-992
MIGRADIEGTKSDVANDAWPPQASYPCAPTEVHTLTSIHAAEALHKQLSPLVHAPSPKEQHAATGKSRLFHATARLTRPLEPILFPK

SEQ ID NO: 158299 - protein, 166 aa, Heterodera glycines
  Coding regions on vcDNA: vcDNA=SeqID_84722; Strand=-; Position=1 -286,461-672
  Homolog annotation: Hit_ID=CAE61620.1; Match level="QueryCoverage =92%, HitCoverage=32%, E-value=2e-21, Identity=39%"; Hit description =Hypothetical protein CBG05546 [Caenorhabditis briggsae]
VQGFEVVKTGFMAALPPLGQAVMKECAGLINDRIPARIMSETVKTKLFNSIAFMSMSAVIVAVSFVPSGYGNLALFLLTFSAFTLGFNIGGFYKSALPFPIPSSFRLTVPVIVNPLTINNTREEWALAFYVNAAIIVACNIFYVCFAKAELQPWATIQVQMNGTEF

SEQ ID NO: 158300 - protein, 227 aa, Heterodera glycines
  Coding regions on vcDNA: vcDNA=SeqID_84723; Strand=+; Position=1 -302,361-453,508-796
  Homolog annotation: Hit_ID=CAC84371.1; Match level="QueryCoverage =65%, HitCoverage=29%, E-value=2e-10, Identity=28%"; Hit description =hypothetical protein [Saimiriine herpesvirus 2]
MNSGVSPTPFLSLRCVCSVLVLLICAFDVSLAAKDKEKNGKEEPGGQFNTLSIILLIPLVIVTGAFVYLLFMKPKSEGTGDDDGEGEGDADVEKGPTEETKTEPRIESPATLLGVTVPLEQDEEEQKKDDEGGDQTAEKKEEDAAAADEQPKEGAAEAAEAEKSATKEETTEDTEETTETTEGSTTETSDSGSGSSSASGSDSEGSSGTSDATSEATEDASSSSEGS

SEQ ID NO: 158301 - protein, 169 aa, Heterodera glycines
  Coding regions on vcDNA: vcDNA=SeqID_84724; Strand=-; Position=1 -93,150-213,363-425,660-823,871-996
  Homolog annotation: Hit_ID=XP_514667.1; Match level="QueryCoverage =94%, HitCoverage=76%, E-value=2e-19, Identity=36%"; Hit description =PREDICTED: hypothetical protein XP_514667 [Pan troglodytes]
MVTDSKEDIVFFARVCKKARRYDDMTEAMKKMIQADANLNSEERELLGTAYKGGGRVPDEDGVRTAHHLPRYFAVMDLSKHAYQDGLEIATKEMKPSNPTRLGLAHNFAVFHFEVLKLPAEARQLAQKALDEAMAEIGTNEVAGETDADLQLIREVLNAWKLLDFAADA

SEQ ID NO: 158302 - protein, 31 aa, Heterodera glycines; identical to SEQ ID NO: 129513
  Coding regions on vcDNA: vcDNA=SeqID_84725; Strand=+; Position=1-93

SEQ ID NO: 158303 - protein, 200 aa, Heterodera glycines
  Coding regions on vcDNA: vcDNA=SeqID_84726; Strand=-; Position=1-601
  Homolog annotation: Hit_ID=S42886; Match level="QueryCoverage=76%, HitCoverage=70%, E-value=7e-37, Identity=47%"; Hit description =collagen - silkworm emb|CAA83002.1| Collagen [Bombyx mori]
MLSTRFAVFVFIFALLILEIDGCYRRRKKDKDSNESGEKKHAKKEDKESNKSGKRGPRGPPGRPGKNHEGKEGPPGKPGKPGQPGEPGQHHESKQGPPGKPGQPGKPGQPGKPGQPGQHQHHEGHQGLPGAPGEPGAPGEPGQHHESKQGPPGKPGQPGKPGQPGKPGQPGQHQHHEGHQGLPGAPGEPGAPGLPGTHGN

SEQ ID NO: 158304 - protein, 26 aa, Heterodera glycines
  Coding regions on vcDNA: vcDNA=SeqID_84727; Strand=+; Position=1 -37,162-205
MEIYACFRFYNIVFRRMEVYAFFFNF

SEQ ID NO: 158305 - protein, 98 aa, Heterodera glycines
  Coding regions on vcDNA: vcDNA=SeqID_84728; Strand=+; Position=1-297
MKNEFKQNRKYSQKEWEKNYAEICKKIGVGYVTIKKWKKHFGFRYMRITEKEKMEKIKIYWQMKRKNPKMTDKEIAKTLKIHQNSLRKWKKQFGREEK

SEQ ID NO: 158306 - protein, 38 aa, Heterodera glycines
  Coding regions on vcDNA: vcDNA=SeqID_84729; Strand=-; Position=1 -177,524-663
LLKIFFSNFHDFSMNFQHFYNFFCHSFFVFLFLFVKTF

SEQ ID NO: 158307 - protein, 45 aa, Heterodera glycines
  Coding regions on vcDNA: vcDNA=SeqID_84730; Strand=-; Position=1 -103,211-245
MPLYGLSGAAVIEGPENPSVKDNPLAMDNPSWIILALYFNQWTFS

SEQ ID NO: 158308 - protein, 446 aa, Heterodera glycines
  Coding regions on vcDNA: vcDNA=SeqID_84731; Strand=-; Position=1 -27,661-1974
  Homolog annotation: Hit_ID=AAN87269.1; Match level="QueryCoverage =77%, HitCoverage=12%, E-value=7e-32, Identity=29%"; Hit description =ORF [Drosophila melanogaster]
MESTSKFNHATLDLTSESFINVLRRFISRRGKPDIIWTDNATTFKLAQKTLELLSAPGPDQEVQNFLTQNRIKWSFIAQISPWAGGFYERLVKLVKDCFKRTLGRRILSFDQLNTFVAEVEATLNYRPITAVSDAVDGPVPLRPINLLQPEIHINWETTTDPIDSEEMFSSTHKRLASRIKALREANDIFWAKWHSEYLTLLRERAQWDHKGPRLQNFGEPKKGMVVLISQDLVPRNQWPMGRIVETHGRPGAIRSVKVEIPVRGTNNRKPKDMPRKTVLTRPVNRIFPLEAGPEMTDPGTEAVAATEQPNENHPKLAREPGHQMVTRRKAKLLEMLPVVAMTLLTLALPFASGFPIGKCDECGLTCYTKGIVVTVPPEIQKFEICCAESCIVRQGIKALNFELPIEVLLNNHHCEARLFLPFSKCFTAYSNFLANFGIILVPFFC

SEQ ID NO: 158309 - protein, 122 aa, Heterodera glycines
  Coding regions on vcDNA: vcDNA=SeqID_84732; Strand=+; Position=1 -73,132-427
  Homolog annotation: Hit_ID=NP_004587.1; Match level="QueryCoverage =86%, HitCoverage=37%, E-value=1e-40, Identity=73%"; Hit description =small nuclear ribonucleoprotein polypeptide A [Homo sapiens] gb|AAH00405.1| Small nuclear ribonucleoprote
MAMADVKPNHTLYINNLNEKVKKEELKKALYAIFSQFGQIIDILAFKHLKMRGQSHVIFKEINSAATALRSMQGFPFYDKPMRIQFSREDSDVISKAKGTFVERLRISYYNFFFQKNPCKEP

SEQ ID NO: 158310 - protein, 72 aa, Heterodera glycines
  Coding regions on vcDNA: vcDNA=SeqID_84733; Strand=+; Position=1 -84,713-849
NDGGVQDEAIVEGQQLVDLGNIDELLAGIRHTLVNLRDSANAEIDRIDGRLQGGYAASGVFVGIREYGIPFY

SEQ ID NO: 158311 - protein, 52 aa, Heterodera glycines; identical to SEQ ID NO: 148524
  Coding regions on vcDNA: vcDNA=SeqID_84734; Strand=+; Position=1 -18,434-574

SEQ ID NO: 158312 - protein, 43 aa, Heterodera glycines
  Coding regions on vcDNA: vcDNA=SeqID_84735; Strand=-; Position=1-173
NYTSIETPRAIELYQELLIWLKMDQVMNLYVLHFFVFLPHGGF

SEQ ID NO: 158313 - protein, 200 aa, Heterodera glycines
  Coding regions on vcDNA: vcDNA=SeqID_84736; Strand=-; Position=1 -105,439-544,855-1037,1542-1657,1931-2021
  Homolog annotation: Hit_ID=XP_372784.3; Match level="QueryCoverage =75%, HitCoverage=21%, E-value=7e-14, Identity=26%"; Hit description =PREDICTED: similar to stromal cell derived factor receptor 2 [Homo sapiens]
GDDAVTYCVLTGNGRVEARLSVNPANTKNNVPAPAFRQHSNNGPGKDLARPNLHKAYYLFLAKGPAEEPHTIGIHSLDSDDHAVFPHISARPIVPLDASSLTKQPKQQQQQQPAPPQNHGHGGGLTLIDVHGIMMVIAWLCLTSVALYSARFMRSAWPHTTIMGLKIWFHIHRTLNFLSVIVMVVSVLLVVLFKGRWTAH

SEQ ID NO: 158314 - protein, 99 aa, Heterodera glycines
  Coding regions on vcDNA: vcDNA=SeqID_84737; Strand=+; Position=1 -206,411-502
MADDDGLDSSGHSCASAGFTPKVQHGGGGGTVGTAAAAAQASASSTGVAPVHRLTITDLKAPWTIENRRDNCLVIAKGVQKAHIGFSSSTCMSLLAYIV

SEQ ID NO: 158315 - protein, 125 aa, Heterodera glycines
  Coding regions on vcDNA: vcDNA=SeqID_84738; Strand=-; Position=1 -16,273-498,544-679
MLLAKPQPNSNSNQLNIRIFRALFFIISVNVGGYFLKLIHITMIIPLLNNDIIEIWNQNQIFGILLNISCISNAPILFWTSSEYRQAFVKECRRSEINSNCFIRHKFCTTLLMSFHTDAKVRKNF

SEQ ID NO: 158316 - protein, 117 aa, Heterodera glycines
  Coding regions on vcDNA: vcDNA=SeqID_84739; Strand=-; Position=1 -43,215-440,486-570
MDYKMIMMSCFFHYAPPNSNSNQLNIRIFRALFFIISVNVGGYFLKFIRITMIIPLLNNDIIEIWNQNQIFGILLNISCISNAPILYWTSSEYRQAFVKEGQKIRNLLFSTNSVQPF

SEQ ID NO: 158317 - protein, 33 aa, Heterodera glycines
  Coding regions on vcDNA: vcDNA=SeqID_84740; Strand=-; Position=1 -95,386-392
MPSAIHSLPNKKPFLATLCALGLVRMPHHWLFN

SEQ ID NO: 158318 - protein, 74 aa, Heterodera glycines
  Coding regions on vcDNA: vcDNA=SeqID_84741; Strand=+; Position=1 -85,590-729
MLSSSEAPHSSAAASSSTEKNISKEKNIQIKLFQKLSNRLAVSKGQCAICLGDLVDLEANTTVKQLPSCNVNKL

SEQ ID NO: 158319 - protein, 78 aa, Heterodera glycines
  Coding regions on vcDNA: vcDNA=SeqID_84742; Strand=+; Position=1 -9,310-537
MAKHLILGFLNRIYCPNVRLRLKVRRNTDKNRVPDRARIPRLFQDLASVPRPDFLKSNTRYPPELVGPSPTGSKNTLL

SEQ ID NO: 158320 - protein, 257 aa, Heterodera glycines
  Coding regions on vcDNA: vcDNA=SeqID_84743; Strand=+; Position=1-774
MVDVDDLEVKFEALKLKVNDLEDKLANKPATNLPAGVKTPKYDATGDLFKFLREFNLMATASNWHATDCVRMFPLFLEGEAKELFLNIPPDKKKTWRDLTNAMADQTKKIDGPMWAKKLLARAKMGHESITEYANKIRELVEQASPDPNYTSEARECESVHYFLNGLPTFLKRKIFFMKKPKTLVEAISMAKEVNQAREELANDEKGDEIKQQINEIREQISVISSQNNGNNENQREFVNRSWRNILKRKFLDRGEK

SEQ ID NO: 158321 - protein, 862 aa, Heterodera glycines
  Coding regions on vcDNA: vcDNA=SeqID_84744; Strand=+; Position=1-2589
  Homolog annotation: Hit_ID=BAB64297.1; Match level="QueryCoverage =81%, HitCoverage=5%, E-value=3e-13, Identity=22%"; Hit description=I- connectin [Procambarus clarkii]
MKICGLRIIPKKSNMFGQEKNVQQQVNNFIEKGHGGILDFYLITSFGHKMNPYRGWEEMNSQTFIWEIPEPTDTYWATHFPVGNFLAEITDDAIVIESEQSVFYFEKEHPEEREGIIGIPDDAFKMTNDAFITIQVKQKAKREAKQKIEPKKKERPVKQEVVFFKFRQNKGNESVVNPTIQITREPNISQEEIKKERENAKEIISEIPTMPKPDQPKETKIAVAPTNFPITTTVRNVLTEQTKITTSTTPKTKMAAVTKAPKTVPNSKVENQPFSKGWIKLKQTEQKYMIKGVNFGKIDTTIIPVTKTAKNMENTTATTAKTPLMSFTTIKPKKEKTPKNISNSVFENEKSKQGNKTKTQTKGTKEEKHPKMVKIGKELDGKTMPEEEKVPKIVTNQKPKEKGVTKNITTTQTPKMTTIKTISTTTPKPKVEEIKAKKALPNQNTTLSTISVTNFSKNSEKELIKTETIEIKNESGEKDLQFRKLSEGDEKESDDVIFEKVKDNLENENESDEYENMENSAEIENEYELDRGENQFEFMEIERNKRTTITTPDAKWLSKLKKSEKRIKSGQENKNLNTRVNYALYRLNEDRKKQYENIFLQACENTKFQLQLAKAILQINPNEGVRKIFDRDDLVARWVGENLEVGFCVPITPEKIFWSKKIGNECYEWTPILAENTTFFVKPGSRELSILGKKVGCAEMEEYVMKNDTQKEAITKISTNFEKIRPKYRNIQNPLVLKAGTLYESETKRIETAMLEYRARMNTLPSATLRIIQKPNISEVIKVIKEEASETMEIVMGKTGNWFEMVKNIPEKAEEAVNYLKGASFLLILIPILILLALIAYVMVKYRLIIFAGFRAGRFLTE

SEQ ID NO: 158322 - protein, 472 aa, Heterodera glycines
  Coding regions on vcDNA: vcDNA=SeqID_84745; Strand=-; Position=1 -110,1387-1436,1511-1700,1746-1874,1919-2023,2072-2233,2349-2392,2443- 2547,2606-2738,2782-2870
  Homolog annotation: Hit_ID=XP_315111.1; Match level="QueryCoverage =88%, HitCoverage=32%, E-value=5e-63, Identity=36%"; Hit description =ENSANGP00000011447 [Anopheles gambiae]
FWKIQDLQDNPAGSCPVKILNSNPAHGESILGSKYNEKPRLSNLEMFKEELKQMQAMRDERMQAMRDERKGLRQHLKERLNMPEEELTESHHLDQPYGPSISDPYGEDDPNTTNLYVCNLPADAKLEDFFDTFAKLEDFFDTFGTFGPLASARILYPRPEDERRYRETLSGFVAFMSRTDAERSKCAMHSRTDAERSKCAMHQETIRNCELRVSWARSVNMPPLPFFVPLPLRELAMPDPPSGLPFPLPFFVPLPLRELAMPDPPSGLPFNARPVTEELRSFLQNYGDLPKLGVPLTEEEGEMIENATVRVVIPTERPLLTLIHRVVEFLVRSGPPLLTLIHRVVEFLVRSGPLFEAILMARERQNPMYRFLFFLFDNHHPTHVYYRWRLYTILQGDDRQKWRLEKFKMFEGGSWWQPPPHALFEQGMPPQLYGGAYVPKRRQPPPHALFEQGMPPQLYGGAYVPKRRRDKP

SEQ ID NO: 158323 - protein, 26 aa, Heterodera glycines
  Coding regions on vcDNA: vcDNA=SeqID_84746; Strand=+; Position=1-119
LFKLKLCTISATKNIPILYRSNTFGN

SEQ ID NO: 158324 - protein, 97 aa, Heterodera glycines
  Coding regions on vcDNA: vcDNA=SeqID_84747; Strand=-; Position=1 -8,205-481,537-545
MILFISADCWLCVFDLLTPSQLGHGIAMISHRFDIYVDEHFKTRKWALKFIQIHSKIGKNGTKEMDIVNYGGKALPIPQNPLPKESRRISTDQHLFH

SEQ ID NO: 158325 - protein, 105 aa, Heterodera glycines
  Coding regions on vcDNA: vcDNA=SeqID_84748; Strand=-; Position=1 -279,957-995
MLKVNGPSFNVHIIPLSREAMAISDIENPYAPQKLYSLAKNVALDSLCHFRDEETNRCILNYFETFEEKQSAVVGFLSKWPRNSNFAAGLTEKCHFNTFLQEITH

SEQ ID NO: 158326 - protein, 131 aa, Heterodera glycines
  Coding regions on vcDNA: vcDNA=SeqID_84749; Strand=+; Position=1 -228,278-442
  Homolog annotation: Hit_ID=AAC47063.2; Match level="QueryCoverage =76%, HitCoverage=14%, E-value=2e-12, Identity=37%"; Hit description =Ubiquitin conjugating enzyme protein 17 [Caenorhabditis elegans]
MPFFQILLELCAALASVPALLPKIVLPQDAHGKSIAKQLIPQFRNNLNNYPTLMSGISEADLSFMDFIRKVNDYSEVIIRLARQFERQIPAEKRVKTSHSHRYFTRIGADRVRRLRNASATVPSSTGPSSA

SEQ ID NO: 158327 - protein, 115 aa, Heterodera glycines
  Coding regions on vcDNA: vcDNA=SeqID_84750; Strand=+; Position=1 -227,404-523
CPRSFGRAIGKFLDFVMGSAHSSANPSSSVSSCSSPTNFREKHTPDSLEDKIELIFELLEKKPTRLGYSIQWAVQLLANATEEEKLEMLRCRVLSRICALITRYSNVEVAAPPGT

SEQ ID NO: 158328 - protein, 140 aa, Heterodera glycines
  Coding regions on vcDNA: vcDNA=SeqID_84751; Strand=+; Position=1 -208,1021-1232
MGKRKNKICESIGKGTSVVSPAQWCQKCRPFPQIFCTCTSGQALRFLLKRWFCPDLVVMDEASQMVECASEAFCAVLHLHALNLFGGLDLSKIGCITPYSAQAEKIQKLMAMGRDEGPRFEVSSVDALPGQQREAIVMSL

SEQ ID NO: 158329 - protein, 68 aa, Heterodera glycines
  Coding regions on vcDNA: vcDNA=SeqID_84752; Strand=+; Position=1 -103,605-708
MEKYGNMDINREIWKNMDMESHPRSFKPSLKHVFRPRKTILVYINSLRIEYLGKCLLVPIFRNLGKNL

SEQ ID NO: 158330 - protein, 29 aa, Heterodera glycines
  Coding regions on vcDNA: vcDNA=SeqID_84753; Strand=+; Position=1-88
SCSWRVRIALHLKGIEFDQRIVNLLNGDQ

SEQ ID NO: 158331 - protein, 129 aa, Heterodera glycines
  Coding regions on vcDNA: vcDNA=SeqID_84754; Strand=+; Position=1 -97,735-1027
MPNEWEEQRMCGRLLIQALKMVCNHQYAQPNRDNFYETTGVLLRVRRSSASRAYVVKRQRSPTDDGAAPMAAPHGAMGRNRRGIIWECCTNKCSLNYIRNNYCAAPPHQSEQTEENAAFQLEDERRRRK

SEQ ID NO: 158332 - protein, 47 aa, Heterodera glycines
  Coding regions on vcDNA: vcDNA=SeqID_84755; Strand=-; Position=1 -87,840-896
MLKANGDECAICLDAYQEGQMIRQIPPCQRTNAKLNSEFCAMKMCDF

SEQ ID NO: 158333 - protein, 44 aa, Heterodera glycines
  Coding regions on vcDNA: vcDNA=SeqID_84756; Strand=-; Position=1 -15,290-409
  Homolog annotation: Hit_ID=CAE58753.1; Match level="QueryCoverage =97%, HitCoverage=10%, E-value=2e-12, Identity=69%"; Hit description =Hypothetical protein CBG01945 [Caenorhabditis briggsae]
MAREQLGGCGVGSICINLPGSFKCDCLPGYQRVDERNCVDLIRI

SEQ ID NO: 158334 - protein, 72 aa, Heterodera glycines
  Coding regions on vcDNA: vcDNA=SeqID_84757; Strand=+; Position=1 -154,1238-1302
MASRQTFGVRVTNFTLAVGTMVDIHTDGATMVGQCLLLGTVQRGTERGISNSLFFISLNEFCQFSFSATGMI

SEQ ID NO: 158335 - protein, 84 aa, Heterodera glycines
  Coding regions on vcDNA: vcDNA=SeqID_84758; Strand=-; Position=1 -84,180-350
MASFLSILPFLVVSAQFGRGNFLLDHLKSAKLTELFMARNLSLEFDFRQSNFTQFDLFNLKDGDQNLLFRIESSTITTPNEVPN

SEQ ID NO: 158336 - protein, 238 aa, Heterodera glycines
  Coding regions on vcDNA: vcDNA=SeqID_84759; Strand=+; Position=1 -204,244-504,658-909
MAILLPFEYFVVQKVYTFAHKVPLENLCQGNNQCILNYFESFTQKENELSKIIDRWFNANEFAYFTEKDNFFLSAILKELVNEFKISENNGNRIGGDYANLLGIFSKAFIEENNPLMNIVKLRLAEEQMIDIISEMCQTIKKIPNSKQFLIEQFNILELKNFCDKWAPVHQKMLHFSEPKIANNALGHWLRQNVNDGKELADEERQIVNFWMTVLSSKMHYLCSKWMPNDIIMLTNIG

SEQ ID NO: 158337 - protein, 44 aa, Heterodera glycines
  Coding regions on vcDNA: vcDNA=SeqID_84760; Strand=-; Position=1 -65,128-194
KRARSARLEAAKRPNVLNKIKKRARSARPEAAKRPNVSTKLKNG

SEQ ID NO: 158338 - protein, 150 aa, Heterodera glycines
  Coding regions on vcDNA: vcDNA=SeqID_84761; Strand=+; Position=1-450
RWNNISLTPIGVTFPPAPVLNSDFVFDGSNIALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQIALELHQSLCTILPLNISGCY

SEQ ID NO: 158339 - protein, 151 aa, Heterodera glycines
  Coding regions on vcDNA: vcDNA=SeqID_84762; Strand=-; Position=1 -68,1065-1131,1181-1309,1358-1548
  Homolog annotation: Hit_ID=AAG45917.1; Match level="QueryCoverage =78%, HitCoverage=12%, E-value=3e-64, Identity=97%"; Hit description =guanylyl cyclase [Heterodera glycines]
MLGHLAANSNIPMLVWGQSMSSNNNSNTLDGRNADAEVIGRLALWWHYDITLSALSNQNYYGFFKRVIDRTGDWPFYCDESNCSKVINASIYSLLLYDAIYNYGMALNESFRQFGIRPEVYRNGTLLARNNRKPFMGKKCKRKPNFESICL

SEQ ID NO: 158340 - protein, 138 aa, Heterodera glycines
  Coding regions on vcDNA: vcDNA=SeqID_84763; Strand=-; Position=1 -94,487-575,640-715,1085-1131,1184-1292
MSSNLFRSVEPMEMTDPIISNESPPMARVGQYRGMQRKMTKFIILTVVNITVTVGLLGFITIENGRTNAELEILKNSVGKLEQHGKELLKAVHPDIRKNIAENFSNPKQNCWDANAIHNDLEIFGSESLKVHYKGDGS

SEQ ID NO: 158341 - protein, 116 aa, Heterodera glycines
  Coding regions on vcDNA: vcDNA=SeqID_84764; Strand=-; Position=1-591
SRAVFGACGVACALMALGLFLIRSRTRRSGAGLVGAGFKKQQHHQAIPSSSMMSSSRRHWKESSQFGKGAKIGDAFENWVLRKFGHFGSPFVRYSLAWNSLGPSEHFDILLSSRLD

SEQ ID NO: 158342 - protein, 111 aa, Heterodera glycines
  Coding regions on vcDNA: vcDNA=SeqID_84765; Strand=-; Position=1-336
MGEKPVSSIWRASPATTEEQKLLQDLFQKEKPIKNVPWEEKPFPTVWTEEKPLLSEEKLTYDNGRRLRDVGGLVKPSPAGAGWQQRRRLYGWRPSAHFGAAAENGQIRRRF

SEQ ID NO: 158343 - protein, 130 aa, Heterodera glycines
  Coding regions on vcDNA: vcDNA=SeqID_84766; Strand=+; Position=1 -85,281-588
MMAFKCHFVLSLLLFFCASSFLVYGGGKDASSGSNNSEKKSLADLMVEERLADRDGKPLNELLKFDKIDKKELDAFLKENGELLDISFDDYNPQNVQLGDHDQVSVLFSPPSAASPAEVGSECHPIFVPF

SEQ ID NO: 158344 - protein, 92 aa, Heterodera glycines
  Coding regions on vcDNA: vcDNA=SeqID_84767; Strand=-; Position=1 -78,572-772
MPSSAPEIPPVQCFHHIEFFVSNAKQTLQENGLELLAPKQMTTDQNGCLFVAKIAGSAGSIAHTLIQNIDYRGLFMPGFRPIADFSLTSTLL

SEQ ID NO: 158345 - protein, 65 aa, Heterodera glycines
  Coding regions on vcDNA: vcDNA=SeqID_84768; Strand=-; Position=1-289
RWANHRSELVQWRKWGQWDEEKRKRSERRGGKGGATANDCLEKHSRLETAQRHKPIKELINELIN

SEQ ID NO: 158346 - protein, 66 aa, Heterodera glycines
  Coding regions on vcDNA: vcDNA=SeqID_84769; Strand=+; Position=1 -117,523-606
MYSFFDLGKKNFGYLVSAVSFLVFYKVSSNIKLKKAIEAGEKCANYESELRFCKIIDFIYDFSSST

SEQ ID NO: 158347 - protein, 22 aa, Heterodera glycines
  Coding regions on vcDNA: vcDNA=SeqID_84770; Strand=-; Position=1-66
MPLTIEEYQIGQLFSVAEASRQ

SEQ ID NO: 158348 - protein, 148 aa, Heterodera glycines
  Coding regions on vcDNA: vcDNA=SeqID_84771; Strand=+; Position=139 -181,247-470,685-864
MSLQYVGIAAVILGTAIALFQTVSLSTRRQIAAQNGRSSGSKRQSKSPSSAKTLAHKIAATVIAEKSLSSIPDKEILQLMDIGFQLLDEVLLRHPHRTAAAQAPTAAVPFAVPRRLRGPRRVQSGSHCAARLAEDPLLGQDHSAAWEP

SEQ ID NO: 158349 - protein, 37 aa, Heterodera glycines
  Coding regions on vcDNA: vcDNA=SeqID_84772; Strand=-; Position=1 -94,172-191
MARAKVTPTLCLLLHFVPLLTALQQQCSSENIASSCR

SEQ ID NO: 158350 - protein, 273 aa, Heterodera glycines
  Coding regions on vcDNA: vcDNA=SeqID_84773; Strand=+; Position=139 -181,247-470,1059-1181,1245-1400,1471-1665,1729-1809
  Homolog annotation: Hit_ID=CAE60846.1; Match level="QueryCoverage =64%, HitCoverage=40%, E-value=3e-14, Identity=31%"; Hit description =Hypothetical protein CBG04555 [Caenorhabditis briggsae]
MSLQYVGIAAVILGTAIALFQTVSLSTRRQIAAQNGRSSGSKRQSKSPSSAKTLAHKIAATVIAEKSLSSIPDNEILQLMDTGFQLLDERCNKLFTKLPLCAIISKTFLCMHGGLPRPEGWDFLMGDDFHKPKTDLEIDENNTFCDLLWADPTNNAQELRLSKDFEPDKGFLGEYGNYRFNQDRETSIQFNDRFAQEFFNRFPHIRGIFRAHENQPKGHSINEARTICTVFSSPRYMEDTDCGSVLRLSADMKHIHFVTLKPKATGEKLSQEE

SEQ ID NO: 158351 - protein, 38 aa, Heterodera glycines
  Coding regions on vcDNA: vcDNA=SeqID_84774; Strand=+; Position=1 -104,519-531
MTAMSVQGKGQNGKQKNGNAKKITFQMDKKSDSANKKN

SEQ ID NO: 158352 - protein, 47 aa, Heterodera glycines
  Coding regions on vcDNA: vcDNA=SeqID_84775; Strand=-; Position=1 -38,376-481
MVTFMETEGAVLNLDKDSNSLWSRTHVGRHCYRMQPICMEEETESPV

SEQ ID NO: 158353 - protein, 676 aa, Heterodera glycines
  Coding regions on vcDNA: vcDNA=SeqID_84776; Strand=-; Position=1-2028
  Homolog annotation: Hit_ID=XP_320889.1; Match level="QueryCoverage =86%, HitCoverage=71%, E-value=1e-123, Identity=39%"; Hit description= ENSANGP00000012033 [Anopheles gambiae] ref|XP_313651.1| ENSANGP00000013044 [Anopheles gambiae] ref|XP_31
MLEDAQKNGTNISLKKIEEELRAIQLVKESALSLVNPPIATNAINTRPRQWTDPAQRQSGSNQRQHHNANSNGKQTRGRPTLPCASCGKSDHWRSDCSFKDAICLKCNKKGHISTVCRQNKTKAPPNSHRSFHTVKVDTHCLHVGTTQGRWWKLIILINGRQTSMNGDTGAQATIISLQTWRELGEPNLTPSDIDAKNCNDQPLALLGKFQCTVQFADKPPQTLIAYVSGEVGHNLLGLPWIEALEIIPRQILFPTSKLAQATKMIENFSTVKPPNKSISDVTTLTTALQKDFPEVFEDGLGHCSKAKAHLILRSDAKPIFCRARPIPHGAMEAVNAELDRLLQIGAIKPIDFSHWAAPILAVKKKNGKTRVCIDFSTGLNNALELNWHPLPRPDDIYASLNGAKFFSNLDLRDAYLQMEMDDKSKQLCAINTHRGLFQCQRLPFGVKSAPAIFQHLMDQICAGIPGVFAYLDDGLIATKTLEQHITALYTLFGRIKEYGLRIQLDKCKFLQPELLFLGHIVSANGIRPDPSRSDAIRKMPAPIDKSTLRSFLGALNYYGRFVKCMRELRAPLDRLLQKNVAWNWTSEQQNAFEKAKEMMTSDLLLTHYDPARPIVVSADASKDGIGATLSHTFPDKKEKVVEHAACTLTAAQQNYSQIEKEALAIVFAVQKFYRM

SEQ ID NO: 158354 - protein, 250 aa, Heterodera glycines
  Coding regions on vcDNA: vcDNA=SeqID_84777; Strand=+; Position=1 -350,638-1040
MNVTDLNSTNFTVWRCVVVDCIGTKTVNEMIEMTFRITEDYEPQTDDEEIMVKVLKQCHEYFLKERFMVNFKEIMDNFVGVIVRIGFTNVHKFLESEFETKPNDFWDSIKKGIDEISSCFESDVKSEIWEPVNEKSGKQKMKQLSSSSSSSSWYEKQNQQEFLALEKHDILKEKPLRGELMLQAERVSAALLYTLIHMKMRLLFDRKQVKKGINISKTNISKTSAKVKSKMRKQLKRLQKTVVERINSVP

SEQ ID NO: 158355 - protein, 95 aa, Heterodera glycines
  Coding regions on vcDNA: vcDNA=SeqID_84778; Strand=-; Position=1 -107,151-331
LAAILLAKKSFWLFSALSAGSPCAPFVSSVGCKFQEFPVVAVYLHSLASSLAFSVQMYTKSLNDSMGYSAERNAPNSPKNIGTTATERRHGHWKS

SEQ ID NO: 158356 - protein, 23 aa, Heterodera glycines
  Coding regions on vcDNA: vcDNA=SeqID_84779; Strand=+; Position=1 -63,182-190
MSGQGNGGKGRGKRGAKGYRKGN

SEQ ID NO: 158357 - protein, 169 aa, Heterodera glycines
  Coding regions on vcDNA: vcDNA=SeqID_84780; Strand=-; Position=1 -162,214-479,541-622
MVIIWTICVVSTISAGQALYKWLHTPRKDGQPKRLRCAYFFRQTDFDWVNNFKEQFLRANAISSVSYEIHFSFLVPSMPMVPFELVNESTKEKLTFAKANEWDIDWIMKRCKIDETSSVQQQKKDENWDNVFIWLFAGTNCIGPLSPPPPAEEDEAGQSITKGTSSADK

SEQ ID NO: 158358 - protein, 258 aa, Heterodera glycines
  Coding regions on vcDNA: vcDNA=SeqID_84781; Strand=-; Position=1 -62,429-704,756-1194
  Homolog annotation: Hit_ID=AAL78214.1; Match level="QueryCoverage =53%, HitCoverage=72%, E-value=5e-13, Identity=30%"; Hit description =putative esophageal gland cell protein Hgg-20 [Heterodera glycines]
MPIFLLLLLIPFSHYFQSISRFICADCWLLVFDFLAPSQLGLGIALISRRFDVYVDEHFKTRKWKLGKMRICHKIGENGTKKMQIVNSDGNPLPILQNPLSNKVIGFRYIQINYIDQNVIAFLRRFHHFFAICSTDLYITTGNDRILEFILLNIWPMLRHSMHLMMFLNTIAFRRLRQLAPSLLNDCPSLHYVSFGDVILPEFPPDESANASDGQAVTKWLFTPRPDGLPKWLRYSVNSPVNQWSSTMEQFKAVIIPI

SEQ ID NO: 158359 - protein, 259 aa, Heterodera glycines
  Coding regions on vcDNA: vcDNA=SeqID_84782; Strand=+; Position=1 -183,300-896
  Homolog annotation: Hit_ID=NP_500013.1; Match level="QueryCoverage =62%, HitCoverage=11%, E-value=5e-09, Identity=25%"; Hit description =predicted CDS, polyprotein family member (4B673) [Caenorhabditis elegans] gb|AAC02594.1| Hypothetical pro
MLYIDKSMPVLIGVKAMRQLNALFGHFTTSWPNTFRRLSPTSMNFWMLLIFATTRQCMLQQKLVVAIRHAWHAAADEYAKAQRKMKEQYDRKARPQQITIGDRVLIRNYDGRVGTSKKFQLPWRGIFRVIKIEGIYVTVISCTSPNSNPKRLHLNQIKKCFEILGPPCTMPTQPIEEEKCLENTENADKAISKGSEIQNEMDPESREGENLEQIHPRGPETRPELEADEEKNEHKKTDTEPRKYDLRKRTRTWKDLVNY

SEQ ID NO: 158360 - protein, 100 aa, Heterodera glycines
  Coding regions on vcDNA: vcDNA=SeqID_84783; Strand=+; Position=1 -111,155-235,285-397
TNGIRITRQRSSARINWLTELTTRDSTPVTTTQTSKDFSEISKHLALVEDEDNIKRIQAKREKEAHERALAFVKNQLLNSRKDDWLHQPIEELLGYAPKY

SEQ ID NO: 158361 - protein, 99 aa, Heterodera glycines
  Coding regions on vcDNA: vcDNA=SeqID_84784; Strand=-; Position=1 -135,458-526,587-683
PKEAKFLSFLEQFTLCTMFRIFVRFVGTYPIAFLIFSLILASLSGKAKVAGIARDWTWTQENPDLDPVGIEGPSSGRVHADHVHVTLQNGRTQRISWLI

SEQ ID NO: 158362 - protein, 43 aa, Heterodera glycines
  Coding regions on vcDNA: vcDNA=SeqID_84785; Strand=-; Position=1-130
KTAKFLSFLEQFTLCTMFRIFVRFVGTYPIAFLIFSLILASLS

SEQ ID NO: 158363 - protein, 62 aa, Heterodera glycines
  Coding regions on vcDNA: vcDNA=SeqID_84786; Strand=+; Position=1 -113,209-284
MQLMMTQAAVLLIIPCTAELIPFIQQPVDCRCWHLSFWLAGEFRDGECSASWHVIHHQACVK

SEQ ID NO: 158364 - protein, 105 aa, Heterodera glycines
  misc_feature (98)..(98): Xaa can be any naturally occurring amino acid
  Coding regions on vcDNA: vcDNA=SeqID_84787; Strand=-; Position=1 -151,689-857
  Homolog annotation: Hit_ID=NP_504741.2; Match level="QueryCoverage =99%, HitCoverage=23%, E-value=2e-29, Identity=55%"; Hit description =neurotransmitter-gated ion-channel subunit family member (5H320) [Caenorhabditis elegans] gb|AAB69969.2|
FSASFTADVLMSQIWHDRRLRYSHMSNCHQNLTLSSAIVDRLWQPFVCFVNSKKSELHISPSANTFVLIYPNGTVWMNFRLRVEGKLIIFLIYEIKNXFKFELIL

SEQ ID NO: 158365 - protein, 127 aa, Heterodera glycines
  Coding regions on vcDNA: vcDNA=SeqID_84788; Strand=+; Position=1 -343,390-430
MTVVVFFLFLLAPICEIALADNKGNALHLNNHPKDVKTNTKKAPPKNSIKTNGISQKAPLHENANVLTGRNEKHHKDKKLPVHKNGNALPKNNDSSEFEDDLLSQALTHLRKMNEQLKNRNWPQNSE

SEQ ID NO: 158366 - protein, 90 aa, Heterodera glycines
  Coding regions on vcDNA: vcDNA=SeqID_84789; Strand=-; Position=1 -269,444-447
MQFSVTLAIFGIFSSLSFLANCRHLPNQNLNLPLPWKSLLLPQFMIRKIEREQMATILDAEQQIKHANIIDKGQSAEIEKVPSSAKDILS

SEQ ID NO: 158367 - protein, 422 aa, Heterodera glycines
  Coding regions on vcDNA: vcDNA=SeqID_84790; Strand=+; Position=1-1266
  Homolog annotation: Hit_ID=XP_320889.1; Match level="QueryCoverage =83%, HitCoverage=44%, E-value=4e-29, Identity=24%"; Hit description =ENSANGP00000012033 [Anopheles gambiae] ref|XP_313651.1| ENSANGP00000013044 [Anopheles gambiae] ref|XP_314
MALNPTIDQLVKMLADQQKMVQDQSQQIAQLIAIGQNAPNAAAQPNQGANSVPILPDISPFEPTDDKSRISEWIERFKFALDCTAPTADDEVKVKCLMNKLSESAFSEYSRSVLPSSVTDFSFKVTTEKLEKLFAKAQSIFIDRYECLKAVRGEGEQFRQFINRHRKLLTDFKFDELTKEQFNCLMLLMALKAPNEAALRQRILTKLSADGANISYDGVVEDLISFQSTISEAKAIEATSSSRPVNSIRQNSKPNNSTNKYVKESPKPNNLPNKFKERTNTEATTICWRCGFGVHRPDECRYKTSKCRKCEFVGHLDKQCERVQEWRKRQNAKKKGNNRVGHLRIGMTTHAVNSISLLKTAVLFNMKPVEFHLDTGSDIVVIDQLTHEYVGRHRSKNATKLARLSTAQKFPLLEKDSVHSNL

SEQ ID NO: 158368 - protein, 20 aa, Heterodera glycines
  Coding regions on vcDNA: vcDNA=SeqID_84791; Strand=-; Position=1-60
MLLLLLLNLLLLLNLLLLLL

SEQ ID NO: 158369 - protein, 130 aa, Heterodera glycines
  Coding regions on vcDNA: vcDNA=SeqID_84792; Strand=+; Position=1 -36,1047-1403
MLLEMSMRMGSKVIYFSLNKDMRAQLIRAIADCLNWACCVGDAAGLSRFGGIHSSIYGRASRRTQPGAESSSGGSVLLHKSSYGAGCMTEANRWRMNAWQARHGRHGMAYKIGAGWLSASRRFGSGTFCD

SEQ ID NO: 158370 - protein, 122 aa, Heterodera glycines
  Coding regions on vcDNA: vcDNA=SeqID_84793; Strand=+; Position=1 -212,264-420
MRISTGASVPSTPNPTTSDQNSPGPTEKRVGGVGTVLGMSKRISLPENLEFQPQMLLNLKQSIHVEKQLTSNSDTSDSASEMSVFEKPVLKASRLQHYQHQQQQKRKAARLQLLRQQAKSLN

SEQ ID NO: 158371 - protein, 222 aa, Heterodera glycines
  Coding regions on vcDNA: vcDNA=SeqID_84794; Strand=-; Position=1-669
MEFKIVLLFLLMLKNLNTIYAGGIKEEKNFDEIFGQRWDEKEEENGEIETDQNGINGQTNDQNGPTNIENFVQRLFVEESNQIFDENLEMKDEKSEEMSTNCDQLEQMTENSGQIYDQIPILNDKQKREIVEKFHKIKEKIKQMGKKFTRKEWHKIERKIAKKLGANQMKIYKWKREFGLIIKDSYSDDEKLKILNQFDQIYGKLKMKLNGKLHKKVQNAKK

SEQ ID NO: 158372 - protein, 154 aa, Heterodera glycines
  Coding regions on vcDNA: vcDNA=SeqID_84795; Strand=-; Position=1 -56,411-497,636-777,985-1161
MELRWENANDSLVDAYQKFNGETLYSLSSAASVRLKLKELQEQIIRLSNSIEVWSSSPSQQNNNGSPAETVGEAPSLRQMQLQKNIKMLALHTLHDVVSVGPDLPSVEQYEQKKLDNQQRAMVAMRRHSGAVMAPTNNQQQQHGTPTADHDDLL

SEQ ID NO: 158373 - protein, 91 aa, Heterodera glycines
  Coding regions on vcDNA: vcDNA=SeqID_84796; Strand=-; Position=1 -153,1403-1525
MALVAFASEMRISLTLWATFAFMIANVLEHLIRARADQFRFGSDASTGRAVNDRISQSSLQKVDNKKLGQFDGKKGQRDGQMNKQREKDRK

SEQ ID NO: 158374 - protein, 166 aa, Heterodera glycines
  Coding regions on vcDNA: vcDNA=SeqID_84797; Strand=+; Position=1 -210,257-326,370-466,635-758
  Homolog annotation: Hit_ID=AAG15366.1; Match level="QueryCoverage =98%, HitCoverage=42%, E-value=3e-73, Identity=69%"; Hit description =alpha tubulin [Chionodraco rastrospinosus]
TNLVPYPRIHFPLATYAPIIATDRAFHEKSSVAEITNQCFEPGNQMVKCDPRNGKFMACCLLFRGDVVPKDVNSAIAAIKAKRTIEFVDWCPTGFKVGINYQPPTVVPGGDLAKMQRVIGEIGLFMYVGEGMEEGEFTEAREDLAALEKDYEEVGVDTYVEDEEEY

SEQ ID NO: 158375 - protein, 81 aa, Heterodera glycines
  Coding regions on vcDNA: vcDNA=SeqID_84798; Strand=-; Position=1 -23,64-180,359-464
MVPPLIIRKYGIYLNQIVTVYLMCRKSLSLVRSNFSKGHHKYRNLFSDWQENFKGDEANSDGIRMLAFFCARFVSAFPAGE

SEQ ID NO: 158376 - protein, 72 aa, Heterodera glycines
  Coding regions on vcDNA: vcDNA=SeqID_84799; Strand=+; Position=1-219
MIWNGQQMRTNEQQLGKNEQQLETNGQQLGTNGQQLRKNGQQLRTNGQQLGDKWTRVDPPPPLPRGHIFGNE

SEQ ID NO: 158377 - protein, 215 aa, Heterodera glycines
  Coding regions on vcDNA: vcDNA=SeqID_84800; Strand=-; Position=1 -270,326-437,484-573,1286-1399,1457-1518
  Homolog annotation: Hit_ID=CAF90672.1; Match level="QueryCoverage =68%, HitCoverage=11%, E-value=2e-11, Identity=32%"; Hit description =unnamed protein product [Tetraodon nigroviridis]
CVNNFVLGVTNPFFLKAFAHWPHILKIGQHCNNKNNPQQRHNDSASRAGPPETTPKETIAAKGNGREAAASFFNGRWEVGRVLRNAKTIKRLSGHAQLDNQAMGGFLSTHRQFLSDDKLLAQKLLKRSGDSALKRHTLERHFMELTQSFINPLERCGVEIVDLVLKFRDHLAELEMKHRGSEQRENWSFSSTPMKQQRVLIRQRAQLQQQLNCLL

SEQ ID NO: 158378 - protein, 140 aa, Heterodera glycines
  Coding regions on vcDNA: vcDNA=SeqID_84801; Strand=-; Position=1 -102,457-576,676-875
  Homolog annotation: Hit_ID=XP_394049.1; Match level="QueryCoverage =87%, HitCoverage=13%, E-value=5e-18, Identity=47%"; Hit description =similar to CG6718-PB [Apis mellifera]
MGHQRERRAAKDNGDALRLLSLDGGGIRGLVLIQILLEIERLVDGGDTQKKGQRKKDNFVQRHFDWVAGTSTGAILALALADGTSLIDCLRLYLRLKDDVFGPEAKASRFGGYKPECLEKFLQDHFGKQRKMSDIRCGKM

SEQ ID NO: 158379 - protein, 64 aa, Heterodera glycines
  Coding regions on vcDNA: vcDNA=SeqID_84802; Strand=-; Position=1 -66,118-179,322-385
MFHSLMVELGYSLFVNQNLTADGMIKVVQRFAEYSKHHAAADSCVVLIASHDLYDHVYGKDMAL

SEQ ID NO: 158380 - protein, 60 aa, Heterodera glycines
  Coding regions on vcDNA: vcDNA=SeqID_84803; Strand=-; Position=1 -41,314-455
MILTSSYRFHKIFSKKNYFMKNQILLLLPLMKRRQVMRMKALTPRCKRTSVSSSPASSES

SEQ ID NO: 158381 - protein, 288 aa, Heterodera glycines
  Coding regions on vcDNA: vcDNA=SeqID_84804; Strand=-; Position=1 -172,220-516,572-803,870-1035
  Homolog annotation: Hit_ID=NP_500082.1; Match level="QueryCoverage =40%, HitCoverage=14%, E-value=1e-27, Identity=51%"; Hit description =CaLPain family member (86.3 kD) (clp-7) [Caenorhabditis elegans] gb|AAF36080.1| Calpain family protein 7
MECCNLGPEVLDEICSMMDLRTSDVPSCLRSSAQWAQFASDGEWSRQKGTAGGCRNFPTFANNPQFGTTISFSISPNNGTEDDGKCTVICAVLQKYRRELRAVGLDELAIGFAIYATDEGTEEGQKHQQQQKHTAQVSHVQRQNAEAPASGRSLSVGFGHLVYWSLDDLVPLGDLDSFGQLINCLRGFGPGYGQPNSYGSAYVQQQQHHVQQQLQPLVPNYYQSLPQMQCQKGNILYGQTYETHLPKQQNCQYQTNPKRIGQQFLEGAKSVAKSASFINLREVIRKKE

SEQ ID NO: 158382 - protein, 144 aa, Heterodera glycines
  Coding regions on vcDNA: vcDNA=SeqID_84805; Strand=+; Position=1 -279,599-754
MAGDNQKLTEQTLQQRDEDGGGKETGRGGFGQTYQRYDRSVPNRADSTSQANKHPKPIELHAPICAQCESAKSATGGEGKADFVERMSTVRWHLLKTLTDTLKEVEKCQKGGQSRGFDQTREVIRCSTSLAVTLVQFTQLIHGL

SEQ ID NO: 158383 - protein, 263 aa, Heterodera glycines
  Coding regions on vcDNA: vcDNA=SeqID_84806; Strand=-; Position=1 -483,657-965
MKRQERNQFIFINYFTCLNQKINKQLNGKSHLINGQSNVCRLERHISICALRIAHSMHCNSEDGVGRPEQGLGCQCVSLQSGHLNQRICVNIVSSFTDNCRDRTTAWQQTKAIGDSATSVDDRNAKTTLPLDGGLNEEVQSQKQKENALPELSSEGTLGGLVVFSRVCVQHFLSTADDNANETASAGVIQQEFETVRRTFDPTLNWVNFGQFDCPFAAFVSVNMPNPMPISRRNGNQNWPFNVRMFDFNPGKSCPNPVAEVQR

SEQ ID NO: 158384 - protein, 41 aa, Heterodera glycines
  Coding regions on vcDNA: vcDNA=SeqID_84807; Strand=-; Position=1-128
RGDDSSEEKHRGSKYQQPQQNAQSVAVAIAVAGGATGNAAG

SEQ ID NO: 158385 - protein, 62 aa, Heterodera glycines
  Coding regions on vcDNA: vcDNA=SeqID_84808; Strand=-; Position=1 -42,147-290
ALLRGNALCRMGMGRGRKRRRCRLLLLGVLQMGQVQVVVPMVGNSKQNLGVNAAPLDRFLHR

SEQ ID NO: 158386 - protein, 87 aa, Heterodera glycines
  Coding regions on vcDNA: vcDNA=SeqID_84809; Strand=-; Position=1-264
MSVKDGEIGAFASTQMDDPSNWDGKEWGGRRNLGESPKKKGRRPKKEGEGMYTKGQKGDKKGQKDDKKGQKGDRKGQTGQNIQKDKG

SEQ ID NO: 158387 - protein, 157 aa, Heterodera glycines
  Coding regions on vcDNA: vcDNA=SeqID_84810; Strand=+; Position=1 -119,948-1301
MDLVTFRRALKVRPKGKAAHGKALFSFLKESERMEKERQIRCATCRRRCPPKAELRHGSVPLLPLNSPLGLCQIGRCCHCAFPPSAAVPFGCSPSVAAQKGLNSLNMLLYLLDVLRHRHCPSRYLYGSLGTHFLRNRRCAFLVFVSNAQRNGAILRQ

SEQ ID NO: 158388 - protein, 151 aa, Heterodera glycines
  Coding regions on vcDNA: vcDNA=SeqID_84811; Strand=-; Position=1 -442,1351-1364
  Homolog annotation: Hit_ID=XP_522969.1; Match level="QueryCoverage =98%, HitCoverage=87%, E-value=2e-15, Identity=33%"; Hit description =PREDICTED: similar to putative protein family member (XC187) [Pan troglodytes]
MRRGTKVIRRGTTVNRRGTTVIKRGTKVIKRGTKVIKRGTKMIKRGTTVIKRGTKVIKRGTKMIKRGTTVIKRGTTVIRSGTTVIRRVIRRGSTVIRRGTTVIRRGTTVNRRGTTVIRRGTKMIKRGITVIKRGTKMIKRGTTITKREILE

SEQ ID NO: 158389 - protein, 29 aa, Heterodera glycines
  Coding regions on vcDNA: vcDNA=SeqID_84812; Strand=+; Position=1-87
MANARGPSSSTSTSTNASVGVLMVGPNFK

SEQ ID NO: 158390 - protein, 48 aa, Heterodera glycines
  Coding regions on vcDNA: vcDNA=SeqID_84813; Strand=+; Position=1 -115,321-352
MRRHHSALNGNVSQQCLTVHKIRHAAATDAKCFCLSKQRPQPPHKRLT

SEQ ID NO: 158391 - protein, 22 aa, Heterodera glycines
  Coding regions on vcDNA: vcDNA=SeqID_84814; Strand=+; Position=1-67
SHAHPSDLAVKQRLLTTKRVRA

SEQ ID NO: 158392 - protein, 263 aa, Heterodera glycines
  Coding regions on vcDNA: vcDNA=SeqID_84815; Strand=-; Position=1 -363,405-771,819-878
  Homolog annotation: Hit_ID=CAE71840.1; Match level="QueryCoverage =100%, HitCoverage=100%, E-value=1e-40, Identity=39%"; Hit description=Hypothetical protein CBG18881 [Caenorhabditis briggsae]
MSAEGNDAPPAAEQPPPAEAAPAEAVPVQEAAAPPVEAAAETAPAEAAQPVEEAAPPAEAPVEAAPAEAAPPIEEAAPPAEAPVEAAPAEAAQPVEEAAPPAEAPVEPAPPVEEPKAAEPEAPVSEAVPAAEAPVEEAVAAPIEVAPAEAEPVSAPPAEAVPAEEAPAAEVAQLSLEEQAPAAEAPVAEEAPAAVPVEEAVPPPAEVPAAECAPPASEATPAEAPAAPEETPADGVSPAPEAAEPAAEQPPAAEEAPPAEGAP

SEQ ID NO: 158393 - protein, 277 aa, Heterodera glycines
  Coding regions on vcDNA: vcDNA=SeqID_84816; Strand=+; Position=1 -107,176-540,594-925,1448-1467
  Homolog annotation: Hit_ID=XP_324453.1; Match level="QueryCoverage =98%, HitCoverage=94%, E-value=4e-45, Identity=41%"; Hit description =predicted protein [Neurospora crassa] emb|CAD70422.1| conserved hypothetical protein [Neurospora crassa]
RLRLKRGTCFGQKGTDCGTHGAPSAGGASSAAGAASASGAGETPSAGVSSGAAGASAGVASDAGGAHSAAGTSAGGGTASSTGTAAGASSATGASAAGACSSKLSWATSAAGASSAGTASAGGAETGSASAGATSMGAATASSTGASAAGTASETGAAFGAFGSSTGGAGSTGASAGGAASSTGCAASAGAASTGASAGGAASSIGGAASAGAASTGASAGGAASSTGCAASAGAVSAAASTGGAAASWTGTASAGAASAGGGCSAAGGASYRGRGN

SEQ ID NO: 158394 - protein, 475 aa, Heterodera glycines
  Coding regions on vcDNA: vcDNA=SeqID_84817; Strand=+; Position=1 -179,269-431,482-554,597-844,1245-1667,1712-1828,1876-1950
  Homolog annotation: Hit_ID=CAE74471.1; Match level="QueryCoverage =100%, HitCoverage=50%, E-value=1e-109, Identity=43%"; Hit description=Hypothetical protein CBG22218 [Caenorhabditis briggsae]
MQILWESGEWPGASIEQAITTLSWTPAAKEGRGLLGVGCDTGAVGVTYTDLGPDHNCCKRHNFNHNFNLRGHQAAIALVAWNKAQTKLLSYDINGVIYFWVPNEERWTVELINDRGFKVRDFDWSPSGASAVRDFDWSPSGASALICYEDNFVLIVSSSGQRIWSNTFLFSSSGQRIWSNTFLFSILCGAWAPNSQELVIGLSSGVVHVLNDQGTLITERTLFQVGVQRAAFSPLRSAEAHGDEWTLACCSATDQILFLNTFYEVELCSWQAPDPVISMRWSSDGTMLAVVCSPNRIVILDYNGRGIHSSAPIPGGTLSAFTWAHSDQAIVVTAKGKIATGRLVRRVPSLSQLVSYSLWEQLGRSSKGVDHLPIPKRERKQIAQFDHHIIRCRVPVAERCRVPVAERLYDVVCQPSIWRWYCTIVPVTRKNLYMLCVEHMGGFVPILLGRHMGGFVPILLGRQTNRIIPQFVISL

SEQ ID NO: 158395 - protein, 305 aa, Heterodera glycines
  Coding regions on vcDNA: vcDNA=SeqID_84818; Strand=-; Position=1 -607,954-1264
MEEGKLRNKPRRKACRDFYGSPAQWCNTNAKCSADTPRRRDVQQRGHGTKQRFLNEVKGVNWHSDDVMVKLGDLFALSLRNRKMVHPFGGAAQLFPQRIGHQLGQRRHSAHQTARGDFALCRHDNGLIAVRPSECGESAAGDGCRERVNATAVVVQNDNAIRTAHDREHCAVTAPTHRNHRVRRLPRAQLNLVEGVQEENLIAEIKCYHWLLQLFVNEKETDRTTRQSPFAISVRLGTSQRGKGRPLDAHLEESAFSDQSALVVQHMDNAAAEADDQFLRIGGPRAAENGEKESVGPNALAGGRN

SEQ ID NO: 158396 - protein, 211 aa, Heterodera glycines
  Coding regions on vcDNA: vcDNA=SeqID_84819; Strand=+; Position=1 -141,419-559,1325-1415,1459-1558,1671-1787
  Homolog annotation: Hit_ID=NP_504498.1; Match level="QueryCoverage =91%, HitCoverage=54%, E-value=2e-45, Identity=49%"; Hit description =ADP ATP (5G168) [Caenorhabditis elegans] pir||T25728 hypothetical protein F25B4.7 - Caenorhabditis elegan
SPSTPPTNSVPQILLQQFGKDFVAGAVAACVAKTVIAPVERVKLILQLQTAQRTIAAASRYSGMVDCFVRLPREQGFLSFWRGNLSNIARAASQESLGMAFKELFKRWCVTESDRSVNYRRFVAGNLLAGGLAGSVTFFFNLLAGGLAGSVTFFFIYPLDFARTRLAVDMGKGPAKRDFLPLVSCSQTAPFSKPIPPFLRKRNSGLSWLIS

SEQ ID NO: 158397 - protein, 123 aa, Heterodera glycines
  Coding regions on vcDNA: vcDNA=SeqID_84820; Strand=-; Position=1 -223,270-418
MKIYKWKKQLGLSRKNERSQKNYYEKKKREFVERIDEFKRMSKRGKQKQFAKALGIGKTTLSTWKKEFGIEISKRVYSNKEKISKMKDYYKMKNKNPYLSDRQIATFLKISPSTLNKWKIEKN

SEQ ID NO: 158398 - protein, 186 aa, Heterodera glycines
  Coding regions on vcDNA: vcDNA=SeqID_84821; Strand=+; Position=1 -122,235-279,513-690,1092-1307
MPTNNVLVGLASVPNFLLVPSSSPQNGPLVERIIEFVHRIREAQPPVELCPTDRQLAFNRSLIAALCLCRSDGAGEHAAGAMMSASVPTATSDDGTGHAQLQLAIARRIHERLWQSLNATLATDLLPFGPSLLRRDSMERQHLAAMLEALRQLRLAHRQCLAHTNCYNVPAELFTAQRRGEQKKSN

SEQ ID NO: 158399 - protein, 108 aa, Heterodera glycines
  Coding regions on vcDNA: vcDNA=SeqID_84822; Strand=-; Position=1 -51,659-785,858-910,1013-1108
MLYEDPRNRCCCAIKIQGIAVAVGSLYLLVLAAMFLLVPHFWQRWLNEFSDFQHQETIMQYPRLVTGCIGAVMLFVQVINIWFELVVYNASTFVQRQHFISQHGAHKV

SEQ ID NO: 158400 - protein, 102 aa, Heterodera glycines
  Coding regions on vcDNA: vcDNA=SeqID_84823; Strand=+; Position=1 -203,588-693
MLLLRESDEAAVSKECPWAFGEMEKRGNCEIWFYEEKNGRTNGRREGHLEGKKNKTAKIKKQKRYSIMLCIWEENIRQRRANKTKESKRKNENEKRPKEKGK

SEQ ID NO: 158401 - protein, 80 aa, Heterodera glycines
  Coding regions on vcDNA: vcDNA=SeqID_84824; Strand=-; Position=1 -106,154-290
MLVELDAERITGTCGLFPIEQKTLRLTTDGFQWNLANQCVAFGQLVSSSNCILCPQKSRIKSDGGAVVFTFELREPNKML

SEQ ID NO: 158402 - protein, 88 aa, Heterodera glycines
  Coding regions on vcDNA: vcDNA=SeqID_84825; Strand=-; Position=1 -156,213-323
MSPNEFSDRPFQQPDNVQHPHQQPDEDAELRAQIEDAEEDLLLNWWREDLKIIRFLFGHRRAPTIEAALLQRAEREAEILRQYAENQQ

SEQ ID NO: 158403 - protein, 82 aa, Heterodera glycines
  Coding regions on vcDNA: vcDNA=SeqID_84826; Strand=-; Position=1 -69,176-355
MNSDNHLIQTMNRGDERSADIYLQEQTLMITSSHQPVQLLYDGANGQYFIPVQNGNDGSVCHIALTPTQSKVIENQDKTSIG

SEQ ID NO: 158404 - protein, 244 aa, Heterodera glycines
  misc_feature (107)..(107): Xaa can be any naturally occurring amino acid
  misc_feature (115)..(115): Xaa can be any naturally occurring amino acid
  Coding regions on vcDNA: vcDNA=SeqID_84827; Strand=-; Position=1 -123,189-368,494-597,646-768,836-929
  Homolog annotation: Hit_ID=CAE64301.1; Match level="QueryCoverage =98%, HitCoverage=27%, E-value=4e-47, Identity=43%"; Hit description =Hypothetical protein CBG08977 [Caenorhabditis briggsae]
CPKLKLILMSATLDSARFQKLFKNCEMLIIRWRTFPVDILYSPTPVISYTHAAVEYSPTPVISYTHAAVETALQIHLTESPGDILIFVTGQKVIIILYRKLNRIFNXNFKETESXLQYCFPLYASMPLDKQQRVFQQCIPNKNNTLISNRKCIVATNVAETSITIDGIAFFSNRKCIVATNVAETSITIDGIAFFVDTGFCKQKIYNPQIRVDSLLVTPISQASAMQRAGRDGRTQPGQCYRLY

SEQ ID NO: 158405 - protein, 465 aa, Heterodera glycines
  Coding regions on vcDNA: vcDNA=SeqID_84828; Strand=-; Position=1-1398
MIIRSPPLTRQRALNLRTFAQNQNAAVEEQQQQQQVEGVHGENEPLFNAPISPGLNRNLSLSAEENEHHFSEMAAAAANDDEIRRRLLHVSIQSNLPPRANGGGNNGAEQQQIRNENVGHEDFVEGLRPNFGSFLVREEGVRMRFVESGTENRRFEQINRNLVRETAPNSRHVSQSELIGRTSTPINFNGELHNFPIVNNQIRHREIYEDFGPYREHENFRSSQIQIRQQPALARQQQNANFGFLPCERQHNEFVGRHIFEGGRRMMHPTEMPRQMHQQPPREERGWQQQTSVLYRPVARQQQNFPNYENQMLPPQSQNLAVLSSLEYNMVLERIPDLNGKEGTDEVKRFFKKFDAYTDSWPDEKRIKGLESKVYGRAERAFEVAKAVIPIKYELLRGEMMRQLEETDSKNLNAFDELMLGVRRKPNESIDDLACRISGLVKRAYPGLSFNCQTISHPIFDPINW

SEQ ID NO: 158406 - protein, 15 aa, Heterodera glycines
  Coding regions on vcDNA: vcDNA=SeqID_84829; Strand=-; Position=1 -6,364-405
MNEILYLISDFDPSD

SEQ ID NO: 158407 - protein, 46 aa, Heterodera glycines
  Coding regions on vcDNA: vcDNA=SeqID_84830; Strand=-; Position=1 -53,408-495
MGLRILHQFIQFVKSRKRAKNGQNVLFIVKKFCVPKMGLNAMPTNV

SEQ ID NO: 158408 - protein, 93 aa, Heterodera glycines
  Coding regions on vcDNA: vcDNA=SeqID_84831; Strand=+; Position=1 -356,512-808
LFEYPKRTLEKIDFFVFGAVPPNRCAQIYGETESFGNSFPIACTLILRWIFAPHNCLSTPNGKNRFFLLFGQSPQTDAPRFMGRPNPSGIASL

SEQ ID NO: 158409 - protein, 40 aa, Heterodera glycines
  Coding regions on vcDNA: vcDNA=SeqID_84832; Strand=-; Position=1 -96,653-679
MNETFRDVLLIKELLIRQPQSEEFHLFQLSGETSSIPVSS

SEQ ID NO: 158410 - protein, 19 aa, Heterodera glycines
  Coding regions on vcDNA: vcDNA=SeqID_84833; Strand=-; Position=1-3,94- 150
MNFKLIGEKRMVRSRFNEK

SEQ ID NO: 158411 - protein, 138 aa, Heterodera glycines
  Coding regions on vcDNA: vcDNA=SeqID_84834; Strand=-; Position=1 -71,135-431,579-627
MSFRLLGILCVLLFVAQLTNGDAAWNDANDVNPFKGHQERALAFNEKLKHAEENTPENVTPTPTPSINATETPDTNATMTTSEVTGETTEGPTIKTTAKPAPPSTSSFQMTILNIVLMGLIAVILLVDIVLAVVKCKK

SEQ ID NO: 158412 - protein, 90 aa, Heterodera glycines
  Coding regions on vcDNA: vcDNA=SeqID_84835; Strand=+; Position=1-273
MGNEWHGLARANIAMVPLEHFQVVKDQANLCKQWSKALARAAERTYQVDFVSVQKAADSDFGRKVIFTIEIMQKLNREPMNGQRIVGWSP

SEQ ID NO: 158413 - protein, 163 aa, Heterodera glycines
  Coding regions on vcDNA: vcDNA=SeqID_84836; Strand=-; Position=1 -101,206-361,686-762,814-852,956-1037
  Homolog annotation: Hit_ID=CAE73454.1; Match level="QueryCoverage =77%, HitCoverage=23%, E-value=7e-38, Identity=59%"; Hit description =Hypothetical protein CBG20903 [Caenorhabditis briggsae]
LKEAGAILLGITNVPELALWWETNNTVYGVTNNPYDLRRTPGGSSGGEGALLAAAGSVIGLGNDVGGSLRVPALFCGVFGLKPGPGVVPSSGILPRVRGYLIQMATAGPMTRYASDLTLMLTRYASDLTLMLRVMLFMLFSSLSSNNLYGIGRPTRAYYLGGG

SEQ ID NO: 158414 - protein, 70 aa, Heterodera glycines
  Coding regions on vcDNA: vcDNA=SeqID_84837; Strand=+; Position=1 -48,103-267
MQPVLASFPSKDATKKVIKRLRREENAPRVEPLNLEQLEIPNTYRVYKRTEIDEEQFLLADTGVFQIHGY

SEQ ID NO: 158415 - protein, 36 aa, Heterodera glycines
  Coding regions on vcDNA: vcDNA=SeqID_84838; Strand=-; Position=1 -85,189-214
MAFFCNEFFRYHGNGKDAKMTTMNWHRHCKNRIFNV

SEQ ID NO: 158416 - protein, 117 aa, Heterodera glycines
  Coding regions on vcDNA: vcDNA=SeqID_84839; Strand=+; Position=1 -105,241-489
SSQSIYGTCTVAPLQSSTSFASFDSPPPGLSNSQNSHNGGANSSSSSSHPFRYRGNEKIHYRRMPFIAYKILEKILYFEKKRIACSAYAFAVLLLLQQCTTSSAHQPGRTRRIKLKI

SEQ ID NO: 158417 - protein, 48 aa, Heterodera glycines
  Coding regions on vcDNA: vcDNA=SeqID_84840; Strand=-; Position=1-185
RNGNNLFGRTLEVPMRMCRLRNILSFDQPTGRSWPSCVILGFCFFVSI

SEQ ID NO: 158418 - protein, 165 aa, Heterodera glycines
  Coding regions on vcDNA: vcDNA=SeqID_84841; Strand=-; Position=1 -111,213-414,489-671
  Homolog annotation: Hit_ID=NP_492222.2; Match level="QueryCoverage =100%, HitCoverage=7%, E-value=3e-39, Identity=52%"; Hit description =j-domain containing protein, required for endocytosis, Receptor Mediated Endocytosis RME-8 (259.2 kD) (rm
IPAQGYLPQFCQAMQSTLSDDVARSALRVLNQLSENLNCASAFAAVPSLPKGLLVCMRMQPELARESAHALKMLSQRCTPEMAEQMLLSGMVDHLLKMLGSSLPGVNNPSAAKAEIADALKACSRDAHFGERITQLLQKSQIWAQYRDQRHDLFLPTITQTQAIT

SEQ ID NO: 158419 - protein, 513 aa, Heterodera glycines
  Coding regions on vcDNA: vcDNA=SeqID_84842; Strand=-; Position=1 -531,712-894,936-1090,1148-1339,1447-1609,1663-1977
  Homolog annotation: Hit_ID=NP_492222.2; Match level="QueryCoverage =97%, HitCoverage=20%, E-value=1e-161, Identity=58%"; Hit description= j-domain containing protein, required for endocytosis, Receptor Mediated Endocytosis RME-8 (259.2 kD) (r
MAAFAFLGVIFGLFRIREKLGSLVISVLKRRCEAIDHATVELLCALMQPMHANFDLRIEQLNKQSLLSSRAFVEHLLQLVVEHVARGTGKQIKSTKVIVFQNDCPGALVIASMLDFLTFTVCAPYSETTPGDTFDSILAMVAQRGRTFYKLFQHPSMTIVKGAGMVMRAIIEESGRDISRQMQLLALTEGAFLKHLELALLSTGKDLRVLTNKQLSGYLVALWIAENQAAKDLLQRCLPRGLIDYLDSNEHVPASAVAEERDLLTIRNNLEMANNSERERPFAQLQDQFRNVQVTLEARLDSLLQHWNLEQKLNFLQSNRIREEHQQQKIQQRPVVLRKRRRLVKATANWKLFCYQFGQNHARADLIWNEKTRDEFRQSIENEWRQLQQELEFIQPGTTVSWNHSEFTVTYDSLLDEIRIGDYYLRFLLTEENSSNSATPIHRPEDFFNKIYHRFLLSQRTEMRCICLRAMALVYERHCISIGPFADTRHIVEMLAKCTNVAERDHFLFLINK

SEQ ID NO: 158420 - protein, 223 aa, Heterodera glycines
  Coding regions on vcDNA: vcDNA=SeqID_84843; Strand=-; Position=1 -133,217-341,388-481,658-977
MTMTMALSPARPPTRECSRQRRAASPSDKMTWQWSKMVTNTVEKAKAFGHCIATRRTVSQRRPRQRRPNTERRAFKCQRKQSIAKLGFVNEMGQLDQSVETKTNIQFRQNVTMADTNGISPLDSFRQDGNFHLNGPQQFRRLSPGATMTQRKMNVVGSASASPIQFCEQRKPYGQKQYFSRAVVGDRNSNANEWRNGRYKMQESHSERRGTQTVQKGPFLVMI

SEQ ID NO: 158421 - protein, 189 aa, Heterodera glycines
  Coding regions on vcDNA: vcDNA=SeqID_84844; Strand=-; Position=1 -128,203-644
MAAFRLNLQKSLFQQDGERLLGLANVKKDSKRKKETFWCLAGRYNKSTRGGKVLYCQIGKGRHFCEEGAICVEGIARGRRSSPTKSFKQKISKLRIIQPVTDIILTIRNNVYHLDSNTLEEKEFLIRQIFKVFPVILYFIGPIKKKRLKSCFYAFRSNTRGFSGALITNMISILTYFESRTRIRTQVGS

SEQ ID NO: 158422 - protein, 45 aa, Heterodera glycines
  Coding regions on vcDNA: vcDNA=SeqID_84845; Strand=+; Position=1 -56,276-357
MWSKTMVGYGSEDEHFVLEPFSLNLTTFWRAWKVWESGQQKGLFC

SEQ ID NO: 158423 - protein, 26 aa, Heterodera glycines
  Coding regions on vcDNA: vcDNA=SeqID_84846; Strand=-; Position=1 -65,215-230
MLLPMGLPEDVAVAGFGLSLERLISK

SEQ ID NO: 158424 - protein, 38 aa, Heterodera glycines
  Coding regions on vcDNA: vcDNA=SeqID_84847; Strand=+; Position=1-116
MTMALLPLALADLNRLTMWAAFEDLNRVELTSHLANPN

SEQ ID NO: 158425 - protein, 140 aa, Heterodera glycines
  Coding regions on vcDNA: vcDNA=SeqID_84848; Strand=-; Position=1 -46,392-646,703-738,916-968
  Homolog annotation: Hit_ID=A49772; Match level="QueryCoverage=100%, HitCoverage=30%, E-value=3e-60, Identity=80%"; Hit description =cuticle protein cut-1 - Caenorhabditis elegans
LFDQGGCRSDEHGRQVAGIELPFDTCNVARTRSLNPKGVFVSTTVVISFHPQFVTKVDRAYRIQCFYMEADKTVSSQLEVSEITTQFQTQVVPMPVCRYEILEGGPHGQPVILEGGPHGQPVQFATIRQVYHKWTCDSET

SEQ ID NO: 158426 - protein, 161 aa, Heterodera glycines
  Coding regions on vcDNA: vcDNA=SeqID_84849; Strand=+; Position=1-486
  Homolog annotation: Hit_ID=EAK89729.1; Match level="QueryCoverage =86%, HitCoverage=65%, E-value=4e-18, Identity=29%"; Hit description =uncharacterized glycine-rich low complexity protein [Cryptosporidium parvum]
MIKSTGSAASRPRIIFLAFLQSLGLNPPAIQSLGLNPPTFQSLGLNPPAFQSLGLNPPAFQSLGLNPPAFQSLGLNPPTFQSLGLNPPAFQSLGLNPPAFQSLGLNPPAFQSLGLNPPAFQSLGLNPPAFQSLGLNPTSFQSLGLNPPAFQSLGLNPPTFQ

SEQ ID NO: 158427 - protein, 56 aa, Heterodera glycines
  Coding regions on vcDNA: vcDNA=SeqID_84850; Strand=+; Position=1-168
MEDRQGQLRSRRAQTQQTETTVEGPTDNRNGRTGGEETTARTHRNGGPNEASFHGY

SEQ ID NO: 158428 - protein, 55 aa, Heterodera glycines
  Coding regions on vcDNA: vcDNA=SeqID_84851; Strand=-; Position=1 -15,426-578
MCRKIVQAWIQVSRSLDFSWTWIFLDFCPGNPAPGPTWNPGSGPGPDFFQNVELD

SEQ ID NO: 158429 - protein, 41 aa, Heterodera glycines
  Coding regions on vcDNA: vcDNA=SeqID_84852; Strand=+; Position=1-125
MKLSLSNLLVQNVVKVFDALFTDPCEPPPALGKVWPMGEKP

SEQ ID NO: 158430 - protein, 66 aa, Heterodera glycines
  Coding regions on vcDNA: vcDNA=SeqID_84853; Strand=-; Position=1-416
SFDQSNRCGKRESGPINVIRDYCFVSILSLFCYSIFVIRRTVIRNSCIIYYHFDKNCLRTNRQKPH

SEQ ID NO: 158431 - protein, 46 aa, Heterodera glycines
  Coding regions on vcDNA: vcDNA=SeqID_84854; Strand=-; Position=1-141
YPRKACNSPPNSKTTKMFPLKIAFLLVLICTPNFGENSSTESSKKS

SEQ ID NO: 158432 - protein, 176 aa, Heterodera glycines
  Coding regions on vcDNA: vcDNA=SeqID_84855; Strand=+; Position=1 -150,394-452,563-722,1172-1330
  Homolog annotation: Hit_ID=NP_492053.1; Match level="QueryCoverage =100%, HitCoverage=9%, E-value=1e-37, Identity=48%"; Hit description =MYOsin heavy chain structural gene, LEThal LET-75 (223.3 kD) (myo-1) [Caenorhabditis elegans] emb|CAA9584
SKKKLETDINDLELGLDMANKTNMEAQKTIKKLIGQVQDLQLQASEPQNLVEEEQRRREEQRENFLMSEKKLNIVLSERDELVVRREQMERDKQRVEAEVQEERARKTELQMDNSQLSAARRQTELDKTLNELKMAEESSKKVSADVTRLQEEYRNEQHHNDHVERQKRGLDAQLK

SEQ ID NO: 158433 - protein, 41 aa, Heterodera glycines
  Coding regions on vcDNA: vcDNA=SeqID_84856; Strand=-; Position=1 -98,201-229
MSGGREEVEISFSRPLSSLHPAKFLPSTKWSKWNCKGMGGK

SEQ ID NO: 158434 - protein, 30 aa, Heterodera glycines
  Coding regions on vcDNA: vcDNA=SeqID_84857; Strand=-; Position=1 -58,350-384
MVMRDGVTTETVQDEHNDKALARKFPIFHA

SEQ ID NO: 158435 - protein, 152 aa, Heterodera glycines
  Coding regions on vcDNA: vcDNA=SeqID_84858; Strand=+; Position=1 -182,507-662,1043-1163
MALYILKVEVNCGAIASLALDSKITDLHTAMLKKVGINASKDVVPVNKPDQEFINMLHLAWQKFGDPNAIVVILHFINSSPYNLDYTNVEMELARVSNGQIKMDFVSLKEGKRLNLDPETFTLRLDGRVVAVVNSGTSALGYLANRAEMETR

SEQ ID NO: 158436 - protein, 82 aa, Heterodera glycines
  Coding regions on vcDNA: vcDNA=SeqID_84859; Strand=+; Position=1 -72,125-301
MHPRNIHWHVALETDDHLTEKIIQDAIQNPGNYVLKPNRECGGNNYFDDEIPKKLQQFSLEQRAAHILMQRLHPLQVKVGES

SEQ ID NO: 158437 - protein, 277 aa, Heterodera glycines
  misc_feature (33)..(33): Xaa can be any naturally occurring amino acid
  misc_feature (45)..(45): Xaa can be any naturally occurring amino acid
  misc_feature (55)..(56): Xaa can be any naturally occurring amino acid
  misc_feature (132)..(132): Xaa can be any naturally occurring amino acid
  misc_feature (148)..(148): Xaa can be any naturally occurring amino acid
  misc_feature (214)..(214): Xaa can be any naturally occurring amino acid
  misc_feature (271)..(271): Xaa can be any naturally occurring amino acid
  Coding regions on vcDNA: vcDNA=SeqID_84860; Strand=-; Position=1-847
  Homolog annotation: Hit_ID=BAB33421.1; Match level="QueryCoverage =97%, HitCoverage=96%, E-value=4e-91, Identity=68%"; Hit description =putative senescence-associated protein [Pisum sativum]
IAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSSLGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 158438 - protein, 256 aa, Heterodera glycines
  Coding regions on vcDNA: vcDNA=SeqID_84861; Strand=-; Position=1 -27,777-885,1034-1089,1150-1263,1651-1746,1803-1885,1957-2110
  Homolog annotation: Hit_ID=CAE58402.1; Match level="QueryCoverage =93%, HitCoverage=21%, E-value=2e-67, Identity=56%"; Hit description =Hypothetical protein CBG01531 [Caenorhabditis briggsae]
KSQSRSRSRVSNELKPRFRVTTILERPYVMLRTNIDHNDNHQDAHGFCIDLLSELAQDLGFTYTIHVVRDNKYGKDGNNSIHVVRDNKYGKDGNNSWDGMIGELLRGEADMVMAPFTANFRRAEVVDFTKPFLSLGISILYRIPEDYQPDIFSFLNPLSLEIWLCILLSDIFSFLNPLSLEIWLCILLSICGITFGMYLVANVTPYLVANVTPYEWNLNFSCCTARRPRPAARFSTVSAATAPTSSAAGGAAPEEK

SEQ ID NO: 158439 - protein, 230 aa, Heterodera glycines
  misc_feature (39)..(39): Xaa can be any naturally occurring amino acid
  misc_feature (112)..(112): Xaa can be any naturally occurring amino acid
  Coding regions on vcDNA: vcDNA=SeqID_84862; Strand=+; Position=1-718
  Homolog annotation: Hit_ID=NP_001004509.1; Match level="QueryCoverage= 99%, HitCoverage=14%, E-value=2e-23, Identity=33%"; Hit description =si:busm1-180o5.3 [Danio rerio] emb|CAD60788.1| novel protein similar to DNA polymerases [Danio rerio]
MAIKYLEWRSKRDGIEIRHAGNGREVKVGKYKLDGFLLXNVGGRDKCIEVMGCYIHGCMNCYDPAAELIGGRTAQELNDETQERLAELRKTLDVEEVCVSLFDIYIFIVNFXGCQIEKELKKDEEMRDFFDDRGNEKGPIDPRMAYAGGRTGPMKLYAKSDEKKKISVYDIVSLYPSVNYGTAYPIGLPEIIIPKTDEINVNWMRPEDLKYKGLYKVRVTPPKGLRIPVL

SEQ ID NO: 158440 - protein, 399 aa, Heterodera glycines
  Coding regions on vcDNA: vcDNA=SeqID_84863; Strand=-; Position=1 -411,461-722,766-1084,1127-1281,1317-1369
  Homolog annotation: Hit_ID=NP_507780.1; Match level="QueryCoverage =93%, HitCoverage=28%, E-value=7e-38, Identity=28%"; Hit description =predicted CDS, DNA polymerase type B, organellar and viral family member (5T899) [Caenorhabditis elegans]
KYVCFFNRGRKFCIDCECFYDQDVYHTLECRARCYYCNKVGGVPCEKENGVKIECPKCHRYFYNWECYNYHQGHQTCRLWRRCMICEKTYRFNPKKDHECGETYCQLCSVSHDPKRSCYIMPIEENEDKDVYRIVVWDSETSQDTIYTGDQKEHVINYISVRVTCTECCDDKHRTNCKICGEERTKDWSEAEGHDPTKDFVEWILTAFTNYDTYIFAHNAGRFDGHFVFNYLCRTGKNPIPLINGLKIYEFKVRNSKKHSMLIWRDSCLLMPVKLESLKATFNLGCEDKPFFPYYYNKKENYGVCLEHLPPMEDYSPGSMNKEKFAKFEKWYNENKGTPFYLDEELRNYSRNDTEILLLSIIEFRRILINDITKGFDPLPRSCNVFVDGAVIDCAGERL

SEQ ID NO: 158441 - protein, 119 aa, Heterodera glycines
  Coding regions on vcDNA: vcDNA=SeqID_84864; Strand=-; Position=1 -192,569-736
MARAHLAALTWLALSWPCTPPIGMGGYRNPDLLCALTTDGFNLQEIRSAICGCKKLLGNELFFEVKGFLRQEDGTSQKVVNEYYEKYDGLNGFAEFIRNWAFTFFCFHAFDDDDTSDED

SEQ ID NO: 158442 - protein, 43 aa, Heterodera glycines
  Coding regions on vcDNA: vcDNA=SeqID_84865; Strand=+; Position=1-388
VKHRISALLCREPAGNGWLSICKKLDWQYVVVKNFWVWNYFLK

SEQ ID NO: 158443 - protein, 107 aa, Heterodera glycines
  Coding regions on vcDNA: vcDNA=SeqID_84866; Strand=+; Position=1 -109,290-504
MNTAIGTINPEKDTVAVVEQTKTGFAHPLDFEFEDLGDPADVLQDGAESYDGATMKRPSDKGKGANGKSGMPRKQSLKLFGTSNSNGKVSLLWCYDVSQKPSNENIF

SEQ ID NO: 158444 - protein, 78 aa, Heterodera glycines
  Coding regions on vcDNA: vcDNA=SeqID_84867; Strand=+; Position=1 -133,366-469
MECWDGYALNDKAGEGWELAIKDCGTPQKDMQNQICAYFHCTTAEGDDHLDMWSCFANINAGGGCASDAFAPRITQPE

SEQ ID NO: 158445 - protein, 28 aa, Heterodera glycines
  Coding regions on vcDNA: vcDNA=SeqID_84868; Strand=-; Position=1-84
MQLIGTRPLLKHWPMCCRQQSSQKVCVA

SEQ ID NO: 158446 - protein, 427 aa, Heterodera glycines
  Coding regions on vcDNA: vcDNA=SeqID_84869; Strand=+; Position=1 -60,199-668,790-1075,1984-2451
  Homolog annotation: Hit_ID=NP_498064.2; Match level="QueryCoverage =59%, HitCoverage=22%, E-value=5e-16, Identity=27%"; Hit description =la related protein (3G102) [Caenorhabditis elegans] gb|AAK93859.2| Hypothetical protein R144.7 [Caenorhab
MSVMLNTDQQKQNLDTKTSQENGQLSDSHETAVIKAPSGGNRKVPKNCWKKVNIDLEYNTSREISRRRQLAWRGERRGGETYGRRDQPKEQRKGSARVAEESSARKDEAAEKRDRNEAQKETAGEAEDGRAEGGGDEETARKRTTAPTGGTKTKNGPNEDGTETGTDQQQQQSRDYCAGPRTTRMPYRSGGGGGIGGPRRSGGGTDYWHKKGGGGGSGQSGRGSEDDRERRPGGSYYQQRNDRWQRNHHPNAPPPLNVAQRRARGPLPDWDEVRPRLNPQQWPLVESATHTEAQNSPTTASGAVEEIAVDNEEMEQKEDQHEEKEGAEEGKELERPQSNEQQRQPQPNSSEEMETTIGTSEEEQRQSETVEEIMEEPKQQQKQEEKGEDQEGWKEVRTKRGNRKKQQPNNKQNKGKENSTHQPQVKQ

SEQ ID NO: 158447 - protein, 361 aa, Heterodera glycines
  Coding regions on vcDNA: vcDNA=SeqID_84870; Strand=-; Position=1 -152,213-384,425-650,718-816,860-1032,1526-1789
  Homolog annotation: Hit_ID=CAE73451.1; Match level="QueryCoverage =38%, HitCoverage=15%, E-value=8e-47, Identity=62%"; Hit description =Hypothetical protein CBG20900 [Caenorhabditis briggsae]
MCQLEMVLPLHYAPFASDFELIPDFQPDFNMPTKPFKPLEQLMGVFPSASRAHIPDGWRWLMTDSSSPIIDFYPETFEIDLNGKKYAWQGVALLPFVEEKRLLDALDSVYATLTTDEIARNATGPDRLFVGNKHNLFSLVYEVHSQKTTTSIKDELTNDDTKETSEGTRETEGEAEETQQAENGESEQIAKTEETTAQEEQANEEAISKPEQAPKQEFETEIEFVDDEEKKWVHIDAVKAYGMSGEVSYDVEALAFGEAHRSLFRNSLEFGDIKYQHQQQWQQGQFYNGQQQQQPVPLFSFGQMAMPPPPPLPPQNWITSHPPPQIQSHVPYGQPPPLISQPRNTQHHHRRNDNNRTYNRK

SEQ ID NO: 158448 - protein, 68 aa, Heterodera glycines
  Coding regions on vcDNA: vcDNA=SeqID_84871; Strand=+; Position=1 -105,162-263
MCLSTAAADNKVVSKYDDYQKEMRLKQIERAFDEAMPKLLHGSYNNLMAFLDTNSFRFEDKVWLFESE

SEQ ID NO: 158449 - protein, 103 aa, Heterodera glycines
  Coding regions on vcDNA: vcDNA=SeqID_84872; Strand=+; Position=1 -45,93-233,326-451
MLNFRNFNRQYRLKNLKWYDGYSIFYVNGEGLVYKVTIQRTMPDDSLKIASLKDKTKEFVQRKILPNPSPNCAGQHQQQQFTSANCASERPPRQQRNDGRRKE

SEQ ID NO: 158450 - protein, 39 aa, Heterodera glycines
  Coding regions on vcDNA: vcDNA=SeqID_84873; Strand=-; Position=1-5,65- 179
MSTEYRQAFREEFPIIFKRNLNVIQVSPQQNGTTFAANK

SEQ ID NO: 158451 - protein, 87 aa, Heterodera glycines
  Coding regions on vcDNA: vcDNA=SeqID_84874; Strand=-; Position=1 -24,69-196,242-353
MADLSNLTFLLEFANETPNWKLISCAAILGIIATMGIVLNFSVIYVTIRTKSLNGTVNYLLILCSFFEIIHQSGHFLFVYTAFSGQI

SEQ ID NO: 158452 - protein, 85 aa, Heterodera glycines
  Coding regions on vcDNA: vcDNA=SeqID_84875; Strand=+; Position=1 -208,801-850
MEEQRKKTEVKRRKGRRNERHKQPTSSVLAGILEEDEARLWGEEGSTASLEGGKVSILLVLLESFSSHQNHPDGVIWSRWCKCLF

SEQ ID NO: 158453 - protein, 148 aa, Heterodera glycines
  Coding regions on vcDNA: vcDNA=SeqID_84876; Strand=-; Position=1-447
  Homolog annotation: Hit_ID=YP_145681.1; Match level="QueryCoverage =67%, HitCoverage=37%, E-value=4e-12, Identity=38%"; Hit description =CopB protein [Ralstonia metallidurans CH34] emb|CAI11330.1| CopB protein [Ralstonia metallidurans CH34]
MAYQLTPIIMLRWLFVGLVLSSHQQMAQMGRMEGDQKRGMEMGQMRGMEMGQMRGMEMGQMRGMEMGQMSGMEMGQMRGMERGQKPGMVITQKSEMDMAQMRGMDGDDGQMRASWAASQKLLRAEEKEKGPKSQKNETEKVKKTCEMR

SEQ ID NO: 158454 - protein, 83 aa, Heterodera glycines
  Coding regions on vcDNA: vcDNA=SeqID_84877; Strand=-; Position=1 -70,258-437
MLRTLGVWRKEQMRTGDAGQEEEGGLNSGALSLDKNIVPRECAGLKDACVEKPLFVGSKSKKCDCEVGFQKAGFKESEGMTEE

SEQ ID NO: 158455 - protein, 237 aa, Heterodera glycines
  Coding regions on vcDNA: vcDNA=SeqID_84878; Strand=+; Position=1 -30,203-424,1321-1436,1596-1665,2384-2656
MQQINGIIMKPPPASEYEIRCYASAPTDESGESSPAAANPKPKAMQKLEEEQRNEFLGEYGLYRSSALQIAKNVMSKLLQAHLVAWATEHPGKAVERKVDGSVVQVAHMYTQGDVCTETGAHRDCQVRMKCREDINAQKVFIYMLEEEIMRVVRQLLEGAGDGQVFVSAAKLKIGKGEDSEEDEEAEQQQQQEGKSRETAEAEAEHGQGSEAEKGIGREEQQGQTQVTTDNETDRER

SEQ ID NO: 158456 - protein, 178 aa, Heterodera glycines
  Coding regions on vcDNA: vcDNA=SeqID_84879; Strand=+; Position=1 -18,78-291,434-738
MSKWTEDGGQRVQMRNDERTATDKGPPRLNLYRTSQIIAQLPRDPPPELDEADEWEDERGTNGLHGDGHHGQPPPPPAPAPFAPLEVFPLALPSSSRSAPSSSYLRLFSSQPTTPRHAPPNHPTFAQPFMDDDQYYQRHLRQRQLLNALEGSINTPTVRTEQRRIIMETEMTNLVSKR

SEQ ID NO: 158457 - protein, 38 aa, Heterodera glycines
  Coding regions on vcDNA: vcDNA=SeqID_84880; Strand=-; Position=1-151
HFTRPITFYASQQHFTRPMTLYASHDILRVPSHFTRPN

SEQ ID NO: 158458 - protein, 45 aa, Heterodera glycines
  Coding regions on vcDNA: vcDNA=SeqID_84881; Strand=+; Position=1-137
MMAFVKSELAQQHAVRAQQLARRIRAVAEAAPSSLRLASGAVELQ

SEQ ID NO: 158459 - protein, 97 aa, Heterodera glycines
  Coding regions on vcDNA: vcDNA=SeqID_84882; Strand=-; Position=1 -79,1539-1753
MRNIYNFLETNLLNEEELNYKMKEEKTKSPKVPKQLPPLIKPIFIELYSPKNLIDVVETLNDKSKYFWKEIENEFDYFDNNLNKEGKSGENKFINPK

SEQ ID NO: 158460 - protein, 38 aa, Heterodera glycines
  Coding regions on vcDNA: vcDNA=SeqID_84883; Strand=-; Position=1-114
MCKRKELRKKNYEEKEANEYGKGATNYGIITVINYDDT

SEQ ID NO: 158461 - protein, 37 aa, Heterodera glycines
  Coding regions on vcDNA: vcDNA=SeqID_84884; Strand=+; Position=1-111
IKVDVEASNQVENVLFMLNISKLVRRKKGICLKSRSL

SEQ ID NO: 158462 - protein, 637 aa, Heterodera glycines
  Coding regions on vcDNA: vcDNA=SeqID_84885; Strand=-; Position=1 -108,153-615,1173-2330,2382-2566
  Homolog annotation: Hit_ID=BAA95789.1; Match level="QueryCoverage =83%, HitCoverage=93%, E-value=3e-23, Identity=24%"; Hit description =KED [Nicotiana tabacum]
MYDIISVFKNESRLYSLYLEFLTITKSMNWLNVKLKLDLFIFVQWTDAKISNSAATIARKKCANVWKRHKFLFYQLYDRWHDEPLDEMPNFQIYQSIFLSEMNLFFEKVLEGKQMKSEKAMDEEIRKIIEKAQKKYDEKKGTRKVKGKAKESDKNGENYAKFEVKLGEKNVETLSKLVEENAIFKKILKTIYESFVDVNDMPEYLGKETTEQIWKTLAIKYFETEEKEKEKEEKEKEEKEKEKEEKDEKEKAGKEEEEEKKEEAKLNAKKKKQKRKKSKNGNKETKENEIKADNGKNSRETEEEERRSFSTAEEEKESFAMGRDTERKEQMKTITVTKSTVEEGKGGNGKGKEEKETEPPNEGLMGTEEDEGEKEGTKLINFATDQFLALKYAEIVNASAKEQQNDDTKMTSAIELANVGILANEIANRLEAIEWLDVQRKSDKTKSISDQWERLKEMKYSAKHSYEGISKRLFQLLMELSGEMDNLGTNLEDKSDKLDQENENIKWENWKEIVGKLHFRKFGIAIVKGRIENWEKLGQKQKTLALSNIVEKREKILEEFERNLEQIEKSEKQRKLDKNIFCQYQSDTNLSEFIEKKDKINFSEKNSQLFPSEKWQEINSVKEFERTNLEEKEKVKI

SEQ ID NO: 158463 - protein, 293 aa, Heterodera glycines
  Coding regions on vcDNA: vcDNA=SeqID_84886; Strand=-; Position=1 -472,769-1175
MNMVRIGEENDKIIVQKTANLEESLYGILYGLEKENRGDTNDGLTAIRTKTMLIHLTEHFVNLHNGSEQLRQCFEGQTFIRLRFKRFVKIMEENVVDEGKVVADQFWHIFKGGTAHSKNNQIKPESFSAILPMNDECPDKEFSLLHSAEKDRVDMTFDSYALMEQYIQLLWEENKQKSEMEMNELTKSVEIGAALLYYGQKAEKLLKYAQFYVENDIFADEIVVYMSKFNKLMKVPKSDDQNLEGKLCQIYQFMHKLVNDAQLIELSEEWKKLLEENVKELGTEPLDKQISLE

SEQ ID NO: 158464 - protein, 147 aa, Heterodera glycines
  Coding regions on vcDNA: vcDNA=SeqID_84887; Strand=-; Position=1 -88,152-507
MRSNNCQFIPLFSFYILFLASQTFSKNLFGIDTNRLDEYYAKLLFDDNLSINDQTILINRLSASHLHRRIKKDFEEFEKIIKPKKSADWLKRIKILKDKFEEIEKEFAKEDKFMQIVLSNLCHFWQLTILLDNFKSGLSTISLNPIE

SEQ ID NO: 158465 - protein, 87 aa, Heterodera glycines
  Coding regions on vcDNA: vcDNA=SeqID_84888; Strand=+; Position=1 -140,1000-1123
MVRAEVTPTLIKMGKMGLPNVRKSMSLLGAYSSDQTPAAVHLPCPYFSKYHEIMKNEFPCVKFLLCSNNHKPPVVVVSVSYYYELRI

SEQ ID NO: 158466 - protein, 51 aa, Heterodera glycines
  Coding regions on vcDNA: vcDNA=SeqID_84889; Strand=-; Position=1 -15,45-143,453-494
MLSYWRQRNKNANGFAKNSVKQLNVSIRTSNSNYMSSWKLHGFLQIYFFIY

SEQ ID NO: 158467 - protein, 106 aa, Heterodera glycines
  Coding regions on vcDNA: vcDNA=SeqID_84890; Strand=-; Position=1 -242,682-760
MAFGVSRQLTFDELAVLCPDEKEFCYKTALLGNCFGKSVKAKLGNFILSESAKIRQNCWPNSANVLVKVHSTDAFRTVAERPTCDVQSIFSYQVKRKEKCLTSFGF

SEQ ID NO: 158468 - protein, 108 aa, Heterodera glycines
  Coding regions on vcDNA: vcDNA=SeqID_84891; Strand=-; Position=1 -69,288-374,715-885
METVLRPQTTTNREAEKYLLKRGIEKGSTVMAVKKEPGKGHGSTIATNVVTNLFGIDMKQPATVFRYEVKINGQIVRQSGECLLVDITETTKFECVFHRMHSEIPFIF

SEQ ID NO: 158469 - protein, 58 aa, Heterodera glycines
  Coding regions on vcDNA: vcDNA=SeqID_84892; Strand=+; Position=1-5,81- 252
MEHLPKNGVPKLYQCAKHKDTFPPTKTNQTTPINNKANLYNCLCFYCSTDNAETPSIP

SEQ ID NO: 158470 - protein, 66 aa, Heterodera glycines
  Coding regions on vcDNA: vcDNA=SeqID_84893; Strand=-; Position=1 -72,514-642
MGDYLGGKWLFVIFNIDVGPKFSQYSFKTLTEAEYAEHEKKCDELEYSNKIANKLMYQKCKQLFYK

SEQ ID NO: 158471 - protein, 108 aa, Heterodera glycines
  Coding regions on vcDNA: vcDNA=SeqID_84894; Strand=+; Position=1 -139,205-392
MALIALSFYCIGILLLPATIFSQNRRGNSEFAHICGKFPNRYFSYEPCPEDERQSSQNQRNRNDQPPRRDQQQQQQVCTRQGWQPIGIKCQNVNDCYQHRESILITFQ

SEQ ID NO: 158472 - protein, 79 aa, Heterodera glycines
  Coding regions on vcDNA: vcDNA=SeqID_84895; Strand=+; Position=1-355
IVETGNFKFADPVAGLEFKIFYRTGSGRINPANPAILQILHLKSAGSCAGLRILGNFKKFCINKKVFQSIKKYSNIFLN

SEQ ID NO: 158473 - protein, 42 aa, Heterodera glycines
  Coding regions on vcDNA: vcDNA=SeqID_84896; Strand=-; Position=1 -37,423-514
MILSSLILLLLDMYVDFTNFCHYVLGNQYTLPWKRVFPIATL

SEQ ID NO: 158474 - protein, 21 aa, Heterodera glycines
  Coding regions on vcDNA: vcDNA=SeqID_84897; Strand=+; Position=1-65
ITVNALIIAQSLLIPQSPIIP

SEQ ID NO: 158475 - protein, 77 aa, Heterodera glycines
  Coding regions on vcDNA: vcDNA=SeqID_84898; Strand=-; Position=1 -151,806-888
MSPRTESPFGFTSFQIWVIRAFFKNHEPRLALNLIRFHRRPFVLIWHCSKQKFYSLHKMYTNYIPYSVNMLIGSGIG

SEQ ID NO: 158476 - protein, 59 aa, Heterodera glycines
  Coding regions on vcDNA: vcDNA=SeqID_84899; Strand=-; Position=1 -117,1812-1873
AMIIGNNLRDHRVLIGLNDENPAFHNVYELDLINNQMRMDDMQYLVNLRPSGTPVIESM

SEQ ID NO: 158477 - protein, 21 aa, Heterodera glycines
  Coding regions on vcDNA: vcDNA=SeqID_84900; Strand=+; Position=1 -24,517-558
MYLYKFAQLIFLQIICINLLK

SEQ ID NO: 158478 - protein, 20 aa, Heterodera glycines
  Coding regions on vcDNA: vcDNA=SeqID_84901; Strand=-; Position=1-60
ENIDHSPQTQKCLKTVRIDV

SEQ ID NO: 158479 - protein, 671 aa, Heterodera glycines
  misc_feature (349)..(349): Xaa can be any naturally occurring amino acid
  misc_feature (628)..(628): Xaa can be any naturally occurring amino acid
  misc_feature (636)..(636): Xaa can be any naturally occurring amino acid
  misc_feature (641)..(641): Xaa can be any naturally occurring amino acid
  Coding regions on vcDNA: vcDNA=SeqID_84902; Strand=-; Position=1 -41,1551-1909,1983-2038,2087-2297,2351-2389,2429-2484,2788-3113,3159 -3282,3336-3471,3519-4050
  Homolog annotation: Hit_ID=XP_419506.1; Match level="QueryCoverage =92%, HitCoverage=28%, E-value=3e-79, Identity=31%"; Hit description =PREDICTED: similar to FLJ00002 protein [Gallus gallus]
PPPPPSVCQQHTFSHEHSNWLSKLFFCWTNPLLRKGFQGHLSQVVCLLLPPPSPFKILFSKRWTMCSIFRPASTPRLQRDILGDCHGQSDHADQRLLSAESFAEALFRAYGRTFLLIGVVRFTGDAFRFASPILLHLLITSLQESSQSVNLGYVCAALMSVSLFVSSVCDFQVNLGYVCAALMSVSLFVSSVCDFQFNYYIEMITLRAKSALLLAVYQKLLRIPAFQLTEKFSSGNLINLMSSDVDRVGGLMVAFHAVDRVGGLMVAFHAFWSMPINFFWSMPINFAIALYLLYREVGMAFLAGVLVSLLLIPLNKYIASKVGQFSNKMMQMKDARVKLCTASPPPCFXFPFLNTVTELSRSMRTVKLNNWTAFFEAKIGHLRSRELANLKGMKYLDAVCVYLWASAPTVASAPTVIMVLMLVTYSVVLGELLTAAKVFTTLSLISILIMPLNAFPWVNAFPWVLSAIINGMVSKRRFDAFFAIRCGDQRQNILTQAEGGGERLLGLDLLGLDGNSFAWNETKSAVSNVHFNGKKVQKMIQLEFIFPVKGMLIGVIGPVGCGKTSLLMGLLGETIATGAVWAKCFDEGFLCCQDVWLEKGTIRKNVLCERPFDQKCPWDSCALSDIQXNESLFDQXRANEXINSQMPKENIDPPAMDPPERSDVWGGGGGG

SEQ ID NO: 158480 - protein, 168 aa, Heterodera glycines
  Coding regions on vcDNA: vcDNA=SeqID_84903; Strand=-; Position=1 -138,190-417,1229-1319,1601-1650
  Homolog annotation: Hit_ID=CAE70143.1; Match level="QueryCoverage =95%, HitCoverage=28%, E-value=4e-17, Identity=53%"; Hit description =Hypothetical protein CBG16605 [Caenorhabditis briggsae]
MLAHLTERVIVKDKDGQLPERDCVTLVNATQNALQSLLSSAACEVKTFVREAEVQHGPEREVKMTEVVVPVVEVTSTEPLSQMIGSGLIAASVSGVPVQNGLTTLNTHVKAATGEEVPQTILARTTSTLFDVKQYCTDMENLLHRIWKRYENGLPPDHILNAKLEASV

SEQ ID NO: 158481 - protein, 273 aa, Heterodera glycines
  Coding regions on vcDNA: vcDNA=SeqID_84904; Strand=-; Position=1 -115,178-404,454-563,643-700,745-973,1387-1471
  Homolog annotation: Hit_ID=XP_420197.1; Match level="QueryCoverage =89%, HitCoverage=41%, E-value=1e-120, Identity=45%"; Hit description= PREDICTED: similar to UDP-N-acetylglucosamine--peptide N -acetylglucosaminyltransferase 110 kDa subunit (
ELWLALHHFEKAIALDPNFIDALINMGNVLKEARIFDRAVAAYLRALALNPNHAVVHGNLACVYYEQAHLDLAIETYKRAIELQPNFPDAYCNLANALKEKGLVTEAEQAYNTALSLCPNHADSLNNLANIKREQGKIEEATRLYLEALKIYPEFAAAHSNLASILQQQGRLQEAIEHYKEAIKISPTFADAYSNMGNTLKEMGDINGALQCYTRAIQINPAFADAHSNLASIHKDAGNIPEAIHRQLLVVMRSYALRRFKCFINLRTLTPTN

SEQ ID NO: 158482 - protein, 46 aa, Heterodera glycines
  Coding regions on vcDNA: vcDNA=SeqID_84905; Strand=+; Position=1-138
MLDLVDREKVIAKNMLGPKREGPTEVNRFFETTKNREKRRKWWQGK

SEQ ID NO: 158483 - protein, 47 aa, Heterodera glycines; identical to SEQ ID NO: 130102
  Coding regions on vcDNA: vcDNA=SeqID_84906; Strand=-; Position=1 -90,313-366

SEQ ID NO: 158484 - protein, 128 aa, Heterodera glycines
  Coding regions on vcDNA: vcDNA=SeqID_84907; Strand=-; Position=1 -277,319-450
  Homolog annotation: Hit_ID=XP_345218.1; Match level="QueryCoverage =96%, HitCoverage=51%, E-value=3e-10, Identity=34%"; Hit description =similar to ES/130-related protein [Rattus norvegicus]
KKLKNGRKAPVLRPRSGRMFPTKLKNGREAPVLRPRSGRMSPKKLKNGREAPVLRPRSGRMSPKKLKNGREAPVLRPRSGRMSPKKLKNGREAPVLRPRSGRMSPKKLKDGREAPVLRPRSARMFPKN

SEQ ID NO: 158485 - protein, 329 aa, Heterodera glycines
  Coding regions on vcDNA: vcDNA=SeqID_84908; Strand=-; Position=1 -351,718-924,964-1395
MEDNSLLSPKELNAIKNGAMMKAKAASQLWSSLFCPKDEEAIFATDAYAKLNSWLLSWMERLRKKQQIEGENGRKGKKRRTDLEEEEDEEYLDDLGEEPPENPVILTGPTGCGKTAMCDLHYLPDTNFWSTLKQICANSLVPIVLTCNDYEVVRTNMLNREPALETFSTIHVDKMPSFQSFNAYLRQWLIGFTGKIRKNSYLSNLFEQKRGDFRAILNALQLDGQHSLSIIEKPTGNGQKQIDFKEFVLQSKRASAVDSTCGKTNEISWRAKQMTDLDYRREKPTRDWTTKVAEMDELRIELLSLLRVDVDWCEILDWFITRFHNYLYS

SEQ ID NO: 158486 - protein, 129 aa, Heterodera glycines
  Coding regions on vcDNA: vcDNA=SeqID_84909; Strand=+; Position=1-390
MQSKQLMWNRRIGRHRSITTLLPPPNQVWARSLSVGYDSWINITGFWINIPDHFIIASEGKNLFYAKPMYHQNSLIHNQQHYIGTCIETAIRMYSRDWDPVEEANREWFRSLQLGPPNSDRETSSRHLR

SEQ ID NO: 158487 - protein, 286 aa, Heterodera glycines
  Coding regions on vcDNA: vcDNA=SeqID_84910; Strand=+; Position=1 -386,504-978
MRTVLNCLSILFAMFALGGAYPTNHCSECKLLCFNKGVKAKIPKEINKVELCCAENCYIHENVKKLTYELPKEILLNDFKCEGHFWMDSKHMFKKDILCPAVDECELIECYFCIEQLANPTCYPLISSMPIIYLAGPNRPPKDRRPRATASQNWTSRRVYRTMAFVVLMVNSLQNLTGAETIAVMAKSEKCIKNATSMRCIVENSATLTLLPAGQTNTLLLKTEEGVLLGSINVVLKALALECQSFTKAWLRSYAINVWPAKGALKWAPAKESIVEKFATILQFLS

SEQ ID NO: 158488 - protein, 330 aa, Heterodera glycines
  Coding regions on vcDNA: vcDNA=SeqID_84911; Strand=-; Position=1 -519,1120-1590
  Homolog annotation: Hit_ID=AAK31375.1; Match level="QueryCoverage =97%, HitCoverage=23%, E-value=9e-09, Identity=21%"; Hit description =ppg3 [Leishmania major]
MNAAMMAAAAAVAASSGGTASSMPSSTDVPPTSSLAAVMESGAGRYTGGGGGGGSSRSNHLHNHHNRVQSAAAGEEFGTAGFAHSSSASAFMAPPTMVPFGHHNAFQSVNALAASLYRQQHHQQQNNANGKRCASPMGSGGGGGINELLLHQQQQAATKRRRLNTADAPATRNLRSPPRDHHNNNLLANQQNNSNTTATSNSSAYNLQQGLLAFVNRHHQLQQQQIAASANALRLQQQQQQAVPSSSSSSSSASVAGGVPTQQHHQHHHHPILVDTTSSGSESGGASSEAAAAAAAQPSATSRYAPLGNNKRCSSPPHSCSDDAASSSAM

SEQ ID NO: 158489 - protein, 93 aa, Heterodera glycines
  Coding regions on vcDNA: vcDNA=SeqID_84912; Strand=+; Position=1-415
YPKRTLEKIDFFWVFGAVPPNRCAQIYGETESFGSSFPIVCTLILRWIFAPHNCLSTPNGHLKKSIFLFSGQSPRTDAPRFMGRPNPSGVASL

SEQ ID NO: 158490 - protein, 248 aa, Heterodera glycines
  Coding regions on vcDNA: vcDNA=SeqID_84913; Strand=+; Position=1 -79,136-803
  Homolog annotation: Hit_ID=P45441; Match level="QueryCoverage=45%, HitCoverage=27%, E-value=1e-11, Identity=38%"; Hit description =Cytoplasmic RNA-binding protein P54 (Y-box factor homolog) (MRNP3) pir||A41786 mRNA-binding protein p54 - Afri
MQAVTRPPIVLERGVSGRVKWFDFSKGYGFITRDDGGQDVFLHASSIVRKVNMYFVLIEGQRVSRTDFELTEGLGHGESGEYNDPRIQVEFDVIDGEKGREAAAVSGPGGIRVGTAIQYNNTARSQPLPVNANNSAGRMFIAGRFRRPVGKVLFGVKMRFFGPLTFTPNKSFFGLSKWTSNGLVCPYKCVLPSADSPPNLFSPSAEQQSQVGRRFGPRGGQWRRRQCKVSAALSVQRHSQRPSHVQSE

SEQ ID NO: 158491 - protein, 86 aa, Heterodera glycines
  Coding regions on vcDNA: vcDNA=SeqID_84914; Strand=-; Position=1-302
GILKFILNPRKMSISFFEKFYTSQKRLRRDGGLCTIAILFHRGFLYLEVIPEKWLSLFLINFIHIQMLSSMIGRAVRNRPFIFEGI

SEQ ID NO: 158492 - protein, 56 aa, Heterodera glycines
  Coding regions on vcDNA: vcDNA=SeqID_84915; Strand=+; Position=1-170
MIGRAVRNRPFIFEGIFKFILNPRKMSISFFEKFYTSQKRLRRDGGLCTIAILFHR

SEQ ID NO: 158493 - protein, 63 aa, Heterodera glycines
  misc_feature (56)..(56): Xaa can be any naturally occurring amino acid
  Coding regions on vcDNA: vcDNA=SeqID_84916; Strand=+; Position=1-191
GSIGPTDPRFCHCSVLLKYLLASSSLTFGFLSVFSKCLLFLLWMSPLIRRLPLRIXPFASSQQ

SEQ ID NO: 158494 - protein, 38 aa, Heterodera glycines
  Coding regions on vcDNA: vcDNA=SeqID_84917; Strand=-; Position=1 -34,191-273
MDSRYEVNERLASDFAERLNVVRECVIRAEDALAIRNL

SEQ ID NO: 158495 - protein, 491 aa, Heterodera glycines
  Coding regions on vcDNA: vcDNA=SeqID_84918; Strand=+; Position=1 -132,566-689,736-919,966-1093,1142-1296,1343-1570,1621-1798,1839-1891
  Homolog annotation: Hit_ID=NP_501545.1; Match level="QueryCoverage =93%, HitCoverage=31%, E-value=1e-109, Identity=45%"; Hit description= steroid receptor-interacting SNF2 domain protein (146.2 kD) (4J665) [Caenorhabditis elegans] emb|CAA9098
HDETGADGRLLINAGKPDSDPEVLAEHLTNVLQPHQIGGVKFMYDNIIESLETFHKSAGFGCILAHSMGLGKSIQAITFLEILFRITGKRHVLLICPVNVLQNRITGKRHVLLICPVNVLQNWHNEFNRWMPETDAETARPIRHFELFVIGDSVKTLENRAQMIENWYQSGGVLLLGYEMNWYQSGGVLLLGYEMFRLLVHQCELLGEKSAQRKKASKKQPLEKAQMTQKDELQRNIRQEKAQMTQKDELQRNIRQALLSPGPDLVICDEGHRIKNLNTEVSCALSAINTKRRIVLTGYPIRRIVLTGYPIQNNLTEYFCMVEFVRPSYLGSKKDFQLMFDKPIRNGSCTDSAKSDVKLAKQRIHVLCDMLRGFVQRRSQHLLKKILPENREFVRSQHLLKKILPENREFVVLLRKSELQHSLYRAFHHFASEQISVGESSFNPLKAFAICLKIANHPDMLYAALKKHQIKLKIANHPDMLYAALKKHQIK

SEQ ID NO: 158496 - protein, 186 aa, Heterodera glycines
  Coding regions on vcDNA: vcDNA=SeqID_84919; Strand=+; Position=1 -155,188-298,407-464,959-1197
PSLSYAQIVRPPQKCVARTDQRNSWPTAHERGMAITNLRTEGGDHNQFLWNCFISCQFQSDDDDFIMPFGFTNQLTGERLAFKSANILSYRGTSDPSDQCECNWPEFAVFMTAFHLVCDYAEAELGPAEQKFMRTYRFRISIPPKDEKKWGTSLASAAYIGMVALLTGRAVRADWCVTGALDSDEE

SEQ ID NO: 158497 - protein, 121 aa, Heterodera glycines
  Coding regions on vcDNA: vcDNA=SeqID_84920; Strand=+; Position=1-366
MIGSNWKNGETHRKTSTEVKKREFNEMQLIIGDLQASTHPLMCPLWHTFYKFRTVTAHDGHWRRSSRNWWPITVAEARREMKTAKEEAERSSRNRRRRDLTNDLHAVIKLTQLMTQILFDV

SEQ ID NO: 158498 - protein, 35 aa, Heterodera glycines
  Coding regions on vcDNA: vcDNA=SeqID_84921; Strand=+; Position=1 -85,504-526
MAEIFDSPRSVIEESEKIFLRQPIPDEVGKIPRKE

SEQ ID NO: 158499 - protein, 1784 aa, Heterodera glycines
  Coding regions on vcDNA: vcDNA=SeqID_84922; Strand=+; Position=1-5354
  Homolog annotation: Hit_ID=NP_920205.1; Match level="QueryCoverage =67%, HitCoverage=74%, E-value=4e-87, Identity=25%"; Hit description =putative DNA helicase homolog [Oryza sativa (japonica cultivar -group)] gb|AAP52492.1| putative DNA helica
MPSKQHNLRMKMKEDRRRTEKSVSPGRSPVPDGSADENGVVSHPGNVTPNISALQLSTPASSIGSKRRGRPSNAGTESITASQHSVSSVGTQIASATQNDESSPRNKKGKIDDFDRPMSALEAIASTPVSTQRNRGGRPSKKRGGHAGSGRSKANDSMSESSSMDQSSEAITNVVVLPTVTDKINFSTVQINFATTRNFACKIWKWAAIGLYERDGETALAPRSGPRFIETCWNDLTQFLNDGFAATYLAYLASISQRKVVVVDPMVWENGLDRVMQYKNMTFGYDPNVQAEVILLPVHFPGHWTLIVHDVQCGTHFADSLPTPYGRLDVQLTDKIIKIISDILPSTVLTGIVDVQNLTAQHDGNSCGYFVCLYAESWLMNNRTFVLPDLSINYEKKRILWHINELYGSDNVPYHPREGVPTPCPIVYRHADEAQSTSKAVESMEVDDNDDIMIIEPQTSGQAANAILTQAQVAGENQVDSLGLVSESCAPQEPIAQADDVIFVRPKTPTRRSVRIGRRQSASISRSPSPAPRRRLSTNAVEQVTAFTQRCYLVHKGWCCAAAAAKHYPEYSNSGKLGDKKCSHCGALLFPHEDSSLCCRQGRVVLPKLNPHPKELKELIACDKQSREGKEFVRHMSRYNNLLQFASVSAGNKPCPAGGPMAVILNGEFHRRISSMQAGTTQIPGFGQLYILDPVEAMEQRRKNPTFTGGKITNDEEFVQGHQLNDETLEILEQMIQENHPAASAYKQAREQLQELLRQQRTEELRFFRMTLLNERSAPGGLKDPKLHPHQIITPSTGEGMFAIHADPTGAPAPKGIWVENKQGQLNEIAPFSPWTDSLTYPLIKPKGDDGYKIGIPYAKPAQKKRRSDQCVDLFDTDTMSDDDICETESIASSDAGSEASMQSVTSRYDKSKKFVSLRDYCKYYLAIRDENLEWHYHHILSCGGGLGQRWVLDQAAKIDWQIATFLRRPDMDLRISTPKNLLLYLVNQYNKQQARQNPNAQQKSVDDIGSVVRLSERNVNSLQYWKKMYEDCNTIFARCHDAKKARLFITFTNNREWPEFKENIYKNGQMFTDRFDMWMRVWSSKIAVFHQELYEKSFFGTILGSGESMEFQGRGGPHAHIVAQTDLDAVPEVIQEYIWAHIPPLPCKDDDSPIAQMHREVRELMHMQLHRCSDSWCGPCDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAQYAKMNFRGATEAFAVVHSMPFAKLSHHVVHLSIHLPNQQPVVYRAFQLVSKAEEIQRGELPETPCSAYWKQWQNEWQHVPSLKDMLFEKVPEQFRWAKDRWVPYKKKPVKRPPIGRVVPVPPTDRERFALYALMRHFPGDPDHLKLVNGQQYNTFTEAALQHGLLEDDQIWHKTLGEAALHRWPDQMRWLFVSILVFGQPSNALELWNKYKDQMYYPQGITSAAIRQAREQQALADIDWRLHFFNLSCVHFGLPDPPNSKAKNTNLAVEEFFFGDDDLNMPPGQPNRKPQQYTPPPLNSDQQKVFDAVVRAIQSDPKDQTVPRRFFIFGDGGTGKTFLFGQIIKRLRKPPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVLACFQTSPLFGQFTTMKLTINQ

SEQ ID NO: 158500 - protein, 72 aa, Heterodera glycines
  Coding regions on vcDNA: vcDNA=SeqID_84923; Strand=+; Position=1-218
MPNSTPTVPFELVNERTQEKLTLLKESDAFANDWLLKRCPIVGETAAEVKWKDEYFFSARVDISLSVDNHCI

SEQ ID NO: 158501 - protein, 141 aa, Heterodera glycines
  Coding regions on vcDNA: vcDNA=SeqID_84924; Strand=+; Position=1 -151,613-725,1144-1305
MKGCLIGTRELFCNELREYRVFVGFWQKHECNKPDNVPLGQRCNFDAYFNEIHGIYIAYFCELDEDQQQDENLLCDVFLPEFDNAPTLVKTANLSFGGRYIRGFLEKCQNMGIKYGHKCQNMDKYGNKSRNMEKYGYGNTA

SEQ ID NO: 158502 - protein, 207 aa, Heterodera glycines
  Coding regions on vcDNA: vcDNA=SeqID_84925; Strand=+; Position=1 -97,162-284,328-549,715-896
  Homolog annotation: Hit_ID=AAH63955.1; Match level="QueryCoverage =29%, HitCoverage=11%, E-value=4e-10, Identity=52%"; Hit description =Ckii protein [Danio rerio]
MARLLLLVFGLAFVFAVLAFGSAQPPPPFQGSGQFGAPPFGGSPPFGGNSADVSVSASDSSECSGEGGNGVQGGGEYGNGNGYGNGNGYGNGGFGGGGAEGGQGMDIDVDVQQSSEEGKRRRKRHSGFGQLIDKIKNFVGGKESMERENDKNGFRPKRNYNPLMMGAMGASQYGQIDHQLIEKYKHLFPICRFDVRLALSVELGLWE

SEQ ID NO: 158503 - protein, 177 aa, Heterodera glycines
  Coding regions on vcDNA: vcDNA=SeqID_84926; Strand=+; Position=1 -90,413-505,1080-1153,1205-1272,1332-1494,1536-1581
  Homolog annotation: Hit_ID=NP_495322.1; Match level="QueryCoverage =94%, HitCoverage=25%, E-value=7e-14, Identity=31%"; Hit description =chaoptin (2G832) [Caenorhabditis elegans] pir||T15864 hypothetical protein C56E6.6 - Caenorhabditis elega
MAFGSFDGLSTSGVSSLQRLSLAGNQIRELLVHLDLSQNRIGRLTKDVFERLDSLEWLSLDILSSLKNLRQLSLAHNDINETQESAFANLPHLEELTMAHNRLRTIKEALLRLITPGVFDKVPSLSRLDLSHNRIEAFDLDFLGPTQVYQLRVLDLSFNVIRKLEIQSAKHSLRSWT

SEQ ID NO: 158504 - protein, 362 aa, Heterodera glycines
  Coding regions on vcDNA: vcDNA=SeqID_84927; Strand=-; Position=1-1086
  Homolog annotation: Hit_ID=CAA82797.1; Match level="QueryCoverage =74%, HitCoverage=41%, E-value=8e-20, Identity=28%"; Hit description =gag protein [Ascaris lumbricoides]
MSGPIQKGIINALKALDNAKSATSLLLHPDPDLSNWENAINLEAQFDRVVKEIRTTEMQMDSLRDLSNAWIELLARLTGDDKDNGEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNLLGGEARELIAGFRLEDANYETVLQLLKDTYGAPEEHIRSLHFELANLKPCRSLRETKDFMLQLERLTRELNNAGEDIEGPQVFLMLEKKLTPPFLRSILTKKGEDPANWTTTKFLDVLTEAVRKEVQIQEVMGEYGHHYVQPKAEVVSAAP

SEQ ID NO: 158505 - protein, 67 aa, Heterodera glycines
  Coding regions on vcDNA: vcDNA=SeqID_84928; Strand=+; Position=1 -48,474-629
MGPGHLPVTAVFTPSKVIVDEIVQADCDKLLFKHTSSVPLHLDKLADNAITDIVFRDWIDNLTEWVL

SEQ ID NO: 158506 - protein, 62 aa, Heterodera glycines
  Coding regions on vcDNA: vcDNA=SeqID_84929; Strand=-; Position=1 -135,551-604
MEFEAECVDAMQKCMECGWAKCIPQEGIAASHCCAAGYNFTCCTEDNIKHLGLSKDIKVFKI

SEQ ID NO: 158507 - protein, 139 aa, Heterodera glycines
  Coding regions on vcDNA: vcDNA=SeqID_84930; Strand=-; Position=1 -114,156-282,731-855,989-1040
MPSSAQRKRAELHWGIIGLGNIANDFVLAMAYCQHPNKVTAVATSNSVERAQQFIQKVGLNSEQVKAYGNYEQLLQDADVGLLVWFLSELAENPTNGARRTDGQPQIGLGGFQSKIGESTDGGKKVIDVKVIGDVSAED

SEQ ID NO: 158508 - protein, 107 aa, Heterodera glycines
  Coding regions on vcDNA: vcDNA=SeqID_84931; Strand=-; Position=1 -85,387-460,519-627,677-732
  Homolog annotation: Hit_ID=NP_501507.1; Match level="QueryCoverage =100%, HitCoverage=21%, E-value=1e-42, Identity=72%"; Hit description= signal recognition particle 54kDa (55.0 kD) (4J508) [Caenorhabditis elegans] emb|CAA92301.1| Hypothetica
MGDIEGLVEKVTEMGLEDNEELIKRLKQGQFTLRDMYEQFQNILKMGPFGQIMSMIPGFGTDFLSKGNEQESMSRLKKLMTIMDSMADNELDHPKANDLFNKEPTRV

SEQ ID NO: 158509 - protein, 161 aa, Heterodera glycines
  Coding regions on vcDNA: vcDNA=SeqID_84932; Strand=+; Position=1-483
MSGPIRSKIGPCAARTKAYIEAATVNLGKDTTDVSIQADLTAERRGLRRAIQLLEDCNDKWQSLLLKLNGADRQQEEQRYDDFKPSGKHFMEWADKARGAVDTIDGVIGPEDDDEITESIISQPANPPQIQHVQPPPPRHEVNLPPISLPKITGRAKGRAK

SEQ ID NO: 158510 - protein, 28 aa, Heterodera glycines
  Coding regions on vcDNA: vcDNA=SeqID_84933; Strand=-; Position=1-84
PSHFWPIKRAPFSLYAHFHISIHSFLLL

SEQ ID NO: 158511 - protein, 38 aa, Heterodera glycines
  Coding regions on vcDNA: vcDNA=SeqID_84934; Strand=+; Position=1 -67,1354-1403
MGDKLVFDEFNEEAFNIMGKSETARILEMYKNKENNKR

SEQ ID NO: 158512 - protein, 62 aa, Heterodera glycines; identical to SEQ ID NO: 150419
  Coding regions on vcDNA: vcDNA=SeqID_84935; Strand=-; Position=1 -125,1639-1702

SEQ ID NO: 158513 - protein, 73 aa, Heterodera glycines
  Coding regions on vcDNA: vcDNA=SeqID_84936; Strand=-; Position=1 -129,254-346
MTNNEMAEQSAFQSKLMLLRLKKVTHLPIDTDIKGNGEKEAEFPLTDFTSIMMYLILENIWDNRSIDVMTIED

SEQ ID NO: 158514 - protein, 63 aa, Heterodera glycines; identical to SEQ ID NO: 130392
  Coding regions on vcDNA: vcDNA=SeqID_84937; Strand=+; Position=1 -97,316-410

SEQ ID NO: 158515 - protein, 204 aa, Heterodera glycines
  Coding regions on vcDNA: vcDNA=SeqID_84938; Strand=+; Position=1 -114,159-501,549-703
  Homolog annotation: Hit_ID=AAK39378.2; Match level="QueryCoverage =99%, HitCoverage=52%, E-value=8e-21, Identity=29%"; Hit description =Suspended animation (anoxia-induced) defective protein 1 [Caenorhabditis elegans]
MMNETGNEDWFDNVENLRPIRGGRRADTLNDIATGKAKISIERAEQKFLTEFANASKGSDPLEPMYRFTIWFEEHFPSGKQKHFCQFLYKICTTYCLVNAYKNDDRLMKLWLKLTENFPESGFAIMEFAFSKGSCRQLAKFYIHWSTMYQSISWWNKAREKLQLGQKMCAMPLDLLHRAVDELEASVMKVTRSGENSEETEADE

SEQ ID NO: 158516 - protein, 50 aa, Heterodera glycines
  Coding regions on vcDNA: vcDNA=SeqID_84939; Strand=-; Position=1 -33,292-411
MHGGKRPSGQVINKYLQVQDKQSGEQVVGMPFFVGVVLKFDPINSDYQTF

SEQ ID NO: 158517 - protein, 26 aa, Heterodera glycines
  Coding regions on vcDNA: vcDNA=SeqID_84940; Strand=-; Position=1 -61,634-653
MWIRKMSPVAKCHTKNKDESDLFIVF

SEQ ID NO: 158518 - protein, 79 aa, Heterodera glycines
  Coding regions on vcDNA: vcDNA=SeqID_84941; Strand=-; Position=1 -100,205-344
MPKAEMIPKNEPKKCLICGGLSSFKYYSIPSCEACKQFFRRTVMLQIPYVCKKRGNCEMSTPYNSKILLIIFIINYQNV

SEQ ID NO: 158519 - protein, 195 aa, Heterodera glycines
  Coding regions on vcDNA: vcDNA=SeqID_84942; Strand=-; Position=1 -129,225-322,1264-1624
MNLQKATCLFGTHFVRQSSDQLIREWVNENFKNTNDFGSLLEKIENFIAYYIVALPCKLNEKMNEQLTNEMTTEIGGETIRLSESQVKQVNEMLSDDHRWENGNESEAFQKLKRELGWDAKYDPILSKIAQRTVGMTSQVEKNMDDHAAHCAAALLSELSNRHDWVRMNPTEAEYATMDGIMCVHVQIQDALFQI

SEQ ID NO: 158520 - protein, 104 aa, Heterodera glycines
  Coding regions on vcDNA: vcDNA=SeqID_84943; Strand=+; Position=1-315
MSSWPGTPEALLAGMFKHCIEEAVADSRERGIEPTHLGCMISSPLLEDGDIPTPIQQMTNNTLDTILSQFKKMAQSKELEDVMLCGEPFTVTITTLDRNGLGRA

SEQ ID NO: 158521 - protein, 725 aa, Heterodera glycines
  Coding regions on vcDNA: vcDNA=SeqID_84944; Strand=+; Position=1 -1040,1091-1857,1903-1964,2182-2490
  Homolog annotation: Hit_ID=NP_001004509.1; Match level="QueryCoverage= 84%, HitCoverage=41%, E-value=3e-77, Identity=31%"; Hit description =si:busm1-180o5.3 [Danio rerio] emb|CAD60788.1| novel protein similar to DNA polymerases [Danio rerio]
MRIRRQKKRNPNIVFRDSFNLMPMSLASLVPSFGLDVEDKPFFPHMANHPDNYGKQIHPTPDDYLVKGMMPDKRQKFDDWYEQHRQEPFFLDEALASYCTNDVEILMAALMAFRHEFLDVTKRNEGIVAERAAFYEHHDGIDVLRECMTIAGACMKHFRTNHLPKKHLAIVPERGYDNAQNQSLLALRFFHWYAEEHGVVVQTAHSAGGEKKIGQYSVDGWVEEERRAIEVNGCVWHGCKDCFPNDNMMMPNGKTAGEVRERDEKRLEFIESQVSRVDVYWECQIKRMLNRDPYMCESFGDYVDDGPLDIREAFMGGRTGPLKLYHKAGEGEKISYYDFTSLYPYVNFSTTYPIEHPKVLILNENVEWTRARDNPYKLSLLKVWVIPPRKCDVPVLPVKVNKRLCFPLCMQCCLDYPKGGVDFDYHCEHDDQQRGWVTTCTSIELDAALEEGYRVTKVFRVLKYRHGDDKLFRPYIAEFMSQKIEASGFDASIKGNAELEQQQFITECAEKFGISIDKDNMKVNKGKRSLAKLCLNNLWGRFSLRNFGLAQTLITDDPSVLTEYVENSSIDIISVDELDEKHQLISYVQKKEGVEEHECSNIIISLWTTSKARLLLLKAMQKVYGLKLRRNGQDEFVLKLRGITLNYDVMQNQSLCYDTFKEEVLRYAQTGEYEQINVMYPNFLRPDIRGGGHVTSGPLQKCYRPYVGKGIVGPNYDVLNFGHIL

SEQ ID NO: 158522 - protein, 179 aa, Heterodera glycines
  Coding regions on vcDNA: vcDNA=SeqID_84945; Strand=-; Position=16-555
MVLVIEFCAQILGCSPKSLRDKLNHPEDRVKALKELVGKKVRTTYQDRNGMQKTFFVDGISDKGAALTPAYGRLRQPYNINIAAHFYARHRIKLHFPYVPCVVEKYSGCGEDRYYPMELLEIVDEDYTNKERWLGKLFTEIEDDFIPVKRLGRVDEVEEIDDNDGGGRYECSQPSYVYW

SEQ ID NO: 158523 - protein, 97 aa, Heterodera glycines
  Coding regions on vcDNA: vcDNA=SeqID_84946; Strand=+; Position=1 -133,176-336
MADQFVQPETAEEQQVKAKKPNVDERFLWKITRGQFVLAIRLCSEDWNNLFHNKDKTRRLEDGRVAIGLEMCEECAKLNCCVSDLIAGQKKNQKKPE

SEQ ID NO: 158524 - protein, 312 aa, Heterodera glycines
  Coding regions on vcDNA: vcDNA=SeqID_84947; Strand=-; Position=1 -169,221-394,805-831,1387-1610,1660-1752,1940-2050,2104-2188,2241-2296
PKTRIKLPRGKVPARVQPITNNEQNGAEEEQMYEVESILAMSVLTTGERLYYLACCGSPGHDSWVRSSWSEALELTVNFIEDLTINQVLKALLNEEAVEAQLVVKLTTHPLFVRCRRFSYTVQEMEYPSNLTWVVVPQCECVAPLNVCVRPADYRHPIVCVPTFLVENFPTTISQCVPNGTDPMLKVWVTLVFLLLLELSILLLMVLMTRRLHSVKNVHRSPPKSEYKMPLAIPPFKHRTAPPEATDENGDGFIEDSWISDSTDRELDAGVTSDKNVVDGLPPKPKERKYKSHYVLTPIPEEEDNEQEDKED

SEQ ID NO: 158525 - protein, 175 aa, Heterodera glycines
  Coding regions on vcDNA: vcDNA=SeqID_84948; Strand=-; Position=1 -31,130-293,360-518,1750-1920
MEKLSLDLILTDEEESSADGQLQKDDGDEDDASVREKKLQYNNLGYFARFLKTELAGACAGAVDKVVGDFSTTSSSSSASNGSSVDNNRDHVDEQYAQQCQQQQHQNAVQQQQFQAVQARLWTAALALAATRQQQQQQQHQLLPDQQQPQFVPAAAGTCRPPASQPPFSLASSMV

SEQ ID NO: 158526 - protein, 145 aa, Heterodera glycines
  Coding regions on vcDNA: vcDNA=SeqID_84949; Strand=-; Position=1 -90,136-483
MSSPPTEPNAFAIFDRDECSDSDEENDEGESMLIETGHVYAQAARNNSEAARDNAAAARESARAVRDITDLMVKQLESKDRQIVDKEFQLAQKNVLLEEKDLQLEEKDRLLRQKDEMIARLQGIIAHGKREKKSIEKLIAHLIKF

SEQ ID NO: 158527 - protein, 18 aa, Heterodera glycines
  Coding regions on vcDNA: vcDNA=SeqID_84950; Strand=-; Position=1-54
MRTRPIWQVKQRLLTSQK

SEQ ID NO: 158528 - protein, 24 aa, Heterodera glycines
  Coding regions on vcDNA: vcDNA=SeqID_84951; Strand=+; Position=1-76
ITGVSIIAVLFLVFLMPSQNLVRF

SEQ ID NO: 158529 - protein, 133 aa, Heterodera glycines
  Coding regions on vcDNA: vcDNA=SeqID_84952; Strand=-; Position=1 -117,530-615,671-778,821-909
  Homolog annotation: Hit_ID=CAE58840.1; Match level="QueryCoverage =100%, HitCoverage=8%, E-value=2e-65, Identity=88%"; Hit description =Hypothetical protein CBG02059 [Caenorhabditis briggsae]
GRIHYTDMYEMLRNIAPPVGFGRKCPYRLAYKHLIRMNMPVSDDGTVHFSTTLFALIRESLSIKMRPVEEMDEADEELRQTLRKIWPLKAKKNMIDLVVPPNGDLCFQKLTVGKVYAGLLILENWRARKSGVE

SEQ ID NO: 158530 - protein, 146 aa, Heterodera glycines
  Coding regions on vcDNA: vcDNA=SeqID_84953; Strand=+; Position=1 -111,852-959,1238-1296,1407-1566
  Homolog annotation: Hit_ID=NP_492053.1; Match level="QueryCoverage =100%, HitCoverage=10%, E-value=9e-33, Identity=44%"; Hit description= MYOsin heavy chain structural gene, LEThal LET-75 (223.3 kD) (myo-1) [Caenorhabditis elegans] emb|CAA958
KKIRQLELEKEELQHALDEAEAALEIEESKVQRLQIESKKKLETDINDLELGLDMANKTNMEAQKTIKKLIGQVEEEQRRREEQRENFLMSEKKLNIVLSERDELVVRREQMERDKQRVEAEVQEERARKTELQMDNSQLSAARRQ

SEQ ID NO: 158531 - protein, 30 aa, Heterodera glycines
  Coding regions on vcDNA: vcDNA=SeqID_84954; Strand=-; Position=1-92
MFFPAILVVLLLIGGLRSFCGAIEAKMSIK

SEQ ID NO: 158532 - protein, 155 aa, Heterodera glycines
  Coding regions on vcDNA: vcDNA=SeqID_84955; Strand=+; Position=1 -102,356-459,559-631,973-1063,1222-1319
  Homolog annotation: Hit_ID=CAE57894.1; Match level="QueryCoverage =69%, HitCoverage=18%, E-value=1e-40, Identity=71%"; Hit description =Hypothetical protein CBG00943 [Caenorhabditis briggsae]
TALNRFLLWLRRMRNELKDDFGSILLLLLLYLLQGVPLGLIAAIPLILQSKEITYSQQAVFSFAYWPFSMKLLWAPIVDSIYFRRIGRRKSWMVPCQYLIGLFLLVISYHVEEILGTEDKTGSKFDLDLYPGMNFSWAWIFVQVQNGIVKAFFEL

SEQ ID NO: 158533 - protein, 298 aa, Heterodera glycines
  Coding regions on vcDNA: vcDNA=SeqID_84956; Strand=-; Position=1 -226,425-689,776-875,920-1224
MAKCIVRLLNNEFQIGLKNAKIIDGTKNMLKSEKWVGEIRVESESDEESGQQKRTEKGHDEKGHESSSGEKESVNDSSKTGYYSAMPKFEFAKVRKREAIFAGNQRHLNKGFLARKRQNIAISKSHSYNLLEAKRTFGLSPIGGFARFLMSGILEKKNKTRTIPWQKTISKIQKAKREHNQLKKEEKKWRDYALKQMPTKSATIGTNEKYMTMNSADETTAYGSKVGKLNEQIAKLVNDGIKVGMRLADLQRKSKSIEHSKSDEFNEEKSDEIANYDEDIEGEEYGSEQSENYGNNGE

SEQ ID NO: 158534 - protein, 90 aa, Heterodera glycines
  Coding regions on vcDNA: vcDNA=SeqID_84957; Strand=-; Position=1 -28,74-318
  Homolog annotation: Hit_ID=CAE70259.1; Match level="QueryCoverage =97%, HitCoverage=14%, E-value=1e-28, Identity=65%"; Hit description =Hypothetical protein CBG16760 [Caenorhabditis briggsae]
MTLKAIVGQKLINEVLQPLHNPQKGGAWNVLIVDRLAMRMLSACCKMHDVMDQGITIVEDLNKRREPLPALDAVYLISPTKVKLSSIIYV

SEQ ID NO: 158535 - protein, 200 aa, Heterodera glycines
  Coding regions on vcDNA: vcDNA=SeqID_84958; Strand=+; Position=1 -132,197-436,486-716
  Homolog annotation: Hit_ID=NP_997820.1; Match level="QueryCoverage =99%, HitCoverage=27%, E-value=3e-56, Identity=38%"; Hit description =zgc:65913 [Danio rerio] gb|AAH56710.1| Zgc:65913 [Danio rerio]
MHAKSRWQGGDVEGARQILSQAFKHNPNSEEIWTAAVKLESENQEFDRARKLLERARNSAPSPRFWMKSARLEWCLDNLDRANELLAEGIGRYPDFEKFYMMLGQILTQQAQFEEARKQYLEGTRRSPHSIAIWLLLIRLEDSRGRHIKARSQLDIAKTKNSKCDQLWLEGIRMELRAGQKELAQSMLARALQECEHSGK

SEQ ID NO: 158536 - protein, 152 aa, Heterodera glycines
  Coding regions on vcDNA: vcDNA=SeqID_84959; Strand=-; Position=1 -310,527-672
MPFIKKRQNLVLNVLNNDKNLLVAPQQPLGIRPLRKPSPSSRQMAQVQQRSVNGMPSSNILKRFKFSLRNACEPPTTHPSNSLADPSAQKGAYGATNAIFNGEIFPDNLILETELLTNAIKSLLLDLQNAPSNRNNSGGASTESNALFHADS

SEQ ID NO: 158537 - protein, 417 aa, Heterodera glycines
  Coding regions on vcDNA: vcDNA=SeqID_84960; Strand=-; Position=1 -124,179-336,400-503,548-601,723-906,971-1040,1093-1244,1331 -1426,1499-1646
  Homolog annotation: Hit_ID=AAG48161.1; Match level="QueryCoverage =97%, HitCoverage=47%, E-value=9e-82, Identity=43%"; Hit description =p95-APP2 [Gallus gallus]
AFPMEFSGTVCADCGASCPSWASLNHGVLICSDCCFVHRNLGRHFSQVRSLTKGVRHFSQVRSLTKGVWHDKQLALLQLLCRNGANNVWEHSLIDSLGAGRAKKKPSDPIIPKKEAFITAKYAQLSDPIIPKKEAFITAKYAQLAFAIRAKDEFNVDDLNRQLWSNRQLWSCVRTAHVETALRLLALGACPNYADTEKGNTPLHVAAKEGQNLQAELLWLYGADIGQRNGAGQTPAELAKTEGFNELAENELAERLVELEYEMTDRFSMFLCGRRPSRRPSHRENQHFLIPDLVDSKKNSQVKQFKDSIQRSSGLILERMVQDVYDEVDRVDRRELNGHWIASEHHPTASANQHVAMFLPPNPRLSAPNPRLSATRNQLRQKLAKFSSADFAHLIIDLLKEIRRRRLNLPLPATDSQ

SEQ ID NO: 158538 - protein, 253 aa, Heterodera glycines
  Coding regions on vcDNA: vcDNA=SeqID_84961; Strand=-; Position=1 -97,345-709,996-1108,1168-1354
MVDEKQQHELQRVRAVHGAEEEEDEELFLLHEDTSTEPMNIIDVEDEEDFDQDEYQHNRGIKIFEREEKMEGQQIMPQQRAPSSVSKVEVIMIRISRGLPSALISKIDLSLFRWSEIFEIGKKFESNKKKEIFKILNLVILDKLFTFFMKIQKKISDEQSGAEMISGSVSAGSVTSSPAKRQQHRTSQEIAGSANGSLLEFERIEREIHEVGAEHGGETSPKNERARAEIAAAAAVAAARGSGEALINVVFFN

SEQ ID NO: 158539 - protein, 299 aa, Heterodera glycines
  misc_feature (283)..(283): Xaa can be any naturally occurring amino acid
  Coding regions on vcDNA: vcDNA=SeqID_84962; Strand=-; Position=1 -72,140-206,299-345,401-500,545-615,660-712,761-856,912-988,1315-1432
  Homolog annotation: Hit_ID=CAE68451.1; Match level="QueryCoverage =99%, HitCoverage=99%, E-value=7e-55, Identity=41%"; Hit description =Hypothetical protein CBG14241 [Caenorhabditis briggsae]
DHLITTPAHHHVSPLVRSRSRSETASFASFRRSASFTSNSAGGFTLPSYGYGGGFMYGGGFMARSLSRSSASLFGRGLHSSALSLFGRGLHSSALDRTPPFHNIAVQRPTPHYTDKYPFVRYSYGNIETGLSIKTQTEMVKYPFVRYSYGNIETGLSIKTQTEMVSPNYYGSPNYYGIKDTGTKRWLEGKLNSYNSGIFSRKLNSYNSGIFSRPVSRERSIERPLAPIRSYVKYMYMPTEDAVDLFKKRCMTVSTLSKYWLSSSLWSFSRESRLHSFAGVVRXVQPFPSLFYQLSKQIF

SEQ ID NO: 158540 - protein, 46 aa, Heterodera glycines
  misc_feature (8)..(8): Xaa can be any naturally occurring amino acid
  Coding regions on vcDNA: vcDNA=SeqID_84963; Strand=+; Position=1 -43,101-269
SVINFQFXCFVYSVPLIRLPSDFGRRVVSDRQHLLSIYAVCVDGLS

SEQ ID NO: 158541 - protein, 145 aa, Heterodera glycines
  Coding regions on vcDNA: vcDNA=SeqID_84964; Strand=-; Position=1 -24,283-491,541-706
  Homolog annotation: Hit_ID=NP_506361.1; Match level="QueryCoverage =97%, HitCoverage=37%, E-value=8e-37, Identity=53%"; Hit description =complex i intermediate-associated protein 30 mitochondrial (5O46) [Caenorhabditis elegans] emb|CAB01129.1
IKFISKFCNFNIFSFKCRGDGRTYKVMLHIPQFMDITWGNSYTYLLHTHGGPHWQFEMIPFSRFVFTVEGRAIDVQYPVSLKLLSSIGITLVSLKLLSSIGITLMDRIEGPFRLEIDFIGATHDISHLEKHAYEKYNIPLGNPML

SEQ ID NO: 158542 - protein, 81 aa, Heterodera glycines
  Coding regions on vcDNA: vcDNA=SeqID_84965; Strand=-; Position=1-244
MIRRGATVIRRVTKMIRRGATVIRRGTAEIRRVTKMIRRGATVIRKGRTVIRRGATVIRRGTTVIRKGTTVIRRGATVIRK

SEQ ID NO: 158543 - protein, 197 aa, Heterodera glycines
  Coding regions on vcDNA: vcDNA=SeqID_84966; Strand=-; Position=1 -165,234-368,772-938,1053-1179
  Homolog annotation: Hit_ID=CAE72242.1; Match level="QueryCoverage =46%, HitCoverage=29%, E-value=6e-28, Identity=68%"; Hit description =Hypothetical protein CBG19360 [Caenorhabditis briggsae]
MMKSSADAEQFGRLSFSINSLFSTQEVASSSSASDPTTQLIISSLNSVRKTNEGTTDNKELSTDEDEQQNVASTSTPEDGEFSKISRIRKRRYSQARIQPTRVKKVMQSDEDIGRMVASVPVAIGSAMEVFAEKLLLAAAESVQHSSTKTLSPMHIKMAVSRVPQFSFLEPMLRDVPMNPKMAPSFGQQSSSTSNGE

SEQ ID NO: 158544 - protein, 405 aa, Heterodera glycines
  Coding regions on vcDNA: vcDNA=SeqID_84967; Strand=-; Position=1 -999,1613-1831
  Homolog annotation: Hit_ID=T18535; Match level="QueryCoverage=96%, HitCoverage=30%, E-value=1e-10, Identity=24%"; Hit description=high molecular mass nuclear antigen - chicken (fragment) dbj|BAA24137.1| high molecular mass nuclear antigen [
AIKRCYSIGGTPTQSPMPKYAALIGGTPWINSTNTIGTTSSSPPCTAAAGTTPPAMPFGRQFELLTKCHQQKQQQQTPPPPLLPRPPSTVFPTTVMQQQQQTPPPPSPVTTATSTVVNGPGNLSELVHHLYNTQQMQLQLQQLQQQQMLEHIMPKVGGIIPTTQTMPAPAAVTTPMVVPIHVLQSLLTTKVVPIQLTESIAPAAPIVPKAVPIQTPQLSLSADNTTPKSASQIRETAVYIAPKAPPFSAAGNTTPKMKGEAVPIQTAAAKQTPAAAAEENAKVGTCTNTDGTASSSSSTGPCFSSSTNAFAADVPTKQNAFAAAAYGEMLMTLFLMQNLLQLYGTRYDPTVRSAFSAVPPKVERQQQQQVQAVQATKTAAAQQQQMEQQHQKKHCENGAQLVQID

SEQ ID NO: 158545 - protein, 101 aa, Heterodera glycines
  Coding regions on vcDNA: vcDNA=SeqID_84968; Strand=+; Position=1 -63,120-218,1030-1173
MKTLRNQVGRQTMPMVVNFGRTGDGQIPGQVGGRQSSMPPSVVPVNLGSMPPYQWYNWFTPTTVKQACVEALAFAREGGLKHENILKIIKMIEERENHDKK

SEQ ID NO: 158546 - protein, 204 aa, Heterodera glycines
  Coding regions on vcDNA: vcDNA=SeqID_84969; Strand=+; Position=1-612
MAINISDTKSLFNQILAQSDITITTSGITVSGPRLSTPRFLPFDDCGRCRVCKATEAEVDTMVTKEGVTLWCTRINKPQFVPFDVVYDLPGHCFFRVKNKARVFNVPYGDLPSGTCAKNKPTDHQQQQQQQQQDLKRKAKVALDLVEAGLMADAMQDGARWKKAKTAINVLGNILLAESLDNTSAPPLKNDAVDIKKEEEEEAN

SEQ ID NO: 158547 - protein, 173 aa, Heterodera glycines
  Coding regions on vcDNA: vcDNA=SeqID_84970; Strand=+; Position=1 -152,660-1026
MRATTPADGTGGAADGHGTSDRNNNSKNNMEAQSVIGMSEAGGTADDSVESFKISLFSELSIVFVLRSVTLTTPVAINGSSSCAEAAADALPTPQPQQLQAVPTPTPPPAEFWPNGACNRKREAETEDGQSARTTAFTPVMLGESEDFFPFIDDSAGTSLQEGSKAEKEEVTR

SEQ ID NO: 158548 - protein, 65 aa, Heterodera glycines
  Coding regions on vcDNA: vcDNA=SeqID_84971; Strand=+; Position=1-196
AQKSIYYKHNNNNNTKYNQSLGLGREKVSGKVARRLHFQYRARVCLACVGGCRENGDESLVEHWL

SEQ ID NO: 158549 - protein, 195 aa, Heterodera glycines
  Coding regions on vcDNA: vcDNA=SeqID_84972; Strand=-; Position=1 -82,133-339,6905-7096,7145-7221
  Homolog annotation: Hit_ID=AAP30754.1; Match level="QueryCoverage =98%, HitCoverage=98%, E-value=5e-83, Identity=80%"; Hit description =putative gland protein G11A06 [Heterodera glycines]
SSPSSSVSLLAIVTIFCLLCKCCVSAPHPCCPCCPGSQKVVSLMANYVGTFAHSFSKASLCSDAQSVAGALKGQLIGCSKGGDATLLADIEASLGTHSADECAHSLGFVRAMFVIAASASSHASNNSEWQALSAQFGQQISEIDSKCAEFGIGIAKVPFDGPKGDHSQRNDHSQRNVPGTDSVISMPGLTGSHKQ

SEQ ID NO: 158550 - protein, 96 aa, Heterodera glycines
  Coding regions on vcDNA: vcDNA=SeqID_84973; Strand=+; Position=1 -57,108-341
VAVVLSSVHLKEDKIDVPQRVKRGEYGGGAYGGDGGGVGAPAPGGGGAANIANVNINQQNGCNGRGPQYQWAYTRKTGWVCINIINVIINQQSGGK

SEQ ID NO: 158551 - protein, 231 aa, Heterodera glycines
  Coding regions on vcDNA: vcDNA=SeqID_84974; Strand=-; Position=1 -82,133-339,420-611,660-736
  Homolog annotation: Hit_ID=AAP30754.1; Match level="QueryCoverage =88%, HitCoverage=98%, E-value=3e-80, Identity=75%"; Hit description =putative gland protein G11A06 [Heterodera glycines]
SSPSSSVSLLAIVTIFCLLCKCCVSAPHPCCPGSQKVVSLMANYVGPCCPGSQKVVSLMANYVGTFAHSFSKASLCSDAQSVAGALKGQLIGCSKGGDATLLADIEASLGTHSADECAECAHSLGFVRAMFVIAASASSHASNNSEWQALSAQFGHQISEIDSKCAEFGIGIAKVPYDGPKGDHSQRNVPGTDSVISMPGLTGSHGDHSQRNVPGTDSVISMPGLTGSHKQ

SEQ ID NO: 158552 - protein, 148 aa, Heterodera glycines
  Coding regions on vcDNA: vcDNA=SeqID_84975; Strand=-; Position=1 -155,1204-1444,1642-1692
MNERMREANDPLPVNVCPFMHFEPAEQQQHHQQQHKEKVYHLNPTKECVQSILKQCPPAFLSNLAKTVCLFSMAIFYCFLDGGVLSSMLFLLLVPLFVVGICDGLQQRLLLTQVIDTKRDEAVAQQRYHLFTLLLFTSLGPFFASLLI

SEQ ID NO: 158553 - protein, 151 aa, Heterodera glycines
  Coding regions on vcDNA: vcDNA=SeqID_84976; Strand=+; Position=1 -213,747-989
MPALTTPMNGTAEGQQRQFWLPNELIHELLIWVRPSYFWRVRQMLTTSAILCPLLMGGKHAITWHQPYDVGTKEMSHADRTFGSGKQYALLCRSHSQTLPGNFMRYQTHSNGTVTVYVLLILDESKFESPAHLAQSVRKMSKKEYLFIYPI

SEQ ID NO: 158554 - protein, 170 aa, Heterodera glycines
  Coding regions on vcDNA: vcDNA=SeqID_84977; Strand=+; Position=1 -213,620-817,1090-1185,1362-1367
MPALTTPMNGTAEGKQRQFWLPNELIHELLLWVRPSYFWRVRQMLTTSAILCPLLMGSKHAITWHQPYDVGTKEMSHADRTFGSGKQYALLCRSHSQTLPGNFIRYLQTHSNGTVTVYVLLILDESKFESPAHLAQSRNFLDCSGSLREGHQTLGQGITSMTFVRCPGEE

SEQ ID NO: 158555 - protein, 362 aa, Heterodera glycines
  Coding regions on vcDNA: vcDNA=SeqID_84978; Strand=+; Position=1 -198,323-409,481-693,811-1010,1057-1152,1201-1493
  Homolog annotation: Hit_ID=NP_501400.1; Match level="QueryCoverage =93%, HitCoverage=22%, E-value=1e-35, Identity=29%"; Hit description =calcium-sensing receptor, similar to human metabotropic glutamate receptor type 3 (157.9 kD) (4J72) [Caen
MPKDRQSAESVAQILRPAALPIAAFSAASAQALVDANVRRFTTTAPLFTDYVKTLVELLKMLGSDLVSIVDFGDDFAYTPLLQEKLRAEGISTAEVVSLDHPMLPSILSASDAKIVVSLVPHRILRNARLGELRALIELHKLWVGIDTELDGGTDAAATDGEGNAAFVTIRRRVRQLKEFSAYFLRVLQSNHAHYTLLRAYAEQVFDCDVTVGTGRNCTDGLLSAERMAKLHRQSNTAEAAILLTYALARATEWIQSKKELAQKCTERGSFAGCHDATRTALLSFSPNDRLLSSGSVRMPPGFIKQLSEMNFFETPEGVVQLTGIGIEAILAEREDKDGANLYRHGTTEEERIVQKLMDECL

SEQ ID NO: 158556 - protein, 46 aa, Heterodera glycines
  Coding regions on vcDNA: vcDNA=SeqID_84979; Strand=+; Position=1-143
FDFASCQCKHFGENCCRSFRRMAKAEGFAFKGFARHRFRCVWLARG

SEQ ID NO: 158557 - protein, 119 aa, Heterodera glycines
  Coding regions on vcDNA: vcDNA=SeqID_84980; Strand=+; Position=1 -139,734-823,870-997
MQNPLEMGTYRVGSETYRRNCPLEKASTAAPAAGAAFGATTAENDDALSPSSSGRCSSSEVRQADFAGSDYGSPGKRACISTEKRKATTILTAKAAQEIGEVSSAGENVPLIVQRKTVE

SEQ ID NO: 158558 - protein, 166 aa, Heterodera glycines
  Coding regions on vcDNA: vcDNA=SeqID_84981; Strand=+; Position=1 -257,547-630,1238-1397
MTKQPISSNSQTVCRRRGVPSYIEEAAENAKTEVPTTSSTNMARHKAEAKVRNGGGSAQMAAHSQPTKGPRCTTAAEEEESSEIEHFAHEYKKQLRRILPSTYAKRLLPAQLYRLVIRKTKSAVVAMRYVRAHSATVSLASIEQSAQFQQLLHQIEDDQRPPALLM

SEQ ID NO: 158559 - protein, 35 aa, Heterodera glycines
  Coding regions on vcDNA: vcDNA=SeqID_84982; Strand=+; Position=1 -64,751-794
MHESFLKYVLIECLINLQIKFENALKRPKFYYMLV

SEQ ID NO: 158560 - protein, 77 aa, Heterodera glycines
  Coding regions on vcDNA: vcDNA=SeqID_84983; Strand=-; Position=1-522
IIFIQKIFFWVFGAVPLNRCAQIYGETESFGNSFPIVCTLILRWIFAPHNCLSTPNGHLKKSIFLFSGQSPRTDAPR

SEQ ID NO: 158561 - protein, 56 aa, Heterodera glycines
  Coding regions on vcDNA: vcDNA=SeqID_84984; Strand=-; Position=1 -160,384-394
MCGRGTAVIRRGTTVIRRGTKVIRRGTTVIRRGTTVIKRRTTAIKSGTTVIKKEIS

SEQ ID NO: 158562 - protein, 82 aa, Heterodera glycines
  Coding regions on vcDNA: vcDNA=SeqID_84985; Strand=-; Position=1 -186,329-391
MAIKYGPKIAKYGHKMAKIAKYGHKWQKCQKMDINFSKLSAKFLQIYWLKLHMRYISKFFDSRKINNKSEIFAFLLIFDIIY

SEQ ID NO: 158563 - protein, 51 aa, Heterodera glycines; identical to SEQ ID NO: 124998
  Coding regions on vcDNA: vcDNA=SeqID_84986; Strand=+; Position=1-155

SEQ ID NO: 158564 - protein, 48 aa, Heterodera glycines
  Coding regions on vcDNA: vcDNA=SeqID_84987; Strand=-; Position=1 -68,354-432
METEQDLDSQNEAIFRRYHDSIGPLSPQDQSDEKEFSTPGPSDQRKKE

SEQ ID NO: 158565 - protein, 440 aa, Heterodera glycines
  misc_feature (14)..(14): Xaa can be any naturally occurring amino acid
  Coding regions on vcDNA: vcDNA=SeqID_84988; Strand=-; Position=1 -251,315-622,689-753,908-1142,1507-1630,1769-2048
  Homolog annotation: Hit_ID=XP_524725.1; Match level="QueryCoverage =94%, HitCoverage=25%, E-value=7e-66, Identity=38%"; Hit description =PREDICTED: similar to dedicator of cytokinesis 7 [Pan troglodytes]
LPDLLRLLLFPFVXLHSLPSLFHLFPSLRAFVRKFPDFLLVESDQQLLTALCQQLLRQMAAENAEVRQQAATSALAQLKIAFRIARGFVRLNRCLTSIARGFVRLNRCLTSALCSLVSTSVASGKALDDNALRASLTLVPEAKKSEKAEFMSQLEQLVVNLNAILSDTFKLSAHIDDFEMSVDLMHRIAHGYRNNPKLRIAWLLGIARIAWLLGIARKHLEERKTYAEAAQCFLHCCAIVATTLLNAGTADDELLPVRCSTFEALSENISEEEDKRGKERLTDGAENFTLSAFIKMVEKMANLFERAQLFELVANALKLVLPLFERTHAHVKLIQAHAQIVSCLSRICHRMDKRCFGTYFRVRFYGVKFGELNGKEFVYKEPAITKLAEISARMEQFYGEKLGRETVETMKDSNEVKLGRKRKGRDQGMDVSSRKLTRNS

SEQ ID NO: 158566 - protein, 152 aa, Heterodera glycines
  Coding regions on vcDNA: vcDNA=SeqID_84989; Strand=+; Position=1 -60,117-344,392-456,537-642
  Homolog annotation: Hit_ID=NP_495101.1; Match level="QueryCoverage =95%, HitCoverage=70%, E-value=2e-10, Identity=32%"; Hit description =i-116 protein like (2F936) [Caenorhabditis elegans] gb|AAB54251.1| Hypothetical protein F59E12.10 [Caenor
MELDFRLDTFERMLALMERKLENVNVDEVKKQSAEEKETAEKAEGMTRKEKGEETPEGTGEEKRTDKRQGKETAAEVTTKANEHPKLAKYFKMLKMGVPEAAVRQKMRSEGMDDALLNDPEKELPLESPQNKAQMVHDALAEDDESSSNSDE

SEQ ID NO: 158567 - protein, 94 aa, Heterodera glycines
  Coding regions on vcDNA: vcDNA=SeqID_84990; Strand=-; Position=1 -105,186-365
MSIVVPSDIKPRLRGSKFAHATEEERKAIAAQMEQGRDANRTATTEAKRNAARLGQAEAKLDQQIEAEKAYFDAQLEKLENELQFVASLLPKSQ

SEQ ID NO: 158568 - protein, 121 aa, Heterodera glycines
  Coding regions on vcDNA: vcDNA=SeqID_84991; Strand=+; Position=1-363
MPTLYQAVPGRSSVRSSTMPTNRQNELVTVDNRPGLTVPQSWRNFLQTLSICIAYFLYGKEKRQKSRDEIEEGTYPVEKKTIQNKASKNRKRLTRTHSIPLTERWPSPEQKPTIPGKMGLK

SEQ ID NO: 158569 - protein, 44 aa, Heterodera glycines
  Coding regions on vcDNA: vcDNA=SeqID_84992; Strand=-; Position=1 -71,445-508
MAKYAFILKNLQDMLLYLEIGFFILVVKPSVFRCLSLGFNSPLG

SEQ ID NO: 158570 - protein, 289 aa, Heterodera glycines
  Coding regions on vcDNA: vcDNA=SeqID_84993; Strand=+; Position=1 -385,542-1026
  Homolog annotation: Hit_ID=YP_142971.1; Match level="QueryCoverage =41%, HitCoverage=70%, E-value=4e-13, Identity=36%"; Hit description =hypothetical protein MIMI_R617 [Mimivirus] gb|AAV50879.1| unknown [Mimivirus]
MYMWAKASVFGDEEAASAILRTSNPKECKRIGSRIRLFNTTAWRRISIFVMTCANWHKYKQNEDLMRHLFNFGPDAEFVECTANDVYWGAGVALSDVEKIRDINRWPGKNILGRILSALMKKFLRKKSEMSAPTAPPNVRDLSEFPPLEKLTLEDVRKKNKIASASPSGNSNISKETCNSAISVDLVASASHITWGGEKGNIGQEKGEKNQKLNKNVASASQRVSENFANQGFDKNPDEMAEEMMEEFSSFNVGENEGKIVEYLVCQVEENIVIGGKLRTMTTKAGHIL

SEQ ID NO: 158571 - protein, 45 aa, Heterodera glycines
  Coding regions on vcDNA: vcDNA=SeqID_84994; Strand=-; Position=1-135
MGESAPQKKKKYRDADARILRLFQRYNDVNNNIVPQNDHNYANVN

SEQ ID NO: 158572 - protein, 120 aa, Heterodera glycines
  Coding regions on vcDNA: vcDNA=SeqID_84995; Strand=-; Position=1-3,95- 270,661-844
MVIKRLRRDENAPRAEPLNLEQLEIPNTYRVYKRTEIDEEQFLLADTGVFQIHGQNGPQRFPDNYMGRIRFNVPITAPLFHPHEWSVHQRTLDSADRTNNFADAFHRKLQRLFNCTHPTI

SEQ ID NO: 158573 - protein, 177 aa, Heterodera glycines
  Coding regions on vcDNA: vcDNA=SeqID_84996; Strand=+; Position=1 -80,131-581
MDDKSLPFPLPDRPLPSKIRFKHLQMWHIDHSVIAFLRSNHQIFDKRGTNLYLAIPSSHSTNGQPIWDVFVREIWPIFSENIRHLHFTGDDHLDNLLRRTSPTILIDLNQLNSIHSFGLSPAAFGDGFDVPNSTISAGQALSKWLHSPRKDGQPKRFRCGRNLNAQADFDWVNSFKE

SEQ ID NO: 158574 - protein, 94 aa, Heterodera glycines
  Coding regions on vcDNA: vcDNA=SeqID_84997; Strand=-; Position=1-285
VKFPENSKFVFVTAANNAYFGPLRVLIASIKQTFGCKQKIIFYDLESVRQNKEWVINQIVNRDRTTGVGGIPNLNQKIILKFLFAENFFKNFRG

SEQ ID NO: 158575 - protein, 282 aa, Heterodera glycines
  Coding regions on vcDNA: vcDNA=SeqID_84998; Strand=+; Position=1 -153,260-405,459-625,680-932,982-1045
  Homolog annotation: Hit_ID=AAH76920.1; Match level="QueryCoverage =98%, HitCoverage=98%, E-value=9e-57, Identity=45%"; Hit description =Steroid-5-alpha-reductase, alpha polypeptide 1 (3-oxo-5 alpha -steroid delta 4-dehydrogenase alpha 1) [Xeno
LKFHLLLHDERLFLFLDDFMLASALITFVTFTFFGMPYGRYAALSFFSKIPARIGWFLQEMPSFVLPTFAVCWQLTIRFLPPVNAIVLLMFIAHYFQRSFVYSFVYPFLIKGGKAIPAPLFSLGFIFCTWNGLIQGFYHANCAVYSSDHFWTLSALIGLPLFALGMFILPLFALGMFINIQSDQILRDLRKPNEIGYKIPHGAMFEFVSCANFFGEIVEWFGYALFAQSRVAWAFALFTAANTMPRAKEHHRWYFEHFSDYWYFEHFSDYPKKRSAVIPFLY

SEQ ID NO: 158576 - protein, 26 aa, Heterodera glycines
  Coding regions on vcDNA: vcDNA=SeqID_84999; Strand=+; Position=1-78
GSAAKTIPSEFAGFIAGNIGTHCSKE

SEQ ID NO: 158577 - protein, 1145 aa, Heterodera glycines
  Coding regions on vcDNA: vcDNA=SeqID_85000; Strand=+; Position=1 -848,1537-4031,4261-4355
  Homolog annotation: Hit_ID=NP_500013.1; Match level="QueryCoverage =37%, HitCoverage=30%, E-value=3e-39, Identity=28%"; Hit description =predicted CDS, polyprotein family member (4B673) [Caenorhabditis elegans] gb|AAC02594.1| Hypothetical pro
MAEQNSFNSQKGENVVLQGQIGSDFDPIFFTPEENQNLNNVLTRMRTFESAICRQFRKLEREFAELKIVAHQSDDTDRMVKIERSIIDLEDREEMDNFQMEEKVIKMAEKAETLEIRQNSFERLTKVKFNKVVEKMKVEMAKITENIDVLKIRVENEMESCEIMVSDPFLGGIAPLEMFDGKPSVSFSRWASKFVDMLSLLPQLTETQKLSRLRILLIGQVRAEYEALDPPPENLTTALNHLKSKFENENTRSIARQALSICKQAPGERVSSWKDSFPSSNLRQNTIQYKTEATACKCVKTSISRRIGFFGGKIEEISTSPVEVPTAICHQMKEMKHSPAGDLIFYEGNKTFRATNNSLEVGWSSWPTGIFWTTNEVTNCYVYEPVVFTRHGMPGISTPINDCNACVYQSGNCHCSQISLIWKPDQTHQCAYVEVGRWGGEYSTRIWTANYGDFALTFLNASRKSDCDGTEFVISDQAFAVPAAQYDEIIKRSGEPNERRKREIGLVYSSQLSAQLTALSVKISQNTQRLFTETIRQICMSLKFLADQTLALAEAIPTLLARFYLGNPFLLARLVTKETLEIKPCFAVNEREMHFNWQSGPCFDKLPIIFSLYGRQKHGFLDPNTMIIHQRAGEIYCNHAKHLYILIKGSILQYDQMTGEMTHIPYGSLHQLSRHGKIDFPEFPVQFFKNKVMANLTELYSPENFNETMEVAKFAQEIARLSKPKSPELGTATPLQRSLRFKENEQRVVQIAVAETNCDPNFRIAGMANDKKVIHLLDTGAHVTLCGIQTAKRLGITELEPAEISGVIGVSGKIVNILGQKKIEMQIFGCTVETVIYVAEAEIGGVGTYDIIVGRKTFRQLPLLLDLQTGTLIRKEDGQTYNCEKFNERDVYFYEPENNRENCGKIREELEICLDRNKSVFARHEYDLGTCAYCAPPILTTSDLPERVRPYPVPKKYEEELKAQIEKMLKSEVIRESCTPWAHNIVLVKKSNGQLRPCVDFRPLNKVTVPDPYPIPRMDKTILRAAGKKWYSTLDLASGFWQIPLDKESSYKCGILTPWGLYQMLKMPFGLRNAPSIFQRVMDKVLKDLPNVTAYIDDILIHTDSEKEHLETLEMIAHPLNQLTEKEKEFNWLEKEEEAFEKLKQ

SEQ ID NO: 158578 - protein, 94 aa, Heterodera glycines
  Coding regions on vcDNA: vcDNA=SeqID_85001; Strand=-; Position=1 -11,81-354
MNRRWICNDVWMVMFPFFDRAQLGLKLALISPRFDVLVDKHFDAKTELTIWRMIILSKEIVTKPKLTVWDFDAVDFPLPEPFRHRISPCQSANF

SEQ ID NO: 158579 - protein, 58 aa, Heterodera glycines
  Coding regions on vcDNA: vcDNA=SeqID_85002; Strand=+; Position=1-192
NIDHRPQTQKCLKTVRIDVKRFEMGWKNRIRGALALFQDEKCRKWSAKLNWDSSDRAI

SEQ ID NO: 158580 - protein, 40 aa, Heterodera glycines
  Coding regions on vcDNA: vcDNA=SeqID_85003; Strand=+; Position=1 -94,375-403
MFLMILLTNDCDNDDDASSSLVFVVVVLWSVEYTNIIYSL

SEQ ID NO: 158581 - protein, 85 aa, Heterodera glycines
  Coding regions on vcDNA: vcDNA=SeqID_85004; Strand=+; Position=1 -170,750-834
  Homolog annotation: Hit_ID=CAE62054.1; Match level="QueryCoverage =92%, HitCoverage=15%, E-value=8e-26, Identity=62%"; Hit description =Hypothetical protein CBG06072 [Caenorhabditis briggsae]
GLRFPDAYERLFFDLFSGRQYNFVRADELEHAWRIFTPLLKRIEGDRVKPEQYEYGSRGPSSSDALMQKHGFVFSGTYKWPSVNP

SEQ ID NO: 158582 - protein, 99 aa, Heterodera glycines
  Coding regions on vcDNA: vcDNA=SeqID_85005; Strand=+; Position=1 -114,195-380
MCLHCESGCFKDEKDGVHKCCDDACAAGCTGEGTDQCILYLSLFLGVQKVRAGRPLCDGVPRLRPLRSGGEAHGPAAGSGPTLRLRSALCANMSAGRSV

SEQ ID NO: 158583 - protein, 74 aa, Heterodera glycines
  Coding regions on vcDNA: vcDNA=SeqID_85006; Strand=+; Position=1 -79,128-185,236-325
  Homolog annotation: Hit_ID=CAE71709.1; Match level="QueryCoverage =100%, HitCoverage=88%, E-value=6e-21, Identity=63%"; Hit description= Hypothetical protein CBG18686 [Caenorhabditis briggsae]
GNIPYNATEADIGNLFSQCGVVTNVRIVYDRETNRPKGFGFCEFQDQQGAQNAVTNLNGAELNGRALRVNWTNK

SEQ ID NO: 158584 - protein, 66 aa, Heterodera glycines
  Coding regions on vcDNA: vcDNA=SeqID_85007; Strand=-; Position=1-199
MSYFSADADASELITAQRRDDEQIQWVYDRMSDCVLRLFGERIWISYHRWLPSLAAFIYLSATNLR

SEQ ID NO: 158585 - protein, 668 aa, Heterodera glycines
  misc_feature (191)..(191): Xaa can be any naturally occurring amino acid
  misc_feature (476)..(476): Xaa can be any naturally occurring amino acid
  Coding regions on vcDNA: vcDNA=SeqID_85008; Strand=-; Position=1 -160,220-272,323-723,776-876,934-1010,1057-1152,1209-1324,1372 -1609,1661-1723,1782-1876,1961-2084,2158-2227
  Homolog annotation: Hit_ID=NP_498112.1; Match level="QueryCoverage =98%, HitCoverage=70%, E-value=5e-76, Identity=30%"; Hit description =ring finger protein (83.3 kD) (3G323) [Caenorhabditis elegans] gb|AAK95874.1| Hypothetical protein C34E10
RSGRGTWTIWRDFRPLCANSSCLSVALSLTADLDSEFDLHNNLSLRRWLAEPISSLFLDHSLFISDENISSLFLDHSLFISDENTSIPLNSVHRMLINYLLSNCRQSVTSIPLNSVHRMLINYLLSNCRQSVVLFSSSVQSDHFANCELKQMVLSTKQLILSNENICKSENPMSGYFDLLQVLRIIIFLSXISEPFLQTPLQPLSDNLDSAVYQTFEQDNAKYEHYQMAIKAALLELSQRQMVRIVVFVLGAGRIVVFVLGAGRGPLVQAAINARDELEREKKHSEQNWKMKLIAVEKNRNAILSNWKMKLIAVEKNRNAILSLKYCNEERWANSVQIVHSDMRSLSTWANSVQIVHSDMRSLSTFVDSKVLERPDLIISELLGSFELLGSFGDNELCPECLDGVSPILKPGTICIPQTYTNFITPIQSLHLHQSVAPIQSLHLHQSVAADQCKSEEQSVGRSKKSVTYQNMLMFXFPFRVFGCAFDRSYVVCMDQFCYLAGNVEPCFRFTHPNFQGSSNSRQSKVHFFQGSSNSRQSKVHFELPPNCELMGFSAHFEVNLFKLMGFSAHFEVNLFKDICLSTHPLRFTENMHSWFPALFPLRRLFHFRDTTTVTFNIHRKIDSDGCWYEWNIEYKGSDGQTTRGSDGQTTRSEIQNERGESQYMKLL

SEQ ID NO: 158586 - protein, 54 aa, Heterodera glycines
  Coding regions on vcDNA: vcDNA=SeqID_85009; Strand=+; Position=1 -456,663-881
CFKVLSLTLLFFHLFQSASALRFCVLTLLFFPFIPIDHVNSFSIHLVSYFMKLY

SEQ ID NO: 158587 - protein, 230 aa, Heterodera glycines; identical to SEQ ID NO: 139868
  Coding regions on vcDNA: vcDNA=SeqID_85010; Strand=+; Position=1-1248

SEQ ID NO: 158588 - protein, 117 aa, Heterodera glycines
  Coding regions on vcDNA: vcDNA=SeqID_85011; Strand=-; Position=1 -97,393-530,572-690
  Homolog annotation: Hit_ID=XP_392175.1; Match level="QueryCoverage =83%, HitCoverage=24%, E-value=3e-09, Identity=33%"; Hit description =similar to CG17068-PA [Apis mellifera]
MDKLSDRMNRLLSTGVDADVHFLVGQGDEQEAASLKEGNNPVEIPDVDVEAFKTMLSFIYTDDLSGVNGKNAIDVLYAAKKYNLPSLVEACVKIPIKELSNVFIAFSKARMKRNYAE

SEQ ID NO: 158589 - protein, 126 aa, Heterodera glycines
  Coding regions on vcDNA: vcDNA=SeqID_85012; Strand=+; Position=1-381
MRLCEVIVGKAPGFQLLTGATHVSVAGTAQPTETPAGCHVCSFAPVAASAQPIETHSPNATHAPLAKRSLAKPPGSNCCTGVTHVPVAATAQPTETPAGCHACAFAKSSLAKPPGSNCSRVPRMFR

SEQ ID NO: 158590 - protein, 108 aa, Heterodera glycines
  Coding regions on vcDNA: vcDNA=SeqID_85013; Strand=-; Position=1-327
MRGTREQLEPGGFANDDFAKAHAWHPAGVSVGCAVAATGTCVAPVQQLEPGGFANDDFAKAHAWHPAGVSVGCAVAATGTCVTPVQQLEPGGFANDRFAKGACVAFGE

SEQ ID NO: 158591 - protein, 46 aa, Heterodera glycines
  Coding regions on vcDNA: vcDNA=SeqID_85014; Strand=+; Position=1 -45,176-217,453-506
MVAKLLPVILCCLFLASFALCSPNAADVLKFKREAAISSCGAVRHI

SEQ ID NO: 158592 - protein, 218 aa, Heterodera glycines
  Coding regions on vcDNA: vcDNA=SeqID_85015; Strand=+; Position=1-657
MSFVKTTVEALKQLQTSFTSDQMPIFNTLITTLSSQIDLLNGSISQLRSTALSTEGMPISAEELERQRSVVIIGMPEHNDSSPAKRAEMDRSKINCLFDSLGIECGTIAYRMGRSFNPAQKSPRPLKILLPSRGFQKQALAAWQKKQNTIRAADSSLHHVRLRESLTKAQLEERRRLHLQCVEKRQKDGQDWIVYAGNVILRDEVHIFRSQTIRESNF

SEQ ID NO: 158593 - protein, 605 aa, Heterodera glycines
  Coding regions on vcDNA: vcDNA=SeqID_85016; Strand=+; Position=1-1818
  Homolog annotation: Hit_ID=NP_502721.1; Match level="QueryCoverage =86%, HitCoverage=38%, E-value=3e-45, Identity=29%"; Hit description =endonuclease/exonuclease/phosphatase family and RNA-directed DNA polymerase (4O953) [Caenorhabditis elega
MNKTDEISLALINKKISILLLTETWTKDNEGIPLSPWIKENYNYIFASRKSENSSRGGGCGILIKNEIAFFVKFSGTKFNCEILIIQLQNLKSIRFALIYRPPKTTLKQTKELFKFIQTFWCENYIILGDLNLSNRELVWRQGQPHAINHIGEIFCDFFNKFTFINATNEPTRGKSWLDLILSANDKIVKHCTVEGGIFSSDHLAQLFVLSVPEIRAKPKEICLRRFTPSNVSHLNAVISARLSSLSLSHFSINEKCCAFNSALLNALNECIPIKKLLKKDLAPKYPQHLLASIKEKAKLYRQCKIDPTKKALYDSITLHIKIQTKKIHNLIEHKAISKGKNSIFKYIQKHNVNPFEIPNLVFENKCYHESEEKSELFAILFANSFNNSEVVLNDLSLDNSYGNNQCFISDINFNIIETQTLLRKLPNKNGTSPDNISYKVLKNCHFSLATVITELFRLSLDSGSLPNIWKESIVFPLFKKGDKFNPENYRPISLTCSLCRVMERILSKNIYNFLLKNNKISESQFGFIRNRSTTNQLITVVEDWYEAIINGKKVTIYVILTRSFVSKTNSGRPKAGLGLKVVEGSYNFLRRIRENYREKFSADD

SEQ ID NO: 158594 - protein, 104 aa, Heterodera glycines
  Coding regions on vcDNA: vcDNA=SeqID_85017; Strand=-; Position=1 -61,369-622
MPFPSFLIFLFATFFTFSAFDALDGEREESIASVPRTSPTFVRFSARAAPMPNESVFSAAQVGTECGANNARPDSVQWTAQMAECRKRKEVAQPMILAVDWHRD

SEQ ID NO: 158595 - protein, 99 aa, Heterodera glycines
  Coding regions on vcDNA: vcDNA=SeqID_85018; Strand=+; Position=1 -260,633-672
MKRRKKQRRRPRYEAAQQTQQQQTGKEKNKRTKRAEKLTKKRRHWKRRRKDTEAAGHEAMKARKTTVLKERHRKCHQIRHQRRKKKRWHPYIIALFPVF

SEQ ID NO: 158596 - protein, 454 aa, Heterodera glycines
  Coding regions on vcDNA: vcDNA=SeqID_85019; Strand=-; Position=1 -615,909-1140,1422-1574,2156-2517
  Homolog annotation: Hit_ID=AAS38911.1; Match level="QueryCoverage =46%, HitCoverage=89%, E-value=2e-14, Identity=29%"; Hit description =similar to Leishmania major. Ppg3 [Dictyostelium discoideum]
MAMELTSSVATPTAGPRHCHHNSGLLMNSLRTLETACHHGRPYSDGDGNDDDDEEYVKNGGEWHADDGGTTGMATTTNSNTEVQHDGEENARFGGGSGAKTVSGNTQGDYDDAGHGHCHADDGQQLLHRPVPRKQAFLANASEVPPPFSPSAVDDGTELLFVHRLDEQLATRRTSAPACLDTAPQFASGRAELRYLSIVYDLESRFSPIDSTTFATTTPGEVNCLKKLETHLYLCQQLMDRKLLYALPNNNNNLNKPNTSAVSCSSMYLPKNCVSSSSSPDSGLGHEMNNSSNIFNNNNNNNSNNCAVAVVGGEPSSSAAASSSSCCGLSGVMAAAASSPPSSSSASSLSSKVSTSIQKCGHLSTLLHSGNSFCGTSATASSSSVGAGFDGTSGAVPSALLSSWLSLLHARRLQCPSSASSNAVVSSSASLPASSACSSLFPSAAAASAALLHN

SEQ ID NO: 158597 - protein, 390 aa, Heterodera glycines
  Coding regions on vcDNA: vcDNA=SeqID_85020; Strand=-; Position=1 -8,1424-2588
MTRCLLSNEICEKMRQERHQRRTEQSVSPGRSPVPDGSADGNGEVSASLRGTTTPSLSALQISTPASSIGSKKRGRPSKAGAKPILATQESVSLIDTPRTAVTQSDQGSPCKKRGKVAECGQPMFANEAIALTPVSTQSRGGRPAKKIRGPGRGRLTDSMSKSSEMDINLVNAPIPATSDTVPEKINFSTVQINFATTRNFACKIWKWAAIGLYERDGETSLAPSSGPRYIETCWNDLTQFLNDGFAATYLAYLASISQRKVVVVDPMVWRNGLDRVMPYKNMTFGYNPNVPAEVILLPVHFPGHWTLIVHDVQWGTHFADSLPTPYGRLDWQLTDKIGKIISDILPSAVLTGIFNAVNLTVQHDGNSCGYFVCLYAESWLMNNCTFVLP

SEQ ID NO: 158598 - protein, 84 aa, Heterodera glycines
  Coding regions on vcDNA: vcDNA=SeqID_85021; Strand=+; Position=1 -118,252-388
MLEARKILNLLVILQLFLGINVLLLSSICSTEIVKPTAEESLVCFGSTMVVVLPCCPRIGRTSGFESHPSPNNFAHFLSYIFRF

SEQ ID NO: 158599 - protein, 49 aa, Heterodera glycines
  Coding regions on vcDNA: vcDNA=SeqID_85022; Strand=+; Position=1 -77,237-306
MPFLNPKTNIVGVGAVNNPRILAANRIKQKFKQKFVPTTRQTFDSSSST

SEQ ID NO: 158600 - protein, 116 aa, Heterodera glycines
  Coding regions on vcDNA: vcDNA=SeqID_85023; Strand=+; Position=1-351
MQNDFSERIRKMEEQHREEKDKNGGQQNMKNYKNIFLFVNLKKFFKLCHKSHFGTDQHPGDMEIISDQQKEQQQQIDQLSIAIQEKCAKIATTENFYGGKIWHNATIKNKKLKRWK

SEQ ID NO: 158601 - protein, 456 aa, Heterodera glycines
  Coding regions on vcDNA: vcDNA=SeqID_85024; Strand=-; Position=1-1371
  Homolog annotation: Hit_ID=NP_510849.1; Match level="QueryCoverage =85%, HitCoverage=29%, E-value=1e-68, Identity=37%"; Hit description =predicted CDS, zn-finger, CCHC type and RNA-directed DNA polymerase and Integrase, catalytic domain conta
MAAVDYIFMANIDQLPVTADEVAEHTQLDTTLRKVFDFCRNGWPKKSPTDLSAFFTHRHKLSEVNGCLLFGERVVIPAALRQRILSALHFTHPGIVRMRALAQQHVYWPRMDLDLERWVRHCVDCAMAAKAPPKTTLSPWPRTNKVYERIHMDFAGPCSDGNLYLIIVDAFSKWPETFQVKSTSADNVIVQLEWLYSRYGFPREIVTDNGPPFHSKDFSHFCRIKGIKQRFSPTNHPQSNGQAERFVDIFKRQMKKCSHGDKKWITNSLFAYRNTPNAALKGQTPAELFLGRSPRTQRSLLKPDISCSNRNQNDYTNNMSKQFDRKHGARHRTFAIGDDVLIINYRNNKKSWLQGKVVSGSGVIWEIKVPVLGNVIVRRHTNQMRNFFPIPQKSQNGNGPGTQHGSPGLVQKRHVRFADEVDQNGTIARDQQQQIADVADKQFEVRRSERHRRPTK

SEQ ID NO: 158602 - protein, 254 aa, Heterodera glycines
  Coding regions on vcDNA: vcDNA=SeqID_85025; Strand=-; Position=1-765
  Homolog annotation: Hit_ID=XP_319741.1; Match level="QueryCoverage =95%, HitCoverage=54%, E-value=1e-32, Identity=33%"; Hit description =ENSANGP00000006515 [Anopheles gambiae]
MARPFWPVLQVDGKDLPDAMQVRLLLGKLGQEEYARHTERVLPRLPTDFTLAQTIDKLKILFGETKSIFTRRYECFQLAKSIFQSPLDFASQVNAMCERSKMDLTKDEIKALIFLTGLSDEDRELRERCFRILEEAKKKTPPEMITFEKLTEECRAFLSLRNTSQSLATVSGTNAITLKSQKLKEQQLKKRSISQRPSAKAQSNKNRSPSPFQRQPKPPSPCRFCGQMHWVRDCSRAPTCSKCNRRGHYRSECR

SEQ ID NO: 158603 - protein, 152 aa, Heterodera glycines
  Coding regions on vcDNA: vcDNA=SeqID_85026; Strand=+; Position=1-459
MSKKNFQEISKDVRRSRNTRNYFRKSPDLGKYYEEVEKHVKENKKFGIKEYVRTFYFKCPPNEDPENNFKKILKKLMSEAISQEAEPGWKISKISVDLYCSALSDPVIIPARPFQQSNPDIVFNEFMHRQQSFGELNLLEERISINCYICFS

SEQ ID NO: 158604 - protein, 173 aa, Heterodera glycines
  Coding regions on vcDNA: vcDNA=SeqID_85027; Strand=+; Position=1 -468,544-597
MYSFKKYFETALEKEDFFWPKNRAEVEAMLIESSQYKVAIHRDYESPFSGYIEMHEHTSAFCFTMVERDMRIFYDSGAGTPMGRYTLVLHGIVQGNYLGNDSGLGLPIFFFWFYWEGRSQTNRNGFFRSRLFLAKVQMLKVMALAWGKELLTSPIERIAWLLVVALSGPSKSL

SEQ ID NO: 158605 - protein, 52 aa, Heterodera glycines
  Coding regions on vcDNA: vcDNA=SeqID_85028; Strand=-; Position=1-214
LKKEKKRGKKKVKPNDFFCLQRLLIYTLTQRNASTMGQLPLVLAYYFHVSNT

SEQ ID NO: 158606 - protein, 118 aa, Heterodera glycines
  Coding regions on vcDNA: vcDNA=SeqID_85029; Strand=-; Position=1-354
MAELTKRLDGPMWARKMLARAKMGHESVTEFANKIRDWVEQASPDPDYTNDARENETVHYFLNGLPTNLKRKLFFMQKPKTLVEAISQTKKVLQLKEEIENDEKGEEFKQQIAELKEQ

SEQ ID NO: 158607 - protein, 231 aa, Heterodera glycines
  Coding regions on vcDNA: vcDNA=SeqID_85030; Strand=+; Position=1 -55,2922-3536,3696-3741
  Homolog annotation: Hit_ID=XP_474255.1; Match level="QueryCoverage =100%, HitCoverage=17%, E-value=1e-38, Identity=39%"; Hit description= OSJNBa0087O24.13 [Oryza sativa (japonica cultivar-group)] emb|CAE03590.1| OSJNBa0087O24.13 [Oryza sativa
SEPKYLNYLSISEGNALDPKQVQAVQNFRPPKSLTELKSLLGALTYFKIIKNFAHIARPLQTLTRKIEENWGNEQEEALETLKKMLTSAPVLQSPRFGKPFIIECDASKKAIGAVLLQTNGPVAYASRALNRHETNYPSIEREALALVYAVKEFSPYIVGSGVTKTITDCSALTSMMKAKELKVRLEKYQITLQSFDLEIVYRPGSKNKAADFLSRLLNVKSKNSKNILYP

SEQ ID NO: 158608 - protein, 269 aa, Heterodera glycines
  Coding regions on vcDNA: vcDNA=SeqID_85031; Strand=-; Position=1 -303,492-998
  Homolog annotation: Hit_ID=EAL44122.1; Match level="QueryCoverage =75%, HitCoverage=27%, E-value=2e-09, Identity=23%"; Hit description =conserved hypothetical protein [Entamoeba histolytica HM-1:IMSS]
MDAPKAPAEEPFNEEGLIAEKVRLLNEIEDLKHRLEETEKRKAEAEKKRSENNEQRPVDEIVLDMDEEDEEEEEEEEEAPQESKRARLDPPLANERRARQRSGTNWRQKKQKKSWRKRFAAKTPATQGQFANCVWEETAQNTKEEKMKKIENSICQKINQIQQQMTEAFGGLKELAKEMDELTKIAKKEMEKAEEFHPNSNRFANTNTSTWRQHDEFRYRNRGTVGRWVNNSRGRGRQRPYHHNWRGNEGWARNDHSQSEPSTSGAFNR

SEQ ID NO: 158609 - protein, 488 aa, Heterodera glycines
  Coding regions on vcDNA: vcDNA=SeqID_85032; Strand=+; Position=1 -175,343-1634
  Homolog annotation: Hit_ID=NP_510671.1; Match level="QueryCoverage =84%, HitCoverage=41%, E-value=2e-36, Identity=29%"; Hit description =predicted CDS, endonuclease/exonuclease/phosphatase family and RNA -directed DNA polymerase (XR69) [Caenor
MNKIDEIALILETEKIDILLITETWTKDGEEINFCPWVKENYNYIFSSRKSKTSGGGCVTLGDFNLPNKDLVWKNGHPYSMSKYGEIFCDFFNRFSYVLATNEPTRINSWLDLIFTANEKIITDCTVKGGIFSSDHLTQFFTLITPKTKLKTKIVNFRWFCPSNVLHFNIVIASRLNALSYECFSINQKYSAFNSMLLEILNECIPIKRLTKNDLTPKYPQHLLASIKEKAKLFRQAKTDPSKKALYDSISLHIKIQTNKYHSQIEKKAISKGRNSIYKYIQKFNVNPSEIPNLIYENKCYHNSAEKSELFATLFANSFNNSETDPSNPCLGNIIEIDQCFISDINFNIIETQNLLKKLPNKNGTSPDNISYKILKICHSSLSTVITDLFRISLDTGSLPDIWKESIVFPLFKKGDKNNPENYRPISLTCSLCRVMERILSKNIYNFLLKTKKISEFQFGFVRNRSTTSQLITVVEDKYEAIINGKNS

SEQ ID NO: 158610 - protein, 296 aa, Heterodera glycines
  Coding regions on vcDNA: vcDNA=SeqID_85033; Strand=+; Position=1 -228,288-346,515-550,621-727,786-844,1030-1165,1299-1439
  Homolog annotation: Hit_ID=NP_499790.1; Match level="QueryCoverage =87%, HitCoverage=55%, E-value=2e-52, Identity=48%"; Hit description =twk-8 protein like family member (3O574) [Caenorhabditis elegans] emb|CAB07286.1| Hypothetical protein T2
FLSVVKCFEIGFPPPSYKMLGICSTSSIQFFSTLIVLLYTHYTRAKLRLRQRLIGHGGGAGAAGHSSTLMKAHLHENISIPVTNISIPVTLVAAILLGYMSIGAVLLAKWERWPLFDGFYYSFITMTTVGFDGFYYSFITMTTVGFGDIVPAKHEFFLFDLFYIPGLAITTMCIDLVGIEYIEKPGLAITTMCIDLVGIEYIEKIHYFGRAISGARFALVNVGGRMVRVPDLVRCAHVLHQKYGQRKPTQNILNLVRYAPKDLPYIRFIDFGSLASFESTRSQASFLQFLRVVVRS

SEQ ID NO: 158611 - protein, 101 aa, Heterodera glycines
  Coding regions on vcDNA: vcDNA=SeqID_85034; Strand=-; Position=1-303
AQYLVLMRAPNSALAIRNIGVQLFPGKLDYFLSAYRIATNKPYGYLVVDMHAASNPLLRLRSGIFKDDEEEGKKIIFIPKMAFCKIGEIVHKNFDFIRVLA

SEQ ID NO: 158612 - protein, 146 aa, Heterodera glycines
  Coding regions on vcDNA: vcDNA=SeqID_85035; Strand=-; Position=1 -135,195-301,445-643
MTSLYIALKIKDIGNASSSNPSNSEPLAQIVNWNWDKNGAQQIIQTNTLNKGSELNYRSNNDSSFVIRILKKREKKSDEKNAFPAPSSSSPDDDLTVKIGDKQVKNRKNNSNIKPTLKQQIFHGKKQFFDTIKILKTICACLVAVL

SEQ ID NO: 158613 - protein, 146 aa, Heterodera glycines
  Coding regions on vcDNA: vcDNA=SeqID_85036; Strand=+; Position=1 -118,166-294,650-841
MQILQNEIMRGKVEKFGQDKLLMELAKSWAEYKRQNGKKSHGKGKNNEKGRKNEKRILQLLYNLLNDGTNGLASADLKSGAKNRQRRRKGRGIITERHIVIFCVIGIIICIFNISLFCYCQCFDHRSAADDIEATDSQTTVETDHQ

SEQ ID NO: 158614 - protein, 457 aa, Heterodera glycines
  Coding regions on vcDNA: vcDNA=SeqID_85037; Strand=-; Position=1 -162,209-480,521-565,613-797,849-913,969-1058,1100-1189,1236 -1391,1441-1554,1698-1891
  Homolog annotation: Hit_ID=CAE64662.1; Match level="QueryCoverage =97%, HitCoverage=45%, E-value=0.0, Identity=84%"; Hit description =Hypothetical protein CBG09434 [Caenorhabditis briggsae]
MVPTEQIDTFLIKDVEMTHQMREDFERAYLELGGMGERVLGFCDFRLDHDKFPKGFEFDVEGPNFPIEGFRFVGLISMIDPPRAAVPDAVAKCRSAGIKVVMVTGDHPITAKAIAKSVGIISEGMETVEDIAVRKEISVDQVDPREAKAIVIHGSDLREMNEDQLAEVISNHDEIVFARTSPQQKLMIVEGFQRQGQIVAVTGDGVNDSPALKKADIGVAMGIAGSDVSKQAADMILLDDNFASIVTGVEEGRLIFDNLKKSIAYTLTSNIPEISPFLMYILFGIPLPLGTVTILCIDLGTDMVPAISLAYEEAESDIMKRLPRDPVRDKLVNERLISLAYGQIGMIQASAGFFTYFWIMADNGFLPKDLYQLRAQWDSRGINNLVDSYGQEWFVISLLQVIVQWADLIISKTRRNSIVQQGMSNWVLNIGLVFETLLAVFLCYCPGLDKGLRMYGL

SEQ ID NO: 158615 - protein, 47 aa, Heterodera glycines
  Coding regions on vcDNA: vcDNA=SeqID_85038; Strand=-; Position=1-142
MDTFRPCAIGEEVEHSASEFVLIDGPLKMGLIGRDSLVRRGNGRTPV

SEQ ID NO: 158616 - protein, 28 aa, Heterodera glycines
  Coding regions on vcDNA: vcDNA=SeqID_85039; Strand=-; Position=1-86
QHPKNLFIKFFVIHLVISRNTNQKFHNV

SEQ ID NO: 158617 - protein, 197 aa, Heterodera glycines
  Coding regions on vcDNA: vcDNA=SeqID_85040; Strand=+; Position=1 -158,380-815
MNSSEETTENVGMGGNKDERQTTSKDETDESSSENQRNEQRQRQMDSEKEDSRFECNICLDMAKDAVSLPATMPFHYVFINTFHFCLRSFRCAAICSAGRAFSNGWTRVPIASCAPCANRRLAKTRFSIFTEFIGMDNQIKKPIHSLSHIPSKIAFFAKVIPLYGRGGGDSDPREKIPPRPQGQRTEETNQVDKRHF

SEQ ID NO: 158618 - protein, 90 aa, Heterodera glycines
  Coding regions on vcDNA: vcDNA=SeqID_85041; Strand=-; Position=1 -23,246-349,1185-1330
MNKWLALVVLIALISVLDSAVLRQRLFVKAENAPKAEPKENPALMQQNGPLSAANFDEALPLGAFIKDFEGMALRLVALELTKGIATNAR

SEQ ID NO: 158619 - protein, 257 aa, Heterodera glycines
  Coding regions on vcDNA: vcDNA=SeqID_85042; Strand=+; Position=1 -341,474-906
MVCRVSSSIGCLCHHSLVLFWPCQKTTPSQKRNVNKLIKNFEKILPIFPALSAATVGFWCSIFLRLLSSASKLRWSTAALTASSTNTSKHANGNWAECKFPTKLEKMAPNKCKFYIDQNVVTFLRRFHRFFAFSSIFLVITENVCVSEFVLLNIWPMLRHSMRAMFLNTIAFRRFRQLAPSLLNDCPSLHTVIFKDAILPEFPPDESANATDGQAVVKWLFSPCPDGVLPNVLHFHDFSVAQWSSTIEQFKAVIIHI

SEQ ID NO: 158620 - protein, 804 aa, Heterodera glycines
  Coding regions on vcDNA: vcDNA=SeqID_85043; Strand=-; Position=1-2487
  Homolog annotation: Hit_ID=NP_510671.1; Match level="QueryCoverage =99%, HitCoverage=83%, E-value=1e-120, Identity=32%"; Hit description= predicted CDS, endonuclease/exonuclease/phosphatase family and RNA -directed DNA polymerase (XR69) [Caeno
KKLRIVLLYRPPNTSASLTKKILNLIGNYLEEFIIMGDFNLNAKDITWTEHLLLNRKKDFCEFFNKYGLFLMTNGPTRGSAWLDLILSSKPDFVNNVLIDIFSSDHLTTNFSLSFPSNRTKTNTFTVRNYNSTKLNLLNKLIFNFTLQITQKFTIEDKFNHFYLLFREYVELYLPKITVGQTRKPNYPLSLKLSIKEKARLYKLQKINRDKYRHLYDSISLHIKIQINNFVTKNENNFLNKGKNAIYKYINKFTKNFEQIHSLSYENQIIFDDYLKAETFAKIFQESFSNSDVPQISSCPSKPSISDVEFNADEISKILKNLPNRESTSPDEISFKILRNCHLTLSPVISELFRISMDTGKIPEIWKKSIVIPLFKKGDRNDPHNYRPISLTCCLCRVMEKIIAKSIYNFLHLNNLISEHQFGFVKHRSTNTQLITVLEDWYDSIYGKKKNIDCIYVDFRKAFDSLPINILINKLHNIGIRGKLLSWLSEFLKDRFYTVKINNKFSNLYPIQSGVPQGSVLGPLLFLIYINDLPQVIPPGVSIKLFADDVKIYGDERSKLNVALDNIGKWANAFGLNISQNKTFILFLGKNNSKQQYKFFNNIINEVESISDLGILIDNKLRFSNHYTKIIKAAYLRIRNIAKILKTRSIRIWTKVFKTYIRPLLEYAPEIWNPTYKKDINKLERCQKYFTKIALFKCRLPYIPYEQRLDLFKLQTLEERRKTIDLVQAFKIINGLTHLKDIFPQFSGHIPYNLRRKGKTSNSFINRTALIWSKLNKDITDAPSVDSFKKRINKFELNKNLVCK

SEQ ID NO: 158621 - protein, 76 aa, Heterodera glycines
  Coding regions on vcDNA: vcDNA=SeqID_85044; Strand=+; Position=1-231
MEEKLFKICKEIRVGRALIEKWLQQFEMFGKRMTKKEKMEKMKIYWKIKGENQKIIDKEIAKMLEIKRRTFSTWKK

SEQ ID NO: 158622 - protein, 121 aa, Heterodera glycines
  Coding regions on vcDNA: vcDNA=SeqID_85045; Strand=+; Position=1 -5,251-611
MGSPKRRDEYFSEYGTYFLLLYSRMGITVAFDTIFTAAIRQFDQKYSSAKNVVQLPIQNVHIYAFVYERMNNFLSSNVENIFSSNEKMEYFFSLMKKFFQTTLKQLNKFVEENEEKMAKFL

SEQ ID NO: 158623 - protein, 168 aa, Heterodera glycines
  Coding regions on vcDNA: vcDNA=SeqID_85046; Strand=-; Position=1 -87,149-325,565-664,814-956
MNYYFICIFFLILLNHRNFNAFPSVNAAVIEDDALVALAKGPKHFANFCAIYGLTIDEKNQFLSEKYEAHLGLLYYLRKDWYEMHSTEENILYEKQWEMSRKFAFILYEYLFREYVAEYVKAVDPAMAEQIPAVMKPITAFQYIEMGYSISITFCEAISERQIFGLVS

SEQ ID NO: 158624 - protein, 191 aa, Heterodera glycines
  Coding regions on vcDNA: vcDNA=SeqID_85047; Strand=-; Position=1 -140,523-614,672-723,782-809,873-897,968-997,1142-1261
  Homolog annotation: Hit_ID=NP_071902.2; Match level="QueryCoverage =100%, HitCoverage=22%, E-value=2e-37, Identity=43%"; Hit description= constitutive photomorphogenic protein isoform a [Homo sapiens] gb|AAM34692.1| constitutive photomorphoge
STTTTTADSLDEFSLLVKNMYRYGEVKVLTTLNYNIDAYNLPSIVSSIEFNKDGDFFVIAGVTKMIKLYDFNALMDHSAFVHQPMVQLRCNSKISAFVHQPMVQLRCNSKISNVNVSWNPYNKHMLASSDYDHMLASSDYDGTVQLWDTAAAKCTRTFGEHEKRCWTVQFNSIDPHLMASGSDDGKVNKYS

SEQ ID NO: 158625 - protein, 86 aa, Heterodera glycines
  Coding regions on vcDNA: vcDNA=SeqID_85048; Strand=+; Position=1 -100,565-725
MTDRAIRKLWDGVMFDGVWQRNETAWGSPQSAATNFTRNPQYFVQIGSQQPKKVLMIISLMQKYRREEGKSLMSIGYHVYRVVKFG

SEQ ID NO: 158626 - protein, 106 aa, Heterodera glycines
  Coding regions on vcDNA: vcDNA=SeqID_85049; Strand=-; Position=1-321
METEKPTAQKDAELIARSSSKVQNLTERQWMVKWQGKGQTSSIVLQIGVLVGTNSSESTKTGTQAVICAAAETAFLGLAEKRDTIWAGGTTGRRNLQAKEIRLDLA

SEQ ID NO: 158627 - protein, 98 aa, Heterodera glycines
  Coding regions on vcDNA: vcDNA=SeqID_85050; Strand=+; Position=1 -92,222-335,430-520
LISRRPFDISRRLKPMHRHPLLSLRRPILSEQQLSKRKLILNIQFASFIPKRFVNGGPSQIFLHFSTKRLWRWKWAERKRTRGRRATVWRWTCSTWKY

SEQ ID NO: 158628 - protein, 186 aa, Heterodera glycines
  Coding regions on vcDNA: vcDNA=SeqID_85051; Strand=-; Position=1 -66,115-267,909-1248
MRMLCSREQLWQLAFDDVDSERDFRAMRRRLQKRFKYYEKKQKLEETAARKKATAAEKRARETEEEKPDETKKHDHDDEFGGGQRPLASDGRATKHERHRAEAQRGDEAAAVLAGRGGAPPTAGSETRQSQAVNGVTGRNGRTASDQRRTNERMFRHSVASLPPDPLFWSVITEPTQLVFYCSSVE

SEQ ID NO: 158629 - protein, 36 aa, Heterodera glycines
  Coding regions on vcDNA: vcDNA=SeqID_85052; Strand=+; Position=1-108
MPLLTLMVNQISGQAILCFFLRRTYDFYALLASKHA

SEQ ID NO: 158630 - protein, 140 aa, Heterodera glycines
  Coding regions on vcDNA: vcDNA=SeqID_85053; Strand=+; Position=1 -183,281-520
  Homolog annotation: Hit_ID=CAE69858.1; Match level="QueryCoverage =89%, HitCoverage=26%, E-value=4e-15, Identity=34%"; Hit description =Hypothetical protein CBG16187 [Caenorhabditis briggsae]
MLRALLSPEIFVEIVNCYQELMVVEGCLQIPCCVEFPPLRKFVAANAIRSRQLRQENLERKWHLELARDACVSKLALSELSWDASLSFETVRVCMEKLRRIGPEKSAQFARLSIHLSNSPKLFVMFNGRLSVPIDWVKEL

SEQ ID NO: 158631 - protein, 92 aa, Heterodera glycines
  Coding regions on vcDNA: vcDNA=SeqID_85054; Strand=-; Position=1-388
  Homolog annotation: Hit_ID=CAE56548.1; Match level="QueryCoverage =81%, HitCoverage=43%, E-value=8e-18, Identity=57%"; Hit description =Hypothetical protein CBG24280 [Caenorhabditis briggsae]
SLLQFLSHSFCRLLLALKNLGFPREYVDAANSVLGECKIAAEKRLKRKNSRLDKCGIPEEQLWQMQQQLIEKVGKKKESGDLPMEWAQSARK

SEQ ID NO: 158632 - protein, 148 aa, Heterodera glycines
  Coding regions on vcDNA: vcDNA=SeqID_85055; Strand=-; Position=1 -153,216-509
  Homolog annotation: Hit_ID=NP_741869.1; Match level="QueryCoverage =76%, HitCoverage=26%, E-value=3e-28, Identity=53%"; Hit description =rhodopsin-like GPCR superfamily (50.0 kD) (XJ763) [Caenorhabditis elegans] gb|AAA68317.3| Hypothetical pr
MKAIIVAYLLPAFFYIPYGIGRYSVKRNELANGDVLYYPDDSAVSKTMGWQIYKWTREGLLRFLPIVILFVLNSQIMVAFRRRQRMFNRLRNRDQTTIARDDTLLYILGGIAAMVMPLMFKVKEFTILLAFKVFRLQYSGCHQSVVHQ

SEQ ID NO: 158633 - protein, 128 aa, Heterodera glycines
  Coding regions on vcDNA: vcDNA=SeqID_85056; Strand=+; Position=1 -214,888-1057
  Homolog annotation: Hit_ID=NP_499750.1; Match level="QueryCoverage =98%, HitCoverage=67%, E-value=8e-48, Identity=67%"; Hit description =DR1 (One) transcription factor related (dro-1) [Caenorhabditis elegans] emb|CAB04453.1| Hypothetical prot
MTEEENEVGLPQKGVNMIIKDALPDMRIANETRELLNQCCVEFVRHVSREAQHISSKDQRKTIYHDHVQKGALKNLGFPREYVDAANSVLGECKIAAEKRLKRKNSRLDKCGIPEEQLWQMQQQLIEK

SEQ ID NO: 158634 - protein, 167 aa, Heterodera glycines
  Coding regions on vcDNA: vcDNA=SeqID_85057; Strand=-; Position=1 -314,646-752,850-930
GWDDLKQSIIMAYEALTDKVSQAFCWGKWLGQKCVHYGKVLLGFLVKLLVEIIPKLEKAMKKLTDFFAGGKNPIDVKEGISVCEVVKQYTTMQVKSGLTVPKVARNVAIRLPKGNCIRKFYEENPIVIQHIEAFYNVSSEQIKRKIANKKAAAFLQSKLNNGNTASS

SEQ ID NO: 158635 - protein, 66 aa, Heterodera glycines
  Coding regions on vcDNA: vcDNA=SeqID_85058; Strand=-; Position=1 -105,357-452
MYVSGAPGEECWVLASDTECSESVGKFNSRAGIDAAKAELTREFIPNCMAKCVSEDGHKDVDEEEQ

SEQ ID NO: 158636 - protein, 136 aa, Heterodera glycines
  Coding regions on vcDNA: vcDNA=SeqID_85059; Strand=-; Position=1-411
MAANSPIFNPGPEFEPKVEILKKKFVGTLKQKRTMNELLLSCNFPIRCVGHPPSKCLIVFAKQNSCWASVCRRHFVSESKLSKKYFSAPATSTESERLFSTAGLIVTDLRKRLLPQNVDKLLFLHHNLKIYDFDYE

SEQ ID NO: 158637 - protein, 105 aa, Heterodera glycines
  Coding regions on vcDNA: vcDNA=SeqID_85060; Strand=+; Position=1 -110,626-833
MNTKSQEKPPAEIYTFLHDHFVSLASKQQSSSTWIWSGKKREINCAFVNFGRVLAKRLKFVHEKFNTFADGKEKECGGRDPHTTNYYDYKHHHAFISDNNTPAEG

SEQ ID NO: 158638 - protein, 172 aa, Heterodera glycines
  Coding regions on vcDNA: vcDNA=SeqID_85061; Strand=+; Position=1 -258,707-964
EVGRAIVAELTDCSVVLMMKKRIYFSWDIQTLHISAFLSSAIFYNDQTETENLNGWTYKQYLEIGPNMWVGRRNNDSVTFKLNQQQVIGQISVRELRKTAAINLMVKKRVYFPYFDGQPYSINAWTENGQEIFTEVALWDFSNNKRYLEIDPDQFGNMNSNDWIYFYIAGQQ

SEQ ID NO: 158639 - protein, 633 aa, Heterodera glycines
  Coding regions on vcDNA: vcDNA=SeqID_85062; Strand=+; Position=1-1903
  Homolog annotation: Hit_ID=CAE64509.1; Match level="QueryCoverage =99%, HitCoverage=89%, E-value=0.0, Identity=40%"; Hit description =Hypothetical protein CBG09244 [Caenorhabditis briggsae]
EKAKKDAEAKPKKDAEEKAKTDAEAKAKKDAEEKAQKDAETKAKKDAEEKAKKDAEAKAKKDAEEKAKKDAEAKAKKDAEEKAKKDAEAKTKKDAEEKAKKDAESKAKKDAEEKAKKDAETKAKKDAEEKAQKDAETNAKKDAEEKAKKDAEAKAKKDAEEKAKKDAEAKAKKDAEEKAKTDAEAKAKKDAEAKKKEEEMKKQKAKPEEKPEAPAEGVAVVPEAKKAEETKEKLKEEEKPIEVPPSPAEKKRKEAEEKKDAEAKAKKDAEEKAKKDAEAKAKKDAEEKAKKDAEAKAKKDAEEKAKTDAEAKAKKDAEEKAKKDAEAKAKKDAEEKAQKDAETNAKKDAEEKAKKDAEAKAKKDAEEKAKKDAEAKAKKDAEEKAKKDAEAKAKKDAEEKAQKDAETNAKKDAEEKAKKDPETKEKKRREKKKAKKDAEAKAKKDAEEKAKKDGEAKAKKDAEEKAQKDAETKAKKDAEEKKKEEEMKKQKAKPEEKPEAPAEGVAVVPEAKKAEETKEKLKQEEKPVEVPPSPAEKKRKEAEEKKAQKDAEAKAKKDAEEKAKKDAEAKAKKDAEEKAKKDAEAKAKKDAEEKAKKDAEAKAKKDAEAKSKEDAEEKQKANAEEKAEAAAEG

SEQ ID NO: 158640 - protein, 101 aa, Heterodera glycines
  Coding regions on vcDNA: vcDNA=SeqID_85063; Strand=-; Position=1-306
MVARLENNSVEKPTHKPLLVVFGKWQCANDFDHPKYLEKMARQRFVNSTIRQPSQNVTIRQLSQNVTIRQPSQNVTIRQLSQNITIRQPSQNVTIRQPSQK

SEQ ID NO: 158641 - protein, 190 aa, Heterodera glycines
  Coding regions on vcDNA: vcDNA=SeqID_85064; Strand=-; Position=1 -183,234-364,449-488,763-914,964-1028
  Homolog annotation: Hit_ID=CAE61502.1; Match level="QueryCoverage =99%, HitCoverage=56%, E-value=2e-50, Identity=53%"; Hit description =Hypothetical protein CBG05401 [Caenorhabditis briggsae]
MALNYPIQFINLIPEKGSLLTSLLMNRLLLGREYPLKKYLSVLAITLGIILCTLATSNLEKKIESVLSLEEAEKHYREWAVGVLMLSAALLISSYLAICQERMYSKYGRHPREAMFYTHAVSLPFFALMGGDILRSVRRFSSAPSALFLGFSLPISALWLRLLASCVLQWLCIMFVYRLNATIDSLSVTL

SEQ ID NO: 158642 - protein, 346 aa, Heterodera glycines
  Coding regions on vcDNA: vcDNA=SeqID_85065; Strand=-; Position=1 -481,726-1113,1262-1432
VGRRSVGGGRVAQRQQHFTNVGAGGGGGGGGGTPLSSSSHNQQQRAVLTGGGGGGSGSNSASSSPVRAFRPTTMSNTVTSSSSPFHHRRYYQQPHHQQQFHLSTASASAGSSPVLLAARPLRIKPSAGAASSCPRPSSIVVQQQPQQQLRIVQQHMNRNDIASTGNVVGGTTDATVATASSSPVSSLHHPHHQHQQHQLNMTTPRTIVVHKSSSSLMPSSDAEGGGGGGVADPATTTIAPLVAGPKRFYVHASGPPHQQHVAAVAGGQPPVMVRRQLPNCPPRQQRQAMATSNTFDILPPPAKMVKHMEFVPTVSDIISPTEPPLSSTTTTKTTTYSVPAAPVVID

SEQ ID NO: 158643 - protein, 333 aa, Heterodera glycines
  Coding regions on vcDNA: vcDNA=SeqID_85066; Strand=+; Position=1 -150,283-709,784-970,1016-1160,1230-1321
QAARSNSPSNNFVCAVFPTKDSRENLERYGSTLWEQIDGIGTLAGKRVKCCRSDHLVQEGEICELRTIDQTVQFAEQFTRAMVNGEKANAAVRSAMMGITKPPLLLSIGFDRIIPAPFHVFQGLGNALIRELEQQDGCATIAQNFFRRFGARREQFRKRDMTGNSIRKILVHASEMEHLFSTDWPITICRTLAEPLSPNDIDELERRVDEFKSFLSAQERMRGFLSKKPKAHLLLSHFVPFAREHKFLGLLDEQGDEALHSVWRRLEQLWKCMPDADQILQQLEHHFVNNWLLDSGKIDELKREKVIRGKSMMSSIKRKKKLTKFRLSMSLID

SEQ ID NO: 158644 - protein, 158 aa, Heterodera glycines
  misc_feature (148)..(148): Xaa can be any naturally occurring amino acid
  Coding regions on vcDNA: vcDNA=SeqID_85067; Strand=+; Position=1 -39,93-206,488-653,1034-1094,1187-1237
  Homolog annotation: Hit_ID=CAE71918.1; Match level="QueryCoverage =99%, HitCoverage=46%, E-value=3e-33, Identity=43%"; Hit description =Hypothetical protein CBG18981 [Caenorhabditis briggsae]
QISIGGPQQGIFGLAFCHGSFYVCSLIRLAFCHGSFYVCSLIRRLLDNGAYTEFAQHNLVQAQYWHDPNLAEGYRRANIFLADVNCERSCDSTYRDNMAKLRNFVLVGFSNDHKLVPKETAWFGFYADNDTQTIVPMEQTSRRRDSLXGCRHPEGIGR

SEQ ID NO: 158645 - protein, 129 aa, Heterodera glycines
  Coding regions on vcDNA: vcDNA=SeqID_85068; Strand=+; Position=1 -169,218-297,571-648,707-769
MNYPTDFSWLPVNNCVCPVKDNLCYHFPGYKKPVICAHKLVQNITAFLSTPPHISNESAPASLSSGSVLMLLTVLQIFIILFTRLVLAVLLVHWRFQTAPQGALLIVCRAEWCQLVNERMMCEEKADKI

SEQ ID NO: 158646 - protein, 133 aa, Heterodera glycines
  Coding regions on vcDNA: vcDNA=SeqID_85069; Strand=-; Position=1 -244,291-448
MSSPSKFSPTKSSPIKKENNVGKAEFVVPSLKAPTRKQPSKNVGMNGGEEQQPSMKKRKVEDRDLWKLAKGKYMLGFYLCVDDWNKLYNNKQRVLRKDDDRFAVNFELCEECALANVRATDILAPPKAKKRIE

SEQ ID NO: 158647 - protein, 249 aa, Heterodera glycines
  Coding regions on vcDNA: vcDNA=SeqID_85070; Strand=+; Position=1-750
MAINMSDKRGLLRQILGEAEITVTTSGLTISGPRLSTPRFLPFDESGRCRSCKATEVEVDTMVTKEGVTIWCTRIDKVQFVPFDVVYELPGHCFFRLKNKSRVFNLPYGDLPSESSEIPLTQHVDEERDLKRKAKAALELVEAGLIADSTVQDGARLKKAKTAMKVISDILLSEPVGDDQKKTVEVAVVDKQPQEQQPAPVQEKPVTAPAVEQNTVEVKTEEEKKDDLGDIDKTLDEFFASLKAATTSM

SEQ ID NO: 158648 - protein, 206 aa, Heterodera glycines
  Coding regions on vcDNA: vcDNA=SeqID_85071; Strand=+; Position=1-619
  Homolog annotation: Hit_ID=AAA45903.1; Match level="QueryCoverage =43%, HitCoverage=14%, E-value=2e-10, Identity=40%"; Hit description =nuclear protein EBNA2
MANKFLLVPQEIYRGLTSASDTGVINLDAVRHDLERARRERTNPTTKNVRYNQQLRRYLQMRRELADRPTKVELTKGLSVLLKRDGGVDDDDGEVVNTQPRPPAPPPPPPPPPPPPPPHQYHRHHPSPPDEQSSSSDDSHPPRPPRPPRPQRTKKNHQSSIKHGRLNQWKQRRRDLQQQPVVRDLLAEAAAAPLPESDDDDEQMLE

SEQ ID NO: 158649 - protein, 366 aa, Heterodera glycines
  Coding regions on vcDNA: vcDNA=SeqID_85072; Strand=-; Position=1 -103,197-400,459-765,858-985,1045-1221,1268-1348
  Homolog annotation: Hit_ID=EAA00110.2; Match level="QueryCoverage =99%, HitCoverage=29%, E-value=4e-58, Identity=35%"; Hit description =ENSANGP00000021183 [Anopheles gambiae str. PEST]
EEESETDIRLNPDAWSTAVRHAPQEDVQVKTKGRQRKLIAEAAEFLLTHQIPQFVRDSVQLAVSPIDGVALVEAMHARGINIRYLGKLIEATQHNSRLDYLTTIAKMELLCRTIAKMELLCRCLRHIFRDFVQGVEVHFMGTAIAHFLNCFKNVSQISQFDNDQTNGVALKKSTGARKKRRYGYFDKNCHWRRLGPTPKTMAWAKLSQEIRCHWHFLSPFSCDSFVEWSGGAQRSAIIRRFCLMNGVQIMLKLNPLKSKSQAPLNPLKSKSQAPFSEDDIFNVFPVIKRLNPRSQSAYNLYLSALIKMQQGFIRTGYDLMQQAHSMMNSIYGPLHPDLAAHSMMNSIYGPLHPDLALCLRFMARMA

SEQ ID NO: 158650 - protein, 376 aa, Heterodera glycines
  Coding regions on vcDNA: vcDNA=SeqID_85073; Strand=-; Position=1 -142,444-556,624-777,905-1028,1226-1383,1487-1575,1758-1830,2036 -2184,2258-2386
  Homolog annotation: Hit_ID=CAE66000.1; Match level="QueryCoverage =95%, HitCoverage=55%, E-value=1e-106, Identity=52%"; Hit description= Hypothetical protein CBG11191 [Caenorhabditis briggsae]
KPVKTNSFTGRGFQQLGFKTVTLGDLNLEEMRAMVCEYRKLLGEGVYAVFYFVGHGFEANGQCYLLPIGAPGEDYGPEHCLSMDWVMVMGQFRDFQPALNLILLDICRKFLPSNLVFTAYAEELRRGEVRVNRNTVYGYATSGGVGAYEVKGEQNGVFMKYLKRRIQQPIPLLDMLNKVISDVERDPKVRDVQIPELRSNLTKSRSLHDPLVYDGHTTSYDHHTYHWRTMHELPMPVTVDFAELGLQVTIWFDFCGHFTNKVYVFSSVDDMSTQSEEIGCDQQRGISNNVRIHRNFFVFFKEFESSRPKLCEDEVEGVSLCVLLSHLQRATVQNEIVCTVELRETESADDGEAKLVAKRERQILGHVLITRLGLAR

SEQ ID NO: 158651 - protein, 67 aa, Heterodera glycines
  Coding regions on vcDNA: vcDNA=SeqID_85074; Strand=-; Position=1 -186,383-400
  Homolog annotation: Hit_ID=NP_505905.2; Match level="QueryCoverage =98%, HitCoverage=13%, E-value=8e-15, Identity=55%"; Hit description =amino acid permease-associated region family member (5L944) [Caenorhabditis elegans] emb|CAA98529.2| Hypo
MGRWSATAFVTNAIIGSGIFITPTGILNNVQAVGASLVVWLLSGLISVVGAFCYVELGTSIKGPFAL

SEQ ID NO: 158652 - protein, 174 aa, Heterodera glycines
  Coding regions on vcDNA: vcDNA=SeqID_85075; Strand=+; Position=1 -354,620-660,815-944
MLRIFFRIIFATLIFAKIRAEWEIPDELRPPQFLTVIKNGFQSAVYFTENGQNSVDEATTNQQWLFQRLLEFADENKMPTMAKRKGGANLEGNGIYREHTVSSNWHTLIDKINGKSGDFFYNHPKELSLKLGKKLTNCAIIVQPAEGNWTNYDQQQEKRHFEFFGISPTENNEI

SEQ ID NO: 158653 - protein, 119 aa, Heterodera glycines
  Coding regions on vcDNA: vcDNA=SeqID_85076; Strand=+; Position=1 -81,435-467,538-651,942-1071
  Homolog annotation: Hit_ID=XP_521884.1; Match level="QueryCoverage =92%, HitCoverage=9%, E-value=2e-37, Identity=64%"; Hit description =PREDICTED: similar to Hypothetical protein MGC66119 [Pan troglodytes]
SLLINFCFHRYYVNRDSLFSFHKAAEVFLANLMSIYAAAHYKNSPDDLQMLADAPAHHLFVLMAPVPADQSSVPQILAVVQQCLEGSISKQSVTNVRDKGKKRAAGDLIPWTLCQHFLD

SEQ ID NO: 158654 - protein, 132 aa, Heterodera glycines
  Coding regions on vcDNA: vcDNA=SeqID_85077; Strand=-; Position=1 -234,777-941
MPFSDFDGRAMQIDFLRSNGPSFLSDYADLWLLGLDMLPMAHQTEEQREQLKMNLFISRSSKCSMEAWVEKQSDQKGPFRFAALYGIGKPYGRKPIYKDSHKCTTHDHGIEEGEQKEQLFPIFASQEKYFVI

SEQ ID NO: 158655 - protein, 52 aa, Heterodera glycines
  Coding regions on vcDNA: vcDNA=SeqID_85078; Strand=-; Position=1 -80,630-708
MRKNKKSKRYNDEKVTQKVCGAYIKKKQKRFVEVKIAILMSRNYKGTTQNGE

SEQ ID NO: 158656 - protein, 154 aa, Heterodera glycines
  Coding regions on vcDNA: vcDNA=SeqID_85079; Strand=+; Position=1 -74,155-461,550-633
  Homolog annotation: Hit_ID=CAE59918.1; Match level="QueryCoverage =100%, HitCoverage=10%, E-value=2e-23, Identity=40%"; Hit description= Hypothetical protein CBG03403 [Caenorhabditis briggsae]
MSTFNRQIEQEQDKSGKLIMEVERRVITKASPDRLLQQLLVGDENAVGSEEVPSDSHFVEDFLLMHRVFFRDSAQIVRQLLRWFRAEPNRRDRVARIMLIWLNNHFEDFEGGQSGRQMAELLDEFDELLASAKMFNHQSLLSITVSVKSQARMV

SEQ ID NO: 158657 - protein, 22 aa, Heterodera glycines
  Coding regions on vcDNA: vcDNA=SeqID_85080; Strand=-; Position=1 -65,455-458
MTLLKMLNALIHLSVAFMINGQ

SEQ ID NO: 158658 - protein, 245 aa, Heterodera glycines
  Coding regions on vcDNA: vcDNA=SeqID_85081; Strand=+; Position=1 -186,364-487,859-890,1177-1313,1695-1779,2091-2261
  Homolog annotation: Hit_ID=CAE71733.1; Match level="QueryCoverage =77%, HitCoverage=14%, E-value=2e-38, Identity=41%"; Hit description =Hypothetical protein CBG18715 [Caenorhabditis briggsae]
PQPLPLAKNGKNGGDFLVKGAAENGKITTNKGIMNSCGESVDEQHTAAFDFRHFSAMEKGHRVCKLFVLKKFDVSFRHLWLNLHTHQLVLTKLASSSASNDEPVLDLRIVKEAQVLSKAIGTMQIAEKWRRDTSLQTFDPELILIIQWGTAFVLNSWLILVNIKHMKPFVQQRLQCKVSSKQLQEIAEGEMGFEAFVLAHNRLLNFHALFDCMFSEYADTEHAQLVPFQRFVDFLRDIQHDGLGQ

SEQ ID NO: 158659 - protein, 170 aa, Heterodera glycines
  Coding regions on vcDNA: vcDNA=SeqID_85082; Strand=-; Position=1-513
MLRGKTVAQIAEECGRIRGICAKFKHVHFVWLPPPYVREQHTLYNELLPILETVAGEWFIALTTSGRSLVEMWRFGETFDMTRIRSDGKILSEGLKCFRAWIVTQIPNFPDDNALGFRRSSRSVPSVSDHISELSLSHSRTSRSHPYAVRHHYSSQAHRGGNEMISRRRH

SEQ ID NO: 158660 - protein, 92 aa, Heterodera glycines
  Coding regions on vcDNA: vcDNA=SeqID_85083; Strand=-; Position=1 -58,418-638
MSSSTPNTSLITWDINSDQNNLCPSFALSDDGNELERLEAQRKAINAKIAVEFARQQMIMEGNEATPKSKGNLEALTNNKKNFIPKYFNSLI

SEQ ID NO: 158661 - protein, 31 aa, Heterodera glycines
  Coding regions on vcDNA: vcDNA=SeqID_85084; Strand=+; Position=1-94
MNKQRLPSELICEIIATIPLMYLFGGISKKP

SEQ ID NO: 158662 - protein, 70 aa, Heterodera glycines
  Coding regions on vcDNA: vcDNA=SeqID_85085; Strand=-; Position=1-211
MIRCPIILLLLFVSILPFNCAVDGMAGDALATVVTLSIGQSDGTSGTAQAKKQLDKEEEAVEEAKSGETI

SEQ ID NO: 158663 - protein, 225 aa, Heterodera glycines
  Coding regions on vcDNA: vcDNA=SeqID_85086; Strand=+; Position=1 -210,287-451,566-863,1105-1109
MKLAFVRLNVLTVLCLFCSMSHSYGNPSDESDDEICEEEENEAQSEAEEADEFFHNFNGTIQSEREEKRTVVEIFCRNTNDKFQFSTDDEGNFKIQMEAKIKWKFHKCTTGLRMAFYKKKVMENKVPKCLPIILRSPKRKLKNAKRLDICVVPIRIKWLKFGPKINAEEAETEENDEILRNEFALDFDVEKNAQMNGQIRNCSDLHSAEHNFEMIFNKYFDDGKT

SEQ ID NO: 158664 - protein, 74 aa, Heterodera glycines
  Coding regions on vcDNA: vcDNA=SeqID_85087; Strand=+; Position=1 -69,414-569
MARAFGINLLQKKISYALIYMRWMFFGHSVILFCFIANLYSFYSSADEVVKCPICQEEFGGNAQEKLLYDCNVS

SEQ ID NO: 158665 - protein, 1398 aa, Heterodera glycines
  Coding regions on vcDNA: vcDNA=SeqID_85088; Strand=-; Position=1 -4153,4258-4301
  Homolog annotation: Hit_ID=NP_508324.1; Match level="QueryCoverage =95%, HitCoverage=54%, E-value=1e-117, Identity=26%"; Hit description= predicted CDS, peptidase family A16 and RNA-directed DNA polymerase and Integrase, catalytic domain and
MSGTIRTRIPILVKSLKNKIEKYYEQIEQGKYEFDSNDLPGCLKLYEFIKKEIFNFEKTFDSLIELDKKWKKIRNKLNTEDKNAEIKIYKIYTEKHDYLKILEEADSVIDELKSLNLEVKKAIQNLKRNKKNNSGDQHEDENDDDDEPNDEQNTEEELTDKEEKETGTDQTNDSEIKSDLNSYEYSNFSSNNHRIKIKLPAQSLTHFNGKYSNWTSFWDDYKSSIHNDKELENIQKFKYLRGLLHDEPYRMISPYPITNQNYPIVIELLKSRYGNENLLRENLHNELRNLRKPSESISDLRKFILSINRIILQLQTYKEDINHPQIKQSIETKLPNNIRIKVREQLGTFNTKKLMNFLDQYTQAREEVQNIEEIDKMNHNAYSNKPQFRNGNFNKNNYSKQYKNFRINGNFQNNPLNNNHSFPTSALTTQSKPVLNINYNKTTDQKSNEIKLFCNFCEKTNHKSKDCKIYPDIETRNSRRRELKLCFNCLKKGHHVKECKSPYTCFYCKNKHNSLLCLKKKQNNNEKQIRPNQTRTNLINEEKLYETQTFSITKQFEKEEIEEILMTIEAPIININDNTELNSIILFDNGSQKSYITMELAKKLNLPIISKKTLALSTFNETKPKIIESQIVQIGIKTLDGSYETVTLQTIDKITDLINVNLQKTIDFGRSKMPIGLRIPHILIGIDHYWQFMLSDSKIRSLPSGFFRISTKIGDICSGKGTVEITKTNYASVKQQEKEELNKTIQKFWNLESIGISDSPSLNDDDLSVIHFNKTVKFENNRYIVRWPFKQEQPEIPTNFGLCFGRLKGVLKQLIKNKKLLEYDEILQNQLEMEVNEIVPFESSYLTHYLAHHPVIKESSNTTKIRPVFDASAKLRGNHSLNDEIFQGPKKMPDLCGMIMRFRLKKYVLIGDIEKAFLQIGLDILDRDTTRFLWIKNELLNELNKSNREIEMKDVEIRRFTRIPFGVNASPFLLAAVIELHLSKIDEMYENFKNINTNDIELDLEDKKEKFGKLCKELTENAYVDNFVMMCEDQNEIKFKHYWSKEIFKFASMNLREFISNHEESNNEIQKIEGSEMPKISKLLGIKWNVENDELTIPIKIPTISIGTTKRNVIHLIAKNFDPMGWISPVILPHKRFFQNLWKSKKDWDDQLSNEEIKNWNEITYEEEIHLRRFPFNNSLIQPVELHIFSDASGSAYASTAYLKLIESNEIYLIFAKTRLAPVKELTIPKLELLALLIGTRIAKFIINETKIKIQNTYLWSDSKCVLSWLKYKKELPTFVKNRVNEIKNATIVFNLKFHYIKSKENPADIASRGMTVSEIKNSDLWWYGPNWLKLPIDKWPYKQLEDFTPEEINEEFNEELEIQLTKSNLTTNPIKPFIKWEDYNLQQNDIRDEEVNK

SEQ ID NO: 158666 - protein, 597 aa, Heterodera glycines
  misc_feature (212)..(212): Xaa can be any naturally occurring amino acid
  misc_feature (239)..(239): Xaa can be any naturally occurring amino acid
  Coding regions on vcDNA: vcDNA=SeqID_85089; Strand=-; Position=1 -23,3012-3609,3645-3757,3833-4810
  Homolog annotation: Hit_ID=NP_508324.1; Match level="QueryCoverage =98%, HitCoverage=22%, E-value=2e-97, Identity=36%"; Hit description =predicted CDS, peptidase family A16 and RNA-directed DNA polymerase and Integrase, catalytic domain and Z
GQPYSSPKQEKEELNKTIQKFWNLESIGISDSPSLNDDDLSVIHFNKTVKFENNRYIVRWPFKQEQPEIPTNFGLCFGRLKGVLKQLIKNKKLLEYDEILQNQLEMEVNEIVPFESSYLTHYLAHHPVIKESSNTTKIRPVFDASAKLRGNHSLNDEIFQGPKKMPDLCGMIMRFRLKKYVLIGDIEKAFLQIGLDILDRDTTRFLWQPRNXNERRCRRFTRIPFGVNASRFLWQPRNXNERRCRRFTRIPFGVNASPFLLAAVIELHLSKKKFGKLCKELTENAYVDNFVMMCEDQNEIKFKHYWSKEIFKFASMNLREFISNHEESNNEIQKIEGSEMPKISKLLGIKWNVENDELTIPIKIPTISIGTTKRNVIHLIAKNFDPMGWISPVILPHKRFFQNLWKSKKDWDDQLSNEEIKNWNEITEEEIHLRRFPFNNSLIQPVELHIFSDASGSAYASTAYLKLIESNEIYLIFAKTRLAPVKELTIPKLELLALLIGTRIAKFIINETKIKIQNTYLWSDSKCVLSWLKYKKELPTFVKNRVNEIKNATIVFNLKFHYIKSKENPADIASRGMTVSEIKNSDLWWYGPNWLKY

SEQ ID NO: 158667 - protein, 279 aa, Heterodera glycines
  Coding regions on vcDNA: vcDNA=SeqID_85090; Strand=-; Position=1 -120,282-896,1999-2103
KRKSTEEPKPDTDTKQSKPEQKPAQQKEGKSEEGQKPKTDTSSLSKETQFVLQKLRQQEAIVQAKELSKVIREVQATINFNRNTDLISYSRALQKASQIPEQDEATDNLNFHSNFSPEINNKFLEELNSLESTHDDIYNRAVADCERAEQKRINSVTKQTQNIFEAVGKAIKAENFNKGLLTELAKAINSPSYNSRAGKDKALIIVNKLQDNLTHHHRFLIGQQKTAEFLRKTFKIPLEDEPSTRDQHENDDENDDDEDEPNDEQNTEEELTDKEEKET

SEQ ID NO: 158668 - protein, 80 aa, Heterodera glycines
  Coding regions on vcDNA: vcDNA=SeqID_85091; Strand=-; Position=1 -64,106-284
MEIVKNKMKICNRRIKRDETNVISGNGRTEKYGNRGNEQRKKKKRNMEDDWTKKEVTDEQKKCWTDNHQTEEIRESEKAM

SEQ ID NO: 158669 - protein, 53 aa, Heterodera glycines
  Coding regions on vcDNA: vcDNA=SeqID_85092; Strand=-; Position=1 -14,189-336
MKYQSHTEKGCMYKNALKCTTHGRLRYSSYKRAYTTHPYPTHPYPTHPYPTHP

SEQ ID NO: 158670 - protein, 76 aa, Heterodera glycines
  Coding regions on vcDNA: vcDNA=SeqID_85093; Strand=-; Position=1 -63,1923-2087
  Homolog annotation: Hit_ID=CAB01921.1; Match level="QueryCoverage =63%, HitCoverage=29%, E-value=3e-10, Identity=64%"; Hit description =COS2.2 [Ciona intestinalis]
MGGCWRRRYRPAHSRLFSTLPLSALSSEKRKRRHRTMFTEYQLNTMEEAFTACQYPDVQMREHLADKLKLREERVE

SEQ ID NO: 158671 - protein, 326 aa, Heterodera glycines
  Coding regions on vcDNA: vcDNA=SeqID_85094; Strand=+; Position=1 -11,71-256,402-834,892-1181,1242-1302
MNRRWICADVWLDILPSFDHAQLGLKMALLSDRFDVLVDTHFDGKSELTIWREIIIDKDEGPKPKVYIDHSVIKFLRSKKRFFDKSGTKLEVFVHSIDTDVQPIWDIFTSEIWALFTTNIRHLGFEDGNHLDNLRRRTSPTILTDLDQLNSIDSGRLFPDRIADDGPNATAGQALSKWLHTSTTDGQPKRLYCNNYFGPLNLEWVNNFKETFRRATTSVSYTIQLYFWVEQMPIESFELVNERTKEKLTLKQNIDEFDVNVCNWLLQRCPIGEMATAPAIKWGDSLNPSANLNHIRFVLWSFDKCIGPLSPPAEEEKADQSNENVV

SEQ ID NO: 158672 - protein, 140 aa, Heterodera glycines
  Coding regions on vcDNA: vcDNA=SeqID_85095; Strand=+; Position=1-423
MAAVTKVGKGPGPFLPDMCWATWWERFEFFIQLKGVTDVATKRLLLFTEMGQVYEELRRMAQPEDVRTMDLAEIEQLMVERFGEAKSIAACRHELFSAKQQTGQSIRDYSVQLRSLIAKAEWSRDSIDMCQRIVYQWHLQ

SEQ ID NO: 158673 - protein, 31 aa, Heterodera glycines
  Coding regions on vcDNA: vcDNA=SeqID_85096; Strand=+; Position=1-93
LLCPRTTDMKKRQIFIWSTNIINKWSSEGKC

SEQ ID NO: 158674 - protein, 105 aa, Heterodera glycines
  Coding regions on vcDNA: vcDNA=SeqID_85097; Strand=-; Position=1 -186,667-798
NLNNSSTRSYDDGNDDSDDDAKNEKVAGGLFAQFTAAFRRRSVSMDERVFRPRHGTISSSYSISGSPTGEVYGGVAKGTRQPRAKESNTFRKMRERLNKWKLSTG

SEQ ID NO: 158675 - protein, 25 aa, Heterodera glycines
  Coding regions on vcDNA: vcDNA=SeqID_85098; Strand=-; Position=1-137
IWQHGKSYSELIAFSKSLNSFALLI

SEQ ID NO: 158676 - protein, 59 aa, Heterodera glycines
  Coding regions on vcDNA: vcDNA=SeqID_85099; Strand=-; Position=1 -117,165-227
MDESSDGNAVDVGEGRSKYVQWILEMSAMVGKQNEEIRMTAKSVQNKRRGLLKFFRFFA

SEQ ID NO: 158677 - protein, 153 aa, Heterodera glycines
  Coding regions on vcDNA: vcDNA=SeqID_85100; Strand=+; Position=1 -69,212-604
MPNVKKQHEDLPPNSKTFKGRGTFFCVQSVAYAPPIFADFRSAQPTIGSIVRPLRQFAADAPQFGRPTEHSHDEAEHEAEIIDSLFSFFRVCLDLDLAFFTLDWTWISWTKIQEIPGPGKIQVAKKWHGPGPRKNPGLDPGPGRSLVQTDATQ

SEQ ID NO: 158678 - protein, 162 aa, Heterodera glycines
  Homolog annotation: Hit_ID=AAG23825.1; Match level="QueryCoverage =100%, HitCoverage=13%, E-value=9e-67, Identity=74%"; Hit description= guanylyl cyclase [Heterodera glycines]
  Coding regions on vcDNA: vcDNA=SeqID_85101; Strand=+; Position=1-708
VAILVAQNDTDFGMARKNAALPNSGGAIPMALEQLWADEILPKSVNFSIHWTYSQCNEANDFGQTYNYISKLGADAIIATSCIDVPPMLGHLAANSNIPMLVWGQSMSSNLASSNNATYPTLLNIVPNCKYMASGLISLLQYFNWTQIGIIIQSDIISASGG

SEQ ID NO: 158679 - protein, 84 aa, Heterodera glycines
  Coding regions on vcDNA: vcDNA=SeqID_85102; Strand=+; Position=2-253
NSSGKVPTANVQSNFLSNTTMPHKLQTTSTRKDSNCSVTSLLPNAEKEFDKSFAGVALSCGGGKKAHQLNDIKAVGEEAAAENV

SEQ ID NO: 158680 - protein, 46 aa, Heterodera glycines
  Coding regions on vcDNA: vcDNA=SeqID_85103; Strand=+; Position=195-335
NWFFQKKVMKELIVLYFYGHPKNVRSFKCMKIVQTFNYHITFDMKR

SEQ ID NO: 158681 - protein, 156 aa, Heterodera glycines
  Homolog annotation: Hit_ID=AAG21332.1; Match level="QueryCoverage =100%, HitCoverage=99%, E-value=2e-84, Identity=100%"; Hit description=hypothetical esophageal gland cell secretory protein 2 [Heterodera glycines]
  Coding regions on vcDNA: vcDNA=SeqID_85104; Strand=+; Position=9-476
MPSFKFVCFQFLLIFVLTELAHSEKGCPKTEDLIEMTKHLLTTGKNVISGEAASSSTEGKCSDTVMESVVTKVIEFGCYDEMEKNDGERAKSKTKNAFIESIETQRKGFCQLWQNGKSIGEKEQKDGILKIVKGLGGIELKKIERILENVQNIGLS

SEQ ID NO: 158682 - protein, 189 aa, Heterodera glycines
  Homolog annotation: Hit_ID=AAG21335.1; Match level="QueryCoverage =100%, HitCoverage=100%, E-value=1e-106, Identity=100%"; Hit description=hypothetical esophageal gland cell secretory protein 5 [Heterodera glycines]
  Coding regions on vcDNA: vcDNA=SeqID_85105; Strand=+; Position=24-590
MTTVKLLCLIALFAVVQLRFAFAMMNQNNQQVSQNNSSDEGEDDDDAGNGGQYDTVAPLRSDSTSFVSSGTLPPQGSTGFSGVGMMPPHAQNMGAMGMGMGNTSFGNLQQPTMQMQYQNQQMMQTPQMMQNQQMPFNQSGSFSGVGMMPMQHQNMGAMGMMNVGSTSFGNLQQSNMQMQHQNQQMMQNP

SEQ ID NO: 158683 - protein, 148 aa, Heterodera glycines
  Homolog annotation: Hit_ID=ZP_00266390.1; Match level="QueryCoverage =99%, HitCoverage=60%, E-value=4e-76, Identity=93%"; Hit description =COG1651: Protein-disulfide isomerase [Pseudomonas fluorescens PfO-1]
  Coding regions on vcDNA: vcDNA=SeqID_85106; Strand=+; Position=1-447
EGVSKLINGIPVAETVVYPAIGETKTHITVFTDTTCPYCHKLHAEVPALNKMGIEVRYVAFPRQGLGSPGDEQLQAVWCSADKKAAMDKMVDGKEIKSAKCANPVSKQFALGQSIGVNGTPAIVLADGQVIPGYQPAPQVAKLALGAK

SEQ ID NO: 158684 - protein, 157 aa, Heterodera glycines
  misc_feature (12)..(12): Xaa can be any naturally occurring amino acid
  misc_feature (37)..(37): Xaa can be any naturally occurring amino acid
  misc_feature (126)..(126): Xaa can be any naturally occurring amino acid
  misc_feature (153)..(153): Xaa can be any naturally occurring amino acid
  Homolog annotation: Hit_ID=AAG21337.1; Match level="QueryCoverage =100%, HitCoverage=100%, E-value=6e-78, Identity=100%"; Hit description=hypothetical esophageal gland cell secretory protein 8 [Heterodera glycines]
  Gene Ontology: Mol. function=heat shock protein activity; Cellular component=plasma membrane; Biological process=response to stress
  Coding regions on vcDNA: vcDNA=SeqID_85107; Strand=+; Position=112-582
MISRRAIIIWAXALLALAAISPNFSTADKGVDAVDAXDEIIDDPKVEVPKNGVGKGTDDQTVQWEEEAIKLEGLSVAEFKQLRESAEKHQFQAEVNRMVKLIINSLYRNKEIFLRELISNASDALXKIRLISLTNSTALAATEELSIKIKADXENHI

SEQ ID NO: 158685 - protein, 83 aa, Heterodera glycines
  Homolog annotation: Hit_ID=AAG21338.1; Match level="QueryCoverage =100%, HitCoverage=100%, E-value=5e-45, Identity=100%"; Hit description=hypothetical esophageal gland cell secretory protein 9 [Heterodera glycines]
  Coding regions on vcDNA: vcDNA=SeqID_85108; Strand=+; Position=71-319
MLMLLMTIFTVLSNVNEVAAEEHELVSRIKRNGYGYSSGYGGGCSACQSSCTTCGYTSYHTVPAAPAPPPPPPPPPPPAPVYS

SEQ ID NO: 158686 - protein, 196 aa, Heterodera glycines
  misc_feature (73)..(73): Xaa can be any naturally occurring amino acid
  misc_feature (150)..(150): Xaa can be any naturally occurring amino acid
  misc_feature (194)..(194): Xaa can be any naturally occurring amino acid
  Homolog annotation: Hit_ID=AAG21339.1; Match level="QueryCoverage =100%, HitCoverage=99%, E-value=1e-116, Identity=100%"; Hit description=hypothetical esophageal gland cell secretory protein 10 [Heterodera glycines]
  Gene Ontology: Mol. function=extracellular matrix structural constituent; Cellular component=secretory vesicle
  Coding regions on vcDNA: vcDNA=SeqID_85109; Strand=+; Position=10-597
MKIITLIPILFSLINSVVGQTTCATPTTPPVCYCTCESTPGVSSTAPTTTVGPTGTTTTGTPLTTGQGTSGPXTPAPTGTPGQSTTAPTGTPGPSTPAPTGTPGPSTPAPTGTPGPSTPTPTGTPGPSTPAPTGTPGPSTPAPTGTPGPXTPAPTGTPGPSTPAPTGTPGPSTPAPTGTPGPSTPAPTGTPGPXTP

SEQ ID NO: 158687 - protein, 229 aa, Heterodera glycines
  Homolog annotation: Hit_ID=AAG23159.1; Match level="QueryCoverage =100%, HitCoverage=99%, E-value=1e-130, Identity=100%"; Hit description=polyprotein [Heterodera glycines]
  Coding regions on vcDNA: vcDNA=SeqID_85110; Strand=-; Position=3-689
VKNCAPSQLAAKAATKTDLHSWPKSTRPWQRIHADYAGPFFGKEFLIVVDSYSKYPEVFEMNTKSAAATIERMRYLFIRHGIPETLVTDNGTQFAASEFAKFTEANGIAHLFSAPYNPKSNGQAERFVDIFKRAFRKIKGEGVPNKEIINTFLVTYRTTPNDSLPDAKTPAEMLLGRKPRTTIDLLMPPLPQPTERYAKRFVSRHFINLFLSISLSLSRPHYFSHLIVS

SEQ ID NO: 158688 - protein, 1174 aa, Heterodera glycines
  Homolog annotation: Hit_ID=AAG23825.1; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85111; Strand=+; Position=34-3558
MPGNSVQQFTTPSAPVANNQTVIKVAMLVAQNDTDFGLPRKNSMLRNAGGAIPMALEQLWADEVLPKSVNFSFEWVYEKCNEATAMGLTYQFIHDFGADAIIPTTCMEVAPQVGHLAANFNIPMIVWGQNMVSNLASSNNATYPTLLNIVPNYKYMASGLISLLQYFNWTQFAVVIQSDLGNVSGGCDYLAKSIDNSLATSNITVNYKTRIFNVQSSDMDRIANSLLQRARIILLCFDDKKQLRTFALNLFDGGLNTKNFVYIIPDNDMTLSFNLSLDPFWVQTSVNSNGLDGRDADAEVIGRLAFWWHYDITLSALSNRNYYGFYGRVVNRTYGWPFYCPESECNTVANGSLNSVLLYDAIYNYGMALNESFKQFGIRRETYRNGSLLAANNRRPFMGLTGYATVETDRNTRVFVLSNRKSDSKQSPLRILMQLAWTNGELNVTMRNASSLMWFSHGGVVPPAVPTCGFDGNGCTVSVFDLYKGYFLGGIALFVLLIGASIFCVAYLIHAKIVDKRKGNLQWKIPFALLQRQNQRRSERTAERSHHSLRSNQTNISALTHATTSSSLAQSKNFTLYAYNGQMCIVHAYGPTLLAMPLSAEGMAECRTLRLFDHVNLNRFLGLSLDGPNLLAVWNFCARGSLKDVIMSGNAMVRDVVFIQSSIRELCEGLHFLHNSPLQFHGRLKSSACLINDRWQVKISYFGLRWLKNTQKIQTKDLLWLAPEQLRKMGENKNLIDGTKQSDIYSLALIFTEMVNMTPCWETNNEDDEADSDKSAADDQAVQQENAMSRRRTTTTTAAQQRVKRRAPGGQQQRTGQRRQNAEEIVYLVKRGGLIPLRPTIRPALDNLNPELIHLIRDCWVESPAERPTIEKVRQKLRQMNAGQSINLMDHVFGMLEQYANKLEEDVHERTRELEEEKRKSDILLYRMMPRQVANSLKLGQSVEPEQFECVTVFFSDIVQFAALSNQMRPLHVVNLMNELYTTFDAIVDEHDVYKVESIGDGYLCVSGLPNRNGNLHAKQCADMALKFLNSLQSFRISEHSDQRIRLRIGLHSGPCVAGVVGLAMPRYCLFGDTVNTASRMESSSSANKIHISKETCILLHENSEGGAYLTESRGEVIIKGKGVMETFWLLGNAKISGGTIGTNHSQAAERQMAMESDKSEKEMYKSYKQSTTN

SEQ ID NO: 158689 - protein, 1112 aa, Heterodera glycines
  Homolog annotation: Hit_ID=AAG23826.1; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85112; Strand=+; Position=12-3350
MFFGTSVAVVLCWLFCTFPTTFGQQQNGTAPLIKVGLMMPHNQSSDLSFARSAGAISVALKHIFNDNLLPPGTNFSFIVRFEECLMSVAAGYAFDLLDGQQVDLFIAPPCTDSAQVALFVSTFYNIPSITWGQNSDSSFNSQSNYPTLLSALPNYADFGQIIISLCIFFKWSVMALIYQLSETGQCASFQQDLQIAINSNDKCDISYREEVKISSAGTSDAQYTISQIQSRARIVILCFDEFVQLRNFAAKLQEGGLDSADYVYLIPGLTMDDSIESVNCVFYKIQICVCFFSVFNLLFVLGGSKATAWWVDPNPTIQSAAYRIAQRSLYLMLDIFNKVATSGQVGNGTSFDQEVIRQVTQWPFFCTDCDQSLQASSYAPLLHDSFYLYAMALSKAAKIAGALSPSVYRNGQLIRSQTANLSFEGMTGSNKFGSDGLRNFIYLVSMYSSLNGDLTSYVWLQMNDAGVNSSWINATAEKLIWSSRNGVKPLAVPLCGFDGNGCHMDFFTEYRGYVIAAGCLLLLILGSFAFGIYWLFQSKAREMERQNRLWQIAYSTLTPAGTKKKMMESVRSLQSSTSSQFTRDSSHSHVSIKHNFNGIVYIMNGERVIGIQHSVGIRLSPQDMAELRTMRLLDGDNVNRFIGLSIDGAALLSLWRYCSRGPLSDVISGSSSLTMDGFFIYSLVRDVAEGLRFLHASSIGWYGNLRSTNCLIDDRWQIKLSEFGLRFFRAHEKREAKDLVWTAPELLRDNDIVGNKFGDVYSFSIVSSEIVNMKPIWEQDEAKGNVERVRTGGKRAFRPKLEPSSQDLSPALLHLIKDCWDESPAERPKMETVTALLQSMNTGRSTNLMDHVFNMLEVYAGSLEEEVEERTKELVEEKKKTDILLYRMLPKQVADKLKLGQSVEPETFDCVTVFFSDVVSFTTIASKCSPLQVVNLLNNLYTLLDSIIAEFDVYKVETIGDGYLCVSGLPHRNGHEHAQHIAKMSLAFMRNLGSFTIPHLPIERLRLRIGIHTGSTVAGVVGLSMPRYCLFGDTINTAARLESSSKPMRIHISTTTNHFLVNVLGGFVTQARGEILVKGKGVLETFWLLGLEGDPAVMRMLHSSDGNNATTE

SEQ ID NO: 158690 - protein, 47 aa, Heterodera glycines
  Homolog annotation: Hit_ID=AAG39300.1; Match level="QueryCoverage =100%, HitCoverage=100%, E-value=9e-20, Identity=100%"; Hit description=HMG-like protein [Heterodera glycines]
  Coding regions on vcDNA: vcDNA=SeqID_85113; Strand=+; Position=2-239
SVAEVAKAAGVEWGRMSAADKTLWEQKAADDKKRYEQEMTQYRARQK

SEQ ID NO: 158691 - protein, 949 aa, Heterodera glycines
  Homolog annotation: Hit_ID=AAG45917.1; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85114; Strand=+; Position=3-2852
KITINYKTRIFNIQSSDTSTIVNAIRERARIVLLCFDDLKQMRTFALQLFDGGLNTKDYVYIMVDNDMYLSFNLTRLPFWVQSSNNSNTLDGRNADAEVIGRLALWWHYDITLSALSNQNYYGFFKRVIDRTGDWPFYCDESNCSKVINASIYSLLLYDAIYNYGMALNESFRQFGIRPEVYRNGTLLARNNRKPFMGLTGYVTVETDQNTRVFVLSNRKSSEKGNALRILMQFAWVEGKLQISLRNGSLSMWSSRGGSIPPAVPICGFDGKGCAASVFEMYKGYLLLGIALFVVTISGSTFTVGFLIHAKFVEGRRSNMSWKIPFALLTKSKPKRADRTAANRSRHSVRSNQTNISSLTHSTIGSLARSRIFSLYSYNGEKCIVRSFGSTTMAKAFTVTQMAECRTMRLFDHENVNRFLGLSLDGANVLAVWNFCMRGSIRDVILSENAMVKDVIFIQSAIKEICEGIHFLHNSPLQFHGRLKSSACLINDRWQVKISYFGLRWLKSSQKNRAKDLLWLSPEQLRKMGDSEIVEGSKHSDIYTMALIFTEMVNMSPCWDSSEADGAEADRAEDGEEQNGTEMSRRKQTAETEGETAQRRPGRRARGRNAEEIAYLVKRGGIVPLRPIIRPAFDHLNTEVIHLIRDCWVETPSERPTIEKVRQKLRQMGAQRRVNLMDHVFDMLEQYANKLEEEVQERTKELEGEKRKSDILLYRMMPRQVADRLKLGQSVEPEQFDCVTVFFSDIVQFAALSNQMRPLQVVNLMNELYTIFDAIIDEHDVYKGDGYLCVSGLPNRNGTLHAKHCADMAIKFMQALLNFRIPDLPNERVRLRIGLHSGPCVAGVVGLAMPRYCLFGDTVNTASRMESSSSPNKIHMSSETLELLHKNFNGSYHTESRGEVIIKGKGVMETFWLLGQVENGTTINADYAHRMHLPVIKFGEEGNETGKNA

SEQ ID NO: 158692 - protein, 244 aa, Heterodera glycines
  Homolog annotation: Hit_ID=AAG21336.2; Match level="QueryCoverage =100%, HitCoverage=100%, E-value=1e-137, Identity=100%"; Hit description=hypothetical esophageal gland cell secretory protein 6 [Heterodera glycines] sp|Q9BN19|HSP6_HETGL Puta
  Coding regions on vcDNA: vcDNA=SeqID_85115; Strand=+; Position=18-752
MDRRFTVFLVIALVTSIYEVLSNGNLNDGDDSFKQFDELEENPAHKYSKEAQKGFEMEEEEVTIREPSGTKESFKLPINMPPVKFSFCVSCGYRQAYEQFAQILREKYPGIDIHGENYPPGILRTVGAQVIGMVKIALIVCVVSGRSPFPTLGLETPTFFQWMLSNRLSAALMLFLFSNAIEGMLQSTGAFEIYIESERIWSKLESGRVPSPPELFQAIDSHLAIRRGGAGRFGSSSSFGIDGS

SEQ ID NO: 158693 - protein, 139 aa, Heterodera glycines
  Homolog annotation: Hit_ID=AAG21331.2; Match level="QueryCoverage =100%, HitCoverage=100%, E-value=2e-73, Identity=100%"; Hit description=hypothetical esophageal gland cell secretory protein 1 [Heterodera glycines]
  Coding regions on vcDNA: vcDNA=SeqID_85116; Strand=+; Position=22-441
MPNIFKILLIVLLAVVSFRLSASTGDKKTANDGSGNNSSAGIGTKIKRIVTAGLLFTSLATGGAEAIGRSNAQGGNAAGLVPSHLTNRSMAPPPPPAQFEKGAATRVEKMRAQLRELAEKMTDKDPKRLSPSGPDPHHH

SEQ ID NO: 158694 - protein, 393 aa, Heterodera glycines
  Homolog annotation: Hit_ID=AAG21334.2; Match level="QueryCoverage =100%, HitCoverage=100%, E-value=0.0, Identity=100%"; Hit description= hypothetical esophageal gland cell secretory protein 4 [Heterodera glycines]
  Coding regions on vcDNA: vcDNA=SeqID_85117; Strand=+; Position=45-1226
MHFQTAFLLLVPFIVANIVLADMPKDDAPRPAVQIRTRRSVYVAMMDGIGVTKEAMRYACRGWQTSFCTKFGTTLAVERTRRDTNAEMMGTKMTANAEREAKKEMNGEMGAKKEMNAEMMNTKKDTNAEVMGTKTNANPERDTKMDAVVMNTKTNANPERDTKTETNAVMVNTKTDSANPERDTKTDAVMVNTKTNVNPERDTKMDTTNAEVMDTKKEANAAAAAPVAASDNTAPAPMTWMMDGIVPRDVNVMVDRTTKELRKTTETDGFYDMSQRAQERVMLETAGKQGEIVKTKLKEAIEEARKMIERALGTVISYSEAPMESKMQLEQVFMTLTDETKTPKEKMERIKDIQQKWTPEIRAALKPSTDDKEIAEAIRFFTDLPAQIELGKK

SEQ ID NO: 158695 - protein, 39 aa, Heterodera glycines
  Coding regions on vcDNA: vcDNA=SeqID_85118; Strand=-; Position=2-118
GNVNPLPFGNRMDQLRKHRKVVIRSVLRLAGSLGSADPH

SEQ ID NO: 158696 - protein, 1151 aa, Heterodera glycines
  misc_feature (443)..(443): Xaa can be any naturally occurring amino acid
  Homolog annotation: Hit_ID=AAC72366.2; Match level="QueryCoverage =100%, HitCoverage=100%, E-value=0.0, Identity=99%"; Hit description =guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85119; Strand=+; Position=978 -6708
MEMPSCFFLLFFLMLFVSPSRHQLVTVSNSSSSPIGTTVAFGTPSPIIPISTAPSTNGTATFGVPPPISPPINSSSSLPSTGPLEASVQLKIGFLFANGTQRLRMLFGFGQSAPAVTLALERARQEHLIDSINFTYTWRMCGCFQPWAVGYATQLVLTENVDALIGPPCAIAAGYVASFYNIPLYLWGATVASEFYNTTVYPTLNNVNVNSDMLALALQSVLVQFNWTEVSFVYTPDNERMVCNSVKQSLTNVLNVTNVTIVFQHQMESNVDSMKATLRNLRNRSRIVLSCFDVEVERRNFLLSIFDTGLAADNEFVFIMGSLRNQGMLQQVASREDGSVKYVNNWMDKNSPGDGRDSDALAATKHVIMIDLENQSSDQLNEFNRNLSAKFGTYPFFCNGSCMGGATEQSPSQYARALFDTTYAYFRALNRTMEKRKSNGRDXLRNGTELNAETAGTTFQGETGRITFDAHGNRQPTFFVTMLNALNVPTVMVKVNITNGVLKMERLYGSEASLWVNWGGFRPMTTPLCGYNGTMCGQNVTVYILIGVTLMLLLLVAALLGIGYAIREKMREKQRLTRECLIPFAELRNLKELRSSEELKSETEKSMRSMRSSQSGSTRLTVGSHKAQRETANCAFFVFNREIVLAVKYHVRVRIMSEDLAFIRKLRQLDHDNMNKLYGVCTDGPLLFAIWRNCQRGTLKELIAKEQYVGDNCVMFALMRDIANGLLAIHQSFIGAHGLLSSENCLINDRWQVKISDFGLNMIRESQTLSKKALLWTAPELLRENNRKGTKEGDVFSFAIICVEMVNRETVWNGVERDQDIDEILYRLRRTNTTIPHRPQLHPRAEINQSLLHLIRDCWSEVPSERPRMDIVRTMLKQMVQDGSQNLMDYVFGMLEQYASSLEQEVEERTKELVEEKRKSDILLYRMLPRQVADKLKIGESVEPESFQMATIFFSDVVSFTTLAGKCSPLQVVNLLNGLYTAFDGIIDTHDCYKVETIGDGYLVCSGIPKRNGDQHAKEIAELSFAFLRTVSSFRVDHLPSERVNLRIGFHSGPAVAGVVGLTMPRYCLFGDSVNTASRMESNGKAGRVHISSSANHFLTSVIGGYVTEPRGEVIIKGKGVMETFWLLGRIGEAHLSEGTAERNASAATRK

SEQ ID NO: 158697 - protein, 437 aa, Heterodera glycines
  Homolog annotation: Hit_ID=AAK26375.1; Match level="QueryCoverage =100%, HitCoverage=100%, E-value=0.0, Identity=100%"; Hit description= class V aminotransferase [Heterodera glycines]
  Gene Ontology: Mol. function=alanine-glyoxylate aminotransferase activity; Cellular component=peroxisome; Biological process =glyoxylate cycle
  Coding regions on vcDNA: vcDNA=SeqID_85120; Strand=+; Position=30-1343
MLSRMLSSAVAVPRMCESNKKLLRKGATFVGLLCGRMANSTFTATVTPPHRLLRPLHINEKKLFGPGPSNMPPLVQEGLVQPLLGHMHPEFFEIMDDVKAGIKYIFQTENALTFAVSGTGHAGMECAILNLLEPGQTILVVQNGVWGLRAANLAERLGIKVHRLVVPEGEVINLDDFAEAVDNYRPQVAFVCHGESSTGVVHPLERFGDICNAYDVLFLVDTVASICGAPFHADALKVDCVYAATQKVLNCPPGLAPISFSEKALEKITKRKTRVPSFYFDALELGNYWGCFDEPRRYHHTAPISLVYALREGLSAVAQEGIGHMVNRHKINAKLLYDAFDQLGLELFVQKENNRLPCLTTVRVPEGVDWKAVQDKLMAQGFEIAGGLGPTAGKIWRIGTFGINSNPEDIESLKQALKGALYEQEEKGQSDHFKAAI

SEQ ID NO: 158698 - protein, 297 aa, Heterodera glycines
  Homolog annotation: Hit_ID=AAK26377.1; Match level="QueryCoverage =100%, HitCoverage=100%, E-value=1e-175, Identity=100%"; Hit description=putative alpha/beta hydrolase [Heterodera glycines]
  Gene Ontology: Biological process=amino acid and derivative metabolism
  Coding regions on vcDNA: vcDNA=SeqID_85121; Strand=+; Position=41-934
MTAAEIELKTCEQKKTNGLTINNAHEETKMEPIEEANLKIIDTDIGYCRYGKGPVNFLFICGGVGCYKKDYPECVLRAFDPNFATIICIDPPGYGTSRPPDRKQEVNRCKMDAKYCLKLMETLKLTPFVVLGWSEGGRTSIHVAGQGKGLVSHMVLLSSGSQVDMRGDLAFKGMRNTDQWMPAAKAPYLEHYSNEFLKEQWAGLCDVVAKVYKDLGGSFPCDRVLNTLKIPVLIVNGNMDRFVLDPSLMSKKLENARIEIHAQGGHDLHIKYPRWFALKVTSFVKESAKSDVKANRK

SEQ ID NO: 158699 - protein, 88 aa, Heterodera glycines
  Homolog annotation: Hit_ID=EAK91016.1; Match level="QueryCoverage =92%, HitCoverage=75%, E-value=2e-18, Identity=62%"; Hit description =hypothetical protein CaO19.6835 [Candida albicans SC5314]
  Coding regions on vcDNA: vcDNA=SeqID_85122; Strand=+; Position=945 -1211
MVRLVFRPYTQVRRSICTSESLRTSTRVSSGFILLRNSSPSFGSQRIRSVSAPSHAIETGLCCAPTPQCQGSHISSVRSLHFHCAFGF

SEQ ID NO: 158700 - protein, 1151 aa, Heterodera glycines
  Homolog annotation: Hit_ID=AAC72366.2; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85123; Strand=+; Position=78-3533
MEMPSCFFLLFFLMLFVSPSRHQLVTVSNSSSSPIGTTVAFGTPSPIIPISTAPSTNGTATFGVPPPISPPINSSSSLPSTGPLEASVQLKIGFLFANGTQRLRMLFGFGQSAPAVTLALERARQEHLIDSINFTYTWRMCGCFQPWAVGYATQLVLTENVDALIGPPCAIAAGYVASFYNIPLYLWGATVASEFYNTTVYPTLNNVNVNSDMLALALQSVLVQFNWTEVSFVYTPDNERMVCNSVKQSLTNVLNVTNVTIVFQHQMESNVDSMKATLRNLRSRSRIVLSCFDVEVDRRNFLLSIFDTGLAADNEFVFIMGSLRNQGMLQQVASREDGSVKYVNNWMDKNSPGDGRDSDALAATKHVIMIDLENQSSDHLNEFNRDLSAKFGTYPFFCNGSCMGGAAEQSPSQYARALFDTTYAYFRALNRTMEKRKSNGRDLLRNGTELNAETAGTTFQGETGRITFDAHGNRQPTFFVTMLNALNVPTVMVKVNITNGVLKMERLYGSEASLWVNWGGFRPMTTPLCGYNGTMCGQNVTVYILIGVTLMLLLLVAALLGIGYAIREKMREKQRLTRECLIPFAELRNLKELRSSEELKSETEKSMRSMRSSQSGSTRLTVGSHKAQRETANCAFFVFNREIVLAVKYHVRVRIMSEDLAFIRKLRQLDHDNMNKLYGVCTDGPLLFAIWRNCQRGTLKELIAKEQYVGDNCVMFALMRDIANGLLAIHQSFIGAHGLLSSENCLINDRWQVKISDFGLNMIRESQTLSKKALLWTAPELLRENNRKGAKEGDVFSFAIICVEMMNRETVWNGVERDQDIDEILYRLRRTNTTIPHRPQLHPRAEINQSLLHLIRDCWSEVPSERPRMDIVRTMLKQMVQDGSQNLMDYVFGMLEQYASSLEQEVEERTKELVEEKRKSDILLYRMLPRQVADKLKIGESVEPESFQMATIFFSDVVSFTTLAGKCSPLQVVNLLNGLFTAFDGIIDTHDCYKVETIGDGYLVCSGIPKRNGDQHAKEIAELSFAFLRTVSSFRVDHLPSERVNLRIGFHSGPAVAGVVGLTMPRYCLFGDSVNTASRMESNGKAGRVHISSSANHFLTSVIGGYVTEPRGEVIIKGKGVMETFWLLGRIGEAHLSEGTAERNASAATRK

SEQ ID NO: 158701 - protein, 1151 aa, Heterodera glycines; identical to SEQ ID NO: 158696
  misc_feature (443)..(443): Xaa can be any naturally occurring amino acid
  Homolog annotation: Hit_ID=AAC72366.2; Match level="QueryCoverage =100%, HitCoverage=100%, E-value=0.0, Identity=99%"; Hit description =guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85124; Strand=+; Position=978 -6708

SEQ ID NO: 158702 - protein, 1112 aa, Heterodera glycines; identical to SEQ ID NO: 158689
  Homolog annotation: Hit_ID=AAG23826.1; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85125; Strand=+; Position=12-3350

SEQ ID NO: 158703 - protein, 949 aa, Heterodera glycines; identical to SEQ ID NO: 158691
  Homolog annotation: Hit_ID=AAG45917.1; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_85126; Strand=+; Position=3-2852

SEQ ID NO: 158704 - protein, 48 aa, Heterodera glycines
  Coding regions on vcDNA: vcDNA=SeqID_85127; Strand=+; Position=212-355
TFSNFHLINLRRILPFLINSLVKRQKIGSFKYAYLNYFHCFPFAYDHT

SEQ ID NO: 158705 - protein, 45 aa, Heterodera glycines
  Homolog annotation: Hit_ID=AAF06120.1; Match level="QueryCoverage =100%, HitCoverage=4%, E-value=8e-15, Identity=77%"; Hit description =beta-galactosidase [Integration vector mini-CTX-lacZ] ref|NP _414878.1| beta-D-galactosidase [Escherichia c
  Coding regions on vcDNA: vcDNA=SeqID_85128; Strand=+; Position=2-136
RDWENPGRTQLNRLAAHPPFPSWHNTEEARSDRPYHHPHSLNGEW

SEQ ID NO: 158706 - protein, 54 aa, Heterodera glycines
  misc_feature (12)..(12): Xaa can be any naturally occurring amino acid
  Homolog annotation: Hit_ID=AAC78831.1; Match level="QueryCoverage =100%, HitCoverage=68%, E-value=2e-14, Identity=66%"; Hit description= lacZ alpha peptide [Expression vector pYZ81N] gb|AAC78828.1| lacZ alpha peptide [Expression vector pYZ41N
  Coding regions on vcDNA: vcDNA=SeqID_85129; Strand=+; Position=2-163
SLAEILQRGDCXNPGVTQINRLESYPPLASWCNIEQVRNYRPSQHLRTLNGEWH

SEQ ID NO: 158707 - protein, 51 aa, Heterodera glycines
  misc_feature (4)..(4): Xaa can be any naturally occurring amino acid
  Coding regions on vcDNA: vcDNA=SeqID_85130; Strand=+; Position=328-480
PTFXYPCMQHHTSPIMAPKFHSLAAVLQGPAWENPGVPTLRACSQSPFGSW

SEQ ID NO: 158708 - protein, 112 aa, Heterodera glycines
  Coding regions on vcDNA: vcDNA=SeqID_85131; Strand=-; Position=0-335
EWVICAPAAILRRSGHFSGPFSGVEPLSSATRHHHGSQIHYHRKLIRQTLERHVAGTRPCDQLSCSESTLDLKSGFALIFGSRICTLARTVVPKLVGQKVSQPRRSSRENGT

SEQ ID NO: 158709 - protein, 114 aa, Heterodera glycines
  misc_feature (71)..(71): Xaa can be any naturally occurring amino acid
  misc_feature (92)..(92): Xaa can be any naturally occurring amino acid
  Homolog annotation: Hit_ID=AAA73456.2; Match level="QueryCoverage =67%, HitCoverage=67%, E-value=1e-20, Identity=66%"; Hit description =beta-galactosidase alpha peptide [Cloning vector pSport1]
  Coding regions on vcDNA: vcDNA=SeqID_85132; Strand=+; Position=35-378
CLLIINVLICKKKKKKKKKKKKLKRSYHCLKKQKEAASRGTKITQLLCCRRHCSSITSPKITSLHVVLQRXDWENPEDPHLNRLAVPPPFPXWRNSEEVHNDRPSQQLLILNGQ

SEQ ID NO: 158710 - protein, 48 aa, Heterodera glycines
  misc_feature (13)..(13): Xaa can be any naturally occurring amino acid
  Homolog annotation: Hit_ID=AAA75565.1; Match level="QueryCoverage =97%, HitCoverage=50%, E-value=5e-10, Identity=68%"; Hit description =LacOPZ-alpha peptide from pUC9; putative [Cloning vector pBGS9-] gb|AAA75563.1| LacOPZ-alpha peptide from
  Coding regions on vcDNA: vcDNA=SeqID_85133; Strand=-; Position=1-144
STFRVLNCCEGRXVRAFSFLRLLAKGGCVLTGLSWVTPGHSQSCSCKN

SEQ ID NO: 158711 - protein, 48 aa, Heterodera glycines
  Homolog annotation: Hit_ID=AAA56734.1; Match level="QueryCoverage =97%, HitCoverage=29%, E-value=1e-14, Identity=78%"; Hit description =non-functional lacZ alpha peptide
  Coding regions on vcDNA: vcDNA=SeqID_85134; Strand=+; Position=3-149
HWPSFYNLLTEKTLPLPNLITLHHIPLSSAGVITKRHAPIALPSSCAP

SEQ ID NO: 158712 - protein, 352 aa, Heterodera glycines
  Homolog annotation: Hit_ID=AAK85303.1; Match level="QueryCoverage =100%, HitCoverage=100%, E-value=0.0, Identity=100%"; Hit description= beta-1,4-endoglucanase-4 [Heterodera glycines]
  Coding regions on vcDNA: vcDNA=SeqID_85135; Strand=+; Position=1-1059
MLVQLVLLAIIGISFVGAAAPPYGQLSVSGTKLVGSNGKPVQLIGNSLFWHQWYPQFWNTETVKALKCNWNSNVVRTAMGVEQGGYLSDANTAYRLTAAVIEAAIAQGIYVIVDWHAHEANADKAIEFFTKVAKAYGSNPHLLYETFNEPLDVSWNDVLVPYHKKVISAIRAIDKKNVIILGTPKWSQDVDVAAQNPIKGFGNLMYTLHFYASSHFVDGLGNKLKTAVNKGLPVFVTEYGTCEASGNGNLNTNSMSSWWSLLDQLQISYVNWSITDKSEACAALTGGTSAANVGTSSRWTQSGNMVASQHKKKSTGVNCSGGGGAAAKPAAKPAAKPAAKSKGKSSKAKKSG

SEQ ID NO: 158713 - protein, 121 aa, Heterodera glycines
  Coding regions on vcDNA: vcDNA=SeqID_85136; Strand=-; Position=138-503
VLSHVLGQARALPRRLITATDVAASTNTPLVTARKTGNETTIPSQCVMCLPQQPLNDAQTPAQPLGRPTSVHPTLAQRTSQARRPATDTLPRSSHTQAFTCAALSGIPQLQRMEAPQKHGS

SEQ ID NO: 158714 - protein, 74 aa, Heterodera glycines
  Homolog annotation: Hit_ID=AAF36455.1; Match level="QueryCoverage =93%, HitCoverage=1%, E-value=1e-13, Identity=49%"; Hit description =ubiquitin-protein ligase 2 [Arabidopsis thaliana]
  Coding regions on vcDNA: vcDNA=SeqID_85137; Strand=+; Position=147-368
KRLVGIACSCMKNQLPSDTMHAILLLCSNLTKNHSVALTFFDAGGLSLLLSLPTSSLFPGFDNVAAGIVRHVIE

SEQ ID NO: 158715 - protein, 57 aa, Heterodera glycines
  misc_feature (29)..(29): Xaa can be any naturally occurring amino acid
  Homolog annotation: Hit_ID=AAO14563.2; Match level="QueryCoverage =100%, HitCoverage=7%, E-value=2e-23, Identity=94%"; Hit description =Hsp90 [Heterodera glycines]
  Gene Ontology: Mol. function=protein binding; Cellular component =centrosome; Biological process=regulation of sleep
  Coding regions on vcDNA: vcDNA=SeqID_85138; Strand=-; Position=3-173
KLLVEKERDKEISDDEAEEEKKEDEAKEXEEKPEDDVSDDEAEKKKEEGDEKKKKTK

SEQ ID NO: 158716 - protein, 114 aa, Heterodera glycines
  Homolog annotation: Hit_ID=CAA39485.1; Match level="QueryCoverage =95%, HitCoverage=32%, E-value=7e-09, Identity=36%"; Hit description =hydroxyproline-rich glycoprotein [Sorghum bicolor] sp|P24152|EXTN _SORBI Extensin precursor (Proline-rich g
  Coding regions on vcDNA: vcDNA=SeqID_85139; Strand=-; Position=1-342
PLVHPVIPAAPPPKSPAPGGELVSAPVYKTPKPPSAIVHFHAQAPVVSPVSTPSRSFNWTKGGEPVSAPPYKTPRPLPVIVHSPAQAPSSAHKARQFHHAPEPPISSPESPFNE

SEQ ID NO: 158717 - protein, 93 aa, Heterodera glycines
  Homolog annotation: Hit_ID=AAD11968.1; Match level="QueryCoverage =100%, HitCoverage=43%, E-value=1e-17, Identity=41%"; Hit description= P22U [Dirofilaria immitis]
  Coding regions on vcDNA: vcDNA=SeqID_85140; Strand=-; Position=1-279
MKRQCKCAEIKPCKDRYQKTMEPCLDTCQSHITSLGGNFRQVKACFAPKESLLNSAMRCTERQHDNACTHSSAAQFVPKRYGQTLENEAMVEI

SEQ ID NO: 158718 - protein, 129 aa, Heterodera glycines
  Homolog annotation: Hit_ID=AAL78211.1; Match level="QueryCoverage =100%, HitCoverage=99%, E-value=3e-66, Identity=100%"; Hit description=putative salivary proline-rich glycoprotein precursor Hgg-15 [Heterodera glycines]
  Coding regions on vcDNA: vcDNA=SeqID_85141; Strand=+; Position=1-387
MVTNRTMLPDKRRLAVRKVGTATTNRQRRRTVPVRHTARSMVTNRKMLPDKRRLAVRKVGTATTNRQRRRTVPVRHTARSMDKRRLAVRKVGTATTNRQRRRTVPVRHTARSMDKRRLAVRKVGTATTN

SEQ ID NO: 158719 - protein, 150 aa, Heterodera glycines
  Homolog annotation: Hit_ID=AAL78212.1; Match level="QueryCoverage =100%, HitCoverage=100%, E-value=5e-82, Identity=100%"; Hit description=putative esophageal gland cell secretory protein Hgg-25 [Heterodera glycines]
  Coding regions on vcDNA: vcDNA=SeqID_85142; Strand=+; Position=1-450
MRTFLFIAVVGLMLAVILENVNATPTKGQSLPDSTKRETEPKEEYGNQQNHATVSNEVQNVDYRQQAPGKQSLDSPNHEKDHKNEHEKYEAAYFQISNVVQNVDNKPRPSAAASHLVPVTPGKVGGASLKMVKKLCGTMMPTMNKPKAVV

SEQ ID NO: 158720 - protein, 193 aa, Heterodera glycines
  Homolog annotation: Hit_ID=AAL78214.1; Match level="QueryCoverage =100%, HitCoverage=100%, E-value=1e-113, Identity=100%"; Hit description=putative esophageal gland cell protein Hgg-20 [Heterodera glycines]
  Coding regions on vcDNA: vcDNA=SeqID_85143; Strand=+; Position=1-579
MGQINVCDDVWLDTLAWINRVEVGMKFALVNVRLNALADKHFKQRKWCFGEFHTCERMTEESGAEIMTSIDGSDFSTLPLPTTPLPDSVVGFRSISIWYINEEVVNFLRTIRRLLTKDIALEFSTFFTEYRSWKVMAQHIWPLLKDGISTLCLKKCDLGHAPSNTCRPPCCFDCAGLDRIHNAKCLPRVFVLV

SEQ ID NO: 158721 - protein, 288 aa, Heterodera glycines
  misc_feature (7)..(7): Xaa can be any naturally occurring amino acid
  misc_feature (9)..(9): Xaa can be any naturally occurring amino acid
  misc_feature (13)..(13): Xaa can be any naturally occurring amino acid
  misc_feature (21)..(21): Xaa can be any naturally occurring amino acid
  misc_feature (26)..(26): Xaa can be any naturally occurring amino acid
  Homolog annotation: Hit_ID=AAL78215.1; Match level="QueryCoverage =100%, HitCoverage=100%, E-value=1e-168, Identity=99%"; Hit description=probable polyprotein allergen Hgg-14 [Heterodera glycines]
  Coding regions on vcDNA: vcDNA=SeqID_85144; Strand=+; Position=1-864
SLRMPSXWXFAPXFSPPIPFXISVLXLLFCLQFFPLNALHHSVFVRRDLSRPAPDDGVASASINTEEDLGGLNTEWLTDDQLSELASAGSNEERMIKMRTFYDNLEGEAKKGATKKIVEECYGWVDEVATEDERNALKQMHHQSHDECKAKVRELMGRLSEERSEQVENRMGFCEHVYYGKMDGEGDGGAGTAGDEHHHHHHHHTKRRAHRQRRDHHHHHHGEHGLEDYFKTHLAWLTDEQKAEISGMKESGKSRQEIKQKVIELYDATTGEAREKATRLAEGRVPES

SEQ ID NO: 158722 - protein, 334 aa, Heterodera glycines
  misc_feature (217)..(217): Xaa can be any naturally occurring amino acid
  misc_feature (241)..(241): Xaa can be any naturally occurring amino acid
  misc_feature (257)..(257): Xaa can be any naturally occurring amino acid
  misc_feature (261)..(261): Xaa can be any naturally occurring amino acid
  misc_feature (276)..(276): Xaa can be any naturally occurring amino acid
  misc_feature (282)..(282): Xaa can be any naturally occurring amino acid
  misc_feature (285)..(285): Xaa can be any naturally occurring amino acid
  misc_feature (290)..(290): Xaa can be any naturally occurring amino acid
  misc_feature (322)..(322): Xaa can be any naturally occurring amino acid
  Homolog annotation: Hit_ID=AAL78216.1; Match level="QueryCoverage =100%, HitCoverage=100%, E-value=0.0, Identity=100%"; Hit description= aspartic protease precursor Hgg-33 [Heterodera glycines]
  Gene Ontology: Mol. function=aspartic-type endopeptidase activity; Cellular component=lysosome; Biological process=induction of non -apoptotic programmed cell death
  Coding regions on vcDNA: vcDNA=SeqID_85145; Strand=+; Position=1-1002
MKGFVSKDIVCIANICVQKQEFTEATSEPGLTFVAAKFDGILGMGFSEISVQKLPTVFDNMVTQQKVPEPVFAFWLNRDPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGKAYTVEGRGLCAENDQHGQKHMPFRFYGHXFAGTCRRTLDSWRCVYWSLLHGVXCGPKSCWFCAGQRRKXNSNXASSARLRKGRRTLLXSFQRSXRFXSADGXGRFCNDGLKKIDFIYAIFSFIQFLIHDEAYEXTIFPSLIIVITM

SEQ ID NO: 158723 - protein, 280 aa, Heterodera glycines
  misc_feature (136)..(136): Xaa can be any naturally occurring amino acid
  Homolog annotation: Hit_ID=AAL78217.1; Match level="QueryCoverage =100%, HitCoverage=100%, E-value=1e-158, Identity=100%"; Hit description=probable protein kinase C subtrate Hgg-23 [Heterodera glycines]
  Coding regions on vcDNA: vcDNA=SeqID_85146; Strand=+; Position=1-840
MFDKMEKDGDGKISSDVLKRFATAGSAAGAAGERGDELLKDIFKKKSDGETTETGDAKQQQIEESLDFAAFLDKFEMVKEFVDEIASAAEKQDAEIPAGTEEGDKTDDQSGEEGQKETEKYEQKTRELIERADQAXKEYDEVADKVSDLERLIRESSSYLDVEFGPDSAWAPLKGQCAELTTTQYVSNCACSTERCKRTETDTRRSAWAIGASGPGRKTATNSRLNAMNMAKRVGMDRRGPLWCSSSAVNSSNLWKPANRPSANITFWQNLRPLVLTRRS

SEQ ID NO: 158724 - protein, 227 aa, Heterodera glycines
  Homolog annotation: Hit_ID=AAL78219.1; Match level="QueryCoverage =100%, HitCoverage=100%, E-value=1e-129, Identity=100%"; Hit description=dorsal gland cell protein Hgg-26 [Heterodera glycines]
  Coding regions on vcDNA: vcDNA=SeqID_85147; Strand=+; Position=1-681
MLKEVEEWYAHHKNDEHKKAPVFVFKCKDNVSLVINVHLDAVRLSKELSNMLEDTADEGYPKPIPSPVQNFKSDIMLKLIKLCEEYKYKFDGLKKTTDVPTGEVAEASASNVQEGDVGEASASKVKAGTIAEEIQKFVPPPHIMQWDVKTDLEMVRAADFYNINRLINDDYIDNVYEIVKVKWINGKTAAGNFARDSASKSPYPPGTSEMGTSLRRSTSWDESVQGT

SEQ ID NO: 158725 - protein, 120 aa, Heterodera glycines
  misc_feature (59)..(59): Xaa can be any naturally occurring amino acid
  misc_feature (96)..(96): Xaa can be any naturally occurring amino acid
  misc_feature (106)..(106): Xaa can be any naturally occurring amino acid
  misc_feature (112)..(112): Xaa can be any naturally occurring amino acid
  misc_feature (119)..(119): Xaa can be any naturally occurring amino acid
  Homolog annotation: Hit_ID=AAL78226.1; Match level="QueryCoverage =100%, HitCoverage=100%, E-value=3e-56, Identity=99%"; Hit description=hypothetical protein Hgg-17 [Heterodera glycines]
  Coding regions on vcDNA: vcDNA=SeqID_85148; Strand=+; Position=1-360
MESDMASSSLETSMTNSANIARQALEELPVKQVRQMEQIAEEGKSKTVEEQERALREYXEKNSESVKKAVDQVFVAKDRADIALETYLRSHAVTFXQEARKANDQXLFLDEXQESFNFXG

SEQ ID NO: 158726 - protein, 253 aa, Heterodera glycines
  misc_feature (154)..(154): Xaa can be any naturally occurring amino acid
  misc_feature (181)..(181): Xaa can be any naturally occurring amino acid
  Homolog annotation: Hit_ID=AAL78227.1; Match level="QueryCoverage =100%, HitCoverage=100%, E-value=1e-145, Identity=100%"; Hit description=hypothetical protein Hgg-18 [Heterodera glycines]
  Coding regions on vcDNA: vcDNA=SeqID_85149; Strand=+; Position=1-759
MVAGGTQKRRKPRTEKGKKGPKEEARKGKKPRKEGGKPEQAQETSKPQKGGPEKGRGQKGRKQSPAPRPSLTESCRQCEQNGSMTQGLNRQKHRKNAAQATAKKTPERAGKSIERSGRKRRKRTAEDGCHQNFGGKSEKRRGIGKRSENENGNXFRGQQKGQRRVDFDNRRQKDAFGRKGXADGGADSQNVGQHEQGAESEQQCRRRRLRQVVLRRRRAGGGHGGQSMINQSDRRIRHCCVMKCSQQRNSLIK

SEQ ID NO: 158727 - protein, 234 aa, Heterodera glycines
  misc_feature (204)..(204): Xaa can be any naturally occurring amino acid
  Homolog annotation: Hit_ID=AAL78228.1; Match level="QueryCoverage =100%, HitCoverage=100%, E-value=1e-130, Identity=100%"; Hit description=SCN esophageal secretory protein [Heterodera glycines]
  Coding regions on vcDNA: vcDNA=SeqID_85150; Strand=+; Position=1-702
MNILLKSVLFISLLSLFGDCMKNSDQIGVKRKSAGIRIEEPNDVKGKGKVVETSRKGKEKVGEKISVMNTAERIEKMDLAQDKAKMEIDNIDTNAKPKQNEDKGVMNTAERIEKMDLAQDKAKMDIDTNGKPKQNEENAPPKYVFIWSGNNEKKNLEVDLRVIRHSKKLSELFHAKSDQSVNAKHGKQEALPGSETGSRKNARXEVEEWYAHHKNDEHKKAPVFVFKCKDNVSL

SEQ ID NO: 158728 - protein, 184 aa, Heterodera glycines
  misc_feature (59)..(59): Xaa can be any naturally occurring amino acid
  Homolog annotation: Hit_ID=AAL78229.1; Match level="QueryCoverage =100%, HitCoverage=100%, E-value=1e-102, Identity=100%"; Hit description=SCN esophageal gland cell protein [Heterodera glycines]
  Coding regions on vcDNA: vcDNA=SeqID_85151; Strand=+; Position=1-552
MNPNGFFFVLAVLFLVKVDFLQCKYNEPMARQVLQKHASQFQQHCKNARRGSAVAKCCXAIRSIMGRFTSQKKAMNQMLAKCKAGTTPSEAQQMRRKLEGSNKLKDCGQFKSQIQHKFSELKQYCNNGAENEEENDERSEREREEERVLEREEQQNSNHQRSLIIADRLTGLADQVFLWHKELR

SEQ ID NO: 158729 - protein, 89 aa, Heterodera glycines
  Homolog annotation: Hit_ID=AAL78230.1; Match level="QueryCoverage =100%, HitCoverage=100%, E-value=1e-46, Identity=100%"; Hit description=putative transitional endoplasmic reticulum ATPase [Heterodera glycines]
  Coding regions on vcDNA: vcDNA=SeqID_85152; Strand=+; Position=1-270
MFAQTLQQQRGFGTSFKFPGEGKKSSSGRGGNEAGNDDDDLYSQSVNIDYSEVISSDDEQNMSLFNCIGCIFAPCRLLCVLFFIYGKVE

SEQ ID NO: 158730 - protein, 262 aa, Heterodera glycines
  Homolog annotation: Hit_ID=AAK08974.1; Match level="QueryCoverage =100%, HitCoverage=100%, E-value=1e-151, Identity=100%"; Hit description=pectinase precursor [Heterodera glycines]
  Coding regions on vcDNA: vcDNA=SeqID_85153; Strand=+; Position=1-789
MLFILLVITFVQIGQLNAGICTFPNPSKSVTVQSMMTVSSSTDYKNTLFVGGSGILNGACDVNNDKLKYLMTLKNGVTIKNAILDTPGLGIYCEGNCVLENIYYKRLCYHATGFGYKSTSTSYTYQVIGGAGQGSPDKYFTQSGKGTTIIKNFCAEGKYGKLWCSCGNCPFQTARTVQISNTVLKGPGLSVVSLNSNYGDKMSLSGLTLHGQKSASTKTSYICQEYKGLTYMAAMSPQANYEPTKSGSGTCAYSASAVKIAS

SEQ ID NO: 158731 - protein, 641 aa, Heterodera glycines
  Homolog annotation: Hit_ID=AAM18623.1; Match level="QueryCoverage =100%, HitCoverage=100%, E-value=0.0, Identity=100%"; Hit description= C-type lectin domain protein [Heterodera glycines]
  Coding regions on vcDNA: vcDNA=SeqID_85154; Strand=+; Position=24-1949
MFHLAAIVALAALALPLASSDKFRPCLEGYAQYGKYCYKAFTNPDKSLPWSDANKMCKTEGAELASVHSETEREFVNMLVLREANKMEFNCKQPGRAFFWFGLKLKWSEKKLEDASWTDGKPVDYLSPTEWGAYKRPLTMDNAGGAGYNKENENCVFLGQWPRKVKEYLSLETALDKSGVDVLWMDVVCEKPEEYWAPHGAVCKMRAKEEEKGYGKDKYGAKEEEEEEDEELRKINKYVTIGSGNFIYANKNTYMILLLKDLYGKQLKEESRKKVCELYNGEYVKVKDEPKEAQEYLDKVLAKEKELYSDASDHMFCRFTGIIGACGESCYKVPLPICAEGYAYFSGYCYKAFTNADKEVKYSEAQKICKSDGAELVSMHSELEREFVNVVALTAAKKYEYNAKVPGLAFYWTSMQLEWDEKKLKNASWADMTPMDYLSPMEWGTKKRPVYVDNSNGGEYNKENENCVFIGQWPREGKQYLKLDSAVDKYGLDVLWRDEVCEKPGEDCPRGAVCKKRATVGECYGTGAYLLDAAEEEEMKKLLKFITVGSGTFVYAEKNTYMVLLLKDLYGKQMKEEDRKKVCAYYKAEYVTVKAEPNKVQEYVDKVLSKQKQMYADASDHMLCKFSGTLGGCGDYCKTGY

SEQ ID NO: 158732 - protein, 272 aa, Heterodera glycines
  Homolog annotation: Hit_ID=AAM74953.1; Match level="QueryCoverage =100%, HitCoverage=100%, E-value=1e-152, Identity=100%"; Hit description=chorismate mutase [Heterodera glycines]
  Coding regions on vcDNA: vcDNA=SeqID_85155; Strand=+; Position=1-819
MNSSVVSFSLLLFGLFTIRTAKSQCEKHCTKSKPMGQCNEAEEVILRNSDCAFMKKTETAFEFVVGMNGQTEDKTAPGANANGAFLCCKATQGTATLFIVGVANKRLMLAKDVVNYKFHQNISIDDFEREKQVLESVSAQGQKAGIGDNYGEKFFQDQMDANKMIQKGSVKLWTANKSLPPQNVPDLQKDTRPKVTAATEEMILALKVFQQFRKNKNCWASVEKELLKSQSFLSLAEPNGKDAMRKAAVRLCAKMEAKIEAQIDETAKKLLA

SEQ ID NO: 158733 - protein, 263 aa, Heterodera glycines
  Homolog annotation: Hit_ID=AAM74954.1; Match level="QueryCoverage =100%, HitCoverage=100%, E-value=1e-152, Identity=100%"; Hit description=pectate lyase 2 [Heterodera glycines]
  Coding regions on vcDNA: vcDNA=SeqID_85156; Strand=+; Position=1-792
MILFILLVITFVQIGQLSAGICKFPNPSKSVTVQSMMTVSSNTDYKNTLFVGGSGILNGACDVNNGKLKYLMTLKNGVTIKNAILDTPGLGIYCEGNCVLENIYYKRLCYHATGFGYKSTSTSYTYQVIGGAGQGSPDKYFTQSGKGTTIIKNFCAEGKYGKLWCSCGNCAFQTARTVQISNTVLKGPGLSVVSLNSNYGDKMSLSGLTLHGQKSSSTKTNYICQEYKGLTHMAAMSPQANYEPTKSGSGTCAYSASAVKIAS

SEQ ID NO: 158734 - protein, 136 aa, Heterodera glycines
  misc_feature (72)..(72): Xaa can be any naturally occurring amino acid
  misc_feature (92)..(92): Xaa can be any naturally occurring amino acid
  Homolog annotation: Hit_ID=EAA16552.1; Match level="QueryCoverage =69%, HitCoverage=87%, E-value=8e-16, Identity=55%"; Hit description =hypothetical protein [Plasmodium yoelii yoelii]
  Coding regions on vcDNA: vcDNA=SeqID_85157; Strand=-; Position=306-751
FVQSKLASPPTPTGKGQRRGTGRKANQTSNTQSVHRTASTDPTTSFLTAAIILCILRAGITAAAGTRLALSXYSLKGLNCTHSDDRPHKRSXLVISRHYLLALRVVAISQAPSPESNPYPPLPVITMVVRYTTIES

SEQ ID NO: 158735 - protein, 209 aa, Heterodera glycines
  Homolog annotation: Hit_ID=AAK94486.1; Match level="QueryCoverage =100%, HitCoverage=99%, E-value=1e-116, Identity=100%"; Hit description=putative gluthathione reductase [Heterodera glycines]
  Gene Ontology: Mol. function=thioredoxin reductase (NADPH) activity; Cellular component=mitochondrion; Biological process=response to oxidative stress
  Coding regions on vcDNA: vcDNA=SeqID_85158; Strand=+; Position=31-657
MKKFDYLVIGGGSGGIASARRAAEFKVKVGLIESERLGGTCVNLGCVPKKVMYNTAIHAEFLRDHADYGFDSMNVKFNWSKIKNSRDEYIRRLNSMYQTNLENSKVEIVRGRAKFNKDGSVEVSRSDGSKETCQGTHTLIAVGGAPRIPKDVPGARYGTSSDGFFGFEQMPNKTVVVGAGHIAVELASILADLGSETHLLIRYDRVLRS

SEQ ID NO: 158736 - protein, 350 aa, Heterodera glycines
  Homolog annotation: Hit_ID=AAK94487.1; Match level="QueryCoverage =100%, HitCoverage=100%, E-value=0.0, Identity=100%"; Hit description= putative ABC transporter protein [Heterodera glycines]
  Gene Ontology: Mol. function=TAP2 binding; Cellular component =mitochondrion; Biological process=positive regulation of growth rate
  Coding regions on vcDNA: vcDNA=SeqID_85159; Strand=+; Position=3-1052
FENGKRNQFGCVLWTFLFVLADLAASFGSICFHGSSPSVGHFSDQFRAPYLFNRSVFDFFVISVLRSFFISLGCAICIFKNAQAPRTLAQLSQASFGLCILLCSFSPTKFLALSDNSGPDHPGTLFPGDIPLILANFIFSITAHRLWLFFLHTAQKNEYERMEEEEEEEEEEEGNERIETRNGAVKGNVRTFVIILRLLQYCRNEWFWHLSGFTWLFIYSLTRIFIPYFTGQVIASVVSSSGEEYASLISSVKLMLFISVISAMAGGLRGGSFEYAYSRINRAIRYNLFASLVRQEVAFFDNHKTGEITSRLTADTTTMSDTIALNVNIFLRNTVQMGGSMLFMMTLCWR

SEQ ID NO: 158737 - protein, 313 aa, Heterodera glycines
  Homolog annotation: Hit_ID=AAK94488.1; Match level="QueryCoverage =100%, HitCoverage=100%, E-value=0.0, Identity=100%"; Hit description= putative C-type lectin [Heterodera glycines]
  Coding regions on vcDNA: vcDNA=SeqID_85160; Strand=+; Position=37-975
MFHLAAIVALAALALPLASSDKFRPCLEGYAQYGKYCYKAFTNPDKSLPWSDANKMCKTEGAELASVHSETEREFVNMLVLREANKMEFNCKQPGRAFFWFGLKLKWSEKKLEDASWTDGKPVDYLSPTEWGAYKRPLTMDNAGGAGYNKENENCVFLGQWPRKVKEYLSLETALDKSGVDVLWMDVVCEKPEEYWAPHGAVCKMRAKEEEKGYGKDKYGAKEEEEEEDEELRKINKYVTIGSGNFIYANKNTYMILLLKDLYGKQLKEESRKKVCELYNGEYVKVKDEPKEAQEYQDKVLAKEKELYSDSSD

SEQ ID NO: 158738 - protein, 211 aa, Heterodera glycines
  misc_feature (177)..(177): Xaa can be any naturally occurring amino acid
  Homolog annotation: Hit_ID=AAK94489.1; Match level="QueryCoverage =100%, HitCoverage=100%, E-value=1e-116, Identity=100%"; Hit description=putative S-adenosylmethionine synthetase [Heterodera glycines]
  Gene Ontology: Mol. function=methionine adenosyltransferase activity; Cellular component=cytoplasm; Biological process=amino acid metabolism
  Coding regions on vcDNA: vcDNA=SeqID_85161; Strand=+; Position=18-650
MDAVKAPTLASIHHKNRLQSPLNAHGHPLIIENGTVAETLVDKEEEELTEQVGTFLFTSESVGEGHPDKMCDQISDAILDAHLALDPAAKVACEVVTKTGMVLVCGETTSSATVDYQSVVRETIKKIGYDDSSKGFNYKTCNVLVALEKQSPEIAAGVHEDKEPEDVGARDQGIMFXYPSDESPEAMPLTLVLSHKLNAKYHQLRRSAVLP

SEQ ID NO: 158739 - protein, 85 aa, Heterodera glycines
  misc_feature (3)..(3): Xaa can be any naturally occurring amino acid
  misc_feature (13)..(14): Xaa can be any naturally occurring amino acid
  misc_feature (16)..(16): Xaa can be any naturally occurring amino acid
  misc_feature (42)..(42): Xaa can be any naturally occurring amino acid
  misc_feature (62)..(62): Xaa can be any naturally occurring amino acid
  misc_feature (75)..(75): Xaa can be any naturally occurring amino acid
  Homolog annotation: Hit_ID=AAK94491.1; Match level="QueryCoverage =100%, HitCoverage=100%, E-value=1e-38, Identity=97%"; Hit description=hypothetical esophageal gland protein scn1120 [Heterodera glycines]
  Coding regions on vcDNA: vcDNA=SeqID_85162; Strand=+; Position=1-255
MQXSPMLTLLFHXXIXGIISLLSAIDSYFISHAFFTTLMRGXGAQIVFGFEYAVLLTTVAHXTINYILHLHDLRXPHPWENKAAY

SEQ ID NO: 158740 - protein, 61 aa, Heterodera glycines
  misc_feature (51)..(52): Xaa can be any naturally occurring amino acid
  misc_feature (60)..(60): Xaa can be any naturally occurring amino acid
  Homolog annotation: Hit_ID=AAK94494.1; Match level="QueryCoverage =100%, HitCoverage=100%, E-value=6e-29, Identity=98%"; Hit description=putative serine kinase-like protein [Heterodera glycines]
  Coding regions on vcDNA: vcDNA=SeqID_85163; Strand=+; Position=3-185
NDENPNPEMDDEMMEEEAAHHEDDQLVLGSDEDEQEDPKDYRKGGYHPVQXXDVLKNGRXH

SEQ ID NO: 158741 - protein, 34 aa, Heterodera glycines
  Coding regions on vcDNA: vcDNA=SeqID_85164; Strand=-; Position=1-102
RTLICIASDQKSININDVRQNSFINLKVFKRVLS

SEQ ID NO: 158742 - protein, 476 aa, Heterodera glycines
  Homolog annotation: Hit_ID=AAC48327.1; Match level="QueryCoverage =100%, HitCoverage=100%, E-value=0.0, Identity=100%"; Hit description= beta-1,4-endoglucanase-1 precursor [Heterodera glycines] gb|AAC15707.1| beta-1,4-endoglucanase-1 precurso
  Gene Ontology: Mol. function=glucosidase activity; Cellular component= cell wall (sensu Fungi); Biological process=cell wall organization and biogenesis
  Coding regions on vcDNA: vcDNA=SeqID_85165; Strand=+; Position=21-1451
MCRLQATHLLARLFLLLALCTALVSSLTAVAPPFGQLSVSGTNLVGANGQPVQLIGNSLFWHQWYPQFWNADTVKALKCNWNANVIRGAMGVDEGGYLSDANTAYNLMVAVIEAAISNGIYVIVDWHAHNSHPDEAVKFFTRIAQAYGSYPHILYEDFNEPLSVSWTDVLVPYHKKVIAAIRAIDKKNVIILGTPTWSQDVDVASQNPIKDYQNLMYTLHFYASSHFTNDLGAKLKTAVNNGLPVFVTEYGTCEASGNGNLNTDSMSSWWTLLDSLKISYANWAISDKSEACSALSPGTTAANVGVSSRWTSSGNMVASYYKKKSTGVSCSGSSSGSSSGSSSGSSGSSSGSSSGSSSGSSSGSSSGSSGSSSGSSSGSGSASISVVPSNTWNGGGQVNFEIKNIGSVPLCGVVFSVSLPSGTTLGGSWNMESAGSGQYSLPSWVRIEAGKSSKDAGLTFNGKDKPTAKIVTTKKC

SEQ ID NO: 158743 - protein, 319 aa, Heterodera glycines
  Homolog annotation: Hit_ID=AAC48326.1; Match level="QueryCoverage =100%, HitCoverage=100%, E-value=0.0, Identity=100%"; Hit description= beta-1,4-endoglucanase-2 precursor [Heterodera glycines]
  Coding regions on vcDNA: vcDNA=SeqID_85166; Strand=+; Position=64-1023
MFVQLVLLAIVGITFVDAAAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPIKGFSNLMYTLHFYASSHFVDGLGNKLKTAVNKGLPVFVTEYGTCEASSNGNLNSGSMSSWWSLLDQLKISYVNWSITDKSEACAALTGGTSAANVGTSSRWTQSGNMVASQHKKKSTGVKC

SEQ ID NO: 158744 - protein, 350 aa, Heterodera glycines
  Homolog annotation: Hit_ID=AAN14978.1; Match level="QueryCoverage =100%, HitCoverage=100%, E-value=0.0, Identity=100%"; Hit description= chitinase [Heterodera glycines]
  Gene Ontology: Mol. function=extracellular matrix structural constituent; Cellular component=extracellular matrix; Biological process=response to bacteria
  Coding regions on vcDNA: vcDNA=SeqID_85167; Strand=+; Position=1-1053
MNRFFTLLFFVLFFNAAINFVSSHRIVGYYQGIRPLTNDQAKKLTHLILAFSTPDSQGNLSPLSSVLKQALKAGKSANGALKVMIAIGGGGFDPAIFTSLASNSGTRKSFINNIVSYLKTNELDGCDIDWEFPTSSDKAIFVTFLRDLKKAMAPSGAVLSMASAASAFYLDPGYDLPGIESAVDFINVMCYDYYGSWTKTSTGPNSPLFKGGSADPSDTLNSNWTMNYHLMKVYNRAKLNMGVPFYGKSWTNVGAPLNGDGLWRQLGTYGTELAWRNMGKSFDMTKTTYHKTAKTAYIYDTATKNFLTFDNPQSLKDKAKYVAEKGIGGIMIWSIDQDDDKLSLLNSVSY

SEQ ID NO: 158745 - protein, 350 aa, Heterodera glycines
  Homolog annotation: Hit_ID=AAN14979.1; Match level="QueryCoverage =100%, HitCoverage=100%, E-value=0.0, Identity=100%"; Hit description= chitinase [Heterodera glycines]
  Gene Ontology: Mol. function=extracellular matrix structural constituent; Cellular component=extracellular matrix; Biological process=response to bacteria
  Coding regions on vcDNA: vcDNA=SeqID_85168; Strand=+; Position=1-1714
MNRFFTLLFFVLFFNAAINFVSSHRIVGYYQGIRPLTNDQAKKLTHLILAFSTPDSQGNLSPLSSVLKQALKAGKSANGALKVMIAIGGGGFDPAIFTSLASNSGTRKSFINNIVSYLKTNELDGCDIDWEFPTSSDKAIFVTFLRDLKKAMAPSGAVLSMASAASAFYLDPGYDLPGIESAVDFINVMCYDYYGSWTKTSTGPNSPLFKGGSADPSDTLNSNWTMNYHLMKVYNRAKLNMGVPFYGKSWTNVGAPLSGDGLWRQLGTYGTELAWRNMGKSFDMTKTTYHKTAKTAYIYDTATKNFLTFDNPQSLKDKAKYVAEKGIGGIMIWSIDQDDDKLSLLNSVSY

SEQ ID NO: 158746 - protein, 335 aa, Heterodera glycines
  Homolog annotation: Hit_ID=AAN32884.1; Match level="QueryCoverage =100%, HitCoverage=100%, E-value=0.0, Identity=100%"; Hit description= cellulase ENG-5 [Heterodera glycines] gb|AAP97436.1| cellulase ENG-5 [Heterodera glycines]
  Coding regions on vcDNA: vcDNA=SeqID_85169; Strand=+; Position=1-1008
MSAWICPGFLLFFVLILITDHCPMTQAVTQPPYGQLAVSGKNLVQKSTKKAVALHGLSMYWSQWVPKFWVKQTVNKLKCSCNANVVRAAMASSFGGYISNPTAEYKKMTAIIDGAIDQGLYVVVDWHTGDDLATTEIKYATEFFTKIAKAYNKYPHILYEIWNEPNKFVAWEAVVKPYAKTMIDVIRKYDKNNVIIVGTPNWDQDVDIVAKSPLKDANIIYTMHFYAGQHKDDIRNKVKTAYKLGLPMFVTEYGCYSADGNEKTNLEELKKWMELLDGYGISYAAWHVADIGEQSSILTKTSEVNNICDPAHLTNYGKAIINKLKSQNNGVKCSG

SEQ ID NO: 158747 - protein, 600 aa, Heterodera glycines
  Homolog annotation: Hit_ID=AAN32885.1; Match level="QueryCoverage =100%, HitCoverage=100%, E-value=0.0, Identity=100%"; Hit description= glutamyl transpeptidedase [Heterodera glycines]
  Gene Ontology: Mol. function=gamma-glutamyl transferase activity; Cellular component=integral to plasma membrane; Biological process =spermatogenesis
  Coding regions on vcDNA: vcDNA=SeqID_85170; Strand=+; Position=1-1803
MSDANLVGTADHPLSSLHHRPSAYAWPPPSHSLMERFRQAAVTSDNGICSEIGRDVMMQKNGNAVDAAVAAMLCIGVTNAQSSGLGGGMVLTFYDAKTRSCKVIDARETAPARATAKAYSERVTANRTTARATGYHEIATPGELAGLWLAYKKFGSGRVPWSKLVMPAAKLALYGFPITEHMRRALVGTEKELINSPTMKQWIINPRTNQLYEFGDLVKRPKLANTLERLAAAEDPKKLFYEGEIGDEIVEEMQRNGAFLSRSDLKNYEPRLYEMPLYTDDPHGNLRMCGPPPPSSYAITQSIIATMRMEPMCGGDGSADDQSQANSLQNDPKFYHRLIEAQKFAYAQRANLGDQAFVPEAKKLAKHMTSNTFLHNVHKKMLDKAMPDEHYTLMIGPSRADKDHTGTSHTSILDADGNAVSVTSSINQWFGAVIQSENLGIIWNDEMEDFSFPDVKNWFGYAISPTNFVAPGKRPMSSFSPMVIYNKHTGKVKFVIGGSGGAKIPSSVAKTVLHVLCLNQTVKEAIDAPVLHNQFTPNHVIYENGTPPKLIKDLNENFGHIMKSYDNNNVVVQAIHVADDGFIYANGDFRRRTYMHPAGF

SEQ ID NO: 158748 - protein, 185 aa, Heterodera glycines
  Homolog annotation: Hit_ID=AAN32886.1; Match level="QueryCoverage =100%, HitCoverage=100%, E-value=1e-102, Identity=100%"; Hit description=gland-specific protein G2D01 [Heterodera glycines]
  Coding regions on vcDNA: vcDNA=SeqID_85171; Strand=+; Position=1-558
MSSSPSVSVLAIVAIVCLMCQCCFSAPHPCCPGSQKVVSLMSNYVGTFANSISKSSLCSDAQNVAEALKGQLIGCSNGGDRTLLADIEASLATHSADECALSLGFVRAMFAIAASASSHASNNSEWQTLSGQFGQKVTEIDSKCAEFGISIGKVPINGPKDVHVQNVPNSESVISMPGLAGSHTQ

SEQ ID NO: 158749 - protein, 132 aa, Heterodera glycines
  Homolog annotation: Hit_ID=AAR01198.1; Match level="QueryCoverage =100%, HitCoverage=100%, E-value=1e-74, Identity=100%"; Hit description=cellulase binding protein [Heterodera glycines] gb|AAN32887.1| cellulose binding protein [Heterodera gl
  Coding regions on vcDNA: vcDNA=SeqID_85172; Strand=+; Position=1-399
MNWMHYCLIACFAFYYFNTVESSTINSVTVQVNKIENNENGRQFNLEFTNQVYERVCHVDFRIDLPDTVKLNKYSKMVPIPDTCGQYALPKSLDLLPGESFDAQLTLLGHDGKPNVTVLNTNNIPTSKQCKK

SEQ ID NO: 158750 - protein, 341 aa, Heterodera glycines
  Homolog annotation: Hit_ID=AAN32888.1; Match level="QueryCoverage =100%, HitCoverage=100%, E-value=0.0, Identity=100%"; Hit description= annexin 4C10 [Heterodera glycines]
  Gene Ontology: Mol. function=phospholipase inhibitor activity; Cellular component=plasma membrane; Biological process=skeletal development
  Coding regions on vcDNA: vcDNA=SeqID_85173; Strand=+; Position=1-1026
MLQNGLTILLLISVVIGHSLANLGPTIKHNPHFKAVQTAHHLHDAIAKKHEAEVTQVICSISNEQRQALALEFKKQFGTDLIAMLKKEFKSDFEELIISLMQTPAVYDANQMRAALSGSNEAVLIEILATRTNRQITAPKQAYEQLDRRHQHNQLEEDIKAKTKRTLPKSVGVFAQLLSRRKSAPASIVLAHDEAMKLFREGEGRRGVNAVVFNQVLATRSFAQLRETFEFYRQAAHHEIEEGIKQEFSGHNEAGFLALIKYVRNASVFFADLLFNSMKGLGTRDSDLIRLVISRSEIDLADIKHAFHTLHKKSLEEAIKGDTSGAYRDALLALVKGNTEQ

SEQ ID NO: 158751 - protein, 166 aa, Heterodera glycines
  Homolog annotation: Hit_ID=AAN32890.1; Match level="QueryCoverage =100%, HitCoverage=100%, E-value=7e-88, Identity=100%"; Hit description=secretory protein 4D09 [Heterodera glycines]
  Coding regions on vcDNA: vcDNA=SeqID_85174; Strand=+; Position=1-501
MAKFVAIALLSLTIVSMALAKTGKSQTADEVEGFRNMNIGDNNKVDAGKEPAADKATKKGKAQKAGTKSAAATNEPAAAKGTKNGKAPKTKAKQEVATNEPAAANEWNDQLMGMSVEKFNEELAVLLPKANTFMENALSFINEQVEKNGIATGAAGDSCSTGIPAN

SEQ ID NO: 158752 - protein, 489 aa, Heterodera glycines
  Homolog annotation: Hit_ID=AAN32891.1; Match level="QueryCoverage =100%, HitCoverage=100%, E-value=0.0, Identity=100%"; Hit description= secretory protein 5D06 [Heterodera glycines]
  Coding regions on vcDNA: vcDNA=SeqID_85175; Strand=+; Position=1-1470
MKNSFLFLLQIFILTNILTEILCGDKSRPSTEINANLGTRKKPETITATKNANLGTGKMHETDGTSKMPKHGKPVSNRMAAKSTTIKNNNEAAGPSQQSKQPAANITPQQKGPMQNSKKQPPNELFGKKQRSTPEEIKAGKQPAMELMPCYRGIGKKTMPTIAQRNATMLKRGDSLTRSADFEDPILANVKQSQMLIRQKSKGTMDLEMDEFLKLHKQIQGPRQKLVRMEREKMIKEATEKAKVDRRNRMLEREKMWSMKKAGVAAHQPASPAIRGRTQQQQQQKLQPDKKPEKMLKQQNKTQNFSAPSTSKQIVNRRLLIGPNKPRTGNKIGTTKHGIHSAEIMTSSSESNVPKSENLGSSEMETAEEAAQTYLNNLRVDLNKIPSMKIPFLEPIIEKYVDEYKKSRQLFAECMQKILRKSKNPNQTVKIIEFKKTIEKEMNDLLKHTDLPPDQLIDLLNTREWLLSMKKDIEYMERILTGRENNDNI

SEQ ID NO: 158753 - protein, 213 aa, Heterodera glycines
  Homolog annotation: Hit_ID=AAN32892.1; Match level="QueryCoverage =100%, HitCoverage=100%, E-value=1e-122, Identity=100%"; Hit description=secretory protein 4D06 [Heterodera glycines]
  Coding regions on vcDNA: vcDNA=SeqID_85176; Strand=+; Position=1-642
MSSLLLSIFPIVFLVCCNAMPNFPCCPGSQQVVAVMSKYIDTFSSAADESTVCSTAKSTVDGIKNELSYRVGCPSGGEAQIVNEIDRQLKNIAKMEINYEDECPYNLGFARAMFDLAAAAAGHAGNGTEWQYMKVQFEQESQAIKAIGQEKNFEVTDVHFGVPSKGVSAHQNVPSPSHVIANPGQHSFGWPTERKKNRCHRTSIFEDQPIRRK

SEQ ID NO: 158754 - protein, 347 aa, Heterodera glycines
  Homolog annotation: Hit_ID=CAA74206.1; Match level="QueryCoverage =100%, HitCoverage=100%, E-value=0.0, Identity=100%"; Hit description= serine proteinase [Heterodera glycines]
  Gene Ontology: Biological process=antifungal polypeptide induction
  Coding regions on vcDNA: vcDNA=SeqID_85177; Strand=+; Position=4-1047
MLKLCLTIILVTIGYKSFSLSEHISEFSECGISDFEPEFPIAPKVEIGTNHIFKGKTIVDDKSLPWMARILSGVSCTATIIGPRHVLTAAHCVEGQALENFVVSYGSADASNQQHKSGVEAIKYHPKTQHYEIKDKFRKNTRAYLFLNDIVVIKIKNSIKFSQNARPICLHGFHLTNSTKSDGKSIKYDEYSKFINNTQCVVAGWGITKPTCSNDDDKPLSGQLIYGQMRMISKQKCRELSIEYEKVFTPSDGNPEVESMIEAFDAYSIKSNICVVPEQSIGEPGDSGGPLMSKVGKNNWGQLGVLTKGDCRPKNPTSTEGLFAQYAPIDCEWVAEATDGEVKCQTW

SEQ ID NO: 158755 - protein, 247 aa, Heterodera glycines
  Homolog annotation: Hit_ID=CAA74205.1; Match level="QueryCoverage =100%, HitCoverage=100%, E-value=1e-141, Identity=100%"; Hit description=serine proteinase [Heterodera glycines]
  Gene Ontology: Mol. function=chymotrypsin activity; Cellular component=extracellular space
  Coding regions on vcDNA: vcDNA=SeqID_85178; Strand=+; Position=29-772
MRVLLLLCLALPVFSENIDSHVVGGSNANIANYPHQLSLRVSGSHSCGASLVSTTKAVTAAHCGGSAISVYSILGGTTSRTDTTCSTCVTRNLSQFNRHASFVNNGNQGYPNDVATLHFSAVTTNSNLRTIAMAASSAGDYAGQSCVITGWGRTSATSSLPVTLQQGTMTVLTNSNCASRWSAAQINNGHICVSSSSVSACSGDSGGPLVCGSTLVGATSWGQAQCNPSYPSVYTRISYFRSWIDSH

SEQ ID NO: 158756 - protein, 272 aa, Heterodera glycines
  Homolog annotation: Hit_ID=CAA74204.1; Match level="QueryCoverage =100%, HitCoverage=100%, E-value=1e-159, Identity=100%"; Hit description=serine proteinase [Heterodera glycines]
  Gene Ontology: Mol. function=blood coagulation factor XI activity; Cellular component=membrane; Biological process=blood coagulation
  Coding regions on vcDNA: vcDNA=SeqID_85179; Strand=+; Position=33-851
MQSLSHILFTFFSILFAAHCQSDESKSAGAQMQTVDENKIRHGKPLTSIVKYPFMATVWQNDRKLCTASIVSPNYILSAGHCFVKMSEENYIILVGTVNAKLEKGNGQQFKVEKAHVYSETVFGQDIAIVKLKNSIDFSDNATQPITLSRRSNFTKTDLAFIAGWGRITDWSSPVTLQGANVLIWPKDEARCDGIMESEVCAFGEDGANVCFGDSGGPLLVKSYDGQRWEQIGVTSRGNFVCESNGFFSCVYIYCEWLAKITEGEVQCLNNE

SEQ ID NO: 158757 - protein, 466 aa, Heterodera glycines
  Homolog annotation: Hit_ID=CAA11148.1; Match level="QueryCoverage =100%, HitCoverage=100%, E-value=0.0, Identity=100%"; Hit description= Hgm1 protein [Heterodera glycines]
  Coding regions on vcDNA: vcDNA=SeqID_85180; Strand=+; Position=17-1417
MNLHTIFSVLLCALVLSCAVGKPPAKKGQQSKKADVIAKAAAGEPAEVKNDGKAKKSATVVPVAAGPVGASNDAKGTTAGGNKATGDTGTTKPSAGGSATTDDDDDDDESPSPSAAAGGATTTDGKAKPSGDGTATTLSGGGGKASSAAKVGSGGTTVPAKGEETTAVKVDENSKGTDETEKPEGSTDATITGDTFTKVNKIADEITECEFYFVHLENVKANEKEKLWTRTKQEAEIDTEEMAEDSVDYRIVTPAISKDQPDMGTLYEQDTDDLPSDPDDLRKEEYFAADTELVDAEFLKKNTSNLYDETDCHGIFGRNEIRHGKSWTIFQKGNSLMKHRFCLFSPDDQLQNTAKTASQVHARCCCYNKNVSDSLRDFDISKTADADAIRAKHIDNEYALFQKNQSSTMALRGSLVGEDGQAVYFSIWSKSAPGSYGLCTAEDGKNSRGKRQAEDDEAFYDNYDDE

SEQ ID NO: 158758 - protein, 272 aa, Heterodera glycines
  Homolog annotation: Hit_ID=AAO19576.1; Match level="QueryCoverage =100%, HitCoverage=100%, E-value=1e-152, Identity=100%"; Hit description=chorismate mutase [Heterodera glycines]
  Coding regions on vcDNA: vcDNA=SeqID_85181; Strand=+; Position=1-1194
MNSSVVSFSLLLFGLFTIRTAKSQCEKHCTKSKPMGQCNEAEEVILRNSDCAFMKKTETAFEFVVGMNGQTEDKTAPGANANGAFLCCKATQGTATLFIVGVANKRLMLAKDVVNYKFHNNISIDDFVREKQVLESVSAQGQKAGIGDNYGEKFFQDQMDANKMIQKGYVKLWTANKSLLPQNVPDLQKDTRPKVTAATEEMILALKVFQQFRINKNCWASVEKELLKSQSFLSLAEPNGKDAMRKAAVRLCAEMEAKIEAQIDETAKKLLA

SEQ ID NO: 158759 - protein, 92 aa, Heterodera glycines
  Homolog annotation: Hit_ID=AAO33473.1; Match level="QueryCoverage =100%, HitCoverage=100%, E-value=8e-53, Identity=100%"; Hit description=gland-specific protein g4e02 [Heterodera glycines]
  Coding regions on vcDNA: vcDNA=SeqID_85182; Strand=+; Position=1-279
MSLFRPQSLLLLAALCLSFALLFVTSSEEGGRVKRGGWPWDWAGKQLCKTSANCKCKDGKNWAKCVKSEGYAASNCCDKNYVWACCGKKPKH

SEQ ID NO: 158760 - protein, 138 aa, Heterodera glycines
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_85183; Strand=+; Position=1-417
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 158761 - protein, 136 aa, Heterodera glycines; identical to SEQ ID NO: 147069
  Homolog annotation: Hit_ID=AAO33475.1; Match level="QueryCoverage =100%, HitCoverage=100%, E-value=5e-76, Identity=100%"; Hit description=gland-specific protein g5d08 [Heterodera glycines]
  Coding regions on vcDNA: vcDNA=SeqID_85184; Strand=+; Position=1-411

SEQ ID NO: 158762 - protein, 214 aa, Heterodera glycines
  Homolog annotation: Hit_ID=AAO33476.1; Match level="QueryCoverage =100%, HitCoverage=100%, E-value=1e-117, Identity=100%"; Hit description=gland-specific protein g6e07 [Heterodera glycines]
  Coding regions on vcDNA: vcDNA=SeqID_85185; Strand=+; Position=1-645
MRTILFMAMVCLVMAVLMEMANSKVVKKDNKKAAVAASPAKGKASPKGGKSPAKGKAAKVSKKDNKLKAKKETKGIKVKNAKPTKKGKSAKGASKTAKKVQAAKKAPGKDKKSLVKPIVLKAPVPPHKMHPMIESEAVPPPAHARSLATVPYSTPGAADRNSLPSYTSTATNLDMADDNDDYQNYYYGTEDSSREFDASAEEEDELYERGESGQ

SEQ ID NO: 158763 - protein, 241 aa, Heterodera glycines
  misc_feature (114)..(114): Xaa can be any naturally occurring amino acid
  Homolog annotation: Hit_ID=AAO33477.1; Match level="QueryCoverage =100%, HitCoverage=100%, E-value=1e-131, Identity=100%"; Hit description=gland-specific protein g4g05 [Heterodera glycines]
  Coding regions on vcDNA: vcDNA=SeqID_85186; Strand=+; Position=1-726
MSNFIFVASLTAAFFSSGLALPAPYDAESVVSSELNVPLLSADANVEAAITNESDAAAEIQAPSIPVPIEHQTAADITHPTETGNESSIASSSSTPKSEQTPKKVMNMKSALEXRRQANVYEERLPLDKQPKTIAEAAAKAKQTPAKLPADYDVNRVAERAAARVYGWLPEDKQPKAIYDAAEKAKNTPKPPGDYDVERVAQKAARLVYGVLPIGMQPNFAGPSTDKSNVDDSEKPSAAAA

SEQ ID NO: 158764 - protein, 249 aa, Heterodera glycines
  Homolog annotation: Hit_ID=AAO63754.1; Match level="QueryCoverage =100%, HitCoverage=100%, E-value=1e-140, Identity=100%"; Hit description=chorismate mutase [Heterodera glycines]
  Coding regions on vcDNA: vcDNA=SeqID_85187; Strand=+; Position=1-750
QCEKHCTKSKPMGQCNEAEEVILRNSDCAFMKKTETAFEFVVGMNGQTEDKTAPGANANGAFLCCKATQGTATLFIVGVANKRLMLAKDVVNYKFHNNISIDDFVREKQVLESVSAQGQKAGIGDNYGEKFFQDQMDANKMIQKGYVKLWTANKSLLPQNVPDLQKDTRPKVTAATEEMILALKVFQQFRINKNCWASVEKELLKSQSFLSLAEPNGKDAMRKAAVRLCAEMEAKIEAQIDETAKKLLA

SEQ ID NO: 158765 - protein, 537 aa, Heterodera glycines
  misc_feature (386)..(386): Xaa can be any naturally occurring amino acid
  Homolog annotation: Hit_ID=AAO85452.1; Match level="QueryCoverage =100%, HitCoverage=100%, E-value=0.0, Identity=100%"; Hit description= putative gland protein G12H04 [Heterodera glycines]
  Gene Ontology: Mol. function=structural constituent of cytoskeleton; Cellular component=neurofilament
  Coding regions on vcDNA: vcDNA=SeqID_85188; Strand=+; Position=1-1614
MALSALLLLLPLLLNVQNIPDESVQSDMKAVYSAISSPEQWKNSQNSLASLESQLTEPQRALAKMHWELETIQKEKPEAPPQFDLGLFSEALEVMVEMDEEAKEVKLRKDKLIRMGRRRGSKKKLKEKMTEEDTVPEVRVNENGKVEVKDGAGGEGRLEVRRTKDEKGREQVVITLMKNGGTEGPAEGTAEKPQEKAKTEEEVQKKNDDKSTRQEQEEAKKTEQENAGGVPKTDSANSHIPVMPMHTILSSPSPPVEEKGKASAEEAQKKEEDKNTRRGGEEANNTEQNKVGGVPKMSVDSPKSVVPMPMHTILSSPAPPVEEQDKARDALTEGANGRKKAQNNEEMLLVATENNGSMRNTNNGGIFDFVRKFISNVFGRKKRDTXSGAQRKYDGGTKENSQHSKFDYEHCREVRLRAEERRQTAAGREKEGGDQAVPGEGSGQHGWNQKGRETGICLVLGASVLDNQVDRGIRKSGGGSQTRIGTAILILQNGISCLPGAEGRGGQMRGEVGQTKGMDRRLFQVKMEETALRGVFF

SEQ ID NO: 158766 - protein, 142 aa, Heterodera glycines
  Homolog annotation: Hit_ID=AAO85453.1; Match level="QueryCoverage =100%, HitCoverage=100%, E-value=1e-77, Identity=100%"; Hit description=putative gland protein G16A01 [Heterodera glycines]
  Coding regions on vcDNA: vcDNA=SeqID_85189; Strand=+; Position=1-429
MATYLFIAAAAFGAGIYCWKAYLGPMLDQPKSDDEEKPKPEGGEEATTAGDKEEKKAGSKGDKHKKKDKKGEGAAAAPAADKKEEKRKDKHRSKEAGKSDDNKAGKKDKHGKKDKKKDTADASTVDEALGEQSTAEMSQAEE

SEQ ID NO: 158767 - protein, 185 aa, Heterodera glycines
  Homolog annotation: Hit_ID=AAO85454.1; Match level="QueryCoverage =100%, HitCoverage=100%, E-value=1e-103, Identity=100%"; Hit description=putative gland protein G16B09 [Heterodera glycines]
  Coding regions on vcDNA: vcDNA=SeqID_85190; Strand=+; Position=1-558
MASSFCSSLISIVAIVCLLCKCCFSAPHPCCPGSQHVVSMMKDHTGTFSASMPKSSLCLSAERVAAAVENQLKTIWCPGNGGQTLINEINAAQSSSDECARSLGFVRAMFEIAASAASHVGANAELANLAVQFREQVGTIDTNCAALGIHVGQISLGTPKGDHPQVHDSESVLSNPGTSGSHKRI

SEQ ID NO: 158768 - protein, 100 aa, Heterodera glycines
  Homolog annotation: Hit_ID=AAO85455.1; Match level="QueryCoverage =100%, HitCoverage=100%, E-value=7e-57, Identity=100%"; Hit description=putative gland protein G17G06 [Heterodera glycines]
  Coding regions on vcDNA: vcDNA=SeqID_85191; Strand=+; Position=1-303
MLSRCCWLRSCLPGLGKCSDQGVGSGRKCRSRPEILQTDRAKEGSVQKARHDGEQHPENPRPRRSNGGPFRDGMGQNNLPNDGTFGENPNFHQSPAIVPR

SEQ ID NO: 158769 - protein, 133 aa, Heterodera glycines
  Homolog annotation: Hit_ID=AAO85456.1; Match level="QueryCoverage =100%, HitCoverage=100%, E-value=3e-72, Identity=100%"; Hit description=putative gland protein G18H08 [Heterodera glycines]
  Coding regions on vcDNA: vcDNA=SeqID_85192; Strand=+; Position=1-402
MAFLLLSLAPLFVALSGIDANKVPLQLCCAGGQSLAGLIYDYSDHFSEVLQQSGTEMCTSLKKDMTKLTTAIEKAEGCKCNLVEKIEKELDDVEDDCAYNLSLHSRTVPHCGHGLGTFGRKLELRSGRVQRAN

SEQ ID NO: 158770 - protein, 222 aa, Heterodera glycines
  Homolog annotation: Hit_ID=AAO85457.1; Match level="QueryCoverage =100%, HitCoverage=100%, E-value=1e-127, Identity=100%"; Hit description=putative gland protein G19B10 [Heterodera glycines]
  Coding regions on vcDNA: vcDNA=SeqID_85193; Strand=+; Position=1-669
MHLKIFLLILFVTICSVWSLSPKIHHNYHQQQQQHNIKNKLPPKNIGTKHLKTEINGHNKHKHNPASRHGHALLQKVKDQLNNDGWASEDANKTSVLLSSLLAIECHMKKLDKKRTNDSAEIKHLTEQICAAENKEQIGIHKLINEVAKTFEKDGKKMVEQMKRDEHTVKVHLDGHYGTLAEILPSAKKHAKATRLRTYHAVLHLLHLITPKMEEGPAKEAM

SEQ ID NO: 158771 - protein, 111 aa, Heterodera glycines
  Homolog annotation: Hit_ID=AAO85458.1; Match level="QueryCoverage =100%, HitCoverage=100%, E-value=3e-58, Identity=100%"; Hit description=putative gland protein G19C07 [Heterodera glycines]
  Coding regions on vcDNA: vcDNA=SeqID_85194; Strand=+; Position=1-336
MLFGFFPFRAGCPGKNDIKAGSSSHVSSTIMIIEEKEDSESDEQMDGAGGDEEKRGGENGSEAQGGKGAARDNEMEDEELKVKAVVEETTTNEQGKTETNVEQSEKEGPMN

SEQ ID NO: 158772 - protein, 192 aa, Heterodera glycines
  Homolog annotation: Hit_ID=AAO85459.1; Match level="QueryCoverage =100%, HitCoverage=100%, E-value=1e-113, Identity=100%"; Hit description=putative gland protein G20E03 [Heterodera glycines]
  Coding regions on vcDNA: vcDNA=SeqID_85195; Strand=+; Position=1-579
MAFAISSLSALISLALLAAPQNSYQQKPNDEPKVFNDIQNGCDLINCTDGRTCGIRVGLAKFGNRNFEKFAFPKCITNETELNMNTDNDGNAHIVPNGPGCQMIQCSVGYQCQVRISISKLGNLPYAQSIGTFPQCVGPNVSFNSSSSTIENGPGCDQLPTKCDEGTKCVTAVGIAKYGNLPWSQFFWPFCT

SEQ ID NO: 158773 - protein, 126 aa, Heterodera glycines
  misc_feature (41)..(41): Xaa can be any naturally occurring amino acid
  Homolog annotation: Hit_ID=AAO92289.1; Match level="QueryCoverage =100%, HitCoverage=100%, E-value=1e-67, Identity=100%"; Hit description=FMRFamide-related peptide precursor [Heterodera glycines]
  Coding regions on vcDNA: vcDNA=SeqID_85196; Strand=+; Position=47-427
MEMRCVPSRRPFRLIAPLFNAIPTFYLILTLIFCILSPWAXSADADEWYGARQLRAPKPKFIRFGRSGQKMIPFSRSFSTETQYGDEGINQLDALVDAVDKLYQSSPEIRAFKTAPKRAQKFIRFG

SEQ ID NO: 158774 - protein, 104 aa, Heterodera glycines
  Homolog annotation: Hit_ID=AAO92290.1; Match level="QueryCoverage =100%, HitCoverage=100%, E-value=2e-52, Identity=100%"; Hit description=FMRFamide-related peptide precursor [Heterodera glycines]
  Coding regions on vcDNA: vcDNA=SeqID_85197; Strand=+; Position=78-392
MAQFPVANILLASLLLGFVILNSKTNAQFQYGGGMLAEGPQMEGLLEDYGRVGDYPFESLAKRAPLDRSAMARFGKRAPLDRSALARFGKRAPLDRSAIARFGK

SEQ ID NO: 158775 - protein, 81 aa, Heterodera glycines
  Coding regions on vcDNA: vcDNA=SeqID_85198; Strand=+; Position=207-452
SRAPPPPPWPTPLSFLQKVAIPLTSSSNLANPIVHSWPQGTKKGCCCASCTRVRHCSPNWAFWSTKALADWPSAKEWANLL

SEQ ID NO: 158776 - protein, 104 aa, Heterodera glycines
  Homolog annotation: Hit_ID=AAO92292.1; Match level="QueryCoverage =100%, HitCoverage=100%, E-value=1e-50, Identity=100%"; Hit description=FMRFamide-related peptide precursor [Heterodera glycines]
  Coding regions on vcDNA: vcDNA=SeqID_85199; Strand=+; Position=38-352
MALQISNTAFMLIVLATSLLLLMPSSSSAKVMPQLGFANAEQLMNDNSSPMGAGVEGEVMDKVEARLLGALELLQSYKEVPIVPKFTEKRKNKFEFIRFGKRRR

SEQ ID NO: 158777 - protein, 355 aa, Heterodera glycines
  Homolog annotation: Hit_ID=AAO92288.2; Match level="QueryCoverage =100%, HitCoverage=100%, E-value=0.0, Identity=100%"; Hit description= peptidylglycine alpha-hydroxylating monooxygenase [Heterodera glycines]
  Gene Ontology: Mol. function=peptidyl-glycine monooxygenase activity; Cellular component=integral to plasma membrane; Biological process =peptide metabolism
  Coding regions on vcDNA: vcDNA=SeqID_85200; Strand=+; Position=40-1107
MGHFFPGTVSFPIFLFMLGSARCWWHFGAKQPRVFASSHAQLTPPEGIESADLRMPGVSPQMNESYLCSAFPLDSERDHFIVGFEPVLSSRHIHHVIVYGCEMPGSEDKAWDCGEMASPRGSYSHSPVCASQPDIVYAWAHNAPELLLPDGVAFRVGGSSAVQFLVLQVHYMRAEEDDTSGIRIIHTDRPQPRQAATLLLATDGRIGPKRKEQLEVACVVDESVVLHPFAFRVHTHRHGRKVGGWAVREDPKSGTDKWTLLGQRDPQLPQMFQLVANQSVTITQGDVLAARCSMENEEKREIKIGPTGEDEMCNFYLMYWTKNGQTLEQNMCFSPGPPIYRWTKSAGLNHTPKRK

SEQ ID NO: 158778 - protein, 186 aa, Heterodera glycines
  Homolog annotation: Hit_ID=AAP30754.1; Match level="QueryCoverage =100%, HitCoverage=100%, E-value=1e-103, Identity=100%"; Hit description=putative gland protein G11A06 [Heterodera glycines]
  Coding regions on vcDNA: vcDNA=SeqID_85201; Strand=+; Position=1-561
MSSSPSVSVLAIVAIVCLMCQCCFSAPHPCCPGSQKVVSLMSNYVGTFANSISKSSLCSDAQNVADALKGQLIGCSNGGDRTLLADIEASLASHSADECAHSLGFVRAMFAIAASASSHASNNSEWQALSTQFVQKVTEIDSKCAEFGISIGKVPIDGPKGDHSQRNVPSTDSVISMPGLTGSHKH

SEQ ID NO: 158779 - protein, 228 aa, Heterodera glycines
  Homolog annotation: Hit_ID=AAP30755.1; Match level="QueryCoverage =100%, HitCoverage=100%, E-value=1e-129, Identity=100%"; Hit description=putative gland protein 29D09 [Heterodera glycines]
  Coding regions on vcDNA: vcDNA=SeqID_85202; Strand=+; Position=1-687
MSSLLLSIFPIVFLVCCNAMPNFPCCPGSQQVVAVMSIYIDTFSSAADESTVCFFAKSTVDGIKNELSSRGGCQNGGEAQIVDEIDRQLKNIAKMEINYEDECPYNLGFARAMFDLAAAAAGHAGNGTEWQYMKVQFEQESQAIKAIGQEKNFEVTDVHFGVPSKGVSAHQNVPSPSHVIANPGQHSSVGPRKERRTVVIGLRFLRTNKSGGNRIENHFVDMSNIYLK

SEQ ID NO: 158780 - protein, 92 aa, Heterodera glycines
  Homolog annotation: Hit_ID=AAP30756.1; Match level="QueryCoverage =100%, HitCoverage=100%, E-value=4e-52, Identity=100%"; Hit description=putative gland protein 10C02 [Heterodera glycines]
  Coding regions on vcDNA: vcDNA=SeqID_85203; Strand=+; Position=1-279
MSLLRPQSLLLVPALSLSFALLFVTSSEEGGRVKPGGCPWDWAGKQLCKTSANCKCKDGKSWAKCVKSEGYAASNCCDKNYVWACCGKKPKH

SEQ ID NO: 158781 - protein, 238 aa, Heterodera glycines
  misc_feature (136)..(136): Xaa can be any naturally occurring amino acid
  Homolog annotation: Hit_ID=AAP30757.1; Match level="QueryCoverage =100%, HitCoverage=100%, E-value=1e-131, Identity=99%"; Hit description=putative gland protein 30G12 [Heterodera glycines]
  Coding regions on vcDNA: vcDNA=SeqID_85204; Strand=+; Position=1-717
MSNFIFVSFLTAAFFSSGLALPAPYDAESVVSFVLNVPLLSADANVEASPPNESDAVFEIQAPSIPVPIEHQTAADITHPTETGNESSIASSSSTPKSEQTPKKVMNMKSALEGAAANVYGGLPLDKQPKTIAEAXAKAKQTPAKLPADYDVNRVAERAAARVYGWLPEDKQPKAIYDAAENAKNTPKPPGDYDVERVAQKAARLVYGVLPIGMQPNFAGPSTDKSNVDDSEKPSAAA

SEQ ID NO: 158782 - protein, 175 aa, Heterodera glycines
  Homolog annotation: Hit_ID=AAP30758.1; Match level="QueryCoverage =100%, HitCoverage=100%, E-value=4e-93, Identity=100%"; Hit description=putative gland protein 25A01 [Heterodera glycines]
  Coding regions on vcDNA: vcDNA=SeqID_85205; Strand=+; Position=1-528
MSNFIFVAFLTAAFFSSSLALPAPYDAESVVSSELNVPLLSADANVQAAENVEIQIPSIPAPIEQQTAAHITHPTETGNEPSIASSSSAPKSEQTPKKVMNMKSAMEGAAANVYGGLPLDQQPKTIAEAAAKAKQTPAKLPADYDANRVAERAAARVYGWLPEDKQPKAIYDAAE

SEQ ID NO: 158783 - protein, 222 aa, Heterodera glycines
  misc_feature (202)..(202): Xaa can be any naturally occurring amino acid
  Homolog annotation: Hit_ID=AAP30759.1; Match level="QueryCoverage =100%, HitCoverage=100%, E-value=1e-125, Identity=100%"; Hit description=putative gland protein G13A06 [Heterodera glycines]
  Coding regions on vcDNA: vcDNA=SeqID_85206; Strand=+; Position=1-669
MAMVCLVMAVLMEMANSKAVKKDNKKGAVAASPAKGKASPKGGKSPAKGKAAKVSKKDNKLKAKKETKGIKVKNAKPTKKGKSAKGAPKTAKKVQAAKKAPGKDKKSLVKPIVLKAPVPPHKMHPMIESEAVPPPAHARSLATVPYSTPGAADRNSLPSYTSAGTNLDMADDNDDYQNYYYGTEDGSREFDASAEEEDELYXEGGRGNEWADGRLRYWQWTG

SEQ ID NO: 158784 - protein, 278 aa, Heterodera glycines
  Homolog annotation: Hit_ID=AAP30760.1; Match level="QueryCoverage =100%, HitCoverage=100%, E-value=1e-158, Identity=100%"; Hit description=putative gland protein G10A07 [Heterodera glycines]
  Coding regions on vcDNA: vcDNA=SeqID_85207; Strand=+; Position=1-837
MRTILFIAMVCLVMAVLMEMANSKAVKKDNKKGAVAASPAKGKASPKGGKSPAKGKAAKKLKPKKDAKGIKAKKAKPAKKGKAAKAVKGAPKTVKKLAIAKTAQAKDKKSPAKPMVLKAVPPHQMHLMNEKVQTAVSPPAHARSLATVPYSTPVAADRNSLPSYTSDGTNLDMAHENDDYQNYYYGSGDSSKEFDASAEEEDGLYEEGDGAMNWANGRLPDWALNRNTGINRGEWPPKSGMLQLKNTKNFGKNLFSKILKHLDFNIPVKKLNFFLPSL

SEQ ID NO: 158785 - protein, 271 aa, Heterodera glycines
  Homolog annotation: Hit_ID=AAP30761.1; Match level="QueryCoverage =100%, HitCoverage=100%, E-value=1e-154, Identity=100%"; Hit description=putative gland protein G20G04 [Heterodera glycines]
  Coding regions on vcDNA: vcDNA=SeqID_85208; Strand=+; Position=1-816
MVCLVMAVLMEMANSKAVKKYNKKGAVAASPAKGKASPKGGKSPAKGKAAKKLKPKKDAKGIKAKKAKPAKKSKAAKAVKGAPKTVKKLAFAKTAAQVKEIKSPAKPMVLKAVPPHQMHLMNEKVQTAVSPPAHARSLATVPYSTPVAADRNSLPSYTSDGTNLDMAHENDDYQNYYYGSGDSSKEFDASAEEEDGLYEEGDGAMNWANGRLPDWALNRNTGINRGEWPPKSGMLQLKNTKNFGKNLFSKILKHLDFNIPVKKLNFFLPSL

SEQ ID NO: 158786 - protein, 109 aa, Heterodera glycines
  Homolog annotation: Hit_ID=AAP30762.1; Match level="QueryCoverage =100%, HitCoverage=100%, E-value=5e-65, Identity=100%"; Hit description=putative gland protein G7E05 [Heterodera glycines]
  Coding regions on vcDNA: vcDNA=SeqID_85209; Strand=+; Position=1-330
MYKFLFFPHFCILIKAISGLHCWNSNMILLSEMPEKGSVTVHQCPSGHQCVTANCWLGVGNYIVQKCVPDQPGARNYCKDFNNICQMGFFGMPIHCSSCKGDLCNEARN

SEQ ID NO: 158787 - protein, 433 aa, Heterodera glycines
  Homolog annotation: Hit_ID=AAP30764.1; Match level="QueryCoverage =100%, HitCoverage=100%, E-value=0.0, Identity=100%"; Hit description= putative gland protein G28B03 [Heterodera glycines]
  Coding regions on vcDNA: vcDNA=SeqID_85210; Strand=+; Position=1-1302
MNILLKSVLFISLLSLFGDCMKNSDQIGVKRKSAGIRIEEPNDVKGKGKVVETSRKGKEKVGEKISVMNTAERIEKMDLAQDKAKMDIDTNGKPKQNEENAPPKYVFIWSGNNEKKNLEVDLRVIRHSKKLSELFHAKSDQSVNAKHGKQEALPVPKQEAEKMLKEVEEWYAHHKNDEHKKAPVFVFKCKDNVSLVINVHLDAVRLSKELSNMLEDTADEGYPKPIPSPVQNFKSDIMLKLIKLCEEYKYKFDGLKKTTDVPTGEVAEASASNVQEGDVGEASASKVKAGTIAEEIQKFVPPPHIMQWDVKTDLEMVRAADFYNINRLINDDYIDNVYEIVKVKWINGKTPQEIRKGFGVEEPYPPGHPEWARVEKENEWEESDEEREARHAKEREEEEERERKEEQKRKEEEAERLHQEQLQQQQNQEQQPQ

SEQ ID NO: 158788 - protein, 484 aa, Heterodera glycines
  Homolog annotation: Hit_ID=AAP30765.1; Match level="QueryCoverage =100%, HitCoverage=100%, E-value=0.0, Identity=100%"; Hit description= putative gland protein G15A10 [Heterodera glycines]
  Coding regions on vcDNA: vcDNA=SeqID_85211; Strand=+; Position=1-1455
MEAGDVDIIRQQHIRYYADIDGRKYPTEGPDYDVLLYGTDLLVDGKLYKNAVPTGYINYINRIEERIPVLGSSGRSIQLNAAGDDQGNNARLHTNVVGHQISGSVSLPEIPIGGNSDYINTGHNKHDGKPTFGDTKREEKQKNKQKQQKRGELIGGNFTHINNQNNENIGGTQDIGRIQIGGMPPGGALHLNTGGNRNVGGTQMIGGIKIGKMPTGGTFGLNIGGNRNVGGTQEIGSSQGLYNRSNTGDLTHALRQQRTEDNHISINGQIYSVDGPNVNVGVEGHDLSVNGRVYQNRATEQYLEIIQDKNIRNVIVSVPLSLFSRENTTVGQTRHIHAECDGNLYIDQSADDCIRILCVDVKKDAAAKNFGSTSGGFNFGSTSVFYNFSVRGTLHIHNSSLECANIECDASLNVTHSPIERNAQMKCGGSLSIDESPMGNIRLNCDGSLRIEKSKMESSQIDVGGSIGIVESPMGSIGIDCGGS

SEQ ID NO: 158789 - protein, 127 aa, Heterodera glycines
  Homolog annotation: Hit_ID=AAP30766.1; Match level="QueryCoverage =100%, HitCoverage=100%, E-value=4e-68, Identity=100%"; Hit description=putative gland protein G30D08 [Heterodera glycines]
  Coding regions on vcDNA: vcDNA=SeqID_85212; Strand=+; Position=1-384
MATYLFIAAAAFGAGIYCWKAYLGPMLDQPKSDDEEKKAGSKGDKHKKKDKKGEGAAAAPAADKKEEKRKDKHRSKEAGKSDDSKAGKKDKHGKKDKKGKKKDTADASTVDEALGEQSTAETSQAEE

SEQ ID NO: 158790 - protein, 144 aa, Heterodera glycines
  Homolog annotation: Hit_ID=AAP30767.1; Match level="QueryCoverage =100%, HitCoverage=100%, E-value=1e-78, Identity=100%"; Hit description=putative gland protein G21E12 [Heterodera glycines]
  Gene Ontology: Mol. function=structural constituent of cytoskeleton
  Coding regions on vcDNA: vcDNA=SeqID_85213; Strand=+; Position=1-435
MATYLFLAAAAFGAGIYCWKTYLGPMLDQPKSDDEEKPKPEGGEEATTAGEEEKKAGSKGDKHKKKDKKGEGAAAAPAADKKEEKRKDKHKSKESGKSDDSKAGKKDKHGKKDKKGKKKDTADASTVDEALGEQSTAETSQAEE

SEQ ID NO: 158791 - protein, 182 aa, Heterodera glycines
  Homolog annotation: Hit_ID=AAP30768.1; Match level="QueryCoverage =100%, HitCoverage=100%, E-value=1e-101, Identity=100%"; Hit description=putative gland protein G22C12 [Heterodera glycines]
  Coding regions on vcDNA: vcDNA=SeqID_85214; Strand=+; Position=1-549
MASSFRSSIISIVAIVCLLCKCCFSAPHPCCPGSQHVVSMMKDHTGTFSASMPKSSLCMSAERVAAAVENQLKTIWCPGNGSQTLINEINATQSSSDECARSLGFVRAMFEIAASAASHAGANADLAVQFREQVGTIDSNCAALGIHVGQISLDAPKGDHPQVHDSESVLSNPGTSGSHKRF

SEQ ID NO: 158792 - protein, 194 aa, Heterodera glycines
  Homolog annotation: Hit_ID=AAP30769.1; Match level="QueryCoverage =100%, HitCoverage=100%, E-value=1e-105, Identity=100%"; Hit description=putative gland protein G16H02 [Heterodera glycines]
  Coding regions on vcDNA: vcDNA=SeqID_85215; Strand=+; Position=1-585
MLRPSVLPLGTSARPLVLSCVAIVASVGIVCAHSQSKGISGAPLNPSPSLLFVCGLSFATLFSVILAMFGLSWLRPIFLLPIICASGVVCVFHTLSVANWLSDWWISADQSLDLDWLIIFTSAITFQAISMLVFSLKHLMIFKLLRPFTFKFAAIAFFDSQIQNIPLIVALIIASTAAESELFLKGGGKSFLFP

SEQ ID NO: 158793 - protein, 265 aa, Heterodera glycines
  Homolog annotation: Hit_ID=AAP30770.1; Match level="QueryCoverage =100%, HitCoverage=100%, E-value=1e-154, Identity=100%"; Hit description=putative gland protein G17G01 [Heterodera glycines]
  Coding regions on vcDNA: vcDNA=SeqID_85216; Strand=+; Position=1-798
MEKIVYLKLLQFVLTLTIIWQLRSLHQFCGTFADPKAFLHDISIGHCKNFTLIGKDSKSGEFSALFDQDKWHNQLIMMSSTNGQLIEEQQHQFMDELATKLPSAGRICIPITISPFDWIFYRIANDRILIDNDILYFSSVQLCVALCLLVPLVLGTLLMLLSVEEYEPCAYFLASYFVFCWCGFAAISSDLLLNWTDLWTCFNFQADHTNMPLATLVLSIVMACSSVFEIFFKNSLFKKRLVNAPAAAENNHHKLRKHYATCAIE

SEQ ID NO: 158794 - protein, 361 aa, Heterodera glycines
  Homolog annotation: Hit_ID=AAP30771.1; Match level="QueryCoverage =100%, HitCoverage=100%, E-value=0.0, Identity=100%"; Hit description= putative gland protein G23G11 [Heterodera glycines]
  Coding regions on vcDNA: vcDNA=SeqID_85217; Strand=+; Position=1-1086
MSDSEKVTTRNAQPKVLDTRDDGKFTAKFIAPRSREPDSVFLHIFGSKKDPHLYLDVSEVQWGNVYIFDLNKTEVIAVRPRRVADELRKLEERDRPPVKREQPKPQPQPQPQPQPVTFQKILSGLVWPTTEKYTLLVSSRDFDLDGRGSPIKQRATNPDPTRAETNYKGTFDVKMALTERPETFYVWVSSAKGGQKRFVIPAYEVDSSKFALDMRTGKVEPFQRLENVLRKLKSVGMINNEQIPSGPPKRAVAAAEPARAAVAPSAGSDMLNSIKAMVNNLGAVLEKKIEQQHAKLKQDIETELEQRVGQKLVAVGKRLGLVDDTLKDMYKKLPREIEDVIAAEFDVLYKKKLIGKLDGKA

SEQ ID NO: 158795 - protein, 106 aa, Heterodera glycines
  Homolog annotation: Hit_ID=AAP30772.1; Match level="QueryCoverage =100%, HitCoverage=100%, E-value=4e-57, Identity=100%"; Hit description=putative gland protein G23G12 [Heterodera glycines]
  Coding regions on vcDNA: vcDNA=SeqID_85218; Strand=+; Position=1-321
MRTFLFIAVVGLMLAVILENVNATGKNSPTKELIHEQGNLQNHATGQSPPDSPNHKNDHENEISNLQNRATGQSPPDSTKRETEHKIEKGKPSPDSPKYDEQALKW

SEQ ID NO: 158796 - protein, 146 aa, Heterodera glycines
  Homolog annotation: Hit_ID=AAP30773.1; Match level="QueryCoverage =100%, HitCoverage=100%, E-value=4e-80, Identity=100%"; Hit description=putative gland protein G24A12 [Heterodera glycines]
  Coding regions on vcDNA: vcDNA=SeqID_85219; Strand=+; Position=1-441
MSSSPSVSVLAVVAIVCLMCQCCFSAPHPCCPGSQKVVSLMSNYVGTFANSISKSSLCSDAQNVADALKGQLIGCSASSHASNNSEWQTLSGQFGQKVTEIDSKCAEFGISIGKVPINGPKGVHVQNVPNSESVISMPGLAGSHTQ

SEQ ID NO: 158797 - protein, 185 aa, Heterodera glycines
  Homolog annotation: Hit_ID=AAP30774.1; Match level="QueryCoverage =100%, HitCoverage=100%, E-value=1e-103, Identity=100%"; Hit description=putative gland protein G30E03 [Heterodera glycines]
  Coding regions on vcDNA: vcDNA=SeqID_85220; Strand=+; Position=1-558
MASSFCSSIISIVAIVCLLCKCCFSAPHPCCPGSQHVVSMMKDHTGTFSASMPKSSLCLSAERVAAAVENQLKTIWCPGNGGQTLINEINAAQSSSDECARSLGFIRAMFEIAASAASHAGANAELANLAVQFREQVGTIDTNCAALGIHVGQISLGTPKGDHPQVHDSESVLSNPGTSGSHKRI

SEQ ID NO: 158798 - protein, 195 aa, Heterodera glycines
  Homolog annotation: Hit_ID=AAP30775.1; Match level="QueryCoverage =100%, HitCoverage=100%, E-value=1e-105, Identity=100%"; Hit description=putative gland protein G32E03 [Heterodera glycines]
  Coding regions on vcDNA: vcDNA=SeqID_85221; Strand=+; Position=1-588
MRAVLFLAMVCLVMAVILETANSKAVKKDNKKGAITTPAKGKAAPKGAAKGGIKKDAKSKGKGKKDAKGKKDKKAKPAKGKASPKNDKKPPAAKANDKKSPTKPMAAVKAVPKAAENAQKGPSSAEVVAEESNLDTEAVDDLGVGPEAVDDLGAEESDFDQLAEDELLEDDAMGGEADEWEGMGEETEMDSQMAL

SEQ ID NO: 158799 - protein, 244 aa, Heterodera glycines
  Homolog annotation: Hit_ID=AAP30776.1; Match level="QueryCoverage =100%, HitCoverage=100%, E-value=1e-142, Identity=100%"; Hit description=putative gland protein G34B08 [Heterodera glycines]
  Coding regions on vcDNA: vcDNA=SeqID_85222; Strand=+; Position=1-735
MRTFLFIAVVGLMLAVILENVNATGKNSPTKGQSPPGSPKHEKDRKNEHGNQQNHATGKSPPGSPRVQSPPGSPRGKSPPGSPRVQSPPGSPRGQSPPGSPKHEKDHKNEHGNQQNHATVPNVVQKVEVHNQPTPSAAASHPVPPTPGNSPTAHDSHHTSPKVAHVAAAATLGHGRQECANVSCGDDVTEEMDRDDDKTVERAVGESPIGVSESSATDEDDSAAVSAYNKNNSSAAASASVADD

SEQ ID NO: 158800 - protein, 308 aa, Heterodera glycines
  Homolog annotation: Hit_ID=AAP30834.1; Match level="QueryCoverage =100%, HitCoverage=100%, E-value=1e-178, Identity=100%"; Hit description=putative gland protein G10A06; Hg-G10A06 [Heterodera glycines]
  Coding regions on vcDNA: vcDNA=SeqID_85223; Strand=+; Position=1-927
MLRIALLISILALFGDCMDKGKRKLGGISINEPSEYGTKEKEAIATKENALTSKDPPTSAGGQNEAIPSPKKPSPKGKLKSDFGLNLAKAFPRPVPKGKKVENTLSSKDSASEAHKELAKEKNEENAQTSKVPTSMERQNEPIPSPKKPSPKGKSKSDFALNLAKAFPRPVAEAKMGEEAQSSKDPTMNAKFVQFVWMHRLSLTLKLSKCHHRFHRECVDGWFKNNDTCPYCRAVVASRYLPRPTRTDRIFDARIENKRRFMGEGEGKYTIIRPNGSTLMVHDNHFGNNFTVEKTEEGSIQLSKNDRK

SEQ ID NO: 158801 - protein, 227 aa, Heterodera glycines
  Homolog annotation: Hit_ID=AAP30835.1; Match level="QueryCoverage =100%, HitCoverage=100%, E-value=1e-137, Identity=100%"; Hit description=putative gland protein G33E05; Hg-G33E05 [Heterodera glycines]
  Gene Ontology: Cellular component=extracellular
  Coding regions on vcDNA: vcDNA=SeqID_85224; Strand=+; Position=1-684
MRTFLFIAVVGLVLAVIMESVNATGNNSPTKGQTPPGSPKGGHGSNKSPTTPHSAGSPHGTQHGNQQNHAAGQTPPGSPKGGHGSNKSPTTPHSAGSPHGTQHGNQQKNATGQTPPGSPKGGHGSNKSATTPHSAGSPHGTQHGNQQKNATGQTPPGSPKGGHGNNKSPTTPHSAGSPHGTQHGNQQNHAAVSNVVQNVDNKPRPSAPASHLVPPTPGNSPTAHDSR

SEQ ID NO: 158802 - protein, 163 aa, Heterodera glycines
  Homolog annotation: Hit_ID=AAP30836.1; Match level="QueryCoverage =100%, HitCoverage=100%, E-value=4e-90, Identity=100%"; Hit description=putative gland protein G30C02; Hg-G30C02 [Heterodera glycines]
  Coding regions on vcDNA: vcDNA=SeqID_85225; Strand=+; Position=1-492
MRKLPFLLLFSACCYLQRKEVYFAEKTERKIHRAANKKHKEETEGMAEVALFQMAMACMANRMDFQMADLAAPVSIQIAAGRIAFQMVDLAAPVAFHRWDITRADFTALGPAHLLEATDTEAVLVEENEKKTESDRRENDLCCCLLCMQNLNGKTHFTSRTLF

SEQ ID NO: 158803 - protein, 235 aa, Heterodera glycines
  Homolog annotation: Hit_ID=AAM50038.1; Match level="QueryCoverage =100%, HitCoverage=100%, E-value=1e-131, Identity=100%"; Hit description=putative gland protein G27D09 [Heterodera glycines]
  Coding regions on vcDNA: vcDNA=SeqID_85226; Strand=+; Position=1-708
MVCLVMAVLMEMANSKAVKKDNKKGAVAASPAKGKSSPKGGKSPAKGKAAKKLKPKKDAKGIKAKKAKPAKKSKAAKAVKGAPKTVKKLAIAKTAAQVKEIKSPAKPMVLKAVPPHQMHLMNEKVQTAVSPPAHARSLATVPYSTPMAADRNSLPSYTSDGTNLDMAHENDDYQNYYYGTEDSSREFDASAEEEDELYEEGDGAMSWQTDDYGIGIGQEYGHQSVEVPPKSVMLD

SEQ ID NO: 158804 - protein, 335 aa, Heterodera glycines
  Homolog annotation: Hit_ID=AAM50039.1; Match level="QueryCoverage =100%, HitCoverage=100%, E-value=0.0, Identity=100%"; Hit description= putative gland protein G26D05 [Heterodera glycines]
  Coding regions on vcDNA: vcDNA=SeqID_85227; Strand=+; Position=1-1008
MNSSFVICCCFHNFVLFLLLSCVVPHAFACCPHGNLRVKGTHLADEKGETVQLRGMSLYWSQWEYGSKFFNEKTVNCLKCSWHADIVRAPLAVDQGGYLSNPEQEYAKVKSVVQAAIDKCIYVLIDWHYTSSEKYTDKAKEFFGRISTLCAGKCNCLYETWNEPIQNDWSSQLKPYHEELVKVIRQNDKNGVIIAGTPNYDQDVKAVVNDPIKEHNIMYTLHLYAASHKQELRNTAQQAIGAGVPLFVTEYGTSSYTGDGGPDLVETQNWYDFFNKNSLSYINWAIDDKQEASVALQNTQPPVGPADVCSTDRLTKSGKFVHDHLIGVNQKPDGC

SEQ ID NO: 158805 - protein, 344 aa, Heterodera glycines
  Homolog annotation: Hit_ID=AAC72366.2; Match level="QueryCoverage =100%, HitCoverage=29%, E-value=0.0, Identity=99%"; Hit description =guanylyl cyclase [Heterodera glycines]
  Coding regions on vcDNA: vcDNA=SeqID_85228; Strand=-; Position=1-1518
MEMPSCFFLLFFLMLFVSPSRHQLVTVSNSSSSPIGTTVAFGTPSPIIPISTAPSTNGTATFGVPPPISPPINSSSSLPSTGPLEASVQLKIGFLFANGTQRLRMLFGFGQSAPAVTLALERARQEHLIDSINFTYTWRMCGCFQPWAVGYATQLVLTENVDALIGPPCAIAAGYVASFYNIPLYLWGATVASEFYNTTVYPTLNNVNVNSDMLALALQSVLVQFNWTEVSFVYTPDNERMVCNSVKQSLTNVLNVTNVTIVFQHQMESNVDSMKATLRNLRNRSRIVLSCFDVEVERRNFLLSIFDTGLAADNEFVFIMGSLRNQGMLQQVASREDGSVKYVN

SEQ ID NO: 158806 - protein, 344 aa, Heterodera glycines
  Homolog annotation: Hit_ID=AAC15708.1; Match level="QueryCoverage =92%, HitCoverage=99%, E-value=0.0, Identity=99%"; Hit description =beta-1,4-endoglucanase-2 precursor [Heterodera glycines]
  Coding regions on vcDNA: vcDNA=SeqID_85229; Strand=+; Position=859 -2894
MFVQLVLLAIVGITFVDAAAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPIKGFSNLMYTLHFYASSHFVDGLGNKLKTAVNKGLPVFVTEYGTCEASGNGNLNSGSMSSWWSLLDQLKISYVNWSITDKSEACAALTGGTSAANVGTSSRWTQSGNMVASQHKKKSTGLSDQLNRQGQDTIKKYIEDLDLRIKGFI

SEQ ID NO: 158807 - protein, 360 aa, Heterodera glycines
  Homolog annotation: Hit_ID=AAO49799.1; Match level="QueryCoverage =100%, HitCoverage=100%, E-value=0.0, Identity=100%"; Hit description= arginine kinase [Heterodera glycines]
  Gene Ontology: Mol. function=creatine kinase activity; Cellular component=cytoplasm; Biological process=phosphocreatine metabolism
  Coding regions on vcDNA: vcDNA=SeqID_85230; Strand=+; Position=7-1089
MAVPQEVIDKIEAGYKKLQAAADCKSLLKKYLTKDVVDACKDKRTKLGATFLDVIQSGVANLDSGVGVYAPDAEAYTLFKPLFDPIINNYHGGFGPSSKQPATDLGEGKTQLPTDLDPEGKFINSTRVRCGRSLQGYPFNPCLTKENYVEMESKVKAVFEQLKGDAELGGTYYPLQGMTKDVQNQLIADHFLFKEGDRFLQEANACRYWPTGRGIFHNAKKTFLVWVNEEDHLRIISMQNGGNVGQVLERLIKGVKAIESKVPFSRDDRLGWLTFCPTNLGTTVRASVHIRLPKISAKPDFKSICDGLKLQIRGIHGEHSESAGGVYDISNKARLGLTEFEAVKQMYDGVKHLIELEKKA

SEQ ID NO: 158808 - protein, 121 aa, Heterodera glycines; identical to SEQ ID NO: 158713
  Coding regions on vcDNA: vcDNA=SeqID_85231; Strand=-; Position=138-503

SEQ ID NO: 158809 - protein, 89 aa, Heterodera glycines
  Homolog annotation: Hit_ID=AAM95699.1; Match level="QueryCoverage =100%, HitCoverage=100%, E-value=2e-45, Identity=100%"; Hit description=33A09 [Heterodera glycines]
  Coding regions on vcDNA: vcDNA=SeqID_85232; Strand=+; Position=1-270
MNLIFEIFAFGMDNFSSEKNVSLLRLFLFFFSTVVLFGSAHPMVNKLCEDLDKPEGWQLLKKLTIEKCRMSIMWNSPNGKTATKALKSL

SEQ ID NO: 158810 - protein, 67 aa, Heterodera glycines
  Homolog annotation: Hit_ID=AAC24579.1; Match level="QueryCoverage =100%, HitCoverage=100%, E-value=6e-32, Identity=100%"; Hit description=14-3-3-like protein [Heterodera glycines]
  Gene Ontology: Mol. function=protein domain specific binding; Cellular component=nucleus; Biological process=protein targeting
  Coding regions on vcDNA: vcDNA=SeqID_85233; Strand=+; Position=3-206
NSPDKACQLAKQAFDDAIAELDTLNEDSYKDSTLIMQLLRDNLTLWTSDTAGDEQEAGGEAGEAGGN

SEQ ID NO: 158811 - protein, 352 aa, Heterodera glycines
  Homolog annotation: Hit_ID=AAP88024.1; Match level="QueryCoverage =100%, HitCoverage=100%, E-value=0.0, Identity=100%"; Hit description= beta-1,4-endoglucanase-4 [Heterodera glycines]
  Coding regions on vcDNA: vcDNA=SeqID_85234; Strand=+; Position=1-1871
MLVQLVLLAIIGISFVGAAAPPYGQLSVSGTKLVGSNGKPVQLIGNSLFWHQWYPQFWNAETVKALKCNWNSNVVRTAMGVEQGGYLSDANTAYRLTAAVIEAAIAQGIYVIVDWHAHEANADKAIEFFTKVAKAYGSNPHLLYETFNEPLDVSWNDVLVPYHKKVISAIRAIDKKNVIILGTPKWSQDVDVAAQNPIKGFGNLMYTLHFYASSHFVDGLGNKLKTAVNKGLPVFVTEYGTCEASGNGNLNTNSMSSWWSLLDQLQISYVNWSITDKSEACAALTGGTSAANVGTSSRWTQSGNMVASQHKKKSTGVNCSGGGGAAAKPAAKPAAKPAAKSKGKSSKAKKSG

SEQ ID NO: 158812 - protein, 335 aa, Heterodera glycines; identical to SEQ ID NO: 158746
  Homolog annotation: Hit_ID=AAN32884.1; Match level="QueryCoverage =100%, HitCoverage=100%, E-value=0.0, Identity=100%"; Hit description= cellulase ENG-5 [Heterodera glycines] gb|AAP97436.1| cellulase ENG-5 [Heterodera glycines]
  Coding regions on vcDNA: vcDNA=SeqID_85235; Strand=+; Position=1-1008

SEQ ID NO: 158813 - protein, 284 aa, Heterodera glycines
  Homolog annotation: Hit_ID=AAQ12016.1; Match level="QueryCoverage =100%, HitCoverage=100%, E-value=1e-151, Identity=100%"; Hit description=tropomyosin [Heterodera glycines]
  Gene Ontology: Mol. function=structural constituent of muscle; Cellular component=muscle thin filament tropomyosin; Biological process=pole plasm oskar mRNA localization
  Coding regions on vcDNA: vcDNA=SeqID_85236; Strand=+; Position=58-912
MDAIKKKMQAMKIEKDNAIDRADAAEEKCRQTQERLERVEEELRDTQKKMMATENELDKAQEDLTAANNLLEEKEKKVQEAEAEVASLNRRMVLLEEELDKLEERLKLATEKMEEATANCDESERVRKVMENRSLQDEERANAIEEQLKEAQSLAEEADRKYDEVARKLAMVEADLERAEERAEAGENKIVELEEELRVVGNNLKSLELSEEKALQREEAYEEQVRQMEVRLKEAETRAEFAERSVQKLQKEVDRLEDELVHEKERYKAISEELDSTFQELSGY

SEQ ID NO: 158814 - protein, 319 aa, Heterodera glycines
  Homolog annotation: Hit_ID=AAC33860.1; Match level="QueryCoverage =100%, HitCoverage=100%, E-value=0.0, Identity=100%"; Hit description= beta-1,4-endoglucanase-3 precursor [Heterodera glycines] gb|AAC33848.1| beta-1,4-endoglucanase-3 precurso
  Coding regions on vcDNA: vcDNA=SeqID_85237; Strand=+; Position=84-1043
MLVQLVLLAIVGITFVDAAAPPYGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPIKGFSNLMYTLHFYASSHFVDGLGNKLKTAVNKGLPVFVTEYGTCEASGNGNLNSGSMSSWWSLLDQLKISYVNWSITDKSEACAALTGGTSAANVGTSSRWTQSGNMVASQHKKKSTGVKC

SEQ ID NO: 158815 - protein, 344 aa, Heterodera glycines
  Homolog annotation: Hit_ID=AAC33860.1; Match level="QueryCoverage =92%, HitCoverage=99%, E-value=0.0, Identity=99%"; Hit description =beta-1,4-endoglucanase-3 precursor [Heterodera glycines] gb|AAC33848.1| beta-1,4-endoglucanase-3 precursor [
  Coding regions on vcDNA: vcDNA=SeqID_85238; Strand=+; Position=736 -2770
MLVQLVLLAIVGITFVDAAAPPYGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPIKGFSNLMYTLHFYASSHFVDGLGNKLKTAVNKGLPVFVTEYGTCEASGNGNLNSGSMSSWWSLLDQLKISYVNWSITDKSEACAALTGGTSAANVGTSSRWTQSGNMVASQHKKKSTGLSDQLNRQGQDTIKKYIEDLDLRIKGFI

SEQ ID NO: 158816 - protein, 412 aa, Heterodera glycines
  Homolog annotation: Hit_ID=AAC62109.1; Match level="QueryCoverage =100%, HitCoverage=100%, E-value=0.0, Identity=100%"; Hit description= mucin-like protein [Heterodera glycines]
  Gene Ontology: Mol. function=signal transducer activity; Cellular component=secretory vesicle; Biological process=invasive growth
  Coding regions on vcDNA: vcDNA=SeqID_85239; Strand=+; Position=27-1265
MKIAAFATLLVAAIALVEAGNPAQQQQQQQQKPTPAPSANVTKVPATTVPATTVPATKVPVPSNATKVPGTKVPATTAPGTKVPATTAPAPTPAGSKPTPAGNTTTAPKPTPAASVPTKQGNCIEVSVERDATYCIAGPICSGSGDKPAGDNCPKKGDVAVKDCLKTLKSYTESGKCVLPEDAKCQKIHTGAWGCVIGGGNATPAPSKPVTPPSNNSTTAPPKPTPAASTPCPSLPIKTPAPSNTTAAPKPTPAASTPCPSLPVKTETPCPSLPIKTPAPSTTTPCPSLPIKTPAPTPAATTPCPSLPVKTPAPSTTTPCPSLPVKTPAPSTTTPCPSLPVKTKTPAPTATKTPAPSNNGTKVPSKTTPAPTTNTTKVPATTAPATKTPAPTNATAVPTKKPQQQQQQQQKL

SEQ ID NO: 158817 - protein, 641 aa, Heterodera glycines
  Homolog annotation: Hit_ID=AAM18623.1; Match level="QueryCoverage =100%, HitCoverage=100%, E-value=0.0, Identity=93%"; Hit description =C-type lectin domain protein [Heterodera glycines]
  Coding regions on vcDNA: vcDNA=SeqID_85240; Strand=+; Position=12-1937
MFHLAAIVALAALALPLASSDKFRPCLEGYAQYGKYCYKADKFRPCLEGYAQYGKYCYKAGAELASVHSETEREFVNMLVLREANKMEFNCKQPGRAFFWFGLKLKWSEKKLEDASWTDGKPVDYLSPTEWGAYKRPLTMDNAGGAGYNKENENCVFLGQWPRKVKEYLSLETALDKSGVDVLWMDVVCEKPEEYWAPHGAVCKMRAKEEEKGYGKDKYGAKEEEEEEDEELRKINKYVTIGSGNFIYANKNTYMILLLKDLYGKQLKEESRKKVCELYNGEYVKVKDEPKEAQEYLDKVLAKEKELYSDASDHMFCRFTGIIGACGESCYKVPLPICAEGYAYFSGYCYKAFTNADKEVKYSEAQKICKSDGAELVSMHSELEREFVNVVALTAAKKYEYNAKVPGLAFYWTSMQLEWDEKKLKNASWADMTPMDYLSPMEWGTKKRPVYVDNSNGGEYNKENENCVFIGQWPREGKQYLKLDSAVDKYGLDVLWRDEVCEKPGEDCPRGAVCKKRATVGECYGTGAYLLDAAEEEEMKKLLKFITVGSGTFVYAEKNTYMVLLLKDLYGKQMKEEDRKKVCAYYKAEYVTVKAEPNKVQEYVDKVLSKQKQMYADASDHMLCKFSGTLGGCGDYCKTGY

SEQ ID NO: 158818 - protein, 144 aa, Heterodera glycines
  misc_feature (82)..(82): Xaa can be any naturally occurring amino acid
  Homolog annotation: Hit_ID=AAR01198.1; Match level="QueryCoverage =100%, HitCoverage=100%, E-value=6e-72, Identity=91%"; Hit description=cellulase binding protein [Heterodera glycines] gb|AAN32887.1| cellulose binding protein [Heterodera gly
  Coding regions on vcDNA: vcDNA=SeqID_85241; Strand=+; Position=1-622
MNWMHYCLIACFAFYYFNTVESSTINSVTVQVNKIENNENGRQFNLEFTNQVYERVCHVDFRIDLPDTVKFDELNYLFNNVXLNKYSKMVPIPDTCGQYALPKSLDLLPGESFDAQLTLLGHDGKPNVTVLNTNNIPTSKQCKK

SEQ ID NO: 158819 - protein, 335 aa, Heterodera glycines
  Homolog annotation: Hit_ID=AAO25506.1; Match level="QueryCoverage =100%, HitCoverage=100%, E-value=0.0, Identity=100%"; Hit description= cellulase [Heterodera glycines]
  Coding regions on vcDNA: vcDNA=SeqID_85242; Strand=+; Position=1-2941
MNSSFVICCCFHNFVLFLLLSCVVPHAFACCPHGNLRVKGTHLADEKGETVQLRGMSLYWSQWEYGSKFFNEKTVNCLKCSWHADIVRAPLAVDQGGYLSNPEQEYAKVKSVVQAAIDKCIYVLIDWHYTSSEKYTDKAKEFFGRISTLCAGKCNCLYETWNEPIQNDWSSQLKPYHEELVKVIRQNDENGVIIAGTPNYDQDVKAVVNDPIKEHNIMYTLHLYAASHKQELRNTAQQAIGAGVPLFVTEYGTSSYTGDGGPDLVETQNWYDFFNKNSLSYINWAIDDKQEASVALQNTQPPVGPADVCSTDRLTKSGKFVHDHLIGVNQKPDGC

SEQ ID NO: 158820 - protein, 407 aa, Heterodera glycines
  Homolog annotation: Hit_ID=AAP41028.1; Match level="QueryCoverage =100%, HitCoverage=100%, E-value=0.0, Identity=100%"; Hit description= arginine kinase [Heterodera glycines]
  Gene Ontology: Mol. function=creatine kinase activity; Cellular component=cytoplasm; Biological process=phosphocreatine metabolism
  Coding regions on vcDNA: vcDNA=SeqID_85243; Strand=+; Position=23-1246
MSSVSKFITNKGPFIAVGMGVVGMGYFGYYKFWRSSREIAMSYKQEDESDGYTVKRIEEAYKTLQEAKDCKSLLKKHFTADVKDKLKYKKTKLGASLFDVIRSGVKNLDSGVGVYAADSESYKVFSPLFDPVIDEYHGGFGPKQKHPPSNFGEDRLGELKDLDPDGKYILSTRIRCGRSLLGYPFNPLLMRDDYLVMQQKVRMALENLEDDPEIGGTYYPLEGMTKETQKQLIADHFLFKEGDRFLEAANSNHFWPAGRGIFHNAKKTFLVWVNEEDHLRIISMQKGGDVGNVLKRLIRGVKGIEKQVPFARDDRLGYLTFCPSNLGTTIRASVHIRLPKISAKPEFKKICEDLKLQVRGIHGEHSESEGGVYDVSNKARLGLTEFEAVKQMYDGVKKLIELEKASK

SEQ ID NO: 158821 - protein, 586 aa, Heterodera glycines
  Homolog annotation: Hit_ID=AAR11446.1; Match level="QueryCoverage =100%, HitCoverage=100%, E-value=0.0, Identity=100%"; Hit description= matrix metalloproteinase [Heterodera glycines] gb|AAR11445.1| matrix metalloproteinase [Heterodera glycin
  Gene Ontology: Mol. function=stromelysin 1 activity; Cellular component=extracellular space; Biological process=proteolysis and peptidolysis
  Coding regions on vcDNA: vcDNA=SeqID_85244; Strand=+; Position=11-1771
MHFHKLFLLLPILLLHLQQSQACFSRGNSGEPSDGNPEAQGLKSENDVRTVQLKKEKQTDETEEEKDEESSAEQKLPSELDPEFVKTYLREFGHLKHNENGLSHGVKHFQRFLGYRQTGNVDLATLQKMSWKRCANSDEGYTAQDPSQLWERSTLFWNLNASHPKQFTHGETKELIAQAFRAWEIVIKIDFLETNNADNAQIIFTFESDGAKKEKSKNGEEEKEKEGKTGLAIAKASSPPVARIVLNADENWSTFQTQEEGKIDIFVVLLHEIGHALGLRHSGDEHSVMFPMFERSVGEHLPVISNDDVEHLRALYEGDLTDRPTLAADLRPTRPVPVQGGTHSTDSYGGEGATTAAGKEAEKCPHSITTAANVNSETLFLFKDGYAWHLSRGKLVGGPYKISEFFPDGPEKVDVAFSSGRLTVLVKSRMLFGYEFDQKTAQFTRDHRYPRELHSRILFYPEGAFPIVNGSVILFKDDVFATYNVESNTPHLFGSMSEFFPGLPQNLRAGFAATPDFTTYHMLTNDYAFLYDVRVARTVSSQSIGQFVGCEGNKLMPPGPPMPHLFFPYQPSPPQNPRFPQQNYGK

SEQ ID NO: 158822 - protein, 372 aa, Heterodera glycines
  Homolog annotation: Hit_ID=AAC69868.1; Match level="QueryCoverage =100%, HitCoverage=100%, E-value=0.0, Identity=100%"; Hit description= dorsal esophageal gland-specific protein [Heterodera glycines]
  Coding regions on vcDNA: vcDNA=SeqID_85245; Strand=+; Position=1-1119
EQFLQDERQRVDKLFNNNNNNSKSNNKPLEKAYGGAFATSSSHDMQMAASTSTVGEEAAAENVHHTNQKLQQSATSAAEGGGKFSDFEDGSDNELFISTTTINNNDGDDDDDEEEEEGKEAIPWHGGGKYAKCFEQIVRDGTLVAKVRCLICAKELSTKSRTSIREHSKLHQLVAESGIFDHSQEGIFDGMMPEAVGTALVEERTPIVIPFRRRVTTTEMMPSTSAQQKMRSQSVEDDILNDEELQQQQNLAHFDWNKQKIELQILEAELIQKQLSNFQRCTELGIPARVHLPVGIVPSGSQSATGWNRRFATFSNAHALQQHSPAGRQQRQMPHGHADNGSRDNGGIAGMFAAAGDDDDGTPCDFVAFADI

SEQ ID NO: 158823 - protein, 64 aa, Heterodera glycines
  Homolog annotation: Hit_ID=NP_502575.1; Match level="QueryCoverage =95%, HitCoverage=26%, E-value=2e-09, Identity=55%"; Hit description =putative protein of eukaryotic origin (26.5 kD) (4O146) [Caenorhabditis elegans] emb|CAB60598.1| Hypothet
  Coding regions on vcDNA: vcDNA=SeqID_85246; Strand=+; Position=2-196
LNVFGLRSVYALVLGGENAAEMMDEQAMLGMAQPQMVAPGQDPIGAFKSEWEALQLYTHTFNPR

SEQ ID NO: 158824 - protein, 92 aa, Heterodera glycines
  Coding regions on vcDNA: vcDNA=SeqID_85247; Strand=+; Position=143-421
TDSEDYFMVEKQLRERRVGIQNFSSMVLFDRKAKQRQKMAEKRRKERNNAKLILYGRPRKTKQCSSVFSKEDFAQIGKKDGSSAYERIKRIR

SEQ ID NO: 158825 - protein, 79 aa, Heterodera glycines
  Coding regions on vcDNA: vcDNA=SeqID_85248; Strand=+; Position=94-333
MVGYFVFGLGMIFWDYVQLRIIFFGTPNLSFSIFYLYLIATFLNWVLSFQFHGKQQIHSNFSKQFDDVKKSKHVICIHF

SEQ ID NO: 158826 - protein, 78 aa, Heterodera glycines
  Coding regions on vcDNA: vcDNA=SeqID_85249; Strand=-; Position=115-351
SERQRGGKGGKKEKKTPPGEGARKKKKLFVFPLAFSPLFWFFQTKYYSLFPFFFSQGKKAFLNFVFGYLLSPGRELFN

SEQ ID NO: 158827 - protein, 179 aa, Heterodera glycines
  Homolog annotation: Hit_ID=EAL29277.1; Match level="QueryCoverage =38%, HitCoverage=4%, E-value=1e-10, Identity=47%"; Hit description =GA14323-PA [Drosophila pseudoobscura]
  Coding regions on vcDNA: vcDNA=SeqID_85250; Strand=+; Position=89-625
MSVVESSSSSIHGRRHQQQQDITAAQPEHHHYPIPIGQRRSASSSASDFVAQHSPFDSGNKWFHVVDLPSSEQRFVITEYSVPCYDRGGGGSGLATTTESVRRKRRAIEYASQLPDEQQQEQQQKTAATEQIALEPGTLYRIRVRAINSVGCSAWSQPVSFKTCVPGFPGSPTSIKITK

SEQ ID NO: 158828 - protein, 38 aa, Heterodera glycines
  Homolog annotation: Hit_ID=BAD17949.1; Match level="QueryCoverage =92%, HitCoverage=8%, E-value=4e-09, Identity=82%"; Hit description =phosphoglycerate kinase [Callorhinchus callorynchus]
  Coding regions on vcDNA: vcDNA=SeqID_85251; Strand=-; Position=216-332
EKWGAEDKVTHVSPGGGPSLELLEGKVLPGVPALSDAP

SEQ ID NO: 158829 - protein, 186 aa, Heterodera glycines
  Homolog annotation: Hit_ID=AAN15806.1; Match level="QueryCoverage =80%, HitCoverage=57%, E-value=5e-49, Identity=59%"; Hit description =putative esophageal gland cell secretory protein 26 [Meloidogyne incognita]
  Coding regions on vcDNA: vcDNA=SeqID_85252; Strand=+; Position=3-560
GGSRAQEGTKGECVPDQGVRIDGRGQWQGYHALISSVQLFRFGGEVNAGQRIGVARDLECAGTRPKPRGDENFVRMELFREDKPIDPTHHLIDCMCTGQICETNRANALEGLPFKFDSRFNGVRGWEIVCPNVRPEEPNSSGESPEQSDNRQTMSPKIYSPIEGEVIGRVRLSASSNSQSYSGCAN

SEQ ID NO: 158830 - protein, 51 aa, Heterodera glycines
  Coding regions on vcDNA: vcDNA=SeqID_85253; Strand=-; Position=0-152
VMTNKEPFSIRQWINHKERRPGFLFLSAPESHIATLRPLLGFWADIAVSAL

SEQ ID NO: 158831 - protein, 177 aa, Heterodera glycines
  Homolog annotation: Hit_ID=NP_700900.1; Match level="QueryCoverage =98%, HitCoverage=92%, E-value=8e-30, Identity=40%"; Hit description =hypothetical protein PF11_0035 [Plasmodium falciparum 3D7] gb|AAN35624.1| hypothetical protein [Plasmodiu
  Gene Ontology: Biological process=N-linked glycosylation
  Coding regions on vcDNA: vcDNA=SeqID_85254; Strand=+; Position=2-532
KEAEKKENEEQKPAGKKEKRAAEKEEKKSESKEAEKKENEEQKPAGKKEKRAAEKEEKKSESNEAEKKENEEQKPAGKKEKRAAEKEEKKSESKETEKKENEEQKPAGKKEKRAAEKEEKKSESKEAEKKENEEQKPAGKKEKRAAEKEEKKSESKETEKKENEEQKPAGKKEKRAA

SEQ ID NO: 158832 - protein, 182 aa, Heterodera glycines
  Coding regions on vcDNA: vcDNA=SeqID_85255; Strand=+; Position=2-547
KFSNRKMNLRHLLFIIFFNIVVIDSGKIQPNFDEIFCNGWDKIESEEIVIKIEQNENSEVDQLGEEMANGPIDQMRNYTDQNHSKSDQNIIEEPNDQQKREIVQKFDAIKEKLREKIKYKRKDYDKIERKIAKLLGANRQLIHKWKNELKLNKKKMKKQLYDEKKRKFIERFDEFKELYGQR

SEQ ID NO: 158833 - protein, 179 aa, Heterodera glycines
  Homolog annotation: Hit_ID=AAL78228.1; Match level="QueryCoverage =100%, HitCoverage=76%, E-value=6e-97, Identity=100%"; Hit description=SCN esophageal secretory protein [Heterodera glycines]
  Coding regions on vcDNA: vcDNA=SeqID_85256; Strand=+; Position=30-566
MNILLKSVLFISLLSLFGDCMKNSDQIGVKRKSAGIRIEEPNDVKGKGKVVETSRKGKEKVGEKISVMNTAERIEKMDLAQDKAKMEIDNIDTNAKPKQNEDKGVMNTAERIEKMDLAQDKAKMDIDTNGKPKQNEENAPPKYVFIWSGNNEKKNLEVDLRVIRHSKKLSELFHAKSDQ

SEQ ID NO: 158834 - protein, 102 aa, Heterodera glycines
  Homolog annotation: Hit_ID=CAE60523.1; Match level="QueryCoverage =60%, HitCoverage=9%, E-value=9e-14, Identity=58%"; Hit description =Hypothetical protein CBG04143 [Caenorhabditis briggsae]
  Coding regions on vcDNA: vcDNA=SeqID_85257; Strand=+; Position=302-610
MPPSKYHRNDGQGHTGNIQPKAVKFIMGLKKEAEIYAEWLQRLCLSEYLALFLGQGYDLPTLARSSPEDLTTLGITRPEDRKRLFQDIQTWRNVTANCKKIN

SEQ ID NO: 158835 - protein, 183 aa, Heterodera glycines
  Homolog annotation: Hit_ID=NP_620614.2; Match level="QueryCoverage =86%, HitCoverage=9%, E-value=2e-24, Identity=37%"; Hit description =SWI/SNF-related matrix-associated actin-dependent regulator of chromatin a2 isoform b [Homo sapiens] emb|C
  Gene Ontology: Mol. function=chromatin binding; Cellular component =nuclear chromosome; Biological process=organogenesis
  Coding regions on vcDNA: vcDNA=SeqID_85258; Strand=+; Position=1-552
TKSPANPKLYAKLNACLNTLLDYKTSNGKKLAGPFVQLPSRREYPDYYDQIERPMDPQRIRKKIEEDKYTMLAQMSADVDLLCENAQRFNMDGSEIHEGSKLLNMVWRRIAEAIGGQGGKEEEDETTGRGGGAARHTPQQEEAAAAPSTSGHAKAPAEDDDVPVSAAAGPSTSSMMNSEKDTN

SEQ ID NO: 158836 - protein, 186 aa, Heterodera glycines
  Homolog annotation: Hit_ID=CAE58997.1; Match level="QueryCoverage =89%, HitCoverage=47%, E-value=2e-34, Identity=47%"; Hit description =Hypothetical protein CBG02270 [Caenorhabditis briggsae]
  Gene Ontology: Mol. function=protein binding
  Coding regions on vcDNA: vcDNA=SeqID_85259; Strand=+; Position=1-561
YAKAYGRMGVALSCQNRYDHAVEAYKKALELDPGNESYKNNLSIAEDKLLKTRETLRNNPQPNPFANMFGGPGGMGGLMNNPEMMSTITNIMQDPSMRNMMTQMVQSMGQPGQQNQDQGQAGNPSANAFSEMLRVGEALARSMQESNPDLVEQLRRQFGGEDGNDGGAGAGGNQNNNNQQPPPGSV

SEQ ID NO: 158837 - protein, 190 aa, Heterodera glycines
  misc_feature (79)..(79): Xaa can be any naturally occurring amino acid
  Homolog annotation: Hit_ID=AAQ82908.1; Match level="QueryCoverage =100%, HitCoverage=17%, E-value=3e-74, Identity=69%"; Hit description= ubiquitin-specific protease 7 isoform [Homo sapiens]
  Gene Ontology: Mol. function=ubiquitin-specific protease activity; Cellular component=nucleus; Biological process=pathogenesis
  Coding regions on vcDNA: vcDNA=SeqID_85260; Strand=+; Position=1-571
DTVILAVEVTADAPHGVNWDSKKDTGYIGLKNQGATCYMNSILQTLFFTNKLRKAVYQMPTEEDNPESSVALAMQRVFXELQFSDSPVGTKKLTKSFGWDSIDSFLQHDVQEFCRVLLDNLDSKMRNTKVNDTIPSLFKGRMKSYIKCKNVDFGSSREECFYDLQLNVKGKSNVLESFRDYIQLEILDGE

SEQ ID NO: 158838 - protein, 170 aa, Heterodera glycines
  Homolog annotation: Hit_ID=XP_448713.1; Match level="QueryCoverage =76%, HitCoverage=98%, E-value=1e-44, Identity=69%"; Hit description =unnamed protein product [Candida glabrata] emb|CAG61676.1| unnamed protein product [Candida glabrata CBS1
  Gene Ontology: Mol. function=DNA binding; Cellular component=nuclear nucleosome; Biological process=chromatin assembly/disassembly
  Coding regions on vcDNA: vcDNA=SeqID_85261; Strand=+; Position=1-513
VASPVKAGKATTKTTASGKGGKAKADGKVKTGGKGAKKAGGKGGKVKIAASGSKNTRSARAGVAFPVGRIHRLLRNGRHAQRIGAGAPVYMASVLEYLAAEVLELAGNAARENKKLRITPRHLQLAVRNDEELNKLLAEVTISRGGVLPNIHTELLSKMQQKKQQNDDSQ

SEQ ID NO: 158839 - protein, 160 aa, Heterodera glycines
  Homolog annotation: Hit_ID=AAN15806.1; Match level="QueryCoverage =89%, HitCoverage=55%, E-value=6e-49, Identity=61%"; Hit description =putative esophageal gland cell secretory protein 26 [Meloidogyne incognita]
  Coding regions on vcDNA: vcDNA=SeqID_85262; Strand=+; Position=3-482
GGSRAQEGTKGECVPDQGVRIDGRGQWQGYHALISSVQLFRFGGEVNAGQRIGVARDLECAGTRPKPRGDENFVRMELFREDKPIDPTHHLIDCMCTGQICETNRANALEGLPFKFDSRFNGVRGWEIVCPNVRPEEPNSSGESPEQSDNRQTMSPKIYS

SEQ ID NO: 158840 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_85263; Strand=+; Position=50-466

SEQ ID NO: 158841 - protein, 194 aa, Heterodera glycines
  Homolog annotation: Hit_ID=CAE63990.1; Match level="QueryCoverage =100%, HitCoverage=31%, E-value=8e-81, Identity=75%"; Hit description= Hypothetical protein CBG08583 [Caenorhabditis briggsae]
  Gene Ontology: Mol. function=translation factor activity, nucleic acid binding; Cellular component=cytosolic ribosome (sensu Eukarya); Biological process=protein biosynthesis
  Coding regions on vcDNA: vcDNA=SeqID_85264; Strand=+; Position=2-665
LTIAIGRRYGLVGPNGMGKTTLLKHIAARKLAIPPNIDILYCEQEIEADKTSAIETVLRSDKVRTELLEREKALIIQLEAGDISAGEKLQEVTSELKNIGAEAAEPRARRILAGLGFNKQMQEKAVEDFSGGWRMRVSLARALFLEPTLLLLDEPINHLDLNAVIWLDTYLQGWKKTLLVVSHDQSFLDNICTD

SEQ ID NO: 158842 - protein, 67 aa, Heterodera glycines
  Homolog annotation: Hit_ID=S01704; Match level="QueryCoverage=94%, HitCoverage=40%, E-value=7e-12, Identity=50%"; Hit description =merozoite surface antigen - Eimeria acervulina (fragment) emb|CAA30977.1| EAMZp35 protein [Eimeria acervulina]
  Coding regions on vcDNA: vcDNA=SeqID_85265; Strand=-; Position=365-568
SPDCPVSPSDCPLSSPDCPVSPSDCPLSSPDCPVSPSDCPLSSPDCPVSPSDCPLSSPDCPLSPRDC

SEQ ID NO: 158843 - protein, 175 aa, Heterodera glycines
  Homolog annotation: Hit_ID=XP_327860.1; Match level="QueryCoverage =89%, HitCoverage=30%, E-value=4e-11, Identity=31%"; Hit description =hypothetical protein [Neurospora crassa] gb|EAA29032.1| hypothetical protein [Neurospora crassa]
  Coding regions on vcDNA: vcDNA=SeqID_85266; Strand=+; Position=65-589
MKMVEKENDIAAAVPNNAANNGHVEAVDPSASKSAKEVPNNTEKHSAEDLMGLARLFLKEYYTKLSDLPSEAGIFYGDDSHFVHADVEETGRENIQRAIGNMGFEDCKARFYSLKTVSLPMQGDNAKLIQVCGELTLVKAAVQKQQPVLPRRFVQTIILAHQTPTVLYVKSDVFQ

SEQ ID NO: 158844 - protein, 55 aa, Heterodera glycines
  Homolog annotation: Hit_ID=AAD23639.1; Match level="QueryCoverage =85%, HitCoverage=28%, E-value=2e-09, Identity=60%"; Hit description =glycine-rich RNA binding protein 7 [Arabidopsis thaliana] emb|CAA78711.1| glycine rich protein [Arabidopsi
  Coding regions on vcDNA: vcDNA=SeqID_85267; Strand=+; Position=2-169
DRGGGGGGYRSGGGGGGGGYRGGGGNRDYSRSRSRSRSPYQRRGGGGGRSRSRSR

SEQ ID NO: 158845 - protein, 197 aa, Heterodera glycines
  Homolog annotation: Hit_ID=NP_494712.1; Match level="QueryCoverage =100%, HitCoverage=63%, E-value=2e-95, Identity=86%"; Hit description= proteasome Regulatory Particle, Non-ATPase-like, S13 (34.6 kD) (rpn -11) [Caenorhabditis elegans] gb|AAC2
  Gene Ontology: Mol. function=proteasome endopeptidase activity; Cellular component=26S proteasome; Biological process=proteolysis and peptidolysis
  Coding regions on vcDNA: vcDNA=SeqID_85268; Strand=+; Position=2-592
MLGEFVDDYTVNVIDVFAMPQSGTGVSVEAVDPVFQAKMLDMLKQTGRPEMVVGWYHSHPGFGCWLSGVDINTQQSFEALSDRAVAVVVDPIQSVKGKVVIDAFRTINPQAIALNQEPRQTTSNIGHLQKPSIQALIHGLNRHYYSIPIAYRTNENEQQMLLNLNKQSWMDSMNLVNYNEHCTRTEKAVEHMLKLAK

SEQ ID NO: 158846 - protein, 155 aa, Heterodera glycines
  Coding regions on vcDNA: vcDNA=SeqID_85269; Strand=-; Position=152-619
VQVPQLHFLLVIPHGAHIASPNCLALHPIDAPVVRDHCRVHPRTLCAALRLLLLLVVFAAAALRLVALSLGHFLCIFQCLFICVQIRQSKHQQFVVLCSVSQQQAKRSLENRSDCRPKSRTKHQNLNTDSSFRMCETTNTPPHRIPILRSPSKFG

SEQ ID NO: 158847 - protein, 66 aa, Heterodera glycines
  Homolog annotation: Hit_ID=AAO33474.1; Match level="QueryCoverage =100%, HitCoverage=47%, E-value=3e-24, Identity=81%"; Hit description= gland-specific protein g4g12 [Heterodera glycines]
  Coding regions on vcDNA: vcDNA=SeqID_85270; Strand=-; Position=182-382
QGGKAPGLGPSHVTNRSRAPPPPPGQFEKGANRLEKMRAPLRELAEKKPVKELKGLSPRGPDPHHH

SEQ ID NO: 158848 - protein, 32 aa, Heterodera glycines
  Coding regions on vcDNA: vcDNA=SeqID_85271; Strand=-; Position=6-104
IEGAMANFTPAKFISHMARRILKQKLNFFLAN

SEQ ID NO: 158849 - protein, 58 aa, Heterodera glycines
  Homolog annotation: Hit_ID=NP_496492.1; Match level="QueryCoverage =87%, HitCoverage=7%, E-value=5e-12, Identity=56%"; Hit description =Dyggve-Melchior-Clausen syndrome protein like, possibly N -myristoylated (78.2 kD) (2L967) [Caenorhabditis
  Coding regions on vcDNA: vcDNA=SeqID_85272; Strand=+; Position=1-177
IEWPSDRLKKFPDLRFKYIEDEDTVDFFVPYIWRLINDGLCLQFDAEAIRLFNVNGEQ

SEQ ID NO: 158850 - protein, 83 aa, Heterodera glycines
  Coding regions on vcDNA: vcDNA=SeqID_85273; Strand=+; Position=79-330
MEIIIDKINNSMERKSPTINGAGNNGKTKVFVVCHHGNDSQLAACHLHKQLSEAGIGDRFIVRDIVGGMDGWALEVDADFPRY

SEQ ID NO: 158851 - protein, 158 aa, Heterodera glycines
  Coding regions on vcDNA: vcDNA=SeqID_85274; Strand=+; Position=1-477
RPGRIHCKKKKSLHLSFRGTKSTHFSNEREAQKKQPKTHKRRPQTTKERDALTKICHAQKLTQQLRRVQSDWESASMVLRRGDAVVVKALQQDGFSLCDNAVSSGLVPVALLGPFDESFTAPFSPESPASGNEPHAIDLAVESAGHKQNNSDVPFASA

SEQ ID NO: 158852 - protein, 71 aa, Heterodera glycines
  Coding regions on vcDNA: vcDNA=SeqID_85275; Strand=+; Position=206-421
MGNRFRAFNLDNKKWQFRHTLNQKHHHHPMNGFFRSTNPKMVPMLRMHILWPTTTHHHHHHPPFSRKLILI

SEQ ID NO: 158853 - protein, 168 aa, Heterodera glycines
  Homolog annotation: Hit_ID=NP_498965.1; Match level="QueryCoverage =100%, HitCoverage=50%, E-value=2e-56, Identity=62%"; Hit description= arsenical pump-driving atpase (37.6 kD) (3J985) [Caenorhabditis elegans] emb|CAA77452.1| Hypothetical pr
  Gene Ontology: Biological process=anion transport
  Coding regions on vcDNA: vcDNA=SeqID_85276; Strand=+; Position=75-578
MSDEGQQLLESTLRNVLDQQSLRWIFVGGKGGVGKTTCSCSLAVQLAKYRRNVLIISTDPAHNISDAFNQKFTRSPTKVNGFDNLFAMEVDGSNFGDHGVPNLGDEDDKSDIFSIGKNFLADFAAGLPGVDEATSFSQMIKLIRSMDFEVVLFDTAPTGHTLRLLQFP

SEQ ID NO: 158854 - protein, 151 aa, Heterodera glycines
  misc_feature (81)..(81): Xaa can be any naturally occurring amino acid
  Homolog annotation: Hit_ID=NP_957208.1; Match level="QueryCoverage =88%, HitCoverage=31%, E-value=5e-36, Identity=54%"; Hit description =abhydrolase domain containing 2 [Danio rerio] gb|AAH47183.1| Abhydrolase domain containing 2 [Danio rerio
  Coding regions on vcDNA: vcDNA=SeqID_85277; Strand=+; Position=127-580
MEEGSQCATGPFVELAELFVQCSILQELYTPPSIWGRNGHLQTIAYGLLGHHSLKRTFDCRHLVRLSDGTTATFDLFEPVXHQNGGDFTLVFCPGIANCSESNYIRTCVHHAQEKGYRCAVLNHIGVPKNVQLTSQRIFSYGGNGEMEAMF

SEQ ID NO: 158855 - protein, 123 aa, Heterodera glycines
  Coding regions on vcDNA: vcDNA=SeqID_85278; Strand=-; Position=14-385
SQTLYNSSHNSKLIFRFGLFLRLQLLQILLVLREHFIGQFCEAFLLVLDLLKVVAEFRDFLQHRRQQFVVLCVQTIFVVQIIFVLLGQFVMEFAQSQVNFAQFVDGGLVFLSDHVQTVLRVDQ

SEQ ID NO: 158856 - protein, 127 aa, Heterodera glycines
  Coding regions on vcDNA: vcDNA=SeqID_85279; Strand=+; Position=160-543
MAEETSKTSENIAEDNGIKVLDSLFASVDHASKCLAFAAGTPNFCLATPAFLAVMVWCCFLMPPVAVLFRSYRRDGNAFTVQAAYNVILCFFLWMPGMLHALWFCFGETVRMLRRHVPPSDDAQKNE

SEQ ID NO: 158857 - protein, 33 aa, Heterodera glycines
  Coding regions on vcDNA: vcDNA=SeqID_85280; Strand=-; Position=0-98
TIRQHPNTIQRLPNTTQQLPTTVRQLPNTIQPL

SEQ ID NO: 158858 - protein, 154 aa, Heterodera glycines
  misc_feature (54)..(54): Xaa can be any naturally occurring amino acid
  misc_feature (66)..(66): Xaa can be any naturally occurring amino acid
  Homolog annotation: Hit_ID=NP_491117.1; Match level="QueryCoverage =97%, HitCoverage=50%, E-value=3e-39, Identity=54%"; Hit description =brix domain containing protein 1 (33.5 kD) (1D742) [Caenorhabditis elegans] gb|AAF60765.1| Hypothetical p
  Gene Ontology: Mol. function=rRNA binding; Cellular component =nucleolus; Biological process=ribosomal large subunit assembly and maintenance
  Coding regions on vcDNA: vcDNA=SeqID_85281; Strand=+; Position=3-466
DEFKQVKSVTLGSKPCIILQGHLFESNGILQRIGNLMVDLFRGPKVEYLPLQGXELIISLTALSEXGLNAEVYRASLKKDMESATPKIQLVEMGPNIDFKIDRTKLASDSLFKTALTKPHEVHKSAKKNVKFDAFGNKVAQVHTGRQSTDAIQT

SEQ ID NO: 158859 - protein, 70 aa, Heterodera glycines
  Homolog annotation: Hit_ID=CAH85743.1; Match level="QueryCoverage =97%, HitCoverage=68%, E-value=6e-34, Identity=100%"; Hit description= hypothetical protein PC403819.00.0 [Plasmodium chabaudi]
  Coding regions on vcDNA: vcDNA=SeqID_85282; Strand=+; Position=427-636
YGYPQNQGITQERTCEQKASKRPGTVKRPRCWRFSIGSAPLTSITKIDAQVRGGETRQDYKDTRRFPLEA

SEQ ID NO: 158860 - protein, 141 aa, Heterodera glycines
  Coding regions on vcDNA: vcDNA=SeqID_85283; Strand=-; Position=122-547
MFNVLICLADIAALCCCCCCCRFSLVGGSYTFDSDIDRFFVRRPGTAFDGRLRCRCCSPSDSVLSSTANFRCSSLIFTMRRERFDGPAAEDCTNGELERRLPFWVILPLLRRTSGRIFWSSLHCWRPTAFCSSLFAAWKTR

SEQ ID NO: 158861 - protein, 193 aa, Heterodera glycines
  Homolog annotation: Hit_ID=NP_490962.1; Match level="QueryCoverage =100%, HitCoverage=23%, E-value=1e-69, Identity=67%"; Hit description= DNA replication licensing factor Mini Chromosome Maintenance, abnormal cell LINeage LIN-6, LEThal LET-35
  Gene Ontology: Mol. function=electron transporter activity; Cellular component=cytoplasm; Biological process=nuclear organization and biogenesis
  Coding regions on vcDNA: vcDNA=SeqID_85284; Strand=+; Position=2-580
DKMSDGTRSILHEVMEQQTLSIAKAGIICQLNARTSVLAAANPIDSKWNKRKNIVKNVNLPHTLLSRFDLIFLVLDPQDEAYDRRLARHLVNFYLESDGEMDKQQRVDMAFLRDYIAYAKQNVQPELTDETVQLLTDKYQFMRQQGQQAGLISAYPRQLESLIRLAEAFAKMRLSPTVTESDVEMAYALHREA

SEQ ID NO: 158862 - protein, 184 aa, Heterodera glycines
  Homolog annotation: Hit_ID=CAE68824.1; Match level="QueryCoverage =100%, HitCoverage=25%, E-value=2e-70, Identity=69%"; Hit description= Hypothetical protein CBG14783 [Caenorhabditis briggsae]
  Gene Ontology: Mol. function=long-chain-fatty-acid-CoA-ligase activity; Cellular component=lipid particle; Biological process =gametogenesis
  Coding regions on vcDNA: vcDNA=SeqID_85285; Strand=+; Position=3-554
ADEHDLSTGSVGPPLRSCEIRLREWTEAGYLPSNSPPQGEVLIHGANVALGYFKNEEKTKEDFVELDGKRWFATGDIGEFREDGSLCIIDRKKDLIKLAHGEYIALGKVETAPLTNPNVDDICVYGESHKDYLIALVVPNLKNLQVLAEKNDVNEPSIERICANKEMPKILQKELHSFVSGKLR

SEQ ID NO: 158863 - protein, 168 aa, Heterodera glycines
  Homolog annotation: Hit_ID=XP_465169.1; Match level="QueryCoverage =94%, HitCoverage=32%, E-value=3e-09, Identity=31%"; Hit description =putative cockayne syndrome 1 homolog [Oryza sativa (japonica cultivar-group)] dbj|BAD23590.1| putative co
  Coding regions on vcDNA: vcDNA=SeqID_85286; Strand=+; Position=100-603
MRNSAKLFHSDRIVCLRCTSDGRFLLSLSQNRNVCVWDAETMRMLCHLKVPESEGGLSTFPVQFELCDEGRLIWLFIPNSNNVTVVGIADPKLFSNRPIVGNIHFQTLRGHFQNVLSCAYRKEYNQLITSSTDRLILVWAPKMDEFRSDSAIQQIRQQLHEDAFSDDE

SEQ ID NO: 158864 - protein, 128 aa, Heterodera glycines
  Homolog annotation: Hit_ID=XP_310658.1; Match level="QueryCoverage =84%, HitCoverage=81%, E-value=7e-33, Identity=60%"; Hit description =ENSANGP00000020734 [Anopheles gambiae]
  Gene Ontology: Biological process=sporulation (sensu Saccharomyces)
  Coding regions on vcDNA: vcDNA=SeqID_85287; Strand=+; Position=3-389
LNRRHSLSFYALFATFTQRKLAKKATMGKERLGEEQRKELLEPLLKEGWETVQERDAIKKSFTFKDFNQAFGFMTRIALKADKMDHHPEWFNVYNKVDITLSSHDVQGISERDVKLASFIENVFKTVK

SEQ ID NO: 158865 - protein, 55 aa, Heterodera glycines
  misc_feature (11)..(11): Xaa can be any naturally occurring amino acid
  Coding regions on vcDNA: vcDNA=SeqID_85288; Strand=+; Position=101-265
MADTPPPPPPXPPAAAAAAGGGDEAVDLEQRVRQLIMSIGLRNEHAAREISILIE

SEQ ID NO: 158866 - protein, 187 aa, Heterodera glycines
  Homolog annotation: Hit_ID=NP_499447.1; Match level="QueryCoverage =80%, HitCoverage=25%, E-value=7e-55, Identity=70%"; Hit description =s6 kinase (3M341) [Caenorhabditis elegans] emb|CAB55075.1| Hypothetical protein Y47D3A.16 [Caenorhabditis
  Gene Ontology: Mol. function=protein serine/threonine kinase activity; Cellular component=nucleus; Biological process=signal transduction
  Coding regions on vcDNA: vcDNA=SeqID_85289; Strand=+; Position=2-565
WWSLGALTFDMLTGGPPFSAENRKRTIDKILKGRLTLPPYLSFEAKDLIKRLLKRHVDTRLGAGPGDAEEIKKHAFFTHHVENWTNVYRREIEAPYKPNITSEEDASLFDSKFTKMTPVDSPTAELPPMSVNPFEGFTYIAPSVLEQVSQPTLVRPRQQRKIHGPAIFHSFHPHQSTTDNGPLEEME

SEQ ID NO: 158867 - protein, 217 aa, Heterodera glycines
  Homolog annotation: Hit_ID=XP_420565.1; Match level="QueryCoverage =100%, HitCoverage=20%, E-value=4e-42, Identity=45%"; Hit description= PREDICTED: similar to DNA helicase HEL308 [Gallus gallus]
  Gene Ontology: Mol. function=theta DNA polymerase activity; Biological process=DNA repair
  Coding regions on vcDNA: vcDNA=SeqID_85290; Strand=+; Position=1-651
RRRTAKSIYICTIEKANGLVNSLIENGRAHELGLVIVDEIHMLGEQGGRGALLEQCLCKLLFRPTNEQQQERVQLIGMSATLGNASELCRFLGANLFRTHFRPVALIERIKLHDKLFRVDEQGEWRMEKELEKGNKELERRDPDGLFKLLGNLLKGSVLIFCPTKQSCENVCQMLSNFSPKQLRDHRADERNALIGRLMDEHEGLICPVLSACIRNG

SEQ ID NO: 158868 - protein, 166 aa, Heterodera glycines
  misc_feature (38)..(38): Xaa can be any naturally occurring amino acid
  misc_feature (77)..(77): Xaa can be any naturally occurring amino acid
  Homolog annotation: Hit_ID=CAE56905.1; Match level="QueryCoverage =100%, HitCoverage=42%, E-value=5e-53, Identity=57%"; Hit description= Hypothetical protein CBG24746 [Caenorhabditis briggsae]
  Gene Ontology: Biological process=sulfur amino acid metabolism
  Coding regions on vcDNA: vcDNA=SeqID_85291; Strand=+; Position=2-500
REGNPTRDVLQESIATLESARHCRIFSSGLAAIAACVXLLNSGQHVIASGDCNGGTKNYFDKICVPHHGLELSPVDXTRLENLENEFKPNTKMALCETPSNPLLKIVDIEAVCRMVRARSKDCVVLVDNTFMTPYFQRPLELGADVTVQSLTKDINGHTDVLMGTV

SEQ ID NO: 158869 - protein, 49 aa, Heterodera glycines
  Coding regions on vcDNA: vcDNA=SeqID_85292; Strand=-; Position=1-147
MCDSISCSNCSSCTNERQPDWALSSTDCLRGFLPNIALVNADSPPPPPP

SEQ ID NO: 158870 - protein, 95 aa, Heterodera glycines
  Homolog annotation: Hit_ID=NP_998483.1; Match level="QueryCoverage =87%, HitCoverage=13%, E-value=6e-19, Identity=50%"; Hit description =delta isoform of regulatory subunit B56, protein phosphatase 2A [Danio rerio] gb|AAH67382.1| Delta isofor
  Gene Ontology: Mol. function=protein phosphatase type 2A, intrinsic regulator activity; Cellular component=nucleus; Biological process =signal transduction
  Coding regions on vcDNA: vcDNA=SeqID_85293; Strand=+; Position=1-288
PSLYKNSRNHWSKTIHGLIYNALKLFMEENQKLFDLCVQNFNKQKEQEQQKQQNNRRRWELLEKAAMENARAIRQQQTDGEAEPYSIGEGEKKPK

SEQ ID NO: 158871 - protein, 156 aa, Heterodera glycines
  Homolog annotation: Hit_ID=NP_498663.1; Match level="QueryCoverage =98%, HitCoverage=99%, E-value=2e-50, Identity=56%"; Hit description =deaminase (3I668) [Caenorhabditis elegans] gb|AAK84461.1| Hypothetical protein R13A5.10 [Caenorhabditis e
  Gene Ontology: Cellular component=mitochondrion
  Coding regions on vcDNA: vcDNA=SeqID_85294; Strand=+; Position=2-472
AQNEFMRAAVEEGIRGVQSGDGGPFGAVIVKNGKIIAQGHNMVLFSNDPTAHAEVMALRGASKVLDSFDLSGCILYTSCYPCPMCLGAVLWSRISNVFYAAAPTDAASVGFDDQNFHEFVSNPKKYEKLMALEHLPVEGHMKVFKMWEQRDEKRMY

SEQ ID NO: 158872 - protein, 126 aa, Heterodera glycines
  Homolog annotation: Hit_ID=EAA05601.2; Match level="QueryCoverage =94%, HitCoverage=29%, E-value=1e-10, Identity=33%"; Hit description =ENSANGP00000012577 [Anopheles gambiae str. PEST]
  Coding regions on vcDNA: vcDNA=SeqID_85295; Strand=+; Position=1-381
GADGQVPAKYKSTLCNIWLMEGICTRGKQCHYAHGIEELNYRQDDTMSRFYKTSLCTFYQQRGFCNNGDQCRWAHGEAELRKGADGSSNGLANYYAATMQAMATGQQNANGSSAEAAAAAAAAGWN

SEQ ID NO: 158873 - protein, 125 aa, Heterodera glycines
  Coding regions on vcDNA: vcDNA=SeqID_85296; Strand=-; Position=1-375
IIHALLFPVVVVVVLVEQLQIEPVLTDCFASITLDQQAQQIQFISSASNSSFFWFIFCCSTRFGILLLHIIHKCFPDRDCFFSANLVHVLAQCRATDHCPILEFIHHYYVCHIFQFEWKNVKSTV

SEQ ID NO: 158874 - protein, 98 aa, Heterodera glycines
  Coding regions on vcDNA: vcDNA=SeqID_85297; Strand=+; Position=1-294
FFFFFFFGTHSLCVLEKTHKNIIVKRKKHHPIILNVNKSKGREWKEMPTMRRIQTNLSQKLIQPNESAAPPNSPPFVYLVTGIRSQIEVLFPNVGCPN

SEQ ID NO: 158875 - protein, 189 aa, Heterodera glycines
  Homolog annotation: Hit_ID=NP_508952.2; Match level="QueryCoverage =95%, HitCoverage=64%, E-value=7e-57, Identity=57%"; Hit description =amidinotransferase family member (XG273) [Caenorhabditis elegans] gb|AAB04595.2| Hypothetical protein T22
  Coding regions on vcDNA: vcDNA=SeqID_85298; Strand=+; Position=13-579
MANAPTKLIRLLMCRPTHFNVKYEINPWMRPGDPVNVQKATDQWERLKRTLEESGAQVEVMEPVGADNYPDLVFTANAAVVRGKNALLSNFFYPERKGEQHFYDRWFKQNGYETFKDLHVPFEGAGDALWIGKSKLFCGIGPRTDVRALTLISEKLRDYGAPFKVYGFRLIDPRFYHIDTCFCPLNDQI

SEQ ID NO: 158876 - protein, 75 aa, Heterodera glycines
  Coding regions on vcDNA: vcDNA=SeqID_85299; Strand=-; Position=284-511
MRTIAPLRLPSPPPPPLHRRHRSPFPVRSRFVHPLAVLFLLSPLFLWFQTVFPLFVLPFSLFGVVVADSSFACKE

SEQ ID NO: 158877 - protein, 50 aa, Heterodera glycines
  Coding regions on vcDNA: vcDNA=SeqID_85300; Strand=+; Position=35-187
CQHGRKKSPDRTDLLHSVAPGRSFSMHGGIGHYGLDPQHSAVHNQLCVLA

SEQ ID NO: 158878 - protein, 204 aa, Heterodera glycines
  Homolog annotation: Hit_ID=NP_495422.1; Match level="QueryCoverage =84%, HitCoverage=23%, E-value=1e-16, Identity=34%"; Hit description =folliculin like (2H237) [Caenorhabditis elegans] gb|AAK31497.1| Hypothetical protein F22D3.2a [Caenorhabd
  Coding regions on vcDNA: vcDNA=SeqID_85301; Strand=+; Position=38-649
MTMQTAVALCYFCENHGSRVVVVCQPMRNCELPRPNSANSMGGPIVNDRQPQQQQPSTSSFVHCQDCDGDGNVAESPQLFTDFFADNEVVDDEARCAACSSFEHGVGLMSKDGDAEISYISTQVPRNERLGHLLRQASLRSLSVEISVPLPTTDRSHSNHIDASPSSSSSDFRPKYDQRIGNVRGDFTERDGIVLFGDDEHWYT

SEQ ID NO: 158879 - protein, 192 aa, Heterodera glycines
  misc_feature (165)..(165): Xaa can be any naturally occurring amino acid
  misc_feature (183)..(183): Xaa can be any naturally occurring amino acid
  Homolog annotation: Hit_ID=AAN32888.1; Match level="QueryCoverage =100%, HitCoverage=56%, E-value=1e-100, Identity=98%"; Hit description=annexin 4C10 [Heterodera glycines]
  Gene Ontology: Mol. function=phospholipid binding; Cellular component= plasma membrane; Biological process=skeletal development
  Coding regions on vcDNA: vcDNA=SeqID_85302; Strand=+; Position=37-612
MLQNGLTILLLISVVIGHSLANLGPTIKHNPHFKAVQTAHHLHDAIAKKHEAEVTQVICSISNEQRQALALEFKKQFGTDLIAMLKKEFKSDFEELIISLMQTPAVYDANQMRAALSGSNEAVLIEILATRTNRQITAPKQAYEQLDRRHQHNQLEEDIKAKTKXTLPKSVGVFAQLLSRRKXPASIVLAHD

SEQ ID NO: 158880 - protein, 135 aa, Heterodera glycines
  Homolog annotation: Hit_ID=AAP41028.1; Match level="QueryCoverage =100%, HitCoverage=33%, E-value=4e-71, Identity=99%"; Hit description= arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_85303; Strand=+; Position=3-410
VNEEDHLRIISMQKGGDVGNVLKRLIRGVKGIEKQVPFARDDRLGYLTFCPPNLGTTIRASVHIRLPKISAKPEFKKICEDLKLQVRGIHGEHSESEGGVYDVSNKARLGLTEFEAVKQMYDGVKKLIELEKASK

SEQ ID NO: 158881 - protein, 137 aa, Heterodera glycines
  Homolog annotation: Hit_ID=NP_509390.2; Match level="QueryCoverage =97%, HitCoverage=63%, E-value=8e-45, Identity=63%"; Hit description =putative protein family member, with at least 3 transmembrane domains (XI852) [Caenorhabditis elegans]
  Coding regions on vcDNA: vcDNA=SeqID_85304; Strand=+; Position=22-435
MAHLNTGYLSTNRGVIKILQIICGFITCSLLCANWYGGKTCFFEGRLGYASGLNFVIVIINIVLFFLNFLSMAAYRMERIYSVIGTILFIVAFICMVWYLIDYDINRGQLIAATVFIGIQMVLFIWDYQILHGQAFN

SEQ ID NO: 158882 - protein, 107 aa, Heterodera glycines
  Homolog annotation: Hit_ID=AAH79755.1; Match level="QueryCoverage =75%, HitCoverage=84%, E-value=2e-20, Identity=60%"; Hit description =Unknown (protein for IMAGE:6951677) [Xenopus laevis]
  Gene Ontology: Mol. function=structural constituent of cytoskeleton; Cellular component=intermediate filament; Biological process =cellular morphogenesis
  Coding regions on vcDNA: vcDNA=SeqID_85305; Strand=+; Position=44-367
MQKMNSATMFTLLLIIGTVLALTIGMPAPGGSDESVASMRQKRGYGMSNGGGMGNGFGGGMGNGFGGGMGNGFGGGMGNGFGGGMGNGFGGGMGGGSGGGYGYGKRR

SEQ ID NO: 158883 - protein, 92 aa, Heterodera glycines
  Coding regions on vcDNA: vcDNA=SeqID_85306; Strand=+; Position=3-281
FALFLLLLILENSLGQFPTSSTTEKTITEYVPWLYRFGQKLMPCQDNIPSDECQKHENDCQDTIKRREMALFCCGTCRTLYPNFLPKQSGRK

SEQ ID NO: 158884 - protein, 177 aa, Heterodera glycines
  Homolog annotation: Hit_ID=AAN32892.1; Match level="QueryCoverage =100%, HitCoverage=83%, E-value=5e-99, Identity=100%"; Hit description=secretory protein 4D06 [Heterodera glycines]
  Coding regions on vcDNA: vcDNA=SeqID_85307; Strand=+; Position=50-580
MSSLLLSIFPIVFLVCCNAMPNFPCCPGSQQVVAVMSKYIDTFSSAADESTVCSTAKSTVDGIKNELSYRVGCPSGGEAQIVNEIDRQLKNIAKMEINYEDECPYNLGFARAMFDLAAAAAGHAGNGTEWQYMKVQFEQESQAIKAIGQEKNFEVTDVHFGVPSKGVSAHQNVPSPS

SEQ ID NO: 158885 - protein, 175 aa, Heterodera glycines
  Homolog annotation: Hit_ID=AAH65093.1; Match level="QueryCoverage =82%, HitCoverage=14%, E-value=7e-13, Identity=37%"; Hit description =Ankrd27 protein [Mus musculus]
  Gene Ontology: Mol. function=transcription factor activity; Cellular component=membrane; Biological process=regulation of transcription, DNA-dependent
  Coding regions on vcDNA: vcDNA=SeqID_85308; Strand=+; Position=102-626
MADDIPPPPAVAADGGDVVVDLEQHVRQLIMSIGQGSEDAVHELSILIESFNQEQLVDFLEIMARIYVESGVSVDMPGGQGINMLMVAASSGRVDFARYLLAHGATVGHLDATGSVFPLMLAAESGELEVCRLLVGEWAAEVNQQAIDGTTPLMSASSEGRLDVVIYLIDHGAEI

SEQ ID NO: 158886 - protein, 160 aa, Heterodera glycines
  Homolog annotation: Hit_ID=AAN32890.1; Match level="QueryCoverage =100%, HitCoverage=96%, E-value=3e-84, Identity=100%"; Hit description=secretory protein 4D09 [Heterodera glycines]
  Coding regions on vcDNA: vcDNA=SeqID_85309; Strand=+; Position=51-530
MAKFVAIALLSLTIVSMALAKTGKSQTADEVEGFRNMNIGDNNKVDAGKEPAADKATKKGKAQKAGTKSAAATNEPAAAKGTKNGKAPKTKAKQEVATNEPAAANEWNDQLMGMSVEKFNEELAVLLPKANTFMENALSFINEQVEKNGIATGAAGDSCS

SEQ ID NO: 158887 - protein, 177 aa, Heterodera glycines
  Homolog annotation: Hit_ID=CAE62006.1; Match level="QueryCoverage =99%, HitCoverage=23%, E-value=4e-75, Identity=78%"; Hit description =Hypothetical protein CBG06014 [Caenorhabditis briggsae]
  Gene Ontology: Mol. function=heat shock protein activity; Cellular component=endoplasmic reticulum; Biological process=response to stress
  Coding regions on vcDNA: vcDNA=SeqID_85310; Strand=+; Position=1-531
IRGLVDSDDLPLNVSREMLQQHKLLKVIKKKLVRKVLDMLKKISPEKFDEFWKEYSTNLKLGVMEDPSNRNRLAKLLRFHSSADSAKQTTLEAYVERMKEKQQAIYYIAGSSREEVENSPFVERLLKKGFEVLYLTEPVDEYCIQSMPEFEGKKFQNVAKEGLKLDEGSKSEEQHKL

SEQ ID NO: 158888 - protein, 195 aa, Heterodera glycines
  Homolog annotation: Hit_ID=AAT02161.1; Match level="QueryCoverage =98%, HitCoverage=90%, E-value=9e-40, Identity=44%"; Hit description =hypothetical protein L3ni22 [Dictyocaulus viviparus]
  Coding regions on vcDNA: vcDNA=SeqID_85311; Strand=+; Position=1-588
IAFLLLVLAKGFEGYTFSCLDGCECDTDDEAIHCHNRPDRHFVQLPPSRLRGFTVLALTRNNIDVLPSEEVLLEKLPDLKAVDVEGNEHFDCSTLDHYRTLMVMSDCGKTPEQLEADRAKLPTDTQPNEDCDFECVANRRSRELREYVKHLWEMVKEKVSRLAKKHGLDKVVDDVGNFFNDVGERISNIKLKKKK

SEQ ID NO: 158889 - protein, 85 aa, Heterodera glycines
  Coding regions on vcDNA: vcDNA=SeqID_85312; Strand=-; Position=2-256
NVNFCFTIDSFLILSFLYGINSQCFFSFFFVFLTFLALPFPKGLAVHFIAPWAHHSRHKTSSPRAGCTPSTKNGRRSRGRRRGDG

SEQ ID NO: 158890 - protein, 193 aa, Heterodera glycines
  Homolog annotation: Hit_ID=EAA59800.1; Match level="QueryCoverage =95%, HitCoverage=32%, E-value=8e-89, Identity=78%"; Hit description =hypothetical protein AN3592.2 [Aspergillus nidulans FGSC A4] ref|XP _407729.1| hypothetical protein AN3592.
  Gene Ontology: Mol. function=chaperone activity; Cellular component =integral to membrane; Biological process=intracellular protein transport
  Coding regions on vcDNA: vcDNA=SeqID_85313; Strand=+; Position=1-579
KIADPEAKKPEDWDEDAPFEIVDEEAEKPADWLENEPLQVPDPEAEKPEDWDDEEDGDWIPPMVSNSKCDEVSGCGPWEKPTIRNPAYKGKWNAPKIDNPAYKGVWKPRKIANPDYFEDKTPANFEPVGAIGFELWTMQNDILFDNIYIGHSEADAKALQTETFDVKVAVEKEEEEKSKPKKEDKKPDIKSPM

SEQ ID NO: 158891 - protein, 183 aa, Heterodera glycines
  Homolog annotation: Hit_ID=CAE73236.1; Match level="QueryCoverage =57%, HitCoverage=11%, E-value=1e-12, Identity=33%"; Hit description =Hypothetical protein CBG20645 [Caenorhabditis briggsae]
  Coding regions on vcDNA: vcDNA=SeqID_85314; Strand=+; Position=2-553
AELKSIEQNHNSNSTSATGTISSTDSNSDEHNDTSSRAKFTSNFERIANAYIKFVSNIFASIGIVIVSAVFFVICFRAVLGFEINLTMVKLFPPDSPLLEVDNYREDKLVPFYTMAQIFVNNPGDLSNNYVKDFNVSVLHDFGLFLGLLENMQDPVVIAGVIISIGFSVDIPAHISAFYGHII

SEQ ID NO: 158892 - protein, 147 aa, Heterodera glycines
  Homolog annotation: Hit_ID=AAN32888.1; Match level="QueryCoverage =100%, HitCoverage=43%, E-value=2e-75, Identity=99%"; Hit description= annexin 4C10 [Heterodera glycines]
  Gene Ontology: Mol. function=phospholipid binding; Cellular component= nucleoplasm; Biological process=skeletal development
  Coding regions on vcDNA: vcDNA=SeqID_85315; Strand=+; Position=38-478
MLQNGLTILLLISVVIGHSLANLGPTIKHNPHFKAVQTAHHLHDAIAKKHEAEVTQVICSISNEQRQALALEFKKQFGTDLIAMLKKEFKSDFEELIISLMQTPAVYDANQMRAALSGSNEAVLIEILATRTNRQITALKQAYEQLD

SEQ ID NO: 158893 - protein, 164 aa, Heterodera glycines
  Homolog annotation: Hit_ID=CAE64972.1; Match level="QueryCoverage =100%, HitCoverage=9%, E-value=2e-71, Identity=79%"; Hit description =Hypothetical protein CBG09806 [Caenorhabditis briggsae]
  Gene Ontology: Mol. function=structural molecule activity; Cellular component=clathrin coat; Biological process=intracellular protein transport
  Coding regions on vcDNA: vcDNA=SeqID_85316; Strand=+; Position=2-493
GRLTELEEFITEPNHAQIQLVGDRCAEDGMNDAARILFISISNFAKLAKTLVELGDFPGAVDAGRKANSTKTWKQICFACVNHQEFRLAQICGLHIVVHADELDELINYYQNRAHFDELIALLENALGLERAHMGMFTELAILYSKYKTEKMREHLELSWSRVN

SEQ ID NO: 158894 - protein, 129 aa, Heterodera glycines
  misc_feature (46)..(46): Xaa can be any naturally occurring amino acid
  Coding regions on vcDNA: vcDNA=SeqID_85317; Strand=+; Position=3-392
VPVQGSKYAADLSQRRRFAGPRRNYFFRGNRNRRPRHSEEAAGGVXSVGEKKEGAEENNGKEAKKEEVAKDANGGRGGGQRRGRGVRFRGRRNNRRNVAGSTSGGTENEGEQKKEQTQPEEETKVNGGE

SEQ ID NO: 158895 - protein, 61 aa, Heterodera glycines
  misc_feature (30)..(30): Xaa can be any naturally occurring amino acid
  misc_feature (46)..(46): Xaa can be any naturally occurring amino acid
  Homolog annotation: Hit_ID=YP_096749.1; Match level="QueryCoverage =100%, HitCoverage=65%, E-value=2e-18, Identity=72%"; Hit description= hypothetical CTC00065, TC0129 [Legionella pneumophila subsp. pneumophila str. Philadelphia 1] ref|YP_094
  Coding regions on vcDNA: vcDNA=SeqID_85318; Strand=-; Position=1-183
YPLSDGPSIQNHRINKTSFRTCSTCRSRSXARLCHCTISTISDRTXRTFVLLRYALGGDRP

SEQ ID NO: 158896 - protein, 45 aa, Heterodera glycines
  Coding regions on vcDNA: vcDNA=SeqID_85319; Strand=-; Position=1-135
KKSWRIWSAFTRLLLYVGLLASRLGFAVLLFSGEWGICRRSALRC

SEQ ID NO: 158897 - protein, 75 aa, Heterodera glycines
  Coding regions on vcDNA: vcDNA=SeqID_85320; Strand=-; Position=316-543
NRCRHAHASSCTVVGTKQQVQYSTVHNSGKITKKYNILVTYLPKIQKSAAYFLVEHFFILSNRIIIKKINKKNFF

SEQ ID NO: 158898 - protein, 129 aa, Heterodera glycines
  Coding regions on vcDNA: vcDNA=SeqID_85321; Strand=+; Position=3-392
VPVQGSKYAADLSQRRRFAGPRRNYFFRGNRNRRPRHSEEAAGGEVPVGEKKEGAEENNGKEAKKEEVAKDANGGRGGGQRRGRGVRFRGRRNNRRNVAGSTSGGTENEGEQKKEQTQPEEETKVNGGE

SEQ ID NO: 158899 - protein, 232 aa, Heterodera glycines
  misc_feature (218)..(219): Xaa can be any naturally occurring amino acid
  Coding regions on vcDNA: vcDNA=SeqID_85322; Strand=+; Position=2-697
EASSSHRTDESPPAINLNESNSLSHRHLAEEANASVAGDSATESTTTAAAALLVKKGRRRELDGLLKMDFGKHSPFQTSDPDKYAQEVLIEARQQQRTLALAQEEQRNARRSVESSCGGSATGKSSKRDKYAKKPFSPPVSPLPESRAASVRSTTPTLQLRAKNHGEKASSSSKLATASGIGKPTKEGTTTSVENKLKTSPKDSFSLEQRRSGGSNVXXEGEERCLYCRRSF

SEQ ID NO: 158900 - protein, 78 aa, Heterodera glycines
  Coding regions on vcDNA: vcDNA=SeqID_85323; Strand=-; Position=65-301
TPPNSSHISVEFWRQFWPCVCQKHVSIQINARTCTRSPSNAFSPCITRKLSTPQHSARPKSQRRLVVRTSLANWPKRW

SEQ ID NO: 158901 - protein, 195 aa, Heterodera glycines
  Coding regions on vcDNA: vcDNA=SeqID_85324; Strand=-; Position=2-586
VRELLLHAFHRLFVVRSVDLVEEAPNCVRVHRLRLHQKNAFARPKFVQHFARLFAQCPLHVTDRILRQNRLLTCEGGQRSAQRPLAHLCRLFQHFAVQFLLDRSADIGRQRRQCRTVQQRAVGLLQQKHQLLLIEHSVILFVQCANSELQRLAKVGPLSVHFRPTFRFNFDLALFAAYINLPVLHNFHTFCRPFP

SEQ ID NO: 158902 - protein, 44 aa, Heterodera glycines
  Coding regions on vcDNA: vcDNA=SeqID_85325; Strand=+; Position=1-135
FFFFFFFGPDCLCVLEKTHKNIFVKRRKLFSIILNVNKSKGREW

SEQ ID NO: 158903 - protein, 151 aa, Heterodera glycines
  Coding regions on vcDNA: vcDNA=SeqID_85326; Strand=+; Position=94-546
SANCSLITPNNKTMLLPTMAPKCLPLELLFEIVPLIPAENATPNALSSCWLLHKLLLPRVIKWKEIKMHAENIVWLEKYPRYFRINWNGMEDRRIDRYEAFVKQLSGVDDWARIGSLPVRSSMESYSLTFQVGAPSNEEYKFKIIAIDARG

SEQ ID NO: 158904 - protein, 176 aa, Heterodera glycines
  Homolog annotation: Hit_ID=NP_504653.2; Match level="QueryCoverage =94%, HitCoverage=72%, E-value=1e-34, Identity=43%"; Hit description =ubiquitin -terminal (25.3 kD) (5G986) [Caenorhabditis elegans] gb|AAM43789.1| Ubiquitin c-terminal hydrol
  Gene Ontology: Mol. function=ubiquitin-specific protease activity; Cellular component=cytoplasm; Biological process=protein deubiquitination
  Coding regions on vcDNA: vcDNA=SeqID_85327; Strand=+; Position=140-667
MAGEEKRITWVPLESNPEAFNKYIEKMGVKGAECHELFGFEPDLVSFVPGPHLALIFCYPYQDKANDYQKGIYGQLTASDKGGVPEWAFFMKQKIHNACGTFALFHALTNNTDRIDIGNGVFYDWFKAAKQLNVEQRSDLLANDSELAHLHEHCALRESETDVPRNVAHHFISYTH

SEQ ID NO: 158905 - protein, 195 aa, Heterodera glycines
  Homolog annotation: Hit_ID=CAE59703.1; Match level="QueryCoverage =100%, HitCoverage=37%, E-value=7e-77, Identity=69%"; Hit description= Hypothetical protein CBG03134 [Caenorhabditis briggsae]
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_85328; Strand=+; Position=1-585
IHGTRSAVTFICEQPDIKAISFVGSDQAGKYIYEHGSKFGKRVQSNMGAKNHGVILPDANREHTLNQVAAAAFGAAGQRCMALSTAIFVGDARGWVSDLVERARKLRVGPGWEAGTDIGPVISQKAKERICELVESALEEGADVPLDGTNVTVKGFEKGNFVGPTVITGVKPEMLCYKEEIFGPVLCVLETETLD

SEQ ID NO: 158906 - protein, 157 aa, Heterodera glycines
  Homolog annotation: Hit_ID=AAN32890.1; Match level="QueryCoverage =100%, HitCoverage=94%, E-value=6e-81, Identity=98%"; Hit description= secretory protein 4D09 [Heterodera glycines]
  Coding regions on vcDNA: vcDNA=SeqID_85329; Strand=+; Position=51-521
MAKFVAIALLSLTIVSMALAKTGKSQTADEVEGFRNMNIGDNNKVDAGKEPAADKATKKGKAQKAGTKSAAATNEPAAAKGTKNGKAPKTKARQEVATNEPAAANEWNDQLMGMSVEKFNEELAVLLPKANTFMENALSFTNEQMEKNGIATGAAGD

SEQ ID NO: 158907 - protein, 94 aa, Heterodera glycines
  Homolog annotation: Hit_ID=CAE60896.1; Match level="QueryCoverage =84%, HitCoverage=19%, E-value=1e-26, Identity=65%"; Hit description =Hypothetical protein CBG04611 [Caenorhabditis briggsae]
  Gene Ontology: Mol. function=protein farnesyltransferase activity; Cellular component=protein farnesyltransferase complex; Biological process=C-terminal protein farnesylation
  Coding regions on vcDNA: vcDNA=SeqID_85330; Strand=+; Position=311-592
MFQNNICQKLSNPKVNCKTYEGGFGGEPNCEAHSGYTFCALASLSLLRKVHLVNRDSAIRWLVNRQMSSEGGFQGRANKLVDGCYSYWNTACFS

SEQ ID NO: 158908 - protein, 186 aa, Heterodera glycines
  Coding regions on vcDNA: vcDNA=SeqID_85331; Strand=+; Position=1-558
EVPPIAPSVGQMSVDILSRHFGLTWEQLMAQFVLKLQIRERVDDTEAVFMDIEEAEWDTKLVEHRTIYKAMLYPKLEEEKNSDGKCDVKVPKLPADAEPLAKRGGQIVFRMTNFKSFSKGCGPKIVFSEPSVPINGMPWRIRVKHCDECVRVDLFCAADQNDMAWSCRAAFTVGVLSCANSDVYVK

SEQ ID NO: 158909 - protein, 170 aa, Heterodera glycines
  misc_feature (157)..(157): Xaa can be any naturally occurring amino acid
  Homolog annotation: Hit_ID=AAN32891.1; Match level="QueryCoverage =100%, HitCoverage=34%, E-value=5e-93, Identity=99%"; Hit description= secretory protein 5D06 [Heterodera glycines]
  Coding regions on vcDNA: vcDNA=SeqID_85332; Strand=+; Position=50-559
MKNSFLFLLQIFILTNILTEILCGDKSRPSTEINANLGTRKKPETITATKNANLGTGKMHETDGTSKMPKHGKPVSNRMAAKSTTIKNNNEAAGPSQQSKQPAANITPQQKGPMQNSKKQPPNELFGKKQRSTPEEIKAGKQPAMELMPCYRGIGKXTMPTIAQRNATML

SEQ ID NO: 158910 - protein, 184 aa, Heterodera glycines
  Homolog annotation: Hit_ID=CAE64431.1; Match level="QueryCoverage =84%, HitCoverage=15%, E-value=3e-35, Identity=48%"; Hit description =Hypothetical protein CBG09134 [Caenorhabditis briggsae]
  Gene Ontology: Mol. function=transcriptional repressor activity; Cellular component=transcription factor complex; Biological process =negative regulation of transcription
  Coding regions on vcDNA: vcDNA=SeqID_85333; Strand=+; Position=2-553
GHKRRHHHGQQSSVGAACSSTQSSAPSSSQSEQADSTLHPEERKRILHLHAEKNRRFALKEGFESLVNAIPVVEQTGVKCTNAVVLNRAAQHIKQLKSEQDQQQMKLRVLREKITNMNERIALIQSNLPSSSTGGSRPCEAQTPSMRIQVEQFFEHYKKERSREDYRFWLMGEVLKPIVHSFAE

SEQ ID NO: 158911 - protein, 183 aa, Heterodera glycines
  Homolog annotation: Hit_ID=AAN32891.1; Match level="QueryCoverage =100%, HitCoverage=37%, E-value=1e-101, Identity=100%"; Hit description=secretory protein 5D06 [Heterodera glycines]
  Coding regions on vcDNA: vcDNA=SeqID_85334; Strand=+; Position=50-598
MKNSFLFLLQIFILTNILTEILCGDKSRPSTEINANLGTRKKPETITATKNANLGTGKMHETDGTSKMPKHGKPVSNRMAAKSTTIKNNNEAAGPSQQSKQPAANITPQQKGPMQNSKKQPPNELFGKKQRSTPEEIKAGKQPAMELMPCYRGIGKKTMPTIAQRNATMLKRGDSLTRSADFE

SEQ ID NO: 158912 - protein, 136 aa, Heterodera glycines; identical to SEQ ID NO: 147069
  Homolog annotation: Hit_ID=AAO33475.1; Match level="QueryCoverage =100%, HitCoverage=100%, E-value=5e-76, Identity=100%"; Hit description=gland-specific protein g5d08 [Heterodera glycines]
  Coding regions on vcDNA: vcDNA=SeqID_85335; Strand=+; Position=58-468

SEQ ID NO: 158913 - protein, 209 aa, Heterodera glycines
  Coding regions on vcDNA: vcDNA=SeqID_85336; Strand=+; Position=2-631
EENGEEETAATEKASSFPRQMTVDQFKQYINTTDNNTGDQGDAMEEEELTETARKRCKMMPIREDEEEGTVPEMETQTIVRQQSKRQQSLWQSNYVRVDAHLPSTDTLLFVPPNLNVFVGAELYYDRDQDTFVHRMGIKERKWGEDGQNWTDEDDDDDDHNHDHDHDYETSSVSSSSSIGATSSSSAVRSLRGRDNASLPPAFCCCWCQ

SEQ ID NO: 158914 - protein, 133 aa, Heterodera glycines
  Homolog annotation: Hit_ID=CAE62134.1; Match level="QueryCoverage =97%, HitCoverage=45%, E-value=5e-26, Identity=48%"; Hit description =Hypothetical protein CBG06178 [Caenorhabditis briggsae]
  Coding regions on vcDNA: vcDNA=SeqID_85337; Strand=+; Position=1-402
KLGLFCATPAVPLSRNVPPKIALDMLLTGRFLEANIAHKFGLVSRLVGTAELRRETLGAAQHICDNSRAVVGMGKAFFYAQLEQNERDAYRQATATMCDNLKWRDAQEGISAFITRPKRQPQWTHTDQRVIKD

SEQ ID NO: 158915 - protein, 190 aa, Heterodera glycines
  Homolog annotation: Hit_ID=CAG62383.1; Match level="QueryCoverage =94%, HitCoverage=24%, E-value=1e-13, Identity=27%"; Hit description =unnamed protein product [Candida glabrata CBS138] ref|XP_449407.1| unnamed protein product [Candida glabra
  Gene Ontology: Mol. function=snoRNA binding; Cellular component=small nucleolar ribonucleoprotein complex; Biological process=processing of 20S pre-rRNA
  Coding regions on vcDNA: vcDNA=SeqID_85338; Strand=+; Position=2-571
DIPRTKESANVVWSLIFVETFLFTGDSRGQLSIYDALNGTLLKFFKTHQAAVLTIATNGKEVFAAGADYRIQIVKRISHDNVRFEWQQSGQRLFHANDVRAICVLDKRLLVSGGSDSELFISDKFTHANPQIKSECAFFVSKSNCYVIVSHHLSHLDLWYKTIGGSLMDQRKRLKLFLRITSGKLGFIKQ

SEQ ID NO: 158916 - protein, 60 aa, Heterodera glycines
  Coding regions on vcDNA: vcDNA=SeqID_85339; Strand=-; Position=1-180
GHKAEGVCSSQSAPLVSISFTHSSGQNRNCIEIAEHNLTSKQTIGTGKMKRNASIRLNAN

SEQ ID NO: 158917 - protein, 43 aa, Heterodera glycines
  misc_feature (30)..(30): Xaa can be any naturally occurring amino acid
  Homolog annotation: Hit_ID=AAK66762.1; Match level="QueryCoverage =97%, HitCoverage=6%, E-value=8e-15, Identity=85%"; Hit description =proprotein convertase 2 [Heterodera glycines]
  Coding regions on vcDNA: vcDNA=SeqID_85340; Strand=+; Position=22-150
ANCSHFEWQTNGVGLEYNHLFGFGVLYSVXMVLMAKVYKTVPS

SEQ ID NO: 158918 - protein, 182 aa, Heterodera glycines
  Homolog annotation: Hit_ID=CAE62116.1; Match level="QueryCoverage =99%, HitCoverage=11%, E-value=4e-81, Identity=81%"; Hit description =Hypothetical protein CBG06155 [Caenorhabditis briggsae]
  Gene Ontology: Mol. function=microtubule binding; Cellular component =microtubule cytoskeleton; Biological process=gametogenesis
  Coding regions on vcDNA: vcDNA=SeqID_85341; Strand=+; Position=2-547
LKSAGTLPIELARLYVAETVLAIEYLHSCGIVHRDLKPDNLLITSMGHIKLTDFGLSKIGLMNRTTLVSEGYLLQDDTQQFKDNQLCGTPEYIAPEVILRQGYGKPVDWWALGVILYEFLVGIVPFMGDTPEALFANIINEDVEYPEGDEALDSDAESLIHLLLENNPLDRLGTVGGAPQVS

SEQ ID NO: 158919 - protein, 82 aa, Heterodera glycines
  Coding regions on vcDNA: vcDNA=SeqID_85342; Strand=-; Position=1-246
FFFFFFFFYGMTVFNGKFSSNLSFSASLILHVFSILDIILCRLFVLLPIFGIILCRLFVLLPIFGIVFCRPFVLLPIFGIIL

SEQ ID NO: 158920 - protein, 187 aa, Heterodera glycines
  Coding regions on vcDNA: vcDNA=SeqID_85343; Strand=+; Position=1-561
TQIFGLSLHLQELKHFDGQNGKLIGNDSDESLESLVSFISKNGFGLINDERRTKIDQAIQEIEQIVKKWNRKAKIIVMGSYQLGALTKQSDIDAICVVPELRTWRAAKFFGKAKCQIQWNGFRRCADDSLFCHFCLAAQVTGLNRIQDAWVPLIKFKFEIDPKTSVDFDIGLETFAIHDDIFKSEEP

SEQ ID NO: 158921 - protein, 108 aa, Heterodera glycines
  Coding regions on vcDNA: vcDNA=SeqID_85344; Strand=+; Position=1-327
KAQNLAMEAANLTDATEQTMAGATETKSALDTLSSELDSVLTTTKDFENQAISDAERSNEVAKKATLSEATANSLQEKLSDSDTKLTEALAQLSQLICVCFVEILFLF

SEQ ID NO: 158922 - protein, 78 aa, Heterodera glycines; identical to SEQ ID NO: 137945
  misc_feature (72)..(72): Xaa can be any naturally occurring amino acid
  Homolog annotation: Hit_ID=BAD26579.1; Match level="QueryCoverage =94%, HitCoverage=92%, E-value=5e-24, Identity=75%"; Hit description =cytochrome P450 like_TBP [Citrullus lanatus]
  Coding regions on vcDNA: vcDNA=SeqID_85345; Strand=-; Position=44-280

SEQ ID NO: 158923 - protein, 118 aa, Heterodera glycines
  misc_feature (59)..(59): Xaa can be any naturally occurring amino acid
  Homolog annotation: Hit_ID=NP_499173.1; Match level="QueryCoverage =100%, HitCoverage=23%, E-value=3e-23, Identity=49%"; Hit description= suppressor of bimD6 (58.6 kD) (3K892) [Caenorhabditis elegans] emb|CAA80180.1| Hypothetical protein ZK63
  Coding regions on vcDNA: vcDNA=SeqID_85346; Strand=+; Position=1-358
EFNLLYHLDTVYVIDLAQAMDISHPSSLRFLHRDITNVLNFFGRIGCEPLPTPHAFFHXVTDIEFDPNKNLYVQVESFERENRNMDLKGAKASPANYELHLHQQESTGRADSPSRPYN

SEQ ID NO: 158924 - protein, 119 aa, Heterodera glycines
  misc_feature (50)..(50): Xaa can be any naturally occurring amino acid
  Homolog annotation: Hit_ID=NP_501330.1; Match level="QueryCoverage =62%, HitCoverage=7%, E-value=4e-10, Identity=40%"; Hit description =eukaryotic translation initiation factor 2C family member (4I725) [Caenorhabditis elegans] gb|AAA81677.1|
  Coding regions on vcDNA: vcDNA=SeqID_85347; Strand=+; Position=14-373
PVRVFYNLYVQAHHPVRGTAKIPEFIFPCNEVCATNEELDAFINGLCHSXQIVKAATSLPVPVYQAHELAKRGRSNYMELRRMAPERIPRSADGQVMCEQLSELLSYNDSPLRESRTTA

SEQ ID NO: 158925 - protein, 202 aa, Heterodera glycines
  Homolog annotation: Hit_ID=CAE66231.1; Match level="QueryCoverage =86%, HitCoverage=37%, E-value=4e-59, Identity=62%"; Hit description =Hypothetical protein CBG11474 [Caenorhabditis briggsae]
  Coding regions on vcDNA: vcDNA=SeqID_85348; Strand=+; Position=3-608
IRMFNKRGEEHGTVTCRINDRENFEVTTLRVDVVCDGRRAKVNFTTDWELDAFRRDLTINSLFLGLDGLIYDYTGGIEDVKQRRIIFVGDPIQRLQEDYLRILRYFRFFGRFSKLDAPHEQKNLEAIVRCRDGLKGVSGERIWMELHQILVGRLAAPVLRCMLVDCGLGPLLALRPDRVDEFERVSRLNAPNGDDGKLSIEP

SEQ ID NO: 158926 - protein, 189 aa, Heterodera glycines
  Coding regions on vcDNA: vcDNA=SeqID_85349; Strand=+; Position=1-567
TQIFGLSLHLQELKHFDGQNGKLIGNDSDESLESLVSFISKNGFGLINDERRTKIDQAIQEIEQIVKKWNRKAKIIVMGSYQLGALTKQSDIDAICVVPELRTWRAAKFFGKAKCQIQWNGFRRCADDSLFCHFCLAAQVTGLNRIQDAWVPLIKFKFEIDPKTSVDFDIGLETFAIHDDIFKSEEPIK

SEQ ID NO: 158927 - protein, 175 aa, Heterodera glycines
  Homolog annotation: Hit_ID=NP_496956.1; Match level="QueryCoverage =100%, HitCoverage=25%, E-value=3e-46, Identity=51%"; Hit description= block of proliferation 1 (77.4 kD) (2O442) [Caenorhabditis elegans] emb|CAB54439.1| Hypothetical protein
  Gene Ontology: Biological process=physiological processes
  Coding regions on vcDNA: vcDNA=SeqID_85350; Strand=+; Position=3-527
LAPRQRKMRLNVDPKQLLPNLPNPKDLQPFPTTLAFYLRGHSGQVRTLAVEPEIGELLVSGGADSTVRVWLLPSGKCLRLFEMPASVTCVAFCPNSNRTLTLVSCESDLVTVLNIQSGDRLAVSNTRQFIAGIPFGTENTAGVLWTHIHSKTMNGIRIKMNDKIRSLCWHKSGDY

SEQ ID NO: 158928 - protein, 167 aa, Heterodera glycines
  Homolog annotation: Hit_ID=AAS78778.1; Match level="QueryCoverage =82%, HitCoverage=89%, E-value=2e-25, Identity=44%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_85351; Strand=+; Position=37-540
MGIHPFWNIGVLRKTDDKSLMNGQLALKGCEIFVLYFGAHMCQRCREFIPVLKQFYDQLKKSPETMPFEIVFVPFDRSEDEFRNSLRDLHDDWLYIPYGSVHINSLAARFNIINWGVIPTLVVLKEDGTLITMAGQANVQHLSASEAMVRWRSIPNPESGFKDFSKF

SEQ ID NO: 158929 - protein, 195 aa, Heterodera glycines
  Homolog annotation: Hit_ID=EAL33677.1; Match level="QueryCoverage =30%, HitCoverage=28%, E-value=2e-09, Identity=45%"; Hit description =GA21056-PA [Drosophila pseudoobscura]
  Coding regions on vcDNA: vcDNA=SeqID_85352; Strand=+; Position=3-587
VNADELKKFPSLTDAFKKKRGNILNFEEEEFDEIISNGTSKRDNSPYTDHDYAGTRQLATAKGATGKHQRQKGGGGTAKEPKKKTALVNGTDSVVRSSARPHRPTKRFVEETNESFIRGTSKVRRTSPRKHGKKSTAEGGSEGEESEDDGKEYSVEKVFKKRVKGGKMEYFVKWAGYDDGWNTWEPRKSLKHLEV

SEQ ID NO: 158930 - protein, 119 aa, Heterodera glycines
  Coding regions on vcDNA: vcDNA=SeqID_85353; Strand=+; Position=3-362
GAKLFEKVLNEFDFARRAEWELVQTLFGIASDRTILFPDDQIRLFIGCPQNSDAYKFLCSIFVDGSSEGINYGTTSTSVLLVDIEGTAVFHERRLVNPQSPMDDPQKWKFSRERFTICY

SEQ ID NO: 158931 - protein, 177 aa, Heterodera glycines
  Homolog annotation: Hit_ID=ZP_00195010.1; Match level="QueryCoverage =91%, HitCoverage=43%, E-value=2e-41, Identity=57%"; Hit description =COG2008: Threonine aldolase [Mesorhizobium sp. BNC1]
  Coding regions on vcDNA: vcDNA=SeqID_85354; Strand=+; Position=1-534
VDILSFGASKNGCWCAEAILVFNDLQQAHKDFPFLRKRAAHLFSKTRFIAAQFEAYFHDSLWLRNARHANKMASHLTSAIRSLDPSVIRLAWTPQANEVFVVMRRSVAETLRKSGEISHFYEWNVPDGERRELKLYTEEGLFRLVTTFATKEAEVDEFASLLKAHYLGKSEQMRSIA

SEQ ID NO: 158932 - protein, 101 aa, Heterodera glycines
  Homolog annotation: Hit_ID=XP_394408.1; Match level="QueryCoverage =65%, HitCoverage=63%, E-value=1e-15, Identity=48%"; Hit description =similar to cytochrome oxidase subunit VIa [Apis mellifera]
  Gene Ontology: Cellular component=integral to membrane; Biological process=energy pathways
  Coding regions on vcDNA: vcDNA=SeqID_85355; Strand=+; Position=1-306
YKTGLRDAVPIAAFWKKFSAFVMMPLCGWKDHQNVHHSPRPEYVAYEYLATRRKPFPWGDGNHSLLHNPATNWVPGVGYEAPWPGDAHKKEGDSGGEGKKH

SEQ ID NO: 158933 - protein, 38 aa, Heterodera glycines
  Coding regions on vcDNA: vcDNA=SeqID_85356; Strand=-; Position=2-115
TKKKKKTNLFLKIKNQLLQSKKFKKILKFLKKKKKKKK

SEQ ID NO: 158934 - protein, 179 aa, Heterodera glycines
  Homolog annotation: Hit_ID=NP_502161.1; Match level="QueryCoverage =97%, HitCoverage=14%, E-value=1e-39, Identity=48%"; Hit description =serine threonine kinase (kin-4) [Caenorhabditis elegans] emb|CAB05684.1| Hypothetical protein C10C6.1 [Ca
  Gene Ontology: Mol. function=microtubule binding; Cellular component =microtubule cytoskeleton; Biological process=gametogenesis
  Coding regions on vcDNA: vcDNA=SeqID_85357; Strand=+; Position=13-549
MRKQQETNYTGAPSAHPSSPCSSSLLPPPVSSLSVPLHHRSSISGGGSRPIVIRKGPQGFGFSIRSVRVYLSEMSEYYSIEHIVAAVREGSPAWEAGLRTNDLITRVHAQSVHNMTHPEMMRRLLSCGNELTVHVVPLSSTSIKEGEPRRNIGKPLRKKPRRPPTAQQKNKQQSRKGSA

SEQ ID NO: 158935 - protein, 199 aa, Heterodera glycines
  Coding regions on vcDNA: vcDNA=SeqID_85358; Strand=+; Position=3-599
VTGFYTQIRAPPNPNVQKDKKGGESFILMDQIIGVSWATKPYMLLQRPLTIVLKFRHFRDERICQLPYWKKSDGISQEIYNHWLNDMRQWDEEYPSLEFIEKKSKELVTVLSEPPRGPPVDVIRLATIEAERENSTKLLKKLKEWQEEQKVGNAMHQPFPSPRQPFYPPSRPIRFPHWPFHHDPSRPRPHLMYGRSVGY

SEQ ID NO: 158936 - protein, 212 aa, Heterodera glycines
  misc_feature (89)..(89): Xaa can be any naturally occurring amino acid
  Homolog annotation: Hit_ID=CAE57723.1; Match level="QueryCoverage =99%, HitCoverage=27%, E-value=1e-85, Identity=72%"; Hit description =Hypothetical protein CBG00733 [Caenorhabditis briggsae]
  Coding regions on vcDNA: vcDNA=SeqID_85359; Strand=+; Position=3-638
IYRWITVKNLNVMNFDNDLDNDTPMGLLRGIKYGTESYHVLFKRLCSYAGLHCVVIKGFSKSAGYQPGLGFDDSRFRNTWNAVFLDGSXRFVQCNWGARHLVNAKENARGKRSMTVQNGHEKDGNGAVGSNLRYEYDDHYFMTDPEEMIYEFFPDESQWQLLPRPVSLKQFEQFPFVRSLFFRYGLRFSDPRLSAVVRADKTGAVSIAIALG

SEQ ID NO: 158937 - protein, 218 aa, Heterodera glycines
  Homolog annotation: Hit_ID=NP_491117.1; Match level="QueryCoverage =100%, HitCoverage=72%, E-value=2e-58, Identity=51%"; Hit description= brix domain containing protein 1 (33.5 kD) (1D742) [Caenorhabditis elegans] gb|AAF60765.1| Hypothetical
  Gene Ontology: Mol. function=rRNA binding; Cellular component =nucleolus; Biological process=ribosomal large subunit assembly and maintenance
  Coding regions on vcDNA: vcDNA=SeqID_85360; Strand=+; Position=2-655
APKLVENDKVTLFVKGKKCSVMLNKILGELYQLKKPLANRLQRNNDSHPFEDDSLLCRFSHKFDASLFVFGSSTKKRPNSLLFGRMYDHQMLDMVELQVENFVSSDEFKQVKSVTLGSKPCIILQGHLFESNGILQRIGNLMVDLFRGPKVEYLRLQGTELIISLTAVSEERIKFRVYRASLKKDMESATPKIELVEMGPNIDFKIDRTKLASDSLFK

SEQ ID NO: 158938 - protein, 158 aa, Heterodera glycines
  Homolog annotation: Hit_ID=CAE68398.1; Match level="QueryCoverage =93%, HitCoverage=85%, E-value=2e-10, Identity=30%"; Hit description =Hypothetical protein CBG14167 [Caenorhabditis briggsae]
  Coding regions on vcDNA: vcDNA=SeqID_85361; Strand=+; Position=40-513
MMLIKFALPLLFVLLHPFVCSAAEENAGAADFPQQFYGAFKLDHSDNWDDYLIAKGYSDPEMRKKVELPRFTRILYRFPNGTYRMMVGTGLEGSKWVKGSKKNADWQFKPNEPFIGNYWDGSKHEITFTYDPKESRLTERHVKVDGTGTPEEFNYKID

SEQ ID NO: 158939 - protein, 182 aa, Heterodera glycines
  Homolog annotation: Hit_ID=NP_498374.1; Match level="QueryCoverage =86%, HitCoverage=25%, E-value=6e-29, Identity=39%"; Hit description =ankyrin and ubiquitin interacting motif (67.0 kD) (3H366) [Caenorhabditis elegans] gb|AAC47054.1| Hypothe
  Coding regions on vcDNA: vcDNA=SeqID_85362; Strand=+; Position=69-614
MSLFEKKRVMNNSLPENTSNSSADDVYGGVSAIEYLSRRVGNCHIGKRSEEQIKSNAFNASLWLSETFPLKLHEQIFPVIDLLAVRNTKFSRLKSFIQLQLPSGFPIRVKIPIFHLINAQITFRNVNDPKEEAIERIAEHSEDDGPQMLQLRQSLFQIPDGFERCELSGSFLFNRAGEFERT

SEQ ID NO: 158940 - protein, 142 aa, Heterodera glycines
  Coding regions on vcDNA: vcDNA=SeqID_85363; Strand=+; Position=47-475
GPFFHNTLPSVASLLESDDDLLRVDIKEEKFYVSEEVTQTHLFCLSKNLCSNLFRLLRRCSSNNAIRVQHLLEISSQLVPIGAPMPNSNALVDLCNRFPTIFKLRCSPQDNYRFDNSVIMLNEQLLDSENLAWRVVLDTDEF

SEQ ID NO: 158941 - protein, 138 aa, Heterodera glycines
  Homolog annotation: Hit_ID=AAO33474.1; Match level="QueryCoverage =100%, HitCoverage=100%, E-value=1e-71, Identity=98%"; Hit description=gland-specific protein g4g12 [Heterodera glycines]
  Coding regions on vcDNA: vcDNA=SeqID_85364; Strand=+; Position=50-466
MPNIFKILLIVLLAVVSFRLSASTGDKFSANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 158942 - protein, 64 aa, Heterodera glycines
  Coding regions on vcDNA: vcDNA=SeqID_85365; Strand=-; Position=161-355
FFRYFSFNFTPFSIRIFFSFLFYFFFYFIEFSTYFSFFSVLRFFFLPIFLQIFLQMIFVPIFIF

SEQ ID NO: 158943 - protein, 116 aa, Heterodera glycines
  Homolog annotation: Hit_ID=NP_660116.1; Match level="QueryCoverage =90%, HitCoverage=38%, E-value=2e-31, Identity=60%"; Hit description =SPRY domain-containing SOCS box 4 [Mus musculus] gb|AAL57358.2| SPRY domain-containing SOCS box protein S
  Coding regions on vcDNA: vcDNA=SeqID_85366; Strand=+; Position=3-353
AQNTKPWSFPYEQPFVAPEKLFCVLDMDEGQLAFATDSKYLGVAFRGLKGKKLYPAVSAVWGHCEITLRYLGGLNPDSQLMDTCRRSIRVRVGKERVDRIGELNLPPNLIKYLHYK

SEQ ID NO: 158944 - protein, 45 aa, Heterodera glycines
  Homolog annotation: Hit_ID=ZP_00357698.1; Match level="QueryCoverage =77%, HitCoverage=18%, E-value=4e-10, Identity=78%"; Hit description =hypothetical protein Chlo02002738 [Chloroflexus aurantiacus]
  Coding regions on vcDNA: vcDNA=SeqID_85367; Strand=-; Position=156-293
FFFFFFFFFFFFFFFFFFFFFFFFFKKIAFYSYTIKTRQSEKNER

SEQ ID NO: 158945 - protein, 142 aa, Heterodera glycines
  Homolog annotation: Hit_ID=AAP30775.1; Match level="QueryCoverage =100%, HitCoverage=77%, E-value=9e-65, Identity=85%"; Hit description= putative gland protein G32E03 [Heterodera glycines]
  Coding regions on vcDNA: vcDNA=SeqID_85368; Strand=+; Position=2-427
ILETANSKAVKKDNKKGTVATPAKGKAAPKGAAKGGIKKDAKSKGKGKKDAKGKKDKKAKPVKGKGVPKNDKKSPAAKANHKKSPTKPMAAVKAVPKAAENAQKGPSSAEVVAEENNLGTEAVDNLGAEESDFDQLAEGELL

SEQ ID NO: 158946 - protein, 72 aa, Heterodera glycines
  Homolog annotation: Hit_ID=AAO33477.1; Match level="QueryCoverage =100%, HitCoverage=29%, E-value=1e-34, Identity=97%"; Hit description= gland-specific protein g4g05 [Heterodera glycines]
  Coding regions on vcDNA: vcDNA=SeqID_85369; Strand=+; Position=2-220
NRVAERAAARVYGWLPEDKQPKAIYDAAEKAKNTPKPPGDYDVERVAQKAARLVYGVLPIGFQPNFAGPSTN

SEQ ID NO: 158947 - protein, 106 aa, Heterodera glycines
  Coding regions on vcDNA: vcDNA=SeqID_85370; Strand=+; Position=265-582
AVPRSLKSTNWPKTISLGPILSRWQKKDSVCTDFLNTFTELFKEEDFYNSIDGSMLNLLLSNLRELYPRVKQTCAWLDLLIQAKLFPATMLLIEELCKFIESPGLY

SEQ ID NO: 158948 - protein, 109 aa, Heterodera glycines
  Homolog annotation: Hit_ID=NP_503119.1; Match level="QueryCoverage =86%, HitCoverage=17%, E-value=1e-28, Identity=61%"; Hit description =glucocerebrosidase (4S421) [Caenorhabditis elegans] emb|CAB02924.1| Hypothetical protein F11E6.1a [Caenor
  Gene Ontology: Cellular component=extracellular space
  Coding regions on vcDNA: vcDNA=SeqID_85371; Strand=+; Position=100-426
QKCTICGTTNPLAFSEACTGYEVFEHKVLLGDWSRGRAYARDILNDLRTWVVGWTDWNMCLDLEGGPNLARNFVDSPIIVNASAGEFYKQPMFYAMAHFSRFVPRDSSV

SEQ ID NO: 158949 - protein, 182 aa, Heterodera glycines
  Homolog annotation: Hit_ID=AAO33476.1; Match level="QueryCoverage =100%, HitCoverage=85%, E-value=6e-98, Identity=100%"; Hit description=gland-specific protein g6e07 [Heterodera glycines]
  Coding regions on vcDNA: vcDNA=SeqID_85372; Strand=+; Position=34-579
MRTILFMAMVCLVMAVLMEMANSKVVKKDNKKAAVAASPAKGKASPKGGKSPAKGKAAKVSKKDNKLKAKKETKGIKVKNAKPTKKGKSAKGASKTAKKVQAAKKAPGKDKKSLVKPIVLKAPVPPHKMHPMIESEAVPPPAHARSLATVPYSTPGAADRNSLPSYTSTATNLDMADDNDDY

SEQ ID NO: 158950 - protein, 176 aa, Heterodera glycines
  Homolog annotation: Hit_ID=NP_497705.1; Match level="QueryCoverage =93%, HitCoverage=32%, E-value=1e-22, Identity=35%"; Hit description =myosin heavy like (3E497) [Caenorhabditis elegans] emb|CAA84327.1| Hypothetical protein F59A2.2 [Caenorha
  Coding regions on vcDNA: vcDNA=SeqID_85373; Strand=+; Position=2-529
RATIAIATHKAEMHSALQQKDQEIEGWIEKCHSMEKRDTDSNTLWQEKVDTLQKAIVALEHEKADMVEKLSQAKQEGVKLVKESEEKRHGEILTEQLKKKDEEWSRRVKELEEQMQLAVEESDLQRKTSVTGHERELSNLRGRVAELEKENTQILQQFCGQKEELEQMKRKELTET

SEQ ID NO: 158951 - protein, 138 aa, Heterodera glycines
  misc_feature (129)..(130): Xaa can be any naturally occurring amino acid
  Coding regions on vcDNA: vcDNA=SeqID_85374; Strand=+; Position=37-450
PMLLSANFRHLHLLRIFNRIVRLSPRCVCQTTELFSERFLSTSFLLLQKRSTPKPTGPVRRVPAVSIGSDVRQKHSERTAGKGDGTNGFWQPWNASDDYSEIKKRLLRPPNDFSELREIIRKDIERMAXXKKKKNKKK

SEQ ID NO: 158952 - protein, 146 aa, Heterodera glycines
  misc_feature (136)..(136): Xaa can be any naturally occurring amino acid
  Homolog annotation: Hit_ID=NP_950005.1; Match level="QueryCoverage =97%, HitCoverage=66%, E-value=6e-26, Identity=44%"; Hit description =putative maleylacetoacetate isomerase [Rhodopseudomonas palustris CGA009] emb|CAE30111.1| putative maleyl
  Gene Ontology: Mol. function=maleylacetoacetate isomerase activity; Biological process=tyrosine catabolism
  Coding regions on vcDNA: vcDNA=SeqID_85375; Strand=+; Position=1-438
GIVNLLNGDQNKDEFLSKLPFAKVPVFVHDNLVLSESMAIIEYLDEKFPEPNPLFPKSAEDRAHVRALALQIVANTQPLQNLGVLKHLSEEPAKRNACARHWIEQSFNVFEKALAKTAGKYAYGDQISLADICIPXQVYNAKRFGV

SEQ ID NO: 158953 - protein, 54 aa, Heterodera glycines
  Coding regions on vcDNA: vcDNA=SeqID_85376; Strand=-; Position=241-405
LSSSPSVYKIGRNRLIGREAVSSPVSISEMSGSLSGSATMSTPSTSPSSSNLSA

SEQ ID NO: 158954 - protein, 60 aa, Heterodera glycines
  Homolog annotation: Hit_ID=AAK55116.1; Match level="QueryCoverage =100%, HitCoverage=28%, E-value=3e-32, Identity=98%"; Hit description= venom allergen-like protein [Heterodera glycines]
  Coding regions on vcDNA: vcDNA=SeqID_85377; Strand=-; Position=158-340
DRIGCAMAQNCPNTNWKTYVVCWYYTGGNYFGAPVYLAGEPCSKCKANDKCDKATGLCSQ

SEQ ID NO: 158955 - protein, 42 aa, Heterodera glycines
  misc_feature (11)..(11): Xaa can be any naturally occurring amino acid
  Homolog annotation: Hit_ID=NP_763331.1; Match level="QueryCoverage =88%, HitCoverage=25%, E-value=4e-09, Identity=75%"; Hit description =Cell wall-associated hydrolase [Vibrio vulnificus CMCP6] ref|NP _760406.1| Cell wall-associated hydrolase
  Coding regions on vcDNA: vcDNA=SeqID_85378; Strand=+; Position=2-127
LFFERWSFHTXPPDHYDLLSHLLDLSVSQLSTLMPLHYQHDF

SEQ ID NO: 158956 - protein, 55 aa, Heterodera glycines
  Coding regions on vcDNA: vcDNA=SeqID_85379; Strand=-; Position=2-166
MVPSSRHFRIKTEMPMLRPSMNDFVKSDAIPVFYLIIIFIMLKCVHQKKKKKKKK

SEQ ID NO: 158957 - protein, 68 aa, Heterodera glycines
  Coding regions on vcDNA: vcDNA=SeqID_85380; Strand=-; Position=2-205
MCPIRSTQSQRSRLIRSGKTVRKGKRVEKKKRKAPESRKRGEEKKTRKRKRKMMRKEEAPKKKKKKKK

SEQ ID NO: 158958 - protein, 149 aa, Heterodera glycines
  Homolog annotation: Hit_ID=CAE69300.1; Match level="QueryCoverage =98%, HitCoverage=60%, E-value=8e-45, Identity=57%"; Hit description =Hypothetical protein CBG15355 [Caenorhabditis briggsae]
  Gene Ontology: Cellular component=integral to membrane; Biological process=mitochondrial translocation
  Coding regions on vcDNA: vcDNA=SeqID_85381; Strand=+; Position=3-449
DLQLDPSIFKESQPQIIMPEGYESGRGKFEFALGYIGCSVIGGFGVGSVRGMFGELGNPQNRTLAWNPWYTRMLNAATKHGSGYAQTAGTAMFLYSVTELGLKLSRADDLLNSFIAGPIAGGLFRGLPHGLRAGGVGALAGLGLVTVWN

SEQ ID NO: 158959 - protein, 84 aa, Heterodera glycines
  Coding regions on vcDNA: vcDNA=SeqID_85382; Strand=-; Position=73-327
VEKQLRERRVGIQNFSSMVLFDRKAKQRQKMAEKRRKERNNAKLILYGRPRKTKQCSSVFSKEDFAQIGKKDGSSANERIKRIR

SEQ ID NO: 158960 - protein, 140 aa, Heterodera glycines
  Homolog annotation: Hit_ID=XP_331491.1; Match level="QueryCoverage =100%, HitCoverage=46%, E-value=1e-16, Identity=38%"; Hit description= predicted protein [Neurospora crassa] gb|EAA35680.1| predicted protein [Neurospora crassa]
  Gene Ontology: Mol. function=zinc ion binding; Cellular component =nucleus; Biological process=regulation of transcription, DNA -dependent
  Coding regions on vcDNA: vcDNA=SeqID_85383; Strand=-; Position=2-421
GRVPPPPPPVGCGTPLPPPFPFLPPPSPGSPPFPFPPFPLSFPPLSPPSSPSLPSSSLSSLSSPSSFSFASSSAPSSSAFSSSSTPSASSWAPSASSPPPSSPSPAPSSSSRFFLNSNASPPFKAAGMALANPFSLGMKS

SEQ ID NO: 158961 - protein, 45 aa, Heterodera glycines
  misc_feature (1)..(1): Xaa can be any naturally occurring amino acid
  misc_feature (43)..(43): Xaa can be any naturally occurring amino acid
  Coding regions on vcDNA: vcDNA=SeqID_85384; Strand=-; Position=0-134
XCFFNVLFRPFASPNSFSAYMQSVLILYSVPEYTKSNFINATXTP

SEQ ID NO: 158962 - protein, 51 aa, Heterodera glycines
  Coding regions on vcDNA: vcDNA=SeqID_85385; Strand=+; Position=3-155
FFFFFFFLLFFFFFFFFFFFFFFFTKEFFAHKDWGETIFFPEKKPTNLKTK

SEQ ID NO: 158963 - protein, 84 aa, Heterodera glycines
  Coding regions on vcDNA: vcDNA=SeqID_85386; Strand=+; Position=94-345
IELSFATTSQNQITPFSIQVRAPAAKNSTNRQVRRSEQKAAQRVSFACFPKSFALPFWWLACRLRAPPLSQCAPAPASVAIRLP

SEQ ID NO: 158964 - protein, 145 aa, Heterodera glycines
  Coding regions on vcDNA: vcDNA=SeqID_85387; Strand=+; Position=1-435
GGHLHLLRIFNRIVRLSPHCVYQTTELFSERFLSTSFLLLQKRSTPKPTGPVRRVPAVSIGSDVRQKHSERTAGKGDGTNGFWQPWNASDDYSEIKKRLLRPPNDFSELREIIRKDIERMAQIKEENLKKRKGTTKGKKQMTDEQ

SEQ ID NO: 158965 - protein, 138 aa, Heterodera glycines
  Homolog annotation: Hit_ID=AAO33474.1; Match level="QueryCoverage =100%, HitCoverage=100%, E-value=1e-72, Identity=99%"; Hit description=gland-specific protein g4g12 [Heterodera glycines]
  Coding regions on vcDNA: vcDNA=SeqID_85388; Strand=+; Position=53-466
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPGGPDPHHH

SEQ ID NO: 158966 - protein, 60 aa, Heterodera glycines
  Coding regions on vcDNA: vcDNA=SeqID_85389; Strand=-; Position=1-180
FIKSHKCEFALPTPTKLRSALNVYFCRSVISSTFVSPFPLLACCECFVALGQQFLLSDVP

SEQ ID NO: 158967 - protein, 59 aa, Heterodera glycines
  Homolog annotation: Hit_ID=AAO33474.1; Match level="QueryCoverage =100%, HitCoverage=42%, E-value=2e-28, Identity=98%"; Hit description= gland-specific protein g4g12 [Heterodera glycines]
  Coding regions on vcDNA: vcDNA=SeqID_85390; Strand=-; Position=195-374
LVPSHVTNRSMAPPPPPVQFEMGANRLEKMRAHLRELVEKMPVNESKRLSPSGPDPHHH

SEQ ID NO: 158968 - protein, 83 aa, Heterodera glycines
  Coding regions on vcDNA: vcDNA=SeqID_85391; Strand=-; Position=1-249
RRHIGFRVEETKDFDQRAQILRMLLLFTSVTAQHKNTGTKGMELRSLVGINEIDEKLVIRQISTMVNVEKEKISRRLDEVENS

SEQ ID NO: 158969 - protein, 39 aa, Heterodera glycines
  Coding regions on vcDNA: vcDNA=SeqID_85392; Strand=-; Position=1-117
VSFIINNYGDQSSLYFPSTSIISLITHFDCQKKKKKKKK

SEQ ID NO: 158970 - protein, 76 aa, Heterodera glycines
  Coding regions on vcDNA: vcDNA=SeqID_85393; Strand=+; Position=2-232
FFFFFFFFFFFFIHFINQRRSSKETIKIINRKIGGFFLDWFWFINNMGAAGAPWHWVQRATVPAWRSAFFLALGYH

SEQ ID NO: 158971 - protein, 32 aa, Heterodera glycines
  Homolog annotation: Hit_ID=ZP_00357698.1; Match level="QueryCoverage =100%, HitCoverage=19%, E-value=1e-12, Identity=92%"; Hit description= hypothetical protein Chlo02002738 [Chloroflexus aurantiacus]
  Coding regions on vcDNA: vcDNA=SeqID_85394; Strand=+; Position=3-98
FFFFFFFFLFFFFFFFFFFFFFFFFFFFFFFL

SEQ ID NO: 158972 - protein, 135 aa, Heterodera glycines
  Homolog annotation: Hit_ID=CAE56797.1; Match level="QueryCoverage =99%, HitCoverage=41%, E-value=3e-31, Identity=42%"; Hit description =Hypothetical protein CBG24609 [Caenorhabditis briggsae]
  Gene Ontology: Mol. function=diphosphoinositol-polyphosphate diphosphatase activity; Cellular component=cytoplasm
  Coding regions on vcDNA: vcDNA=SeqID_85395; Strand=+; Position=2-406
GLIEILVTRSNAQLRAIKAAYQKLYGHGLEKDLAAETSGSFKTLLLDLVEANRDESYRTDLAKAKTDAEKLYKAGEGKWGTDEDAFIKVLANQNLSQLQLMFNEYEKLGKKHTIEQAIKAEFSGDEFSALLAIVS

SEQ ID NO: 158973 - protein, 34 aa, Heterodera glycines
  Homolog annotation: Hit_ID=ZP_00241907.1; Match level="QueryCoverage =94%, HitCoverage=10%, E-value=7e-09, Identity=87%"; Hit description =COG0788: Formyltetrahydrofolate hydrolase [Rubrivivax gelatinosus PM1]
  Coding regions on vcDNA: vcDNA=SeqID_85396; Strand=-; Position=3-104
MKTSQEFVLTLSCQDAKGIVHAVSGLLYQAGCNI

SEQ ID NO: 158974 - protein, 132 aa, Heterodera glycines
  Homolog annotation: Hit_ID=AAO33474.1; Match level="QueryCoverage =100%, HitCoverage=95%, E-value=2e-67, Identity=99%"; Hit description= gland-specific protein g4g12 [Heterodera glycines]
  Coding regions on vcDNA: vcDNA=SeqID_85397; Strand=+; Position=53-448
MPNIFKILLIVLLAVVSFRLSASTGDKKTANDGSGNNSSAGIGTKIKRIVTAGLLFTSLATGGAEAIGRSNAQGGNAAGLVPSHVANRSMAPPPPPVQFEMGANRLEKMRAHLRELAEKMPVNESKRLSPSG

SEQ ID NO: 158975 - protein, 148 aa, Heterodera glycines
  misc_feature (120)..(120): Xaa can be any naturally occurring amino acid
  Homolog annotation: Hit_ID=CAE57736.1; Match level="QueryCoverage =99%, HitCoverage=36%, E-value=6e-35, Identity=53%"; Hit description =Hypothetical protein CBG00747 [Caenorhabditis briggsae]
  Gene Ontology: Mol. function=cystine transporter activity; Cellular component=integral to membrane; Biological process=cystine transport
  Coding regions on vcDNA: vcDNA=SeqID_85398; Strand=+; Position=1-444
GCYTVYNLLLYFDPNVQRIYIERHGQRSLIPVLINDVVFASHALLACIITGVQCFFYERGNQRISYIGRAWASLLLCFSSVSLALALFRVLNWLDFINYLSYSKMAVTLSKYFPQAILNXKRKSTVGWSIGNVLLDFSGGFMGICQMC

SEQ ID NO: 158976 - protein, 101 aa, Heterodera glycines
  Homolog annotation: Hit_ID=AAN32886.1; Match level="QueryCoverage =100%, HitCoverage=54%, E-value=1e-51, Identity=99%"; Hit description= gland-specific protein G2D01 [Heterodera glycines]
  Coding regions on vcDNA: vcDNA=SeqID_85399; Strand=+; Position=54-356
MSSSPSVSVLAIVAIVCLMCQCCFSAPHPCCPGSQKVVSLMSNYVGTFANSISKSSLCSDAQNVAEALKGQLIGCSNGGDRTLLADIEAFLATHSADECAL

SEQ ID NO: 158977 - protein, 39 aa, Heterodera glycines
  Homolog annotation: Hit_ID=ZP_00357698.1; Match level="QueryCoverage =100%, HitCoverage=20%, E-value=3e-09, Identity=77%"; Hit description= hypothetical protein Chlo02002738 [Chloroflexus aurantiacus]
  Coding regions on vcDNA: vcDNA=SeqID_85400; Strand=+; Position=2-121
FFFFFFFFFFFFFFFFFFFFFFFFKKILFYPPNFCFSKF

SEQ ID NO: 158978 - protein, 121 aa, Heterodera glycines
  Homolog annotation: Hit_ID=CAE67294.1; Match level="QueryCoverage =99%, HitCoverage=18%, E-value=2e-38, Identity=62%"; Hit description =Hypothetical protein CBG12746 [Caenorhabditis briggsae]
  Gene Ontology: Mol. function=RNA helicase activity; Cellular component=cytoplasm; Biological process=mRNA processing
  Coding regions on vcDNA: vcDNA=SeqID_85401; Strand=+; Position=1-363
GDFENIQHVINFEMPEDIENYVHRIGRTGRSMRRGIATTFINRKADLPVLLDLKHLLIEAGQQLPAFLKQLAGEDEDLGAIQETEPVNDMDKGCSYCSGLGHRITNCPKLESVRTKNASNL

SEQ ID NO: 158979 - protein, 59 aa, Heterodera glycines
  Coding regions on vcDNA: vcDNA=SeqID_85402; Strand=+; Position=125-304
IIGGVKKLNYGIQSFSKSKGTKIVGGDKIYRLGINTILIIDIICLEEQLSQFSSLHKAA

SEQ ID NO: 158980 - protein, 121 aa, Heterodera glycines
  Homolog annotation: Hit_ID=CAE67649.1; Match level="QueryCoverage =95%, HitCoverage=19%, E-value=1e-47, Identity=73%"; Hit description =Hypothetical protein CBG13209 [Caenorhabditis briggsae]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_85403; Strand=-; Position=2-364
LQISFRVWMCGGSIEVVPCSHVGHIFRAGHPYNMTGPGGNKDVHGTNSKRLAEVWVDDYKRLFYVHRMGLKDVEVGDLSARKALRERLGCKSFKWYLDNVIPEKFVPDENVNAYGLVQDTD

SEQ ID NO: 158981 - protein, 88 aa, Heterodera glycines
  Coding regions on vcDNA: vcDNA=SeqID_85404; Strand=+; Position=1-267
GRRSPRSTWSSVSGAEMGRETRVRTRKATKSLIRIDQQRTHHHILLIGTVIFHHQIHNTFPFSGLSLISIFGYCFLFFSSIFCKILLL

SEQ ID NO: 158982 - protein, 45 aa, Heterodera glycines
  Coding regions on vcDNA: vcDNA=SeqID_85405; Strand=+; Position=34-171
KMKIYLTTKKKQSLVDIDHLKKNPNDRYCFCFFMNFWGHCAMAGH

SEQ ID NO: 158983 - protein, 95 aa, Heterodera glycines
  Homolog annotation: Hit_ID=NP_741818.1; Match level="QueryCoverage =56%, HitCoverage=14%, E-value=7e-23, Identity=85%"; Hit description =cysteine PRotease related (42.4 kD) (cpr-6) [Caenorhabditis elegans] gb|AAK39189.1| Cysteine protease rel
  Gene Ontology: Mol. function=peroxidase activity; Cellular component =lysosome; Biological process=protein targeting
  Coding regions on vcDNA: vcDNA=SeqID_85406; Strand=-; Position=59-346
AVKLLGWGADNGIPYWLVANSWNTDWGEDGFFRILRGSDECGIESGPVGGVPDLGRSPSAGGRDETNNEIEEQMDDEEKGKEEEEEEGDEWEEEI

SEQ ID NO: 158984 - protein, 130 aa, Heterodera glycines
  Coding regions on vcDNA: vcDNA=SeqID_85407; Strand=+; Position=1-390
GQRNLATRTVGFDDPNCLAMAIRDEENIRVNDKSAQFGFKSFKELLESPMMDKFVKVEVGIKEGRLRTTYTAKMDATTRKVMEQQKWFHQTAEGRLKEQRRQNYQSQNNAAAAKRRCSMAPLSVNHPSLF

SEQ ID NO: 158985 - protein, 127 aa, Heterodera glycines
  Homolog annotation: Hit_ID=CAG02933.1; Match level="QueryCoverage =84%, HitCoverage=10%, E-value=3e-16, Identity=37%"; Hit description =unnamed protein product [Tetraodon nigroviridis]
  Gene Ontology: Cellular component=synaptonemal complex; Biological process=synaptonemal complex formation
  Coding regions on vcDNA: vcDNA=SeqID_85408; Strand=+; Position=1-381
GQNLAGREAAPKFTVPTVQDSYFLALKAGTRATNLVDKWVREYEESPDQAIVQLLQLIVASCGCSGKLDANMIHNMQWKDIVERLSEYFDEDSGDYPLTTQQYRKFRNNFAEFLQAFVLRSKNNILF

SEQ ID NO: 158986 - protein, 61 aa, Heterodera glycines
  Coding regions on vcDNA: vcDNA=SeqID_85409; Strand=-; Position=94-279
PRRILEFNFTEWRRKIRENGGKERDSRNESILKLFSNYIYGSLILNAFLLVLFLSFFYHFT

SEQ ID NO: 158987 - protein, 67 aa, Heterodera glycines
  Coding regions on vcDNA: vcDNA=SeqID_85410; Strand=-; Position=2-202
VLQLKFIFRLFFPDLNHYPDAFRIILLYTVICFYDDFLFCLCIFIIRQNISRSINFVKSKKKKKKKK

SEQ ID NO: 158988 - protein, 73 aa, Heterodera glycines
  Coding regions on vcDNA: vcDNA=SeqID_85411; Strand=-; Position=148-369
FPQFTTGDVIGCGLNAFNRHVFFTLNGEKLDMGILAADPVRLFAAVTLVDNKDAIRANFGPSFVFNLSSVLPF

SEQ ID NO: 158989 - protein, 74 aa, Heterodera glycines
  Coding regions on vcDNA: vcDNA=SeqID_85412; Strand=+; Position=1-225
FFFFFFFLSTNSTKLLRFCAILKNTEQKLTEHKMTGMRKKLKAQSKRDTFWLHNYLLGYNKIECQKLRKECEKK

SEQ ID NO: 158990 - protein, 67 aa, Heterodera glycines
  Homolog annotation: Hit_ID=AAO33474.1; Match level="QueryCoverage =98%, HitCoverage=47%, E-value=4e-33, Identity=100%"; Hit description= gland-specific protein g4g12 [Heterodera glycines]
  Coding regions on vcDNA: vcDNA=SeqID_85413; Strand=+; Position=1-204
GQGGNAAGLVPSHVTNRSMAPPPPPVQFEMGANRLEKMRAHLRELAEKMPVNESKRLSPSGPDPHHH

SEQ ID NO: 158991 - protein, 146 aa, Heterodera glycines
  Coding regions on vcDNA: vcDNA=SeqID_85414; Strand=+; Position=1-438
GTSEEDTEADMEEGDGLAADERKMEMLDKYIHCARQAQMEPQVAFRATEHICGWLLCGGLRIGSAESVKALAHLLLVMFNTESRDRAPEAHVCLSRFLPCFVAVNRRHQQLLFRAFMSAFSLLQTMSLALQEEARQIDTVKMAISV

SEQ ID NO: 158992 - protein, 71 aa, Heterodera glycines
  Coding regions on vcDNA: vcDNA=SeqID_85415; Strand=+; Position=1-213
FFFFFFFFFFFFFFFFFFFNGSNLNQITKQKKTVKISSCSSNFCSARTFWATPASPEWAILRFPSRGAIRT

SEQ ID NO: 158993 - protein, 97 aa, Heterodera glycines
  Coding regions on vcDNA: vcDNA=SeqID_85416; Strand=+; Position=41-331
QKSKKANLEMNKIFEKMSAFLCLSSTAFVLKFVIQSIDSIKVSRKSVEIALGAASPNLKMDSNTDSSAEVVSRPMNAIQSLTQQLPLASSWAVCSSS

SEQ ID NO: 158994 - protein, 50 aa, Heterodera glycines
  Coding regions on vcDNA: vcDNA=SeqID_85417; Strand=-; Position=126-278
LIFLSELSFIVCLSSLSNYNPSSSLFFNLNLLISSCKHAFSSSRFKQSIL

SEQ ID NO: 158995 - protein, 35 aa, Heterodera glycines
  Coding regions on vcDNA: vcDNA=SeqID_85418; Strand=+; Position=3-110
FFFFFFFSFFFFFFFFKPKMDLTTKKRGKPFFYTK

SEQ ID NO: 158996 - protein, 49 aa, Heterodera glycines
  Coding regions on vcDNA: vcDNA=SeqID_85419; Strand=-; Position=52-201
LLSLSVWTFPLLIKSLPDNNTCVLIQIALNKKIRFLHCIFDEKPEGCVF

SEQ ID NO: 158997 - protein, 83 aa, Heterodera glycines
  Coding regions on vcDNA: vcDNA=SeqID_85420; Strand=-; Position=169-420
QLHENDGDNDQCQHHHQQPWHNEHCANSTLVSPDFWRPISAQNTEQHLELTLEPSARTVYHGGRYGRFWQKVDNEMAKSLLLK

SEQ ID NO: 158998 - protein, 63 aa, Heterodera glycines
  Coding regions on vcDNA: vcDNA=SeqID_85421; Strand=+; Position=64-255
LETKKATCICVVLFCCYSNHIVHLCRCFTVLFSFFSLSVPLFLFFPLLAYKFLFLYYTNIEFD

SEQ ID NO: 158999 - protein, 55 aa, Heterodera glycines
  Homolog annotation: Hit_ID=CAG06679.1; Match level="QueryCoverage =100%, HitCoverage=7%, E-value=6e-10, Identity=61%"; Hit description =unnamed protein product [Tetraodon nigroviridis]
  Coding regions on vcDNA: vcDNA=SeqID_85422; Strand=-; Position=12-179
KESREREIEERGEREREERERMRTEGDRERVREKKESEREERREKRKRERERGER

SEQ ID NO: 159000 - protein, 93 aa, Heterodera glycines
  Coding regions on vcDNA: vcDNA=SeqID_85423; Strand=+; Position=65-346
NLLCFHTHFLGVCAKEIERKFKILSGIGHHLFFTVALCCFEHEKYNNNSSEAKHRSSQIAKMTRIHFWSSHLFNVSSSPQQILFLLPLFGPRI

SEQ ID NO: 159001 - protein, 135 aa, Heterodera glycines
  Coding regions on vcDNA: vcDNA=SeqID_85424; Strand=-; Position=1-405
APRAFGTALSLRVKFKMDSEMAQADQQWTETRKRETKWLYSVAACVLAVAVGHLLLNFGYVLQSMIFESLSVATGLSFVFSMCLLGAVGFYAVRLLRFCLILSAYISLNLFVTASLLLFAFIQDFFFLATTLDDE

SEQ ID NO: 159002 - protein, 63 aa, Heterodera glycines
  Coding regions on vcDNA: vcDNA=SeqID_85425; Strand=+; Position=154-342
IKSIFFSPSLQNRPQPSADQNRQLRWNDQSKVRLPLRNRALEAQLEFHFRLWPAQNQHDFGPH

SEQ ID NO: 159003 - protein, 122 aa, Heterodera glycines
  Homolog annotation: Hit_ID=CAE64512.1; Match level="QueryCoverage =98%, HitCoverage=22%, E-value=1e-28, Identity=50%"; Hit description =Hypothetical protein CBG09248 [Caenorhabditis briggsae]
  Gene Ontology: Biological process=reproduction
  Coding regions on vcDNA: vcDNA=SeqID_85426; Strand=-; Position=99-467
VPIPKTKSKALRSTFLNLARLKNIEFSFLKDEDNLWDLVGEGSPYFYAEFPDGSKMLSRSMAQFPLQFGREVFANKALLDCEEKVDWRNCSLGKKEEEKLTIALKEGFKPFAFTGDSFEDED

SEQ ID NO: 159004 - protein, 104 aa, Heterodera glycines
  Homolog annotation: Hit_ID=AAN32888.1; Match level="QueryCoverage =100%, HitCoverage=30%, E-value=2e-50, Identity=97%"; Hit description= annexin 4C10 [Heterodera glycines]
  Gene Ontology: Mol. function=phospholipase inhibitor activity; Cellular component=nucleoplasm; Biological process=skeletal development
  Coding regions on vcDNA: vcDNA=SeqID_85427; Strand=-; Position=72-386
HEIEKGIEQEFSGQNEAGFLALIKYVRNASVFFADLLFNSMKGLGTRDSDLIRLVISRSEIDLADIKHAFHTLHKKSLEEAIKGDTSGAYRDALLALVKGNTEQ

SEQ ID NO: 159005 - protein, 65 aa, Heterodera glycines
  Coding regions on vcDNA: vcDNA=SeqID_85428; Strand=-; Position=98-295
RAPVFDRLQKEPGSSVTGQFVHGRTEKTGQATQFDRLKRVEFDEAKIHGGVMVVFSYDCVSICGF

SEQ ID NO: 159006 - protein, 123 aa, Heterodera glycines
  Homolog annotation: Hit_ID=CAE61811.1; Match level="QueryCoverage =90%, HitCoverage=87%, E-value=1e-09, Identity=33%"; Hit description =Hypothetical protein CBG05778 [Caenorhabditis briggsae]
  Coding regions on vcDNA: vcDNA=SeqID_85429; Strand=+; Position=68-436
MSIDEIERTIPLPSSHLFSHSQFVRAEIHSFEEAFVHNKRFKEFEGLLRTNHKTYESVEAKFDLQKIEKMSTLTNRLNKLADHLGEIGHLHFEKGELNAMDLEEKPMFEIVRLAEQKQHEIEE

SEQ ID NO: 159007 - protein, 134 aa, Heterodera glycines
  misc_feature (18)..(18): Xaa can be any naturally occurring amino acid
  Homolog annotation: Hit_ID=XP_312441.1; Match level="QueryCoverage =99%, HitCoverage=25%, E-value=2e-48, Identity=70%"; Hit description =ENSANGP00000022164 [Anopheles gambiae]
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_85430; Strand=+; Position=1-403
GIHGTRSAVTFICEQPDXTISFVGSDQAGKYIYEHGSKLGKRVQSNMGAKNHGVILPDANREHTLNQVAAAAFGAAGQRCMALSTAIFVGDARGWVSDLVERARKLRVGPGWEAGTDIGPVISQKAKERICELV

SEQ ID NO: 159008 - protein, 83 aa, Heterodera glycines
  Coding regions on vcDNA: vcDNA=SeqID_85431; Strand=+; Position=56-304
CGKTMNAIDCLKSHRPLVVIYLPPFFFLGPTVSLLPTVSVFDFGCSFSAVFTAAGCVLGCSLSTVRAATGCGFGCSFSAGFVT

SEQ ID NO: 159009 - protein, 77 aa, Heterodera glycines
  Coding regions on vcDNA: vcDNA=SeqID_85432; Strand=-; Position=3-233
GHPYANLLRKCRSMNRSVCPRVDPPLIIIRAMDGSNGGRKNGCLVFRFYSTLFYLLVFQNKFLPQLFNPKKKKKKKK

SEQ ID NO: 159010 - protein, 116 aa, Heterodera glycines
  Coding regions on vcDNA: vcDNA=SeqID_85433; Strand=+; Position=3-350
EQERPEDHESYWNSVLRQMLCADFSSVLTLLQFHSAFKNDEALLKMAKILQTVNVSLFKYDRTNCDELWALRKKVCDLTAHKQMFRSHDNLGVICSLLIGDRGTFKKYFDLFRPNW

SEQ ID NO: 159011 - protein, 98 aa, Heterodera glycines
  Coding regions on vcDNA: vcDNA=SeqID_85434; Strand=-; Position=65-361
KVDHPTLLSDSDSLFGATTAATNALNIYYMCHYYYYLLPNPNPINHLNYYVLHIPFISPQLNHPSSFKMIYSFFHTIFKFDFSSADTIAWNTHTFPRC

SEQ ID NO: 159012 - protein, 34 aa, Heterodera glycines
  Coding regions on vcDNA: vcDNA=SeqID_85435; Strand=+; Position=3-107
FFFFFFFFFFFFFFFFIFFFFFGKKRIFFSQNPF

SEQ ID NO: 159013 - protein, 141 aa, Heterodera glycines
  Homolog annotation: Hit_ID=AAH70826.1; Match level="QueryCoverage =98%, HitCoverage=27%, E-value=3e-25, Identity=44%"; Hit description =MGC83917 protein [Xenopus laevis]
  Coding regions on vcDNA: vcDNA=SeqID_85436; Strand=+; Position=2-427
GNLLESLEPPPRPKISWSNYLRASDEQSHLGRPIQTKVTTKDVSGMLAMSTDFPISLNLALDILSVMEPVNPTVAKLREFCTAKLPEGFPVRVEMPIFATIQARVIFQQFRWCGEGASPAFPDAMFRTPDDYREDPKRFRM

SEQ ID NO: 159014 - protein, 29 aa, Heterodera glycines
  Coding regions on vcDNA: vcDNA=SeqID_85437; Strand=+; Position=3-92
FFFFFFFFWVRGIYGIFKNNNLFLSMNKT

SEQ ID NO: 159015 - protein, 139 aa, Heterodera glycines
  Homolog annotation: Hit_ID=XP_342000.1; Match level="QueryCoverage =72%, HitCoverage=14%, E-value=6e-18, Identity=48%"; Hit description =similar to HRD1 protein; synoviolin 1 [Rattus norvegicus]
  Coding regions on vcDNA: vcDNA=SeqID_85438; Strand=+; Position=3-419
EQAQHFPWSPHQPFSMPFGGLPPPPPFLPFPQPPLFAGLSDAEIAAMEGTERRAVEARIQSLRNISTLLDAALLQFQQYLSVSPGIAPQQTQRDENFAQNPSTSADSATDAETNGRESQRNETETYAKKRKRDRERDSH

SEQ ID NO: 159016 - protein, 158 aa, Heterodera glycines
  Homolog annotation: Hit_ID=CAE73419.1; Match level="QueryCoverage =99%, HitCoverage=15%, E-value=5e-72, Identity=80%"; Hit description =Hypothetical protein CBG20862 [Caenorhabditis briggsae]
  Gene Ontology: Mol. function=pre-mRNA splicing factor activity; Cellular component=spliceosome complex; Biological process=cell cycle
  Coding regions on vcDNA: vcDNA=SeqID_85439; Strand=+; Position=2-475
GDPPPYEALAAALEHLYALGALNHKGMLTKLGRRMAEFPCDPAMSKMIISSEKYECSEEIITISAMLSVNAAVFYRPKAMVIHADTARKGFWSSSGDHLTLLNVYNKWRETNFSMQWCIENFVQHRTMKRARDIRDQLEGLLERVEIEPKSSSDTMAI

SEQ ID NO: 159017 - protein, 56 aa, Heterodera glycines
  Homolog annotation: Hit_ID=CAE66337.1; Match level="QueryCoverage =83%, HitCoverage=13%, E-value=1e-15, Identity=85%"; Hit description =Hypothetical protein CBG11588 [Caenorhabditis briggsae]
  Gene Ontology: Mol. function=methyltransferase activity; Cellular component=small nuclear ribonucleoprotein complex; Biological process=ribosomal large subunit assembly and maintenance
  Coding regions on vcDNA: vcDNA=SeqID_85440; Strand=-; Position=136-306
AEPEAVFAGEVNKLREEQFKPIEQVTLEPYERDHAVVVAEYRAAKKKVKKEKMEEE

SEQ ID NO: 159018 - protein, 122 aa, Heterodera glycines
  Coding regions on vcDNA: vcDNA=SeqID_85441; Strand=-; Position=2-367
IKEFKHLSKNRIKNLLKLDLHVEQHFWQTLNAILTDIQYGRPYFFAQLLKEKLDKLRGNEKWASADALKNVTRILLTRAPIDLADIDQEFQGLSGSLTIRISISAYIEQIIGFKKKKKKKKK

SEQ ID NO: 159019 - protein, 51 aa, Heterodera glycines
  Coding regions on vcDNA: vcDNA=SeqID_85442; Strand=-; Position=136-291
THASVPEQMRNLIGISDTLIRLSVGCEAKTALINDLDMALNLATDEMNRAG

SEQ ID NO: 159020 - protein, 93 aa, Heterodera glycines
  Coding regions on vcDNA: vcDNA=SeqID_85443; Strand=-; Position=0-278
IKTRTIIMTISAGRFGREKKRKYVYPKDGHPLRCCEGDIFCKLRPAPIGCEDGGLLLLTLFPVETVEEGAPITPAAGGWMTLAERIPSTTPPP

SEQ ID NO: 159021 - protein, 145 aa, Heterodera glycines
  Coding regions on vcDNA: vcDNA=SeqID_85444; Strand=+; Position=2-436
GCLFCFMASLIVFALVLGLAITLTVITVNNWKEIGVLLSKQSALKSRSDIEAFYEIDCPIYSDNSKLPDKWDQFDLAFCNRYCDRNQMFEFMYRQLDPNRKSSAKSKDNQELMCPIYIEFKQCQMEEGGHCEEKLFSEEFTEFVQ

SEQ ID NO: 159022 - protein, 100 aa, Heterodera glycines
  Homolog annotation: Hit_ID=XP_392495.1; Match level="QueryCoverage =85%, HitCoverage=35%, E-value=7e-09, Identity=41%"; Hit description =similar to CG8448-PA [Apis mellifera]
  Coding regions on vcDNA: vcDNA=SeqID_85445; Strand=+; Position=43-345
MKQRRRHTTNLFGDGAFGAHFAGKDENNCEFSTVIRFSTSSKDPGKKIKKTITQTRLVNGKKIVTKKVEDNGQVEEEVMENGVLKAKLINGTPVDIRAEC

SEQ ID NO: 159023 - protein, 142 aa, Heterodera glycines
  Coding regions on vcDNA: vcDNA=SeqID_85446; Strand=+; Position=10-438
LIIPMPLKNNGPAKKLVPKRLALELLYEITLFISPRNDLSSFCSSSAVFREFMCPRVIKWNLFWHSAIEKLKTSYKEAKKSPIWDSIISNASGVAKLGDNSVFRFLSDAVNLCEGEPVRFSSTRPVTGSLCISSPPPKKQKE

SEQ ID NO: 159024 - protein, 165 aa, Heterodera glycines
  Homolog annotation: Hit_ID=NP_990316.1; Match level="QueryCoverage =99%, HitCoverage=39%, E-value=3e-55, Identity=65%"; Hit description =PGK protein [Gallus gallus] gb|AAC42219.1| PGK pir||I50407 phosphoglycerate kinase (EC 2.7.2.3) - chicken
  Gene Ontology: Mol. function=phosphoglycerate kinase activity; Cellular component=cytosol; Biological process=glycolysis
  Coding regions on vcDNA: vcDNA=SeqID_85447; Strand=+; Position=3-497
GSMVGCAMEKRASGFLMKKELEYFAKALESPTRPFLAILGGAKVADKIQLINNLLDKVDEMVICGGMAFTFYKVLTGKSIGKSLFDEEGSKIINDLMAKAKDKNVKIHQPVDFVVGDEFKEGTPFANVDAKDGIPNGKMGLDIGQETLKQFAEVIGRAKTVVWNG

SEQ ID NO: 159025 - protein, 28 aa, Heterodera glycines
  Coding regions on vcDNA: vcDNA=SeqID_85448; Strand=-; Position=148-234
LFFFFFFFFFFFFFFFFFFFFFERRSIY

SEQ ID NO: 159026 - protein, 102 aa, Heterodera glycines
  Coding regions on vcDNA: vcDNA=SeqID_85449; Strand=-; Position=75-383
LRCLEPSSISASKTSGSARVTRKFSPILLKFLAFPLRVSNFSARSKFAASSVVPPSASLLCCPPFVLSASVSPFCCCCCSQSVGPFLASFPSPPFPFVFNGK

SEQ ID NO: 159027 - protein, 51 aa, Heterodera glycines
  Coding regions on vcDNA: vcDNA=SeqID_85450; Strand=-; Position=2-154
SAETAMSAQKPRSGRRVAMWDSGADRKRKPGRRSLWLIHCRIENGSLLVIT

SEQ ID NO: 159028 - protein, 109 aa, Heterodera glycines
  Homolog annotation: Hit_ID=NP_492824.1; Match level="QueryCoverage =100%, HitCoverage=60%, E-value=6e-18, Identity=44%"; Hit description= vamp-associated protein like family member (34.3 kD) (1L383) [Caenorhabditis elegans] gb|AAC17524.1| Hyp
  Gene Ontology: Mol. function=structural molecule activity; Cellular component=microtubule associated complex; Biological process=N -linked glycosylation
  Coding regions on vcDNA: vcDNA=SeqID_85451; Strand=-; Position=2-328
KKSESKEPEKKENEEQKPAGKKEKRPAEKEEKKSESKEAEKKENEEQKPVGKKEKRPAEKEEKKSESKEPEKKENEEQKPVGKKEKRPAEKEEKKSESKEAKKKKKKKK

SEQ ID NO: 159029 - protein, 135 aa, Heterodera glycines
  misc_feature (120)..(120): Xaa can be any naturally occurring amino acid
  Homolog annotation: Hit_ID=NP_494593.1; Match level="QueryCoverage =98%, HitCoverage=12%, E-value=4e-09, Identity=28%"; Hit description =eukaryotic initiation factor 2C2 family member (2D895) [Caenorhabditis elegans] gb|AAF60724.1| Hypothetic
  Coding regions on vcDNA: vcDNA=SeqID_85452; Strand=+; Position=38-442
MFFGLDMSHAPPQTLFERRTGKAPAIPTIVGMAYTISEHLLQMNGTYWMQQPRVATVQMASPMVNAVKEALMTFNAKNGFFPEHIFVFRAGASEGEYKKVAYWEGGAFATAFAELTKERXMSKKPALTLIVCQRN

SEQ ID NO: 159030 - protein, 147 aa, Heterodera glycines
  misc_feature (135)..(135): Xaa can be any naturally occurring amino acid
  Coding regions on vcDNA: vcDNA=SeqID_85453; Strand=+; Position=1-441
GGWRRLFELCMDHVNGLGCSYQNVRLRIGSCLATISSSDFKKALVEANGGEANADDDSQLKHVTVEEVISRINAMLTPLWSEALRSSVGVSADVPHTESALSLDGIVVTPADEHKREKLALITLLNYFSSLSTHXAQLLRPFATSIF

SEQ ID NO: 159031 - protein, 77 aa, Heterodera glycines
  misc_feature (13)..(13): Xaa can be any naturally occurring amino acid
  misc_feature (31)..(31): Xaa can be any naturally occurring amino acid
  misc_feature (66)..(66): Xaa can be any naturally occurring amino acid
  Coding regions on vcDNA: vcDNA=SeqID_85454; Strand=+; Position=1-235
FFFFFFFFFVDHXFFKFIKSFNEFALFLIIXIGFSFSFYLILIHFSIWVLIADLRLIILQFFFQFXIIFPFVFYFFT

SEQ ID NO: 159032 - protein, 118 aa, Heterodera glycines
  Homolog annotation: Hit_ID=P48817; Match level="QueryCoverage=88%, HitCoverage=67%, E-value=6e-27, Identity=51%"; Hit description =Nucleoside diphosphate kinase (NDK) (NDP kinase) gb|AAA90988.1| nucleoside diphosphate kinase pir||JC4359 nucl
  Gene Ontology: Mol. function=ATP binding; Cellular component=nucleus; Biological process=negative regulation of cell proliferation
  Coding regions on vcDNA: vcDNA=SeqID_85455; Strand=+; Position=96-449
MERTFVCIKPESVRRCLVGKIIERFEANGFRLIAIKMIVATRKQAMDHYVACAGQPFFPKVISYMTSGPVVAMIWEGVGVVRGIRKILGATPDKVPPPGTLRADYRNNSDVGKYHDTV

SEQ ID NO: 159033 - protein, 79 aa, Heterodera glycines
  Coding regions on vcDNA: vcDNA=SeqID_85456; Strand=-; Position=3-239
TKKPGPSVSWTRAWPIGQFGGRKGVRANASDTCGILQGRRTTSSRPNSMKNVFLLFAAFQHSIFVLKFNFKKKKKKKKK

SEQ ID NO: 159034 - protein, 142 aa, Heterodera glycines
  Homolog annotation: Hit_ID=CAE67866.1; Match level="QueryCoverage =100%, HitCoverage=89%, E-value=2e-53, Identity=66%"; Hit description= Hypothetical protein CBG13458 [Caenorhabditis briggsae]
  Coding regions on vcDNA: vcDNA=SeqID_85457; Strand=+; Position=53-478
MVQMWCMETYPCGDPRLPHHCFPPKLVNPDELTKRTGALYYKLDLEDQVALSKRIAIMKLERNFTKEDTYTLDAQTTNDFKEKIAELFEETESDEDQARMVLEGSAYYDVEAKDGVWIRIFCEYGDLLIIPKGIAHRMTTTP

SEQ ID NO: 159035 - protein, 122 aa, Heterodera glycines
  Homolog annotation: Hit_ID=AAR01198.1; Match level="QueryCoverage =100%, HitCoverage=92%, E-value=3e-68, Identity=100%"; Hit description=cellulase binding protein [Heterodera glycines] gb|AAN32887.1| cellulose binding protein [Heterodera gly
  Coding regions on vcDNA: vcDNA=SeqID_85458; Strand=+; Position=65-430
MNWMHYCLIACFAFYYFNTVESSTINSVTVQVNKIENNENGRQFNLEFTNQVYERVCHVDFRIDLPDTVKLNKYSKMVPIPDTCGQYALPKSLDLLPGESFDAQLTLLGHDGKPNVTVLNTN

SEQ ID NO: 159036 - protein, 77 aa, Heterodera glycines
  Coding regions on vcDNA: vcDNA=SeqID_85459; Strand=-; Position=2-232
SSQPTTPRHVPPNHPTFAQPFMDDDQYYQRHLRQRQFLNALEGSINTPPVRTEQRRIIMETEMTNLVSKKKKKKKKK

SEQ ID NO: 159037 - protein, 64 aa, Heterodera glycines
  Coding regions on vcDNA: vcDNA=SeqID_85460; Strand=+; Position=3-194
FFFFFFFFCEHCFFTHPTNVVQNDKIDRVGNGPPIQNQLCLKMEFFFASIPSDEFVQSQRRSIG

SEQ ID NO: 159038 - protein, 103 aa, Heterodera glycines
  Coding regions on vcDNA: vcDNA=SeqID_85461; Strand=-; Position=3-311
WWRRSWRQSEQQQPAASARQCLRSKNISEKEGTDRNLCDGPINCPSPCAIPFDFIRKTIILLCVLSSRTRYLLMSHNAYKSILGKHLMNQINPQFAKKKKKKK

SEQ ID NO: 159039 - protein, 170 aa, Heterodera glycines
  Coding regions on vcDNA: vcDNA=SeqID_85462; Strand=+; Position=1-510
GETLHHYSSSISSDLHISFPSVLSSNCCHFQLPFTAIVDDIPPPPAVAADGGDVVVDLEQHVRQLIMSIGQGSEDAVHELSILIEPFNQEQLVDFLEIMARMYVESGVSVDLPGGQGINMLMVAASSGRVDFARYLLAHGATVGHLDATGSVFPLMLAAESGELEVCRLL

SEQ ID NO: 159040 - protein, 108 aa, Heterodera glycines
  misc_feature (47)..(47): Xaa can be any naturally occurring amino acid
  Homolog annotation: Hit_ID=NP_508168.1; Match level="QueryCoverage =98%, HitCoverage=47%, E-value=1e-25, Identity=50%"; Hit description =cysteine dioxygenase (21.9 kD) (XB482) [Caenorhabditis elegans] gb|AAB36852.2| Hypothetical protein F56F1
  Coding regions on vcDNA: vcDNA=SeqID_85463; Strand=+; Position=133-456
MDKLVLKIRELLDENEVNFGEVQRILEEYKSEPKDWRQFTHFDEHKXTDEVKQVESKVLFRYTRNLVDAGNGKYNLMILCWGPGMGSSIHDHSAAQCFVKVLDGQLLE

SEQ ID NO: 159041 - protein, 65 aa, Heterodera glycines
  Homolog annotation: Hit_ID=CAA75581.1; Match level="QueryCoverage =100%, HitCoverage=48%, E-value=1e-17, Identity=69%"; Hit description= histone H2A [Aspergillus niger] sp|O13413|H2A_ASPNG Histone H2A
  Gene Ontology: Mol. function=DNA binding; Cellular component=nuclear nucleosome; Biological process=chromatin assembly/disassembly
  Coding regions on vcDNA: vcDNA=SeqID_85464; Strand=-; Position=240-437
AGNAARENKKLRITPRHLQLAVRNDEELNKLLAEVTISRGGVLPNIHTELLSKMQQKKQQNDDSQ

SEQ ID NO: 159042 - protein, 42 aa, Heterodera glycines
  Homolog annotation: Hit_ID=AAO33474.1; Match level="QueryCoverage =100%, HitCoverage=30%, E-value=8e-18, Identity=100%"; Hit description=gland-specific protein g4g12 [Heterodera glycines]
  Coding regions on vcDNA: vcDNA=SeqID_85465; Strand=-; Position=194-322
VQFEMGANRLEKMRAHLRELAEKMPVNESKRLSPSGPDPHHH

SEQ ID NO: 159043 - protein, 123 aa, Heterodera glycines
  Homolog annotation: Hit_ID=P41962; Match level="QueryCoverage=97%, HitCoverage=75%, E-value=2e-45, Identity=66%"; Hit description =Superoxide dismutase [Cu-Zn] emb|CAA53902.1| cytoplasmic Cu/Zn -superoxide dismutase [Brugia pahangi]
  Gene Ontology: Mol. function=copper, zinc superoxide dismutase activity; Cellular component=cytoplasm; Biological process =neurogenesis
  Coding regions on vcDNA: vcDNA=SeqID_85466; Strand=+; Position=1-369
GQGEITGLSPGKHGFHVHAFGDLSSGCMSAGPHFNPTNKTHGGPEDETRHVGDLGNVLAGQDGVAKLDFTDKVISLVGPHNIIGRALVVHKLEDDLGRGEGLKKPESMETGNAGPRLACGVIG

SEQ ID NO: 159044 - protein, 105 aa, Heterodera glycines
  Homolog annotation: Hit_ID=NP_506192.1; Match level="QueryCoverage =97%, HitCoverage=16%, E-value=3e-35, Identity=71%"; Hit description =ATP-binding cassette sub-family F member like (69.2 kD) (5N242) [Caenorhabditis elegans] emb|CAA99835.1|
  Gene Ontology: Mol. function=translation factor activity, nucleic acid binding; Cellular component=membrane; Biological process =protein biosynthesis
  Coding regions on vcDNA: vcDNA=SeqID_85467; Strand=-; Position=84-401
HIKNLSGGQKSRVALAELSLKQPDILILDEPTNNLDIESIQALVEGIEDFSGGVVMVTHDERLIKATNCRLWVVEDQKIYQIDGDFDDYRKEVLDQVEKSLTSIG

SEQ ID NO: 159045 - protein, 48 aa, Heterodera glycines
  Coding regions on vcDNA: vcDNA=SeqID_85468; Strand=+; Position=1-144
FFFFFFFFFCILALLFCLNLRNFDKLKWQLWFTNKIFYSHPPVRGWNP

SEQ ID NO: 159046 - protein, 94 aa, Heterodera glycines
  Coding regions on vcDNA: vcDNA=SeqID_85469; Strand=-; Position=2-283
LPLFIALLQAHAPVGMKIVVKKHSPRYQRSKYIPDPQLEDFKEPLGHLHDPVVRKLLGWEAYQPSQWKCTVINASCFNSRKQKKCAKKKKKKKK

SEQ ID NO: 159047 - protein, 151 aa, Heterodera glycines
  Homolog annotation: Hit_ID=AAL78214.1; Match level="QueryCoverage =90%, HitCoverage=68%, E-value=7e-28, Identity=44%"; Hit description =putative esophageal gland cell protein Hgg-20 [Heterodera glycines]
  Coding regions on vcDNA: vcDNA=SeqID_85470; Strand=+; Position=93-545
MSDHPNVALADLSRVANDVWLDTLFWIDRAEVGMKFALIDARFGRLVATHFNLRKWWLGELGVHRAPRRWQCGGTAAVSAMDDYAMSNRLPLATCPAPNGVIGFRAIYIWYVDLEVIAFLQCLQRVINRGIAVQFTIHSTDVRCWALMAQR

SEQ ID NO: 159048 - protein, 78 aa, Heterodera glycines
  Homolog annotation: Hit_ID=S01704; Match level="QueryCoverage=96%, HitCoverage=40%, E-value=1e-15, Identity=50%"; Hit description =merozoite surface antigen - Eimeria acervulina (fragment) emb|CAA30977.1| EAMZp35 protein [Eimeria acervulina]
  Coding regions on vcDNA: vcDNA=SeqID_85471; Strand=-; Position=365-601
SPVSPSDCPLSSPDCPVSPSDCPLSSPDCPVSPSDCPLSSPDCPVSPSDCPLSSPDCPVSPSDCPLSSPDCPLSPRDC

SEQ ID NO: 159049 - protein, 96 aa, Heterodera glycines
  Coding regions on vcDNA: vcDNA=SeqID_85472; Strand=-; Position=3-290
VRNLKRRPLSWIAHLKRNRRKSRMRHLMLLQPLLTHCPLRRLHRIRRMKLWRFPPLLLFPPLSMFRRTVDTAPPPSLSQPVAATAAAAQYHQHRNN

SEQ ID NO: 159050 - protein, 38 aa, Heterodera glycines
  Coding regions on vcDNA: vcDNA=SeqID_85473; Strand=-; Position=2-115
RTDAISPIGDFKFVSRFWYNFGLNKSPINKKKKKKKKK

SEQ ID NO: 159051 - protein, 143 aa, Heterodera glycines
  Homolog annotation: Hit_ID=CAE64301.1; Match level="QueryCoverage =99%, HitCoverage=19%, E-value=2e-66, Identity=83%"; Hit description =Hypothetical protein CBG08977 [Caenorhabditis briggsae]
  Gene Ontology: Mol. function=pre-mRNA splicing factor activity; Cellular component=spliceosome complex; Biological process=mRNA splicing
  Coding regions on vcDNA: vcDNA=SeqID_85474; Strand=+; Position=1-429
GRFEDCVSDRTVLKYCTDGMLLREAMNNPLLEQYNVVLLDEAHERTLATDILMGLIKEIIRQRQDLKIVVMSATLDAGKFQNYFDSCPLLSVPGRTFPVEIFYTPEPERDYLEAAVRTVIQIHVCEEVEGDILLFLTGQEEIE

SEQ ID NO: 159052 - protein, 132 aa, Heterodera glycines
  Homolog annotation: Hit_ID=CAE67084.1; Match level="QueryCoverage =93%, HitCoverage=46%, E-value=2e-20, Identity=40%"; Hit description =Hypothetical protein CBG12495 [Caenorhabditis briggsae]
  Coding regions on vcDNA: vcDNA=SeqID_85475; Strand=+; Position=16-411
QRRVRGTLSSENFFEDEERPEENIYERHFAQQQMTKEETRLVELQKRKEKAMEKADATQQIAQDINDLNQIMQDLAQLVHEQHDMVDSIEDHVERSMQEVKSGERNLRRAVASNSAKYPVAAAAVGGAVMGG

SEQ ID NO: 159053 - protein, 117 aa, Heterodera glycines
  Homolog annotation: Hit_ID=AAN14978.1; Match level="QueryCoverage =100%, HitCoverage=33%, E-value=4e-65, Identity=100%"; Hit description=chitinase [Heterodera glycines]
  Coding regions on vcDNA: vcDNA=SeqID_85476; Strand=-; Position=70-423
YNRAKLNMGVPFYGKSWTNVGAPLNGDGLWRQLGTYGTELAWRNMGKSFDMTKTTYHKTAKTAYIYDTATKNFLTFDNPQSLKDKAKYVAEKGIGGIMIWSIDQDDDKLSLLNSVSY

SEQ ID NO: 159054 - protein, 66 aa, Heterodera glycines
  Coding regions on vcDNA: vcDNA=SeqID_85477; Strand=-; Position=1-198
RKFIGTNSPLGWHFPLRWTASTFSNQSTFDCLLLFCMFCYILLSTKSYLLLINLCARKKKKKKKKK

SEQ ID NO: 159055 - protein, 150 aa, Heterodera glycines
  Homolog annotation: Hit_ID=Q17390; Match level="QueryCoverage=84%, HitCoverage=16%, E-value=1e-20, Identity=40%"; Hit description =Cullin 2
  Gene Ontology: Mol. function=protein binding; Cellular component=SCF ubiquitin ligase complex; Biological process=induction of apoptosis by intracellular signals
  Coding regions on vcDNA: vcDNA=SeqID_85478; Strand=+; Position=2-451
GTDINISQSLTTRFHEEMVKQEVRMDVPIHVMVLQAGAWPLSVPTAPAEPSSSSQQHETSADYVPPPVLQNSLKLFEQFYTTSHSGRKLTWLYGNSTAEVHLNYLDKLYQVTMSVYQLSILLLFSHQNTQQLAQIAFLCSLSVPAVIRAS

SEQ ID NO: 159056 - protein, 156 aa, Heterodera glycines
  Homolog annotation: Hit_ID=CAE64562.1; Match level="QueryCoverage =98%, HitCoverage=8%, E-value=4e-39, Identity=55%"; Hit description =Hypothetical protein CBG09312 [Caenorhabditis briggsae]
  Gene Ontology: Mol. function=zinc ion binding; Cellular component =nucleus; Biological process=growth
  Coding regions on vcDNA: vcDNA=SeqID_85479; Strand=+; Position=22-489
MADTSGQLNERFADLECLADAHQSLSRESAQGNKNAHQILHKVLTQLEELLNDMKSDVSRLPTTLARLRPVTERLGMTERAILGRLTSKDPDAVAGQSPLPPPGPFVTPMAQSRFSGIQPKFAALLKPKHQSKKENLPEKDGNDKQNQEEKRPSKE

SEQ ID NO: 159057 - protein, 167 aa, Heterodera glycines
  Homolog annotation: Hit_ID=XP_415618.1; Match level="QueryCoverage =99%, HitCoverage=20%, E-value=2e-47, Identity=49%"; Hit description =PREDICTED: similar to RIKEN cDNA 4732465I17 [Gallus gallus]
  Coding regions on vcDNA: vcDNA=SeqID_85480; Strand=+; Position=3-503
ATLLKWTNGTFPEMNYSRVVCGQDPRYCARPRSVHPYVWGLNISNWPICEKHSPSIPKSEKHMHCTVTGRPCCIQMHGQCRITSREYCDFVRGHFHPNATLCSQISCLNEVCGMTPFLRRDIPDQLYRLFTPLFIHAGIIRCVISLTLYLTIMCRFEIMIGWLRLSS

SEQ ID NO: 159058 - protein, 106 aa, Heterodera glycines
  Homolog annotation: Hit_ID=AAO33474.1; Match level="QueryCoverage =100%, HitCoverage=76%, E-value=6e-53, Identity=100%"; Hit description=gland-specific protein g4g12 [Heterodera glycines]
  Coding regions on vcDNA: vcDNA=SeqID_85481; Strand=+; Position=53-370
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRL

SEQ ID NO: 159059 - protein, 44 aa, Heterodera glycines
  Coding regions on vcDNA: vcDNA=SeqID_85482; Strand=-; Position=77-211
PNIPNLLPILYCVNCWSSLGLFENRFVTVPFARSLLCLKSPTPI

SEQ ID NO: 159060 - protein, 32 aa, Heterodera glycines; identical to SEQ ID NO: 158848
  Coding regions on vcDNA: vcDNA=SeqID_85483; Strand=+; Position=16-114

SEQ ID NO: 159061 - protein, 58 aa, Heterodera glycines; identical to SEQ ID NO: 158849
  Homolog annotation: Hit_ID=NP_496492.1; Match level="QueryCoverage =87%, HitCoverage=7%, E-value=5e-12, Identity=56%"; Hit description =Dyggve-Melchior-Clausen syndrome protein like, possibly N -myristoylated (78.2 kD) (2L967) [Caenorhabditis
  Coding regions on vcDNA: vcDNA=SeqID_85484; Strand=-; Position=123-299

SEQ ID NO: 159062 - protein, 78 aa, Heterodera glycines
  Homolog annotation: Hit_ID=NP_499535.1; Match level="QueryCoverage =100%, HitCoverage=15%, E-value=1e-30, Identity=79%"; Hit description= NOT-like, component of CCR4/NOT complex, CCR4-associated Factor family (ntl-3) [Caenorhabditis elegans]
  Gene Ontology: Mol. function=3'-5' exoribonuclease activity; Cellular component=CCR4-NOT core complex; Biological process=poly(A) tail shortening
  Coding regions on vcDNA: vcDNA=SeqID_85485; Strand=+; Position=160-393
MAEKRKLLNEIDKCYKKIDEGFEILDDIMEKMNEANSDNQREKFQDDLKKEIKKLQRLRDQIKGWQNSSEIKDKDSLS

SEQ ID NO: 159063 - protein, 72 aa, Heterodera glycines
  Coding regions on vcDNA: vcDNA=SeqID_85486; Strand=+; Position=3-221
FFFFFFFFLEMKIYECFKVQKIVRTKYINQILLKWISTIKRVCLMEFSGMTNNLLGRILAADQYNVWVGFFS

SEQ ID NO: 159064 - protein, 103 aa, Heterodera glycines
  Coding regions on vcDNA: vcDNA=SeqID_85487; Strand=-; Position=126-437
VFPQINFDLIRNRKVPTQIEQRHGEERARVGNIYEQFRTKESVYDLIRQIQQAEARRLSVKQSLPPQQFDVNGNLVTADRPTAAEETNNEASGFITENPLNLN

SEQ ID NO: 159065 - protein, 153 aa, Heterodera glycines
  Coding regions on vcDNA: vcDNA=SeqID_85488; Strand=+; Position=3-464
GVQAIHYSFSLTKYHNNFCIPEHSFIHSSFIMARPRGGGRNPAKARGARAKRRIGNKRKAAAGTAANVQAADRRPICPICLKKMTGVRQVRTICDHVFHYVCFHRWLKYRLFCPVCERNFRTELYHAGNAVVEGAYADGHVVLRTDGEQSNSG

SEQ ID NO: 159066 - protein, 73 aa, Heterodera glycines
  Coding regions on vcDNA: vcDNA=SeqID_85489; Strand=-; Position=1-219
VPSFSPPCPSMSPSRPPSSSLPTPSLALSFLSLFLPFSPSFALNMRRAFRSDAGQRERRTICAVVAGTDHRGH

SEQ ID NO: 159067 - protein, 71 aa, Heterodera glycines
  Coding regions on vcDNA: vcDNA=SeqID_85490; Strand=-; Position=64-279
PADGQGRQNVGQNCVVRGIGVARNHFAIVVEGDGLEKENGLCTAPFMIGCPFVILCLFVTFQCIRQMKAIN

SEQ ID NO: 159068 - protein, 158 aa, Heterodera glycines
  Coding regions on vcDNA: vcDNA=SeqID_85491; Strand=+; Position=2-475
GSNLRKKFAETEDEFTREIERVTAERDELRNEKETLSNLQTQRKKSDERQSQTDDEPKQRMTEQQIAEMVEQNVQLKTELNEREEELYRLRNDKVLAEITTSEGHSKRPPSDTDSATSNNDWERMGKEEIEAEGVSSSAGSEEKETPMANRHKKSSEL

SEQ ID NO: 159069 - protein, 124 aa, Heterodera glycines
  Homolog annotation: Hit_ID=NP_505680.2; Match level="QueryCoverage =98%, HitCoverage=23%, E-value=7e-27, Identity=46%"; Hit description =amino acid/polyamine transporter, family II (57.3 kD) (5K912) [Caenorhabditis elegans] emb|CAD54163.1| Hy
  Coding regions on vcDNA: vcDNA=SeqID_85492; Strand=+; Position=1-372
GWTGILLSVLMNFMFMYTSTVLDKCWVILQRRWPSSYSKQHCRQPYPELGGRACGPKLRAAVAACIDLNQFSTTTVYLLLSAKNIHDALKAFLDLNISFCLLLIFLVLLLLPLIFLNSPVDFWG

SEQ ID NO: 159070 - protein, 108 aa, Heterodera glycines
  Coding regions on vcDNA: vcDNA=SeqID_85493; Strand=+; Position=115-438
GSFCSFTIKYALELQLCQTKTPRRGGVADAWIRGRVIALNLAHSNAMFPRELWNVVDRVAAGIGRTNNSVEAWHSIWNVHLKGNQRLSSFIRKMIEEDNMWANRIADF

SEQ ID NO: 159071 - protein, 45 aa, Heterodera glycines
  Coding regions on vcDNA: vcDNA=SeqID_85494; Strand=-; Position=1-135
KWLFFCSLSELICVFFPLGGIFFCFCCFLRIKHFLPKKKKKKKKK

SEQ ID NO: 159072 - protein, 55 aa, Heterodera glycines
  Coding regions on vcDNA: vcDNA=SeqID_85495; Strand=+; Position=117-284
FKNVLIALTIEHKQPRFGHKGNEQLPRVWIIKASLIKGVNKCFGFFFRIKNIGQG

SEQ ID NO: 159073 - protein, 137 aa, Heterodera glycines
  misc_feature (8)..(8): Xaa can be any naturally occurring amino acid
  misc_feature (67)..(67): Xaa can be any naturally occurring amino acid
  Homolog annotation: Hit_ID=AAG34547.1; Match level="QueryCoverage =98%, HitCoverage=69%, E-value=3e-69, Identity=95%"; Hit description =beta-galactosidase [Cloning vector pUG7]
  Coding regions on vcDNA: vcDNA=SeqID_85496; Strand=+; Position=1-411
GPNSPYSXESYYNSLAVVLQRRDWENPGVTQLNRLAAHPPFASWRNSEEARTDRPSQQLRSLNGEWXAPCSGALSAAGVVVTRSVTATLASALAPAPFAFFPSFLATFAGFPRQALNRGLPLGFRFSALRHLDPKKP

SEQ ID NO: 159074 - protein, 36 aa, Heterodera glycines
  Coding regions on vcDNA: vcDNA=SeqID_85497; Strand=-; Position=2-109
TIIYRFLMFFLNSKCFYFEVHKKSPIRKKKKKKKKK

SEQ ID NO: 159075 - protein, 116 aa, Heterodera glycines
  Homolog annotation: Hit_ID=XP_456171.1; Match level="QueryCoverage =53%, HitCoverage=30%, E-value=4e-10, Identity=54%"; Hit description =unnamed protein product [Kluyveromyces lactis] emb|CAG98879.1| unnamed protein product [Kluyveromyces lac
  Coding regions on vcDNA: vcDNA=SeqID_85498; Strand=+; Position=31-378
MVAANLKLSLIFVAGFCLLFIADSDAGKSCKPGEKGPPGPPGKPGNKGKPGVCKPKYETTSKYGTTTSKYDTTTSKYGTTTPEYDTTTSKYDTTTSKYDTTTSDYGTTTSKYDTTT

SEQ ID NO: 159076 - protein, 75 aa, Heterodera glycines
  Coding regions on vcDNA: vcDNA=SeqID_85499; Strand=+; Position=1-225
CFFFFFFFFFLPKLKAFYALINFNFISESYNTNLFCHYLNSLFTHWPFDGTKPAQHSLCSSPPFPFVLGLVSCGP

SEQ ID NO: 159077 - protein, 164 aa, Heterodera glycines
  Coding regions on vcDNA: vcDNA=SeqID_85500; Strand=+; Position=1-492
GPSTTAELLLPGGSIGRLHASELTHSKSEWSEGTFPMQNFMARSSGKTITVKVICVSRSKSISARGRELLMERRQSDRIVECTAISEKVQEPRKKLSLIRYREQFDFGNVVPVFIVDTAKKEGTDQTHFTGEINPEFRAIIQITQSAKPAAKKDGTDTDQSENT

SEQ ID NO: 159078 - protein, 105 aa, Heterodera glycines
  Coding regions on vcDNA: vcDNA=SeqID_85501; Strand=-; Position=31-348
RRRFFSMMATLFFNDGDFFMEGLYHFKKLLLEAGIFTHYLFPFDDTWQQKFVQQPTGRERIRCGIFGRDERHNFVQKFERKAFGGHCWEMQGAVLLFGVISEQIS

SEQ ID NO: 159079 - protein, 68 aa, Heterodera glycines
  Coding regions on vcDNA: vcDNA=SeqID_85502; Strand=+; Position=1-207
FFFFFFFFLLMFICQFKYDVHVKKYITKYSEGRESNKKKTERKALGKIMRKLNVYEFTANDRMDLKLG

SEQ ID NO: 159080 - protein, 133 aa, Heterodera glycines
  Homolog annotation: Hit_ID=AAK26375.1; Match level="QueryCoverage =100%, HitCoverage=30%, E-value=2e-71, Identity=99%"; Hit description= class V aminotransferase [Heterodera glycines]
  Gene Ontology: Mol. function=alanine-glyoxylate aminotransferase activity; Cellular component=peroxisome
  Coding regions on vcDNA: vcDNA=SeqID_85503; Strand=+; Position=63-461
MLSRMLSSAVAVPRMCESNKKLLRKGAIFVGLLCGRMANSTFTATVTPPHRLLRPLHINEKKLFGPGPSNMPPLVQEGLVQPLLGHMHPEFFEIMDDVKAGIKYIFQTENALTFAVSGTGHAGMECAILNLLE

SEQ ID NO: 159081 - protein, 73 aa, Heterodera glycines
  Coding regions on vcDNA: vcDNA=SeqID_85504; Strand=-; Position=39-260
EMQLMFRFSSVARRVPLRSLIKVAQRQFPHGPAWMNEEEHLSKWLNPKSGRKSEKQRTKFIVKSISVYYCNLE

SEQ ID NO: 159082 - protein, 57 aa, Heterodera glycines
  Coding regions on vcDNA: vcDNA=SeqID_85505; Strand=+; Position=1-171
FFFFFFFFFSSDQIVLHQKPIRNNQMVFPVAANTRALFLLGNKNPSRSNWFTASSKH

SEQ ID NO: 159083 - protein, 59 aa, Heterodera glycines
  Coding regions on vcDNA: vcDNA=SeqID_85506; Strand=+; Position=125-304
IIGGVKKLNYGIQSFSKSKGTKIGGGDKIYRLGINTILIIDIICLEEQLSQFSSLHKAA

SEQ ID NO: 159084 - protein, 93 aa, Heterodera glycines
  Coding regions on vcDNA: vcDNA=SeqID_85507; Strand=+; Position=2-283
GASVWKHWANFLGNLYLANHSESSALSTGVQAMASTLEHISMVGAQKSRTSVAKLLWLLKIASACPSEKLMNAVDELLFRYVDTIQPANWLFG

SEQ ID NO: 159085 - protein, 121 aa, Heterodera glycines
  Homolog annotation: Hit_ID=CAE60688.1; Match level="QueryCoverage =99%, HitCoverage=19%, E-value=4e-40, Identity=64%"; Hit description =Hypothetical protein CBG04341 [Caenorhabditis briggsae]
  Gene Ontology: Biological process=cell organization and biogenesis
  Coding regions on vcDNA: vcDNA=SeqID_85508; Strand=+; Position=1-363
GIGLNNIKANDYTNVEYHALFHVPTLRDYFLREQNYMHIKRPTGDKLTLMPQRFGELLRKLWNPKAFKAHVSPHEMLQAVALCRDKKFQIIRQGDAHESMMCFLNTLHIGLNGTGKTNSSI

SEQ ID NO: 159086 - protein, 134 aa, Heterodera glycines
  Coding regions on vcDNA: vcDNA=SeqID_85509; Strand=+; Position=2-403
GVQRSLRPYIASSHQLNYHSEDNGGASAVNVCAELCAFLCANGFARAAKRRKTAPGIEENVARDGNCLPAEMGNKKGRGVQLGLRSLLRFHNKRYTAPKSEEKTQRRLLVVLLDADFAKPIALRHVFALLALGP

SEQ ID NO: 159087 - protein, 48 aa, Heterodera glycines
  Coding regions on vcDNA: vcDNA=SeqID_85510; Strand=-; Position=1-144
RRRRKRRRHPRRWRKKRRPRRRRNARRKRRRRKQRHRARKKKKKKKKK

SEQ ID NO: 159088 - protein, 139 aa, Heterodera glycines
  Coding regions on vcDNA: vcDNA=SeqID_85511; Strand=-; Position=1-417
GCCRDVRWPALGCLCSSSLSPPPLRFVVPRSCRSEATIRWMATRTFGTTLCSALRPRAQHHKQLLRTDSKRPPAPPCRTVQLLERSGRHAPARAAAPDVNSLCNNSSVRQRISGRPKSGATSTMPRATARKWCPPTALP

SEQ ID NO: 159089 - protein, 37 aa, Heterodera glycines
  Coding regions on vcDNA: vcDNA=SeqID_85512; Strand=+; Position=3-113
AHSSIKGMAPEISEDLYHLIKKAVSIRKHLERFKRTL

SEQ ID NO: 159090 - protein, 134 aa, Heterodera glycines
  Coding regions on vcDNA: vcDNA=SeqID_85513; Strand=+; Position=1-402
GAHFGHLLVGHRFAYALSPPIGWRRNGFWPISEIDRHFHRPLYFWARLIIGPHEKNAANRQRIGQTKRNDKNSVGHFCWTGQFANTSGIHRVSGRPFRTFHLCGRLISIYEILVCAYSSRPRVLLLFDGHYFGR

SEQ ID NO: 159091 - protein, 152 aa, Heterodera glycines
  Homolog annotation: Hit_ID=CAE59455.1; Match level="QueryCoverage =99%, HitCoverage=18%, E-value=3e-23, Identity=41%"; Hit description =Hypothetical protein CBG02834 [Caenorhabditis briggsae]
  Coding regions on vcDNA: vcDNA=SeqID_85514; Strand=+; Position=1-456
GEDDFFKKVIHEMTIKNIDWYTLDRTTHLAETTLGGLIVLVFSKTIQINTVRIRDRYFHMNSLATLANLASFFKQLSPLASQKLIGLLETMTKRRAKLIRLLRERAENEPQQQINREEAKDGGGEEETATERLTEAEEGDDLHHDITALEEG

SEQ ID NO: 159092 - protein, 50 aa, Heterodera glycines
  Coding regions on vcDNA: vcDNA=SeqID_85515; Strand=-; Position=100-252
RNQSERTRRTLSNWCPSLKKCYAGERTTKRQATETRKRCDVPLSERARAQ

SEQ ID NO: 159093 - protein, 114 aa, Heterodera glycines
  Homolog annotation: Hit_ID=CAE63272.1; Match level="QueryCoverage =99%, HitCoverage=15%, E-value=9e-09, Identity=35%"; Hit description =Hypothetical protein CBG07649 [Caenorhabditis briggsae]
  Coding regions on vcDNA: vcDNA=SeqID_85516; Strand=+; Position=2-343
GQLSLHNPWRSYNVVRLRPLTNYTFCLEYHLVHFPLHLADSSSSIFKTCIDVQTEEPLGFWTSLSPISIGILLAFCFCLSALLCFRALYLRFYIWHEAKLRARMNQSMSGQSFL

SEQ ID NO: 159094 - protein, 159 aa, Heterodera glycines
  Homolog annotation: Hit_ID=AAN32885.1; Match level="QueryCoverage =100%, HitCoverage=26%, E-value=2e-87, Identity=100%"; Hit description=glutamyl transpeptidedase [Heterodera glycines]
  Gene Ontology: Mol. function=gamma-glutamyl transferase activity; Cellular component=plasma membrane; Biological process=leukotriene biosynthesis
  Coding regions on vcDNA: vcDNA=SeqID_85517; Strand=+; Position=42-518
MSDANLVGTADHPLSSLHHRPSAYAWPPPSHSLMERFRQAAVTSDNGICSEIGRDVMMQKNGNAVDAAVAAMLCIGVTNAQSSGLGGGMVLTFYDAKTRSCKVIDARETAPARATAKAYSERVTANRTTARATGYHEIATPGELAGLWLAYKKFGSGRV

SEQ ID NO: 159095 - protein, 164 aa, Heterodera glycines
  misc_feature (75)..(75): Xaa can be any naturally occurring amino acid
  Homolog annotation: Hit_ID=NP_504577.1; Match level="QueryCoverage =93%, HitCoverage=27%, E-value=2e-36, Identity=48%"; Hit description =metallo-phosphoesterase and Protein similar to CwfJ, N-terminal 1 and Protein similar to CwfJ, N-terminal
  Gene Ontology: Biological process=reproduction
  Coding regions on vcDNA: vcDNA=SeqID_85518; Strand=+; Position=27-517
MNTKTNQKPIKVLCAGDVNGKFAQLSARVKAVDQKCGPFDALFCVGEFFGPNDEQNKSVLEGEMQLPLPTYILGXPSCQFTTVYFPSESSELCQSLTFLGRKGILTTASGISVAYFSGVEESPGGHQQDETKPFEFDQKAVDDLLLPLSANSGFLGVDLLLTSV

SEQ ID NO: 159096 - protein, 72 aa, Heterodera glycines
  Homolog annotation: Hit_ID=XP_395077.1; Match level="QueryCoverage =100%, HitCoverage=76%, E-value=2e-25, Identity=72%"; Hit description= similar to DcoH-like protein DCoHm [Apis mellifera]
  Gene Ontology: Biological process=sporulation (sensu Saccharomyces)
  Coding regions on vcDNA: vcDNA=SeqID_85519; Strand=-; Position=111-329
AIKKSFTFKDFNQAFGFMTRIALKADKMDPHPEWFNVYNKVDITLSSHDVQGISERDVKLASFIENVFKTEK

SEQ ID NO: 159097 - protein, 66 aa, Heterodera glycines
  Coding regions on vcDNA: vcDNA=SeqID_85520; Strand=-; Position=97-297
RQNDGRPTAAADGHGTDNDERELRLTNNRTDVILYSIIFHVWIRTYICMFYPHIYFACHARYLLLL

SEQ ID NO: 159098 - protein, 81 aa, Heterodera glycines
  Coding regions on vcDNA: vcDNA=SeqID_85521; Strand=-; Position=46-291
RNGVNVPSFSACATSLFSSLCPSLTNSPYAEGIGFRLFGFLLFPLSFITWYSIQNSILLRTNRGLPISFCFQCPFPFFCSF

SEQ ID NO: 159099 - protein, 75 aa, Heterodera glycines
  Coding regions on vcDNA: vcDNA=SeqID_85522; Strand=-; Position=129-356
WNWRNWELMDCSLFHLPFRLITKRTNDRITSRPPTHRRVTTTRGPALCRRKETDDLNGIHFVSLTHLSVSWSLFL

SEQ ID NO: 159100 - protein, 161 aa, Heterodera glycines
  Coding regions on vcDNA: vcDNA=SeqID_85523; Strand=+; Position=11-493
MGNEKGIPIAEPEIVAFNSPDNSDREWMTMFERCVNKHIQFIMLVDEKRKDTHGLLKLSEAMHKVTTQHVTLEKANDVVRKNQRQTLENILNKLNMKNFGLNYVPVMEPSACRRFSLENGNVLVIGYDVNHPAPMPQQTRRLLASQGESQLSSLDPSCVGI

SEQ ID NO: 159101 - protein, 75 aa, Heterodera glycines
  Coding regions on vcDNA: vcDNA=SeqID_85524; Strand=+; Position=121-345
NKNFIKKTVEFESSHPNINHFPHFFTQNTHLSRLAAAVGLLLLLNPSFLRTQVALPLKLAVVRTEQKLLLVQIGV

SEQ ID NO: 159102 - protein, 83 aa, Heterodera glycines
  Coding regions on vcDNA: vcDNA=SeqID_85525; Strand=-; Position=110-361
ATDGRKGGPVLNWRGREEAKVKRWRPIDDFVQINPREKTECTASTSLTHTENFQIFMPRPPPFTSHLTLIYFSHFNNYYFFTF

SEQ ID NO: 159103 - protein, 149 aa, Heterodera glycines
  Coding regions on vcDNA: vcDNA=SeqID_85526; Strand=-; Position=1-447
NSQSAIGTFPSPVAFFSNSELKLRLAEHVMSFLTMKLCEDSVDSGDESNRWEKSDEGTNDRFQGVIRLWSREFSRFSFGCSAGKGGGRGRGKRSGHWSAANWEGTAMEFEWSKFKKGASFGVKFEATSSIRIKSSDPSRVWVGEAGPPP

SEQ ID NO: 159104 - protein, 114 aa, Heterodera glycines
  misc_feature (78)..(78): Xaa can be any naturally occurring amino acid
  Homolog annotation: Hit_ID=AAO33474.1; Match level="QueryCoverage =100%, HitCoverage=82%, E-value=3e-57, Identity=99%"; Hit description= gland-specific protein g4g12 [Heterodera glycines]
  Coding regions on vcDNA: vcDNA=SeqID_85527; Strand=+; Position=53-394
MPNIFKILLIVLLAVVSFRLSASTGDKKTANDGSGNNSSAGIGTKIKRIVTAGLLFTSLATGGAEAIGRSNAQGGNAXGLVPSHVTNRSMAPPPPPVQFEMGANRLEKMRAHLR

SEQ ID NO: 159105 - protein, 61 aa, Heterodera glycines
  Coding regions on vcDNA: vcDNA=SeqID_85528; Strand=-; Position=79-264
SLSKAMKEMDLDRSKQTPSSTEKPPSRKGSRKGAHLLEMMDQETAAPKTTQARKGSVKRGN

SEQ ID NO: 159106 - protein, 58 aa, Heterodera glycines
  Coding regions on vcDNA: vcDNA=SeqID_85529; Strand=-; Position=0-173
LKSFFPASVVPIARNCLRLPPFLCPALSDRRTTSSASSSNLNTFGDWSAERRRLNVTL

SEQ ID NO: 159107 - protein, 156 aa, Heterodera glycines
  misc_feature (140)..(140): Xaa can be any naturally occurring amino acid
  Homolog annotation: Hit_ID=NP_494893.1; Match level="QueryCoverage =89%, HitCoverage=41%, E-value=2e-50, Identity=65%"; Hit description =small glutamine-rich tetratricopeptide (36.5 kD) (2F192) [Caenorhabditis elegans] gb|AAA83170.1| Hypothet
  Gene Ontology: Mol. function=protein binding
  Coding regions on vcDNA: vcDNA=SeqID_85530; Strand=+; Position=26-492
MAANENMQTEDNKKGKVTNDERNLVVSFIQFLRHKVSSNQCTDEQIEGLEVAIQCLETAFFVSDRNYAFQPSKPLIEIFKAAEGLPDGDQEFPKPTQTDVEKSNALKEEGNELVKSNKFEEAILKYNEAIKLNRDPIFFXNRAAAYCRLEQYDLAI

SEQ ID NO: 159108 - protein, 150 aa, Heterodera glycines
  Coding regions on vcDNA: vcDNA=SeqID_85531; Strand=+; Position=1-453
GNHSSFHFLPIFSPALNCTAPRMVYEEYCFDVRLDDFNEEYCFEVSNADIVHNSCLYVEQTNPNYMTIHGVDYDIFVCEKTISGLKDDRSENVFNRRQGACASGDDRCDNVFNRGQVASARNGEGRDSILIQGLAFVIVKVVNAVYDMIV

SEQ ID NO: 159109 - protein, 148 aa, Heterodera glycines
  Homolog annotation: Hit_ID=AAA98565.1; Match level="QueryCoverage =93%, HitCoverage=85%, E-value=1e-29, Identity=50%"; Hit description =fatty acid binding protein homolog As-p18 [Ascaris suum] sp|P55776|FABH_ASCSU Fatty acid-binding protein h
  Coding regions on vcDNA: vcDNA=SeqID_85532; Strand=+; Position=1-447
GIASVPELPQKFLKSWSVDHSENFDEYLEAKGYGWFMRQVVKLAGITKTFSKNENGTYACKIETTKKNVEWPSFKLGEEFQAEYLDDSVPKITFDYNPTTDELIETHKKVDSEEKPDIYKYNIDSDGFLVMQMEYNGVKTKRFYKKNE

SEQ ID NO: 159110 - protein, 146 aa, Heterodera glycines
  Homolog annotation: Hit_ID=CAA52290.1; Match level="QueryCoverage =99%, HitCoverage=100%, E-value=1e-74, Identity=97%"; Hit description= polyubiquitin [Volvox carteri] pir||S40611 polyubiquitin 5 - Volvox carteri
  Coding regions on vcDNA: vcDNA=SeqID_85533; Strand=+; Position=1-438
GEASDTIENVRAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTG

SEQ ID NO: 159111 - protein, 69 aa, Heterodera glycines
  Coding regions on vcDNA: vcDNA=SeqID_85534; Strand=-; Position=67-276
KVAEQPNVAHCNCEVKEEDESATIGQLIINQMPTQSKWPSFDHFLLSISSNRCLCFSSFLLLLFISVSI

SEQ ID NO: 159112 - protein, 188 aa, Heterodera glycines
  Coding regions on vcDNA: vcDNA=SeqID_85535; Strand=+; Position=2-565
GVYSKEGITGQQLSDEKLRRMATRNNSSPYILPRRTPNSARPGTFITTRNLSALHIQPRPTPFLSGTISKSSPQPLRVVGRIIDPMALGSSRQILLAPSSTVLSPAEQFSNVQPVVNDNFHRPLSRQQRTPLFKLGQDQSEEDEFDLDEMYRLLDESAGYRAQEMSLPRRRERLNNLSQEEKINRRKH

SEQ ID NO: 159113 - protein, 71 aa, Heterodera glycines
  Coding regions on vcDNA: vcDNA=SeqID_85536; Strand=-; Position=2-214
TQRKRGARRKRPARGWTKRLRTGNGDRCRQWRGGGGENGRRSGAIVRIYLDFKLHFCINSFSQKKKKKKKK

SEQ ID NO: 159114 - protein, 70 aa, Heterodera glycines
  Coding regions on vcDNA: vcDNA=SeqID_85537; Strand=+; Position=53-262
FLPDVYWVFMFISFTSILISCKIPSAAAPSLLRVALDQCQKCVSVNSAGVPFDRLLQALLVQRVKSVFDV

SEQ ID NO: 159115 - protein, 57 aa, Heterodera glycines
  Coding regions on vcDNA: vcDNA=SeqID_85538; Strand=-; Position=37-210
NDFFRLHVHLLPLDCLLYIASPITVFKILLIIAQHRYPCQILPFYCIIDTTVIYKRR

SEQ ID NO: 159116 - protein, 45 aa, Heterodera glycines
  Homolog annotation: Hit_ID=AAP41028.1; Match level="QueryCoverage =100%, HitCoverage=11%, E-value=1e-17, Identity=97%"; Hit description= arginine kinase [Heterodera glycines]
  Coding regions on vcDNA: vcDNA=SeqID_85539; Strand=-; Position=168-305
GDHSESEGGVYDVSNKARLGLTEFEAVKQMYDGVKKLIELEKASK

SEQ ID NO: 159117 - protein, 137 aa, Heterodera glycines
  Homolog annotation: Hit_ID=CAG84899.1; Match level="QueryCoverage =99%, HitCoverage=12%, E-value=1e-67, Identity=82%"; Hit description =unnamed protein product [Debaryomyces hansenii CBS767] ref|XP _456921.1| unnamed protein product [Debaryomy
  Gene Ontology: Mol. function=DNA-directed RNA polymerase activity; Cellular component=DNA-directed RNA polymerase II, holoenzyme; Biological process=transcription from Pol II promoter
  Coding regions on vcDNA: vcDNA=SeqID_85540; Strand=-; Position=1-411
TTSPSYSQTSPNYSLTSPQYSPSSPRYSATSPTYSPTSPSYSPTSPSYSPTSPQYSPSSPRYSPTSPSYSPTSPSYSPTSPSYSPTSPQYSPSSPRYSPTSPTYSPTSPSYTPTSPNYSPTSPQYSPSSPRYSPSSP

SEQ ID NO: 159118 - protein, 57 aa, Heterodera glycines
  Coding regions on vcDNA: vcDNA=SeqID_85541; Strand=+; Position=70-240
KKDNLSLMKCRRHNVKHSNSSATFTVPIATAASAAHSTSKTGAHSASKTIAHSASKS

SEQ ID NO: 159119 - protein, 75 aa, Heterodera glycines
  Coding regions on vcDNA: vcDNA=SeqID_85542; Strand=+; Position=2-229
FFFFFFFFLVKGFSEHFLSLHSLWRLFLVIASDASSYFLPHWFGKKFGYKVRQGPQQNNAISWGFMGSWQSFSCF

SEQ ID NO: 159120 - protein, 74 aa, Heterodera glycines
  Homolog annotation: Hit_ID=AAP30755.1; Match level="QueryCoverage =100%, HitCoverage=32%, E-value=5e-28, Identity=83%"; Hit description= putative gland protein 29D09 [Heterodera glycines]
  Coding regions on vcDNA: vcDNA=SeqID_85543; Strand=-; Position=111-335
QYMKVQFEQESQAIKAIGQEKNFEVTDVHFGVPSKGVFAHQNVPSPSHVIANPGQHSSVGQGKKEEPLSSDLDF

SEQ ID NO: 159121 - protein, 140 aa, Heterodera glycines
  Homolog annotation: Hit_ID=CAE73337.1; Match level="QueryCoverage =95%, HitCoverage=51%, E-value=9e-28, Identity=43%"; Hit description =Hypothetical protein CBG20766 [Caenorhabditis briggsae]
  Gene Ontology: Mol. function=metalloendopeptidase activity; Cellular component=integral to membrane; Biological process=cell-cell signaling
  Coding regions on vcDNA: vcDNA=SeqID_85544; Strand=+; Position=2-421
GFFLAFAQIWCQSAEDPAKTSRRLLLDPHPPPKFRVLGSLQNFPAFQNAFNCPKDSLYAPKEHCDVWISEVKQVNGDNFLPPPPSLNIPQKESELTPKFREASEYFEKSVDIAQDPCNNFYEYACNAFDEIAHFDRISIQ

SEQ ID NO: 159122 - protein, 75 aa, Heterodera glycines
  Coding regions on vcDNA: vcDNA=SeqID_85545; Strand=-; Position=38-265
PTVAAAADVMVALTMRRNCGSQTIGRMLFIFDHFYVCTYILSSCIFDVLCHARIFAALTVHIVLGILCLTTFNTR

SEQ ID NO: 159123 - protein, 49 aa, Heterodera glycines
  Coding regions on vcDNA: vcDNA=SeqID_85546; Strand=-; Position=2-148
VVENGWLLIGGFTFFIQLSWELQISKNVFFFEIFGKLIGIKKKKKKKKK

SEQ ID NO: 159124 - protein, 138 aa, Heterodera glycines
  Coding regions on vcDNA: vcDNA=SeqID_85547; Strand=+; Position=2-415
GFIAAAFLLNFGCCQQNESQTTETLRARNASSSPQFPLNTTTFTTTKKETTVATPSTTEAGTEAATTDDTNDEQSLLFWILIGVIVAIVLFLVLLVCIVCCMRGGSQKDARETVNGESGGAVTKLTMNGDNADSSSAS

SEQ ID NO: 159125 - protein, 54 aa, Heterodera glycines
  Homolog annotation: Hit_ID=ZP_00357698.1; Match level="QueryCoverage =55%, HitCoverage=19%, E-value=5e-12, Identity=93%"; Hit description =hypothetical protein Chlo02002738 [Chloroflexus aurantiacus]
  Coding regions on vcDNA: vcDNA=SeqID_85548; Strand=+; Position=1-162
FFFFFFFFFLFFFFFFFFFFFFFFFFFFFFPGVGYSENPRELKKGGGNFPPKAG

SEQ ID NO: 159126 - protein, 68 aa, Heterodera glycines
  Coding regions on vcDNA: vcDNA=SeqID_85549; Strand=+; Position=53-256
ITTSIKCNNQSKRKKQTTTDHHFFRALRDNTPSKKKLVILRPLPLFKVRLAPPVPPPPLPPQQFSFPH

SEQ ID NO: 159127 - protein, 92 aa, Heterodera glycines; identical to SEQ ID NO: 158759
  Homolog annotation: Hit_ID=AAO33473.1; Match level="QueryCoverage =100%, HitCoverage=100%, E-value=8e-53, Identity=100%"; Hit description=gland-specific protein g4e02 [Heterodera glycines]
  Coding regions on vcDNA: vcDNA=SeqID_85550; Strand=+; Position=63-341

SEQ ID NO: 159128 - protein, 159 aa, Heterodera glycines
  misc_feature (84)..(84): Xaa can be any naturally occurring amino acid
  Homolog annotation: Hit_ID=NP_506513.1; Match level="QueryCoverage =79%, HitCoverage=21%, E-value=2e-14, Identity=41%"; Hit description =TRNA Methylase (58.3 kD) (trm-1) [Caenorhabditis elegans] emb|CAB00881.1| Hypothetical protein ZC376.5 [C
  Coding regions on vcDNA: vcDNA=SeqID_85551; Strand=+; Position=72-547
TVFRGDVSPVELAVVALFTEHEGPSVECATEKGNGVGPSVAADCEANKLAEVTEGLARITATAEGGETFYNRVQEFNRDLTGLXVVVLRAFAAEIPNEKEPKTEEEGPKAKQRKMDEGKAPEANAAQSQPRAFSVLDALSASGLRAIRFALEVPNVTRV

SEQ ID NO: 159129 - protein, 32 aa, Heterodera glycines; identical to SEQ ID NO: 158848
  Coding regions on vcDNA: vcDNA=SeqID_85552; Strand=+; Position=13-111

SEQ ID NO: 159130 - protein, 60 aa, Heterodera glycines
  Coding regions on vcDNA: vcDNA=SeqID_85553; Strand=+; Position=119-298
NVNFCFTNDSFLILSFLDGINSQGFFSFFFGFLTFLALPFPKGLAVHFIAPWAHHSRDKT

SEQ ID NO: 159131 - protein, 53 aa, Heterodera glycines
  Coding regions on vcDNA: vcDNA=SeqID_85554; Strand=-; Position=169-330
ALATNKNGDKLRYRLSLNKIVKVLLISPMPPDCEPFIAAVFETKYAYFNNPVI

SEQ ID NO: 159132 - protein, 53 aa, Heterodera glycines
  Coding regions on vcDNA: vcDNA=SeqID_85555; Strand=+; Position=1-162
FFFFFFFFFFAGAQIIVRFTCTLPRAATSKIIRPSAKDPPVSNMGQSLGVSAG

SEQ ID NO: 159133 - protein, 42 aa, Heterodera glycines
  Homolog annotation: Hit_ID=ZP_00357698.1; Match level="QueryCoverage =97%, HitCoverage=22%, E-value=9e-12, Identity=79%"; Hit description =hypothetical protein Chlo02002738 [Chloroflexus aurantiacus]
  Coding regions on vcDNA: vcDNA=SeqID_85556; Strand=+; Position=1-126
FFFFFFFFFFLFFFFFFFFFFFFFFFFFFLGPNPKKFFFPFG

SEQ ID NO: 159134 - protein, 90 aa, Heterodera glycines
  Coding regions on vcDNA: vcDNA=SeqID_85557; Strand=+; Position=53-322
FPQDVYWVFMFISFTSILISCKIPSAAAPSLLRVALDQCQKCVSVSSAGVPFDRLLQALLVQRVKSVFDVSQVNLRPRNDQTNQIPVACA

SEQ ID NO: 159135 - protein, 64 aa, Heterodera glycines
  Coding regions on vcDNA: vcDNA=SeqID_85558; Strand=-; Position=74-268
PPTDAARVLPRRDDSKRTRVSHGRHWHDSPGTRLSVISLLQIMLFRCDGVTYDMPIFEGFISYF

SEQ ID NO: 159136 - protein, 71 aa, Heterodera glycines
  Coding regions on vcDNA: vcDNA=SeqID_85559; Strand=-; Position=64-279
AADGQGRQNVGQNCVVRGIGVARNHFAIVVEGDGLEKENGLCTAPFMIGCPFVILCLFVTFQCIRQMKAIN

SEQ ID NO: 159137 - protein, 132 aa, Heterodera glycines
  Homolog annotation: Hit_ID=NP_506241.1; Match level="QueryCoverage =88%, HitCoverage=49%, E-value=9e-30, Identity=54%"; Hit description =prion-like Q/N-rich domain protein PQN-69, Eukaryotic Initiation Factor, Prion-like Q/N-rich domain prote
  Gene Ontology: Mol. function=translation initiation factor activity; Cellular component=eukaryotic translation initiation factor 3 complex; Biological process=translational initiation
  Coding regions on vcDNA: vcDNA=SeqID_85560; Strand=+; Position=96-491
MSMDELKKRAKAIGTFEELRKIIDIRGVNRYNPNNAPVLERAVDLMIKETKYDKDILMTLLKLYQLNPFLYNEEYVCLVLLKTMTNFPRNDFALAKYLVDAAKVNAPELRRVCQIGSLLESCNFALFWRLVD

SEQ ID NO: 159138 - protein, 189 aa, Heterodera glycines
  Homolog annotation: Hit_ID=CAE66816.1; Match level="QueryCoverage =100%, HitCoverage=8%, E-value=1e-29, Identity=39%"; Hit description =Hypothetical protein CBG12181 [Caenorhabditis briggsae]
  Gene Ontology: Cellular component=chromatin; Biological process =mitosis
  Coding regions on vcDNA: vcDNA=SeqID_85561; Strand=+; Position=2-568
LDYVVERKTLDDLRRSIKETRYLEQKQRLKKCGLRNVVFVLEGGTTANDRQLEQAMVSSGVESGFLVHRTPNVQGTAKFLQNLTRWLRERCSKQKVTGPPFDSFQQESKKAHAATVSDYWVRQLTVCPGLSTDRARIIRNRFPTFRSFVEFCRKNSTDKNSIRDDYSSAIGVELPQLSAAPTKNLMSFF

SEQ ID NO: 159139 - protein, 48 aa, Heterodera glycines
  Coding regions on vcDNA: vcDNA=SeqID_85562; Strand=+; Position=1-144
GDRAGVSGLHSPVCCCTLGCYPPHWGLLSFCLSGEWGFFRRSALICSE

SEQ ID NO: 159140 - protein, 90 aa, Heterodera glycines
  Coding regions on vcDNA: vcDNA=SeqID_85563; Strand=-; Position=73-345
LTSAKVAFYQPDDPKYVVNTSRAESLWIHWPVIIKPNTATRLVPSTEGRMLHFRNWHFLEDENGILASENYMPRKIFDGNFNACNRKKGF

SEQ ID NO: 159141 - protein, 58 aa, Heterodera glycines
  Coding regions on vcDNA: vcDNA=SeqID_85564; Strand=+; Position=136-309
LPLLGLLLINTVFGHHFFDNFHIINPSLLLRDALLFFPRLPLGLPTEIKSARFACVVV

SEQ ID NO: 159142 - protein, 88 aa, Heterodera glycines
  Coding regions on vcDNA: vcDNA=SeqID_85565; Strand=-; Position=0-263
LTAIEHRSVGQIGRGRRAKGIRDDILQHRRSTFAVQCALIVGHCLLLLGTPVVICCRILSVAEFNLSEQLSASSLSGTSPLFSSSLSP

SEQ ID NO: 159143 - protein, 91 aa, Heterodera glycines
  Coding regions on vcDNA: vcDNA=SeqID_85566; Strand=+; Position=2-274
FFFFFFFFFAARLLITILVLKIEENQCQNIQTEMGVTGNNNWTWYSCPRHLSTALYSDRGPSSFCPAPCPKWVRASRKTPFRCLCLPWPMS

SEQ ID NO: 159144 - protein, 73 aa, Heterodera glycines
  Coding regions on vcDNA: vcDNA=SeqID_85567; Strand=-; Position=3-221
SPEKVGHRKRKRKKTKTTSKRGGMKTVMSQCPSMKRMRRKRRKSTTNCWKKKEEEEKKNKTKRKGQKKKKKKK

SEQ ID NO: 159145 - protein, 109 aa, Heterodera glycines
  Homolog annotation: Hit_ID=AAO33477.1; Match level="QueryCoverage =100%, HitCoverage=45%, E-value=1e-53, Identity=100%"; Hit description=gland-specific protein g4g05 [Heterodera glycines]
  Coding regions on vcDNA: vcDNA=SeqID_85568; Strand=+; Position=69-395
MSNFIFVASLTAAFFSSGLALPAPYDAESVVSSELNVPLLSADANVEAAITNESDAAAEIQAPSIPVPIEHQTAADITHPTETGNESSIASSSSTPKSEQTPKKVMNMK

SEQ ID NO: 159146 - protein, 62 aa, Heterodera glycines
  Coding regions on vcDNA: vcDNA=SeqID_85569; Strand=-; Position=133-321
GQKQTLLGAIRRRERPIYNWQSPIRIHGKINIELYEFADIQRGNCDPFLGEPFTKINDGTEK

SEQ ID NO: 159147 - protein, 48 aa, Heterodera glycines
  Coding regions on vcDNA: vcDNA=SeqID_85570; Strand=-; Position=3-146
AKCALFCLAIIKKVISLLPPMCYELCRQFKGFADPKIFQCQKKKKKKK

SEQ ID NO: 159148 - protein, 82 aa, Heterodera glycines
  Coding regions on vcDNA: vcDNA=SeqID_85571; Strand=-; Position=0-245
NHPRLCRNAATNCQFSLFSTAFQIHWKREKFDEHLAKERIYLLLVFRRILIIFSQKFSAGMNLFLFLSFSLFSCVFLIFISP

SEQ ID NO: 159149 - protein, 69 aa, Heterodera glycines
  Coding regions on vcDNA: vcDNA=SeqID_85572; Strand=+; Position=129-335
LGKFNGIEIHRRTTIYDHSSAADLYLLREIPPSIIQHIIVRLSASKALQIFMCGPSLNFSSVFNCSDWR

SEQ ID NO: 159150 - protein, 152 aa, Heterodera glycines
  Coding regions on vcDNA: vcDNA=SeqID_85573; Strand=+; Position=1-456
GQQCNNNGNVTAPTERIFRDALNRSRRLFFSFTLLTEHIAFVELFDKVWIAGWTSAVDLRLRENGCSLNFGDEVEQIDGSVVRNLRALTEIYQRIMPGAQIPLLLRANPTMMVFTLVKPENARLNLGIKFNRPAKFLLRHPFDCLTIDSIAL

SEQ ID NO: 159151 - protein, 120 aa, Heterodera glycines
  Homolog annotation: Hit_ID=AAO33474.1; Match level="QueryCoverage =100%, HitCoverage=86%, E-value=6e-61, Identity=100%"; Hit description=gland-specific protein g4g12 [Heterodera glycines]
  Coding regions on vcDNA: vcDNA=SeqID_85574; Strand=+; Position=52-411
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKM

SEQ ID NO: 159152 - protein, 105 aa, Heterodera glycines
  Coding regions on vcDNA: vcDNA=SeqID_85575; Strand=-; Position=1-315
SIGRPMKRGGETQSKESKISEEILDDQKLLQLLEKAFVALVNGTELPVVPEKLSADEIANLKNGTRNPTDEKPMSESQKTETKSWWDTLKSYWPSAKKKKKKKKK

SEQ ID NO: 159153 - protein, 133 aa, Heterodera glycines
  Coding regions on vcDNA: vcDNA=SeqID_85576; Strand=+; Position=2-400
GIFSNSQMAFSKIFSSLLISFLFLLRKAFSYTDNYIKPYEESYGSQEIPNDGFKQNDEQLQQQYSKDDLNTYDRNDRRYGNYAPRSGFPEDYNFNDLNRDNYDPSYDNYIPSIDNDKRYSKNGNSCYNVKLPK

SEQ ID NO: 159154 - protein, 96 aa, Heterodera glycines
  Coding regions on vcDNA: vcDNA=SeqID_85577; Strand=+; Position=38-328
RQAPMNMSYNDKVGFINSASKQLGDRLSEQNKKMHEMLKEDKNERSSTSHFDEGNKKGSSYNFEKFSSSESRPAPYSYSGKPAVYFRGPTIRDVPP

SEQ ID NO: 159155 - protein, 115 aa, Heterodera glycines
  Coding regions on vcDNA: vcDNA=SeqID_85578; Strand=+; Position=38-385
RQAPMNMSYNDKVGFINSASKQLGDRLSEQNKKMHEMLKEDKNERSSTSHFDEGNKKGSSYNFEKFSSSESRPAPYSYSGKPAVYFRGPTIRDVPPSDGSIGGTVTTWEWGTVSN

SEQ ID NO: 159156 - protein, 130 aa, Heterodera glycines
  Coding regions on vcDNA: vcDNA=SeqID_85579; Strand=+; Position=28-417
RISMEHGSLPLQLIILFVLTLQISTQSPEISVPSDVQILSAVRNVDLTTQIVKVKTDFELKNGRNEELSSFVHAMSAEEAARLSWMSAYESGKESGKLRISRVRVKGVSSDMVFHKIEFLDLLMSGSNIK

SEQ ID NO: 159157 - protein, 139 aa, Heterodera glycines
  Coding regions on vcDNA: vcDNA=SeqID_85580; Strand=-; Position=111-530
VGIEKAAENGEQFDLVALDACEMYIDLICPASVFSDEKILQKIKAILKPTGAFVVNILMSDEKEEDKYVAEQKRKLLNIFPICLHTSFVGELAHVFVCLPTKINVFGEHAKLSKEWEKKREELTKEFGIDEHLTQYRIS

SEQ ID NO: 159158 - protein, 191 aa, Heterodera glycines
  Homolog annotation: Hit_ID=CAE67649.1; Match level="QueryCoverage =96%, HitCoverage=31%, E-value=3e-70, Identity=66%"; Hit description =Hypothetical protein CBG13209 [Caenorhabditis briggsae]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_85581; Strand=-; Position=3-575
SGGPAAGIGTLWWSLHFKMDPIPERVAKMRKHADHLDSPTMAGGLFAVSREYFFEIGAYDPGMDIWGGENLEISFRVWMCGGSIEVVPCSHVGHIFRAGHPYNMTGPGGNKDVHGTNSKRLAEVWMGDYKRLFYVHRMGLKDVEVGDLSARKALRERLGCKSFKWYLDNVIPEKFVPDENVNAYGLVQDTD

SEQ ID NO: 159159 - protein, 123 aa, Heterodera glycines
  Homolog annotation: Hit_ID=AAH34113.1; Match level="QueryCoverage =86%, HitCoverage=9%, E-value=3e-28, Identity=52%"; Hit description =Trip12 protein [Mus musculus]
  Gene Ontology: Mol. function=ligand-dependent thyroid hormone receptor interactor activity; Cellular component=cytoplasm; Biological process=protein ubiquitination
  Coding regions on vcDNA: vcDNA=SeqID_85582; Strand=+; Position=2-370
GFCGTDDADDKVWSKSVLQHCIRPDHGYTYDSQQIKWLIDMLHGFPKEKRRRFLQFCTGSPRLPVGGFKGLSPPLTVVKKTASFVGNENELPSAMTCYNYLKIPPYESYNTFLDRFEVALQHV

SEQ ID NO: 159160 - protein, 202 aa, Heterodera glycines
  Homolog annotation: Hit_ID=NP_499447.1; Match level="QueryCoverage =100%, HitCoverage=34%, E-value=2e-82, Identity=74%"; Hit description= s6 kinase (3M341) [Caenorhabditis elegans] emb|CAB55075.1| Hypothetical protein Y47D3A.16 [Caenorhabditi
  Gene Ontology: Mol. function=protein serine/threonine kinase activity; Cellular component=nucleus; Biological process=signal transduction
  Coding regions on vcDNA: vcDNA=SeqID_85583; Strand=+; Position=3-608
DILLDCKGHVKLTDFGLCKEAIEGDQKTHTFCGTIEYMAPEILMRTGHGKAVDWWSLGALTFDMLTGGPPFSAENRKRTIDKILKGRLTLPPYLSFEAKDLIKRLLKRHVDTRLGAGPGDAEEIKKHAFFTHHVENWTNVYRREIEAPYKPNITSEEDASLFDSKFTKMTPVGSPTAELPPMSVNPFEGFTYIALSVLEQVS

SEQ ID NO: 159161 - protein, 129 aa, Heterodera glycines
  Homolog annotation: Hit_ID=CAC21848.1; Match level="QueryCoverage =90%, HitCoverage=59%, E-value=1e-20, Identity=38%"; Hit description =hypothetical protein [Globodera rostochiensis]
  Gene Ontology: Biological process=embryogenesis and morphogenesis
  Coding regions on vcDNA: vcDNA=SeqID_85584; Strand=+; Position=1-390
RDYGIFYYEVKVLNIKRYIKIGFATKKLELDTGVGEKPDSYGYVNGGCLWRNGTEYSGNPKFARDDTVGCGINLVTGRIIFTKNGEQLDTADVFASPTSQWFPCVSLLDSGDLINANFGPNFKFDPSAV

SEQ ID NO: 159162 - protein, 136 aa, Heterodera glycines
  Coding regions on vcDNA: vcDNA=SeqID_85585; Strand=+; Position=9-416
LSGEFRPHSVVLTPPRVSHSALSVPSGANFGSDMVQFRQMAHSPPILSVPLATSVHQSSAGRLINSPQAENTTEESNGRLSGQLKHSPTVGSAATSPLASSSTIGVHEISLSYVRPNTFSPSAGDDRRSLPTYLSS

SEQ ID NO: 159163 - protein, 98 aa, Heterodera glycines
  Homolog annotation: Hit_ID=AAO33474.1; Match level="QueryCoverage =43%, HitCoverage=31%, E-value=1e-18, Identity=100%"; Hit description= gland-specific protein g4g12 [Heterodera glycines]
  Coding regions on vcDNA: vcDNA=SeqID_85586; Strand=-; Position=171-467
WDWYEDQKNCHRWTALHFPGDGWGESDWAKQCSGRKCRRIGAIACDQSLNGSTTSPVQFEMGANRLEKMRAHLRELAEKMPVNESKRLSPSGPDPHHH

SEQ ID NO: 159164 - protein, 124 aa, Heterodera glycines
  Homolog annotation: Hit_ID=CAE69228.1; Match level="QueryCoverage =72%, HitCoverage=11%, E-value=1e-18, Identity=52%"; Hit description =Hypothetical protein CBG15268 [Caenorhabditis briggsae]
  Gene Ontology: Mol. function=translation factor activity, nucleic acid binding; Cellular component=ribosome; Biological process =protein biosynthesis
  Coding regions on vcDNA: vcDNA=SeqID_85587; Strand=-; Position=110-484
VVNMAGPLIRILGERHPVPVKVAAVNALLRLLENVSLLLKAFLPQMQSVLLKILQDPSSQNLRQLASQAVVHLIDLHPKPETILKELNKLREADKSPEGLDLHTDKLINELIAKIALKNGNTSK

SEQ ID NO: 159165 - protein, 64 aa, Heterodera glycines
  misc_feature (54)..(54): Xaa can be any naturally occurring amino acid
  Homolog annotation: Hit_ID=AAG29508.1; Match level="QueryCoverage =90%, HitCoverage=51%, E-value=7e-15, Identity=61%"; Hit description =zinc metallopeptidase 2 [Ancylostoma ceylanicum]
  Coding regions on vcDNA: vcDNA=SeqID_85588; Strand=-; Position=191-384
HPWCDQPDDFERSLQLIGDFHSPAKFRVFGSLRNFPPFRNAFNCPLNSKYPPKXHCNVWVTPVT

SEQ ID NO: 159166 - protein, 138 aa, Heterodera glycines
  Homolog annotation: Hit_ID=AAO33474.1; Match level="QueryCoverage =100%, HitCoverage=100%, E-value=3e-68, Identity=94%"; Hit description=gland-specific protein g4g12 [Heterodera glycines]
  Coding regions on vcDNA: vcDNA=SeqID_85589; Strand=-; Position=189-605
MPNIFKILLIVLLAVVSFRLWASTGDKKTANDGSGNNSSAGIGTKIKRIAPVGLLFTSLATGGAEAIGRSNAQGGNAAGLVPSHVTNRSMAPPPPPVQFEMGANRLEKMRAPLRELVEKMPVNESKGLSPSGPDPHHH

SEQ ID NO: 159167 - protein, 145 aa, Heterodera glycines
  Coding regions on vcDNA: vcDNA=SeqID_85590; Strand=+; Position=132-566
VGSGKVPEIRRGLNDETSEKTRHGTQLRKEAAGDAGEGAQFLPARINRDNFKFVFFVGRRSDLKRQTVRLHGAANRKTSNSCPIVHPGQLLNKCLITVNSSVLHSVPVDAKVTRVFFEPNDIFSVHFYLFPFDDTWQQKFVQQPT

SEQ ID NO: 159168 - protein, 183 aa, Heterodera glycines
  Homolog annotation: Hit_ID=NP_491896.1; Match level="QueryCoverage =95%, HitCoverage=32%, E-value=2e-69, Identity=69%"; Hit description =metalloenzyme (59.2 kD) (1H147) [Caenorhabditis elegans] gb|AAB96720.1| Hypothetical protein F57B10.3a [C
  Gene Ontology: Biological process=locomotory behavior
  Coding regions on vcDNA: vcDNA=SeqID_85591; Strand=+; Position=3-551
FPILFPPVSHQNVLAEWLSKLKVSQFHCAESEKYAHVTFFFNGGREEAFEGEEHVMVPSPRVATYDKKPEMNCEGIADKVVKQIELGKHPFIMCNFAAPDMVGHTGKFEPTVKACEATDVAIGRILEACKSHGYVLLVTADHGNAEQMIAKDGGPHTAHTCNKVPFACSSTSHSFKSAPPTTA

SEQ ID NO: 159169 - protein, 91 aa, Heterodera glycines
  Coding regions on vcDNA: vcDNA=SeqID_85592; Strand=+; Position=3-275
FFFFFFFFLVFFFFFLKLVKFIELKKHGNFVIISLAFHQFNWFWHKVQLPCMKWPPIGPLAFCKFSQPQLKKSPRWKGHSRAEIPVPSQIP

SEQ ID NO: 159170 - protein, 160 aa, Heterodera glycines
  Coding regions on vcDNA: vcDNA=SeqID_85593; Strand=+; Position=8-490
MAKVKQTEWHETDIKKFCFAEMSVDGLRALKAKTAALCFIFEKTTKNDCSCKDLEKELLQLGLPSDHVSVLVELYNSNRAALCDSLAGPAIKAPSLTVVCKEQVPTAADPSVKSDYFRLDTTSSDGSTATLLIHRDELVQLRTCMEDAVRVLESLVVNKE

SEQ ID NO: 159171 - protein, 55 aa, Heterodera glycines
  Homolog annotation: Hit_ID=ZP_00357698.1; Match level="QueryCoverage =60%, HitCoverage=21%, E-value=3e-11, Identity=82%"; Hit description =hypothetical protein Chlo02002738 [Chloroflexus aurantiacus]
  Coding regions on vcDNA: vcDNA=SeqID_85594; Strand=+; Position=3-167
FFFFFFFFYFFFFFFFFFFFFFTFFFFLKFHFFCQIINKLRGLTRVGIKVNQILR

SEQ ID NO: 159172 - protein, 71 aa, Heterodera glycines
  Homolog annotation: Hit_ID=NP_502959.1; Match level="QueryCoverage =98%, HitCoverage=36%, E-value=7e-25, Identity=78%"; Hit description =small GTP-binding protein RHO RHO-1, small GTP-binding protein RHO, guanine nucleotide regulatory protein
  Gene Ontology: Mol. function=ATP binding; Cellular component=cytosol; Biological process=cell-matrix adhesion
  Coding regions on vcDNA: vcDNA=SeqID_85595; Strand=+; Position=2-217
GNDQQTIRDLSRNKQEPVKSEQGKAIAEQIGAYAYLECSAKTKEGIREVFEKATQAALQQKKKKKKGCNVL

SEQ ID NO: 159173 - protein, 138 aa, Heterodera glycines
  misc_feature (95)..(95): Xaa can be any naturally occurring amino acid
  Homolog annotation: Hit_ID=AAO33474.1; Match level="QueryCoverage =100%, HitCoverage=100%, E-value=2e-70, Identity=97%"; Hit description=gland-specific protein g4g12 [Heterodera glycines]
  Coding regions on vcDNA: vcDNA=SeqID_85596; Strand=+; Position=53-469
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPXTVQFEMGANRLEKMRAHLRELAEKMPVNESKRLSPSGPDPYHH

SEQ ID NO: 159174 - protein, 85 aa, Heterodera glycines
  Homolog annotation: Hit_ID=AAN32890.1; Match level="QueryCoverage =100%, HitCoverage=51%, E-value=2e-39, Identity=92%"; Hit description= secretory protein 4D09 [Heterodera glycines]
  Coding regions on vcDNA: vcDNA=SeqID_85597; Strand=-; Position=215-472
TKNGKAPKTKARQEVATNEPPAVNEWNDQLMGMSVEKFNEELVVLLPKANTFMENALSFTNEQMEKNGIATGAAGDSCSTGIPAN

SEQ ID NO: 159175 - protein, 95 aa, Heterodera glycines
  Homolog annotation: Hit_ID=AAO51573.1; Match level="QueryCoverage =73%, HitCoverage=5%, E-value=2e-09, Identity=41%"; Hit description =similar to Dictyostelium discoideum (Slime mold). Adenylyl cyclase
  Coding regions on vcDNA: vcDNA=SeqID_85598; Strand=-; Position=165-452
AEQQQAAQAQTQKAKEQRQTHQPQKPREVEQQQTPQTQQQPKKAKEDEQQQQAAQSQQQPQKSKYVPPSMRKKRRDLFDENLVFNVCLIGVAKYC

SEQ ID NO: 159176 - protein, 187 aa, Heterodera glycines
  Coding regions on vcDNA: vcDNA=SeqID_85599; Strand=+; Position=69-629
LDEEMTSPAESLNLDAAEVPELLRKELDTLHKALGENMQRYTECKEIKVDEGLRTLEAKVGRLALSINSHKGILKRERMRLAETAKRLGLDQRIAHNVQRTRDNLAKSPQFGRAHSVDFLHEVATQNDQSLAEQCETVEKLRKLLDRLSNSDEEPSLSRNDLVDHLTRFDRIFEQVASQVYALNDSA

SEQ ID NO: 159177 - protein, 165 aa, Heterodera glycines
  misc_feature (94)..(94): Xaa can be any naturally occurring amino acid
  Homolog annotation: Hit_ID=AAG34547.1; Match level="QueryCoverage =82%, HitCoverage=70%, E-value=2e-71, Identity=97%"; Hit description =beta-galactosidase [Cloning vector pUG7]
  Coding regions on vcDNA: vcDNA=SeqID_85600; Strand=+; Position=3-499
TRWELSIWSTCRRPEFPRPPWRPGACDVGPNSPYSESYYNSLAVVLQRRDWENPGVTQLNRLAAHPPFASWRNSEEARTDRPSQQLRSLNGEWXAPCSGALSAAGVVVTRSVTATLASALAPAPFAFFPSFLATFAGFPRQALNRGLPLGFRFSALRHLDPKKLD

SEQ ID NO: 159178 - protein, 84 aa, Heterodera glycines
  Homolog annotation: Hit_ID=NP_506580.1; Match level="QueryCoverage =96%, HitCoverage=21%, E-value=1e-14, Identity=45%"; Hit description =farnesyltransferase (45.1 kD) (5O929) [Caenorhabditis elegans] emb|CAB01167.1| Hypothetical protein F23B1
  Gene Ontology: Mol. function=protein farnesyltransferase activity; Cellular component=cytoplasm; Biological process=C-terminal protein farnesylation
  Coding regions on vcDNA: vcDNA=SeqID_85601; Strand=-; Position=197-451
KLFDTLPLQSYVLEACQAPSGGLRDKPDKSPDLYHTCYTLFGLSVSQIYSGGIHSGNQNIVESVHPIYNVHIDAYSKAQRYFKA

SEQ ID NO: 159179 - protein, 100 aa, Heterodera glycines
  Coding regions on vcDNA: vcDNA=SeqID_85602; Strand=+; Position=101-400
MDKNNKKCLILNFRNGQNIFSIGSFLSLPRSFRAKNLRVGFLQFFDRFGVQLFVVQKIADEFLAGNSEVILGHVLEHFLLHGNHFALVGQTEFANGRLFA

SEQ ID NO: 159180 - protein, 175 aa, Heterodera glycines
  Coding regions on vcDNA: vcDNA=SeqID_85603; Strand=-; Position=1-525
AHQTPTVLYVKSDVFQWLDTAFLVTVSEKYNAANNAGATVPSPPTTVAEQQQPLENGGGQVAPPPMVNGGSGKLHQIVVESEPKKASVVVDHSPQKEPEKKPDAPSDAAPTVVDSLPSPTSTPNKKDEVMAISAVAPLSSIVDVPKTVDTAPPPSLSQPVAATAAAAPPPTSEQQ

SEQ ID NO: 159181 - protein, 124 aa, Heterodera glycines
  Coding regions on vcDNA: vcDNA=SeqID_85604; Strand=-; Position=107-481
VGILFWHVHSLAAECAPICPTVPLADRQICHCFLVHCPFCVRQRSVPDIEAWNLYGHLHARLAIVLHHFPANDSSDAVLFAYDANVFLWRLRIHRNIFNIFVARNAGKRIAGLNCPRSSCTNWL

SEQ ID NO: 159182 - protein, 65 aa, Heterodera glycines
  Homolog annotation: Hit_ID=ZP_00109558.1; Match level="QueryCoverage =96%, HitCoverage=14%, E-value=6e-10, Identity=44%"; Hit description =COG1357: Uncharacterized low-complexity proteins [Nostoc punctiforme PCC 73102]
  Coding regions on vcDNA: vcDNA=SeqID_85605; Strand=-; Position=211-408
GSSFKHVINCNIMVADMSDFQAVNETIKNFFPEDTYPARSFFQVVKLPKSAYVMIDVVAIVQGQS

SEQ ID NO: 159183 - protein, 183 aa, Heterodera glycines
  misc_feature (180)..(180): Xaa can be any naturally occurring amino acid
  Homolog annotation: Hit_ID=XP_392465.1; Match level="QueryCoverage =70%, HitCoverage=17%, E-value=5e-12, Identity=32%"; Hit description =similar to Bmsqd-2 [Apis mellifera]
  Coding regions on vcDNA: vcDNA=SeqID_85606; Strand=+; Position=68-616
MKMVEKENDIAAAVPNNAANNGHVEAVDPSASKSAKEVPNNTEKHSAEDLMGLARLFLKEYYTKLSDLPSEAGIFYGDDSHFVHADVEETGRENIQRAIGNMGFEDCKARFYSLKTVSLPMQGDNAKLIQVCGELTLVKAAVQKQQPVLPRRFVQTIILAHQTPTVLYVKSDVFQWLDTXFLV

SEQ ID NO: 159184 - protein, 202 aa, Heterodera glycines
  Coding regions on vcDNA: vcDNA=SeqID_85607; Strand=+; Position=2-607
GITTNTIKYVDAGESDDVVLAELLRYEPSTAHKKIQANGLVVRKRPEYLLMYNPKYGLSILLPKYANVQSACEFDEKFSLGEFYSCAFIRVAEREARRLTYEWMCKGDFKLHEPMLKTRLIMDRFVHVHVNCEFTKEKITKLHGDHYVLKTDLGNVRFGKEFLTHNDLYDKSANVWVTFVKETEGCHWEIVQDSWGSLLDDE

SEQ ID NO: 159185 - protein, 51 aa, Heterodera glycines
  Homolog annotation: Hit_ID=EAA21693.1; Match level="QueryCoverage =84%, HitCoverage=6%, E-value=7e-09, Identity=65%"; Hit description =putative chaperonin [Plasmodium yoelii yoelii]
  Coding regions on vcDNA: vcDNA=SeqID_85608; Strand=+; Position=3-158
FFFFFFFFLFFFFFFFFFFFFFFFLGGAFFVGPKIIKNFWEKKGGENWPPI

SEQ ID NO: 159186 - protein, 73 aa, Heterodera glycines
  Homolog annotation: Hit_ID=CAE67217.1; Match level="QueryCoverage =93%, HitCoverage=11%, E-value=4e-10, Identity=48%"; Hit description =Hypothetical protein CBG12654 [Caenorhabditis briggsae]
  Gene Ontology: Biological process=locomotory behavior
  Coding regions on vcDNA: vcDNA=SeqID_85609; Strand=-; Position=208-429
AKDGGPHTAHTCNKVPFACSSPSHSFKSAPPTTAEGVPRARALCDVAPTVLSLMGLTNPEEMDGQNLLGTAAN

SEQ ID NO: 159187 - protein, 204 aa, Heterodera glycines
  Coding regions on vcDNA: vcDNA=SeqID_85610; Strand=+; Position=3-614
GPLSNKIRFKDLQIAYIDHYVIAFLRANKQLFDGNGTALKFSIWSAKNDVQPIWDVLARDIWPIFAPNIRHLGLTNADHLDKLRRFISPTILSDLKWLNSINAYRLLPEAIGGDFDQSNATGGQILSKWLHTPTTNGQPKRFNCVYYQEPAINIDEWINTFKEAFLRATSSACYAIQFAVHATSTSMVPFEEVNKRTNEKLTLI

SEQ ID NO: 159188 - protein, 193 aa, Heterodera glycines
  Homolog annotation: Hit_ID=NP_500997.1; Match level="QueryCoverage =96%, HitCoverage=20%, E-value=3e-20, Identity=30%"; Hit description =putative protein of ancient origin (4H315) [Caenorhabditis elegans] gb|AAB37739.1| Hypothetical protein C
  Coding regions on vcDNA: vcDNA=SeqID_85611; Strand=+; Position=2-580
GQTRSSFYCGLSSFHRRFTAPWVLCRCIFKGGAEVAQKLRNYEFAVELLEFLLETDLLRNFCMSSRGKWYERIALNLERHLKSLDKSAHFCRLGMADELVGKSDKLILQHRLTQMNNRKKQTQSQTDLGFVELEDPEKMEINGTTLAKSLGDGEQVNHFYIPTSDRGEINKCSVEELVLHHFITVEHFTHGFH

SEQ ID NO: 159189 - protein, 158 aa, Heterodera glycines
  Homolog annotation: Hit_ID=AAN32891.1; Match level="QueryCoverage =100%, HitCoverage=32%, E-value=3e-85, Identity=100%"; Hit description=secretory protein 5D06 [Heterodera glycines]
  Coding regions on vcDNA: vcDNA=SeqID_85612; Strand=-; Position=206-682
IGTTKHGIHSAEIMTSSSESNVPKSENLGSSEMETAEEAAQTYLNNLRVDLNKIPSMKIPFLEPIIEKYVDEYKKSRQLFAECMQKILRKSKNPNQTVKIIEFKKTIEKEMNDLLKHTDLPPDQLIDLLNTREWLLSMKKDIEYMERILTGRENNDNI

SEQ ID NO: 159190 - protein, 169 aa, Heterodera glycines
  Homolog annotation: Hit_ID=AAC95573.1; Match level="QueryCoverage =98%, HitCoverage=41%, E-value=7e-25, Identity=37%"; Hit description =orf 48 [Ateline herpesvirus 3] pir||T42963 hypothetical protein 48 - ateline herpesvirus 3 (strain 73) ref
  Gene Ontology: Mol. function=protein binding; Cellular component =axoneme; Biological process=N-linked glycosylation
  Coding regions on vcDNA: vcDNA=SeqID_85613; Strand=+; Position=1-507
GGREEEEEETDDDEIIVIEQSKSTGEEKTKSGREEAFQKTQAMQGEKEEKQIDEKEEEQMEDEEKEAEQIGEEMEEGQMEDEEKEAEQIEEEMEEGQMEDEEKEAEQIGEEMEEGQMEDEEKEAEQIEEEMEEGQMEDEEKEAEQIGEEMEEGQIEEEEREVHSRGGEN

SEQ ID NO: 159191 - protein, 72 aa, Heterodera glycines
  Coding regions on vcDNA: vcDNA=SeqID_85614; Strand=+; Position=72-287
SPTKKYVKNLFCVKNEQKKRLFKINRQLKRKVCLIPKSQLNSQTKMPSFIPWSAQFTDSSSAGWSAGVFPSV

SEQ ID NO: 159192 - protein, 93 aa, Heterodera glycines
  Coding regions on vcDNA: vcDNA=SeqID_85615; Strand=+; Position=3-281
FFFFFFFFFLFFFFFFFFFFFLNKFYLIFANFSKKQITMNKTVIITTNGSSLVGFPLSFFLKGGWCLFWIFSTRAPAIYPPMFPRGGVFAFAP

SEQ ID NO: 159193 - protein, 75 aa, Heterodera glycines
  Coding regions on vcDNA: vcDNA=SeqID_85616; Strand=+; Position=192-416
CCRQIFNSFISSEGAHLGYWKKELRADNCQLWVAFEKNYQQNDAEHYCHWHQQQQKQAEVTHCLCPVVNGLLKKN

SEQ ID NO: 159194 - protein, 212 aa, Heterodera glycines
  Homolog annotation: Hit_ID=CAE61287.1; Match level="QueryCoverage =100%, HitCoverage=28%, E-value=9e-81, Identity=67%"; Hit description= Hypothetical protein CBG05109 [Caenorhabditis briggsae]
  Gene Ontology: Mol. function=long-chain-fatty-acid-CoA-ligase activity; Cellular component=lipid particle; Biological process =lipid transport
  Coding regions on vcDNA: vcDNA=SeqID_85617; Strand=+; Position=3-638
EGYGQTECVAAATITIEGDPVPGHVGVPVPCCAVKLIDVPDLNYFATHGAGEVCIKGPNVFRGYYKMAEQTAETLDTDGWLHTGDIGRWTEQGTLKIVDRKKHIFKLAQGEYVAPEKIELIYMRSKYVAQCFVHGESLKTCLVAVVVPDFDVLPEAAKKQLGIEGKTMEELCRKQQVKAMVMEDIHEVGKKAGLFTFEQAKDIHLYAELFTV

SEQ ID NO: 159195 - protein, 18 aa, Heterodera glycines
  Coding regions on vcDNA: vcDNA=SeqID_85618; Strand=+; Position=1-57
FFFFFFFFCCLKFIGLII

SEQ ID NO: 159196 - protein, 122 aa, Heterodera glycines
  Coding regions on vcDNA: vcDNA=SeqID_85619; Strand=-; Position=88-456
YDLNSNSILFTIGNAELDLVSNEWVAYLHVNMRGTVVATTNKARLRLLSIEESKIRLFVDESAESNEHEIVKSSDSRIDPFWLEARSDLSTNCLNSRFVLVKHVEKNVSTRIPCHLRFFGKN

SEQ ID NO: 159197 - protein, 205 aa, Heterodera glycines
  misc_feature (192)..(192): Xaa can be any naturally occurring amino acid
  Homolog annotation: Hit_ID=NP_510033.1; Match level="QueryCoverage =95%, HitCoverage=35%, E-value=7e-19, Identity=30%"; Hit description =predicted CDS, protein ET like family member (XM768) [Caenorhabditis elegans] pir||T23766 hypothetical pr
  Coding regions on vcDNA: vcDNA=SeqID_85620; Strand=+; Position=59-673
MPSPPGGSEQETSISVQTVRFIYGTFTALTVLGTAILALLPVPTATTPARQTNTVDGTSSAAAVRDPSTVSTELAHSIDEGAEGSGEAVAVAEQPSHLAILSSTVKLMGTRRMVFFSLPFMYTGISQSFWSSIYPTTVANTEMFQLNQGVNPKLLLALTAIVQGVGQATSGFFFGILDSRTRRFGRTKIVGXGAALQLCSFLLAY

SEQ ID NO: 159198 - protein, 60 aa, Heterodera glycines; identical to SEQ ID NO: 158916
  Coding regions on vcDNA: vcDNA=SeqID_85621; Strand=+; Position=2-181

SEQ ID NO: 159199 - protein, 115 aa, Heterodera glycines
  Homolog annotation: Hit_ID=NP_871644.1; Match level="QueryCoverage =94%, HitCoverage=12%, E-value=3e-17, Identity=39%"; Hit description =putative cytoplasmic protein of ancient origin (3H529) [Caenorhabditis elegans]
  Coding regions on vcDNA: vcDNA=SeqID_85622; Strand=-; Position=160-507
RSGQLDAKLLESAKRSLIFNLISKESTVELRVNSAILATIRSVDNNFTRDLCLKIWNAKAEDVLAIGGPPIRRLFEPEQSFCSIALNPSGVDELKEHFPETKVIKLDELQVPSIF

SEQ ID NO: 159200 - protein, 111 aa, Heterodera glycines
  Homolog annotation: Hit_ID=NP_493982.1; Match level="QueryCoverage =95%, HitCoverage=20%, E-value=3e-29, Identity=57%"; Hit description =solute carrier family 2 member 3 (2B799) [Caenorhabditis elegans] gb|AAK31540.1| Hypothetical protein H17
  Gene Ontology: Mol. function=glucose transporter activity; Cellular component=cytoplasm; Biological process=glucose transport
  Coding regions on vcDNA: vcDNA=SeqID_85623; Strand=+; Position=2-337
GYLSILFVLLFVISFATGPGSIPWLFVNEIFPSNARGNANSIAVLSNWGSNAIVGYSFPMLNTALGEYVFFVFTTVSVLCIVFAVKFMPETKNKSLEDIQAEIDRRRGITN

SEQ ID NO: 159201 - protein, 185 aa, Heterodera glycines
  misc_feature (44)..(44): Xaa can be any naturally occurring amino acid
  Homolog annotation: Hit_ID=NP_509854.1; Match level="QueryCoverage =95%, HitCoverage=49%, E-value=8e-71, Identity=75%"; Hit description =phosphoribosyl pyrophosphate synthetase-associated protein (39.0 kD) (XL693) [Caenorhabditis elegans] emb
  Gene Ontology: Mol. function=enzyme inhibitor activity; Biological process=nucleobase, nucleoside, nucleotide and nucleic acid metabolism
  Coding regions on vcDNA: vcDNA=SeqID_85624; Strand=+; Position=59-612
FGNNAEYAGCKAGASRIVSLDLYRKEIQGFFSIPVDNLRASPFXLLQYMKYNIPDYKNAVIVAKTPGVMNKATSYSERLRIGIAVIHGEEKGVQEDGRQSPPPSPTDKRKGVSYELFPSQVAKEKPPLTVVGDVGGKIAILVDDIIDDAQSFVAAAEVLKARGAYKIYVVATHGLMSLDAPSLLE

SEQ ID NO: 159202 - protein, 104 aa, Heterodera glycines
  Homolog annotation: Hit_ID=XP_219265.2; Match level="QueryCoverage =93%, HitCoverage=9%, E-value=8e-11, Identity=34%"; Hit description =similar to importin 7 [Rattus norvegicus]
  Gene Ontology: Mol. function=RAN protein binding; Cellular component =nuclear pore; Biological process=signal transduction
  Coding regions on vcDNA: vcDNA=SeqID_85625; Strand=+; Position=1-315
GLKNIICSHWEVDDEKKRWTLSEQDKVSVKQQTIPAIIRSPEPIRIHLCTSIQNIMRNDFPARWANFTDEILPLLRVSEPETLMGTLLILHRLCKIYELVFDYI

SEQ ID NO: 159203 - protein, 74 aa, Heterodera glycines
  Coding regions on vcDNA: vcDNA=SeqID_85626; Strand=-; Position=2-223
FHVGSVTCLPGPPRFSNYKFPLLGFTISRIGGPIRHNTRLLLLHPLRSVFFPKQQQITIGTREIMPKKKKKKEK

SEQ ID NO: 159204 - protein, 82 aa, Heterodera glycines
  Coding regions on vcDNA: vcDNA=SeqID_85627; Strand=+; Position=2-247
FFFFFFFFYGMTVFNGKFSSNLSFSASLILHVFSIFGIILCRLFVLLPIFGIILCRLFVLLPIFGIGFCRPFVLLPIFGIIL

SEQ ID NO: 159205 - protein, 153 aa, Heterodera glycines
  Coding regions on vcDNA: vcDNA=SeqID_85628; Strand=-; Position=100-561
KFKEKFSHFIRINCKAFALADFYDFCGYVETRIRLQLLIDVERFDRIRLAHAKQIVEKEQILGENLDGSPANKKNPKKNVFFKIWLVGIELDEQIASENESESTNNWNSWKEALNSMLSEQFNAVILKGYRTKNGFSGPLVHIQLTAQYEQKH

SEQ ID NO: 159206 - protein, 191 aa, Heterodera glycines
  Homolog annotation: Hit_ID=NP_504629.1; Match level="QueryCoverage =85%, HitCoverage=30%, E-value=4e-09, Identity=27%"; Hit description =putative cytoplasmic protein, with a coiled coil domain, of eukaryotic origin (54.8 kD) (5G898) [Caenorha
  Coding regions on vcDNA: vcDNA=SeqID_85629; Strand=+; Position=26-598
MKLNDTVKTDFETIFAKFYSHICDDTEETIQRKQLKKLFSFIDTNKHNPNFRDRIGPRCDLRFLAGLLRRYQCSVSGEDRLLFSILELLEKHMALDFRIISPLVFGPSSKTYYEELIQYGRALHKYLTPEQVLAYFDSKRMWKSLLKLAHFDRHFSAALSKGSTVNAAMEIATGEIDPSCYDPRFVLRLLV

SEQ ID NO: 159207 - protein, 112 aa, Heterodera glycines
  Coding regions on vcDNA: vcDNA=SeqID_85630; Strand=-; Position=153-491
AFVLSKFYFYFRFLRQCGRWAIGPRGETVERSGKSFRFERRRSENARTDHTSGDQSGEAEEGNRYIGKRVGEFGSNQRFIADSLLQLCKFGAGGTTMKRSNWARRDGSSQVE

SEQ ID NO: 159208 - protein, 167 aa, Heterodera glycines
  Coding regions on vcDNA: vcDNA=SeqID_85631; Strand=+; Position=3-503
GVENFFYNKMMNKIYTTIHFLLLLTVIANKSTNCATNVQGTQTVKTADATYDEAGKISRDSSSSSDEDDSTTAASKMLLNEANHAFSKDNDEPINHQQKMRPEANFSVKYLPPRLNAAQIDNIAQQASSMITLRTLKHVKEVFSKFAPDSWLEALEDIPLPTIRCTV

SEQ ID NO: 159209 - protein, 58 aa, Heterodera glycines
  Coding regions on vcDNA: vcDNA=SeqID_85632; Strand=-; Position=1-174
MEADTLDPDDLLGEERSAPDGRFEVRGGESEIGDEEPYLMVGHTCPQRGVPPDPACHF

SEQ ID NO: 159210 - protein, 76 aa, Heterodera glycines
  Homolog annotation: Hit_ID=NP_422410.1; Match level="QueryCoverage =98%, HitCoverage=37%, E-value=6e-19, Identity=57%"; Hit description =hypothetical protein CC3616 [Caulobacter crescentus CB15] gb|AAK25578.1| conserved hypothetical protein [
  Coding regions on vcDNA: vcDNA=SeqID_85633; Strand=-; Position=2-229
AQNGGVIDAVYAAPYHADAVIERYRHPDHPDRKPNPGMLLRAIEEHGIDPSKSLMIGDQPTDVEAARRAGVTGHLS

SEQ ID NO: 159211 - protein, 124 aa, Heterodera glycines
  Coding regions on vcDNA: vcDNA=SeqID_85634; Strand=+; Position=46-420
TEQTSEHNFDSVQSHRSEGNHASRHRHHFLDGICPFGVNAKRFDLHENDRCGRQHWQLETCECGKSVCLSLRCCAKHSLSIGEKSSFPPHNSSHQMAPSYDTAVTLTTSPQPPSHSANLQQKWS

SEQ ID NO: 159212 - protein, 186 aa, Heterodera glycines
  misc_feature (37)..(37): Xaa can be any naturally occurring amino acid
  misc_feature (49)..(49): Xaa can be any naturally occurring amino acid
  misc_feature (60)..(60): Xaa can be any naturally occurring amino acid
  misc_feature (137)..(137): Xaa can be any naturally occurring amino acid
  misc_feature (153)..(153): Xaa can be any naturally occurring amino acid
  misc_feature (170)..(170): Xaa can be any naturally occurring amino acid
  Homolog annotation: Hit_ID=BAB33421.1; Match level="QueryCoverage =94%, HitCoverage=61%, E-value=3e-64, Identity=70%"; Hit description =putative senescence-associated protein [Pisum sativum]
  Coding regions on vcDNA: vcDNA=SeqID_85635; Strand=+; Position=1-558
GSKNIAILPRRDSDLEAFSHNPSDGSFAPLVYRPSTXTKCLNLRFLSHXQDYYHSNRSLXGKTNLSHDGLNPAHVPYWWVNNPTLGEFCFAMIGRADIEGSKSYVAMDAWPPQASYPCGNFSDTSCWKLYTFKRIDXATLSRSVFVLKIRIKXAFAFLLYERFPSSLSSXLGHLRYALTDVPPQSN

SEQ ID NO: 159213 - protein, 82 aa, Heterodera glycines
  Coding regions on vcDNA: vcDNA=SeqID_85636; Strand=-; Position=46-294
FSVHSVINNSHNPPICASIDVFTTVVPRWTEERRNRKMEQIGKKSRRADSGRRNWAILENEQLIGVLHIYISYIYLQFFIGI

SEQ ID NO: 159214 - protein, 66 aa, Heterodera glycines
  Coding regions on vcDNA: vcDNA=SeqID_85637; Strand=-; Position=2-199
IELIYIERLIVWLLFFADKGHQKHVHFYQLLVREILIANASKLKQSVDQSRQFVTGLINSNCGRRR

SEQ ID NO: 159215 - protein, 98 aa, Heterodera glycines
  Coding regions on vcDNA: vcDNA=SeqID_85638; Strand=-; Position=3-296
LFPFPFLLPVFFFWPRTPWFFFFYHPKVFFFFFVRGEIFFFPPPRCFFFSPLSNYSIVFPLALLKGPFFNKGKRAQKKKKKKKKKKKKNQKKKKKKKK

SEQ ID NO: 159216 - protein, 118 aa, Heterodera glycines
  Coding regions on vcDNA: vcDNA=SeqID_85639; Strand=-; Position=2-355
LPKTKKKKLKKNRKRHRDIFEQQFKEIEGMSVEIVSPPKEEMDPITHNCDVNAQQIKEFGCKAIKGMSVEMVNSPTNEKKTAQLRDMSGSVVCSSEKALEKMDETLTKSKKKKKKKKK

SEQ ID NO: 159217 - protein, 122 aa, Heterodera glycines
  Coding regions on vcDNA: vcDNA=SeqID_85640; Strand=+; Position=1-369
GRKMKRRRSRKSGFATTFWMDILPFLTVFKLDSIWDVFVRQIWPIFTTPNSHNLSPSYADHLDNLLRLTTPTILSDLNINSIHSSSFLSVPALLSITTCSFICPCQRQLCHLNWRMSGRKKS

SEQ ID NO: 159218 - protein, 214 aa, Heterodera glycines
  Homolog annotation: Hit_ID=AAL78214.1; Match level="QueryCoverage =79%, HitCoverage=88%, E-value=8e-09, Identity=26%"; Hit description =putative esophageal gland cell protein Hgg-20 [Heterodera glycines]
  Coding regions on vcDNA: vcDNA=SeqID_85641; Strand=+; Position=1-642
GSFDHAQLGLKMALLSPRFNALVDKHFDGKTQFTIWKAIKIRKDKDEMPKLFVEGKSEGFPLPDRPLPNKIIFKKLRIEYIDHFVIEFLRSNQQIWDKGTTLYITVWEKNEDNKPIWDVFVAEIWPLFATNICQLCFAGAEFLDYLRRLISPTILSDLNRLDSIISCHLFPDVLADDDDFDGPNTTSAGQALAKWLHNPRKDGQPKSLHCWELN

SEQ ID NO: 159219 - protein, 153 aa, Heterodera glycines
  Homolog annotation: Hit_ID=AAN08587.1; Match level="QueryCoverage =84%, HitCoverage=28%, E-value=2e-36, Identity=52%"; Hit description =putative esophageal gland cell secretory protein 21 [Meloidogyne incognita]
  Coding regions on vcDNA: vcDNA=SeqID_85642; Strand=-; Position=83-544
FSGLKSPIGSPLCDWIRTRKYFAYSAHDTTIAALFSALGFNKTNFDVDGYPHYSACVTFELWQNATNLEHYIKAFYWPPNSPSFEEMTGNITGCETNSTLNRFVERSEIFKPVPSPDEYCKDTHFPTNFSSKPAHYFQNIIIIYFVLFMAFSL

SEQ ID NO: 159220 - protein, 154 aa, Heterodera glycines
  Coding regions on vcDNA: vcDNA=SeqID_85643; Strand=-; Position=99-563
TKFKEKFSHFIRINCKAFALADFYDFCGYVETRIRLQLLIDVERFDRIRLAHAKQIVEKEQILGENLDGSPANKKNHKKNVFFKIWLVGIELDEQIASENESESTNNWNNWKEALNSMLSEQFNPVILKAYRTKNGFSGPLVHIQLTAQYEQKH

SEQ ID NO: 159221 - protein, 121 aa, Heterodera glycines
  Homolog annotation: Hit_ID=CAE69228.1; Match level="QueryCoverage =71%, HitCoverage=11%, E-value=1e-16, Identity=49%"; Hit description =Hypothetical protein CBG15268 [Caenorhabditis briggsae]
  Gene Ontology: Mol. function=translation factor activity, nucleic acid binding; Cellular component=ribosome; Biological process =protein biosynthesis
  Coding regions on vcDNA: vcDNA=SeqID_85644; Strand=+; Position=4-369
MAGPLIRILGERHPVPVKVAAVNAFLRLLENVSLLLKAFLPQMQSVLLKILQDPSSQNLRQLASQAVVHLIDLHPKPETILKELNKLREADKSPEGLDLHTDKLINELIAKIDLKNGNTSK

SEQ ID NO: 159222 - protein, 147 aa, Heterodera glycines
  Coding regions on vcDNA: vcDNA=SeqID_85645; Strand=-; Position=2-442
CAPAAILRRSGHFSGPFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSGRLNLHMHGLIFEMNTSVQAGSTRS

SEQ ID NO: 159223 - protein, 141 aa, Heterodera glycines
  Homolog annotation: Hit_ID=CAE72423.1; Match level="QueryCoverage =57%, HitCoverage=27%, E-value=3e-16, Identity=46%"; Hit description =Hypothetical protein CBG19588 [Caenorhabditis briggsae]
  Gene Ontology: Mol. function=fucosyltransferase activity; Cellular component=extracellular; Biological process=carbohydrate metabolism
  Coding regions on vcDNA: vcDNA=SeqID_85646; Strand=-; Position=1-423
YLAFENSVCPQYVTEKFWNAFRALTVPVVLRRAVLRGMGVPDDAYIAADDFCSAQELAQHLLTLRHDTDRYMQFFNWTRKYSKKKKIRYFLQFANSVKSHKKIQGQNMQSTREIFGLKHKVNTILLKKIFSPEKKKKKKKK

SEQ ID NO: 159224 - protein, 105 aa, Heterodera glycines
  Homolog annotation: Hit_ID=XP_319808.1; Match level="QueryCoverage =89%, HitCoverage=5%, E-value=2e-36, Identity=75%"; Hit description =ENSANGP00000016536 [Anopheles gambiae]
  Gene Ontology: Cellular component=CCR4-NOT core complex; Biological process=reproduction
  Coding regions on vcDNA: vcDNA=SeqID_85647; Strand=+; Position=1-318
GIANQLRYPNSHTHYFSCALLYLFLGANSKHIQEQITRILFERLVALRPHPWGLLITFIELIRNQRYGFWKHEFVYCATEIERLFLSVANSCSVSGPESHHSNGI

SEQ ID NO: 159225 - protein, 121 aa, Heterodera glycines
  Coding regions on vcDNA: vcDNA=SeqID_85648; Strand=+; Position=3-365
FFFFFFFWLIKFIKSTKQWKNVKGNEFFCAQLVNSAICPSAPEVSSHRWVGWKTAQRMANRSLLIVSAMPAPSSAPSSSSPSTCGFSPSALFSSPPSSNFVVLRNLSNSRLAKNLWPKSRF

SEQ ID NO: 159226 - protein, 63 aa, Heterodera glycines
  Coding regions on vcDNA: vcDNA=SeqID_85649; Strand=+; Position=116-304
VPEGMPGGERTNGVTNIIYNIRANRSASSRHVIRFINAVQLSVIPFGLPIARILSNAFFVFSS

SEQ ID NO: 159227 - protein, 200 aa, Heterodera glycines
  Coding regions on vcDNA: vcDNA=SeqID_85650; Strand=+; Position=2-601
GAINCPNKQKMYSKYFFENFMKFLTIFVFIGIHSPTVAEVIHQLPEDNICAKFTVQFLEEFYQQNSSSPIFGWITAEGDVTLGQQNGTHFGIKCLALALSDWDFVVDRACLMTLAPPNSHRRFIASPWHQQNDQLNNGTNQTADQNVSYIVPLKSAEVRSPQLISFVQKWANKRPTARPCIFPIDDKIGSKLSWNGTICG

SEQ ID NO: 159228 - protein, 166 aa, Heterodera glycines
  misc_feature (118)..(118): Xaa can be any naturally occurring amino acid
  Homolog annotation: Hit_ID=NP_493910.2; Match level="QueryCoverage =95%, HitCoverage=26%, E-value=7e-70, Identity=79%"; Hit description =sodium:neurotransmitter symporter family member (67.4 kD) (snf-3) [Caenorhabditis elegans] gb|AAB71293.2|
  Gene Ontology: Mol. function=GABA:sodium symporter activity; Cellular component=integral to membrane; Biological process=transport
  Coding regions on vcDNA: vcDNA=SeqID_85651; Strand=+; Position=3-499
KISCFFTLKFVYFCALFPYFLILVLLIRGLTLEGAGKGIIFYLKPNITKLTDTTVWKDAGTQVFYSYGVGFGTLIALGSHNKFHHNCYHDAMVVCVINGMTSILAGFAIFSVLGHLSXVCKKPIAEIVKPGVGLAFLAYPEVASNLPFKQIWAFLFFLMITILGLD

SEQ ID NO: 159229 - protein, 129 aa, Heterodera glycines
  misc_feature (9)..(9): Xaa can be any naturally occurring amino acid
  Homolog annotation: Hit_ID=CAE67340.1; Match level="QueryCoverage =100%, HitCoverage=13%, E-value=9e-30, Identity=48%"; Hit description= Hypothetical protein CBG12802 [Caenorhabditis briggsae]
  Gene Ontology: Mol. function=ATP-dependent peptidase activity; Cellular component=mitochondrion; Biological process=proteolysis and peptidolysis
  Coding regions on vcDNA: vcDNA=SeqID_85652; Strand=+; Position=102-489
HRLFQQQIXILLIPKQNVTEDPIALCDLLGAIGETSTATTQDLQDLTEKTDVVERLRKALELLEKEKTILRMRNQIKEDVERKVNEQHRKAVLYEHLKAIKRELGIEKEDKRAVLEKMEERLANLKVPE

SEQ ID NO: 159230 - protein, 46 aa, Heterodera glycines
  Coding regions on vcDNA: vcDNA=SeqID_85653; Strand=+; Position=3-143
FFFFFFFLFFFFFFFFFFFFFFFWGKGIFWVLKDQTKTPLKRKFNK

SEQ ID NO: 159231 - protein, 171 aa, Heterodera glycines
  Homolog annotation: Hit_ID=CAE65225.1; Match level="QueryCoverage =91%, HitCoverage=31%, E-value=2e-46, Identity=56%"; Hit description =Hypothetical protein CBG10101 [Caenorhabditis briggsae]
  Gene Ontology: Mol. function=hydrogen:sugar symporter-transporter activity; Cellular component=integral to plasma membrane; Biological process=anion transport
  Coding regions on vcDNA: vcDNA=SeqID_85654; Strand=+; Position=2-514
GVIRRPSRPIPIGAIVRSKAVWAILIGHFAGDWGAYMMALGLPSFLNDVLGMQMTSMGFASAIPYVVYFAVINLGGHLSDSLLQRQLLSTLNCRRLAMALALGGQAFFLLLISFCPCGYDKLVIALLTLSIGISGFQYSGFVINYLDIAPELAGLLLGLGNTLSCLAGFLG

SEQ ID NO: 159232 - protein, 191 aa, Heterodera glycines
  Coding regions on vcDNA: vcDNA=SeqID_85655; Strand=+; Position=2-574
GAEAPFLPFKTEGQHFGCQKNLKMRYPIFQIFLIMSFICRFKSAVIFRSDTMNQTDYGPMVLAHNGTSPSDQDKIQDEETDHWLTLTQTDQTTTDQNSTLSIDWMSNTIMKADHDATLSLGEDHGQTLEAKNDDEPNLENGHYGTTPTDYEPNEEKNAVDNADHNDMAVDGAHDLSSAEDYDGNDSISAKN

SEQ ID NO: 159233 - protein, 114 aa, Heterodera glycines
  Coding regions on vcDNA: vcDNA=SeqID_85656; Strand=-; Position=167-511
EKVLNEFDFARRAEWELVQTLFGIASDRTILFPDDQIRQQTGCPQNSDAYKFLCSIFVDGSSEGINYGTTSTSVLLVDIEGTAVFHERRLVNPQSPMDDPQKWKFSRERFPICY

SEQ ID NO: 159234 - protein, 187 aa, Heterodera glycines
  misc_feature (166)..(166): Xaa can be any naturally occurring amino acid
  Homolog annotation: Hit_ID=CAE64198.1; Match level="QueryCoverage =97%, HitCoverage=26%, E-value=6e-70, Identity=73%"; Hit description =Hypothetical protein CBG08827 [Caenorhabditis briggsae]
  Gene Ontology: Mol. function=enzyme regulator activity; Cellular component=mitochondrial inner membrane; Biological process =mitochondrial translocation
  Coding regions on vcDNA: vcDNA=SeqID_85657; Strand=+; Position=63-623
MLHGWRVFASCSKSVLKSPSLQSGGYGLSRRLKSDEVRGPVIGIDLGTTNSCVAVMEGKQAKVIENAEGSRTTPSIVAFTKDNERLVGAPARRQAVTNSENTLYATKRLIGRRFDDPEVQKDIKVVPYKIVKASNGDAWLEAQGKLYSPSQIGAFVLMKMKETAEXFLGTSVANSVVTVPAYFNDSQ

SEQ ID NO: 159235 - protein, 150 aa, Heterodera glycines
  Homolog annotation: Hit_ID=CAE70434.1; Match level="QueryCoverage =99%, HitCoverage=33%, E-value=9e-33, Identity=47%"; Hit description =Hypothetical protein CBG17010 [Caenorhabditis briggsae]
  Gene Ontology: Mol. function=cytochrome P450 activity; Cellular component=endoplasmic reticulum; Biological process=electron transport
  Coding regions on vcDNA: vcDNA=SeqID_85658; Strand=+; Position=50-502
MEDRLRLPYTHAVESLRLSNLLPLNLHKVLQTDVEIGGHKLKKGTAVVNQIATVLFDDKIFPDHEKFMPSRFLEEDGKMRRVDELIPFGIGKRSCPGETLGRMELVLFTANFFHKFHVYPCDPLNPPKFEKRQTFAVKLADYKCKVTKRK

SEQ ID NO: 159236 - protein, 202 aa, Heterodera glycines
  Homolog annotation: Hit_ID=NP_494215.1; Match level="QueryCoverage =92%, HitCoverage=25%, E-value=1e-48, Identity=54%"; Hit description =cystathionine beta-synthase (2C510) [Caenorhabditis elegans] gb|AAF35961.1| Hypothetical protein F54A3.4
  Gene Ontology: Mol. function=cystathione beta-synthase activity; Cellular component=cytoplasm; Biological process=cysteine metabolism
  Coding regions on vcDNA: vcDNA=SeqID_85659; Strand=+; Position=1-606
GPQKTFATNEKYDPEKAGEEKFQKVNEPWHSVPYSPPTKALLFNAISAAIGGTPLVKLQRLPREDGIEAEILVKCEFLNAGGSVKDRIARKMVELAEAKGILRAGQSTIIEPTSGNTGIGLALMAAIRGYRCIIVMPEKMSWEKECVLRALGAQIVRTPSEKGYTDADSHIGVALRLQREILGAVILDQAKEAGGWGNTPRG

SEQ ID NO: 159237 - protein, 175 aa, Heterodera glycines
  Coding regions on vcDNA: vcDNA=SeqID_85660; Strand=-; Position=2-526
LTTRRRRPKKGCWATRFLSLFWSTSTEVLATFVTSAFGTDELPTCSVVRCPHPLSSMSQRFSSVPFPSVAVPSFSSSELSSHGGRNASTRLFELGFFFFDGLTPCEGGRGPTKSFRVLAVNPKSGGCPQRKVFESLPDVFDSSCHLCPKFAFFCCLLDILRGFSLDYLKNRNISS

SEQ ID NO: 159238 - protein, 86 aa, Heterodera glycines
  Coding regions on vcDNA: vcDNA=SeqID_85661; Strand=+; Position=171-431
VITPIGKQLNLKAETREVVESIISHTFHHFVFFESAFFTFGDFFSSDKTSFWPFAFSALSFAFFLALCCSFLRSASFFLSAPVGNT

SEQ ID NO: 159239 - protein, 59 aa, Heterodera glycines
  Coding regions on vcDNA: vcDNA=SeqID_85662; Strand=-; Position=42-221
FGLNINRLPIRMSINLSQYQSVDLVSFLGDSSLESVIASFGGSFLSTLFTFTSSTALSS

SEQ ID NO: 159240 - protein, 192 aa, Heterodera glycines
  misc_feature (22)..(22): Xaa can be any naturally occurring amino acid
  Homolog annotation: Hit_ID=AAK26375.1; Match level="QueryCoverage =100%, HitCoverage=43%, E-value=1e-102, Identity=97%"; Hit description=class V aminotransferase [Heterodera glycines]
  Gene Ontology: Mol. function=alanine-glyoxylate aminotransferase activity; Cellular component=extracellular space
  Coding regions on vcDNA: vcDNA=SeqID_85663; Strand=+; Position=51-624
MLSRMLSSAVAVPRMCESNKKXLLRKGATFVGLLRGRMANSTFTATVTPPHRLLRPLHINEKKLFGPGPSNMPPLVQEGLVQPLLGHMHPEFFEIMDDVKAGIKYIFQTENALTFAVSGTGHAGMECAILNLLEPGQAILVVQNGVWGSRAANLAERLGIKVHRLVVPEGEVINLDDFAEAVDNYRPQVAFV

SEQ ID NO: 159241 - protein, 73 aa, Heterodera glycines
  Coding regions on vcDNA: vcDNA=SeqID_85664; Strand=+; Position=2-220
FFFFFFFFFAIYFYFNVINFDNHAGNKCTILLFVVSQLCCVCCLFHSFLLLNDASHLLRFSQIMRLQKKNELV

SEQ ID NO: 159242 - protein, 184 aa, Heterodera glycines
  Homolog annotation: Hit_ID=CAE73541.1; Match level="QueryCoverage =90%, HitCoverage=42%, E-value=6e-31, Identity=39%"; Hit description =Hypothetical protein CBG21009 [Caenorhabditis briggsae]
  Coding regions on vcDNA: vcDNA=SeqID_85665; Strand=+; Position=2-556
GFGANFGPISAPSTSDGPHFPDNVWFLCENYVLQSDAALETVHEEFDIIFALACSKWVHLNWGDAGIKRLFLRAFRQLRTGGRFVLETAPFKDYRKHCKKAAADRPPDEVLRNFGAIRLHPDEFTAFLLNVVGFSHHEELDSAHSKALGISGRLQVFYKGQFMLTDAPEGARDETPGATPQQQQ

SEQ ID NO: 159243 - protein, 81 aa, Heterodera glycines
  Coding regions on vcDNA: vcDNA=SeqID_85666; Strand=-; Position=194-439
GRPIRMCPILHALSTSHTNIWPRVETLSLGATAPIFYCTTRPLIGCLALATNPRGPAMRTKRRGTPAARGKSIERRPLPDG

SEQ ID NO: 159244 - protein, 140 aa, Heterodera glycines
  Homolog annotation: Hit_ID=CAE64717.1; Match level="QueryCoverage =99%, HitCoverage=54%, E-value=1e-42, Identity=63%"; Hit description =Hypothetical protein CBG09503 [Caenorhabditis briggsae]
  Gene Ontology: Mol. function=electron transporter activity; Cellular component=mitochondrion; Biological process=carbohydrate metabolism
  Coding regions on vcDNA: vcDNA=SeqID_85667; Strand=+; Position=1-423
GNVKAGFMMAKLFAPEIEQSGGGSIVFNSSIGAYRSPQGIAAYGITKTALLGLTRALAESLAPKGIRVNAIAPGIIKTKMSKALWEGIDERSSAEAIGTLMGRLGMPEECAALVAFLCSSDASYITGETVPVAGGAYSRL

SEQ ID NO: 159245 - protein, 138 aa, Heterodera glycines
  Coding regions on vcDNA: vcDNA=SeqID_85668; Strand=-; Position=2-415
NESDFVTLGLGNNDCEKGFEIGIALIKKDTIWSPWLKPIMLDPPIVFIDGNVDATKRIEFGSYFKLDIWPKLDENSEIVYRVNVYCAANTHFEFKTYPKSLANVVINSNYKVFTPIGSEKMKPDIKGQLCKKKKKKKK

SEQ ID NO: 159246 - protein, 99 aa, Heterodera glycines
  Homolog annotation: Hit_ID=CAE62116.1; Match level="QueryCoverage =97%, HitCoverage=6%, E-value=9e-22, Identity=57%"; Hit description =Hypothetical protein CBG06155 [Caenorhabditis briggsae]
  Gene Ontology: Biological process=gametogenesis
  Coding regions on vcDNA: vcDNA=SeqID_85669; Strand=-; Position=105-404
NELTVHVVPLSSPSIKEGDPRRNIGKPLRKKPRRPPPAQQKNNHQSRKGSALLRRLSGKRTVGDIVPGTSSQKQMFIPRSVSSQEGRAQLFTSSTSKLE

SEQ ID NO: 159247 - protein, 142 aa, Heterodera glycines
  Homolog annotation: Hit_ID=AAH70826.1; Match level="QueryCoverage =97%, HitCoverage=27%, E-value=3e-25, Identity=44%"; Hit description =MGC83917 protein [Xenopus laevis]
  Coding regions on vcDNA: vcDNA=SeqID_85670; Strand=+; Position=2-430
GNLLESLEPPPRPKISWSNYLRASDEQSHLGRPIQTKVTTKDVSGMLAMSTDFPISLNLALDILSVMEPVNPTVAKLREFCTAKLPEGFPVRVEMPIFATIQARVIFQQFRWCGEGASPAFPDAMFRTPDDYREDPKRFKRM

SEQ ID NO: 159248 - protein, 73 aa, Heterodera glycines
  Coding regions on vcDNA: vcDNA=SeqID_85671; Strand=+; Position=174-392
IQFILGQQKNKLPHRKNGKCFFNHRMPWLIPRRVSRGFPTKITVPVDKAVLHDNQCLNNAWLLFNCRHALIAF

SEQ ID NO: 159249 - protein, 117 aa, Heterodera glycines
  Coding regions on vcDNA: vcDNA=SeqID_85672; Strand=-; Position=84-437
HWPFHHDPSRPRPHLMYGRSVGSHPYANQFPRPMTQARMRSPFCYGTFQPFGLNRYPRNIPANSASNFHPEALKNSALKKSQFAMEWTTNRPAPYFPRNDYAAFSTSQVGNAGGTWF

SEQ ID NO: 159250 - protein, 105 aa, Heterodera glycines
  misc_feature (97)..(97): Xaa can be any naturally occurring amino acid
  Homolog annotation: Hit_ID=AAL31950.1; Match level="QueryCoverage =84%, HitCoverage=19%, E-value=1e-15, Identity=55%"; Hit description =CDH1-D [Gallus gallus]
  Coding regions on vcDNA: vcDNA=SeqID_85673; Strand=+; Position=39-352
IGSSLHTDRSRNTNRPRISRNGSVPGSDGRCVQRAGTYSERVDDSPLQGIPRSRTIIAMSDPNHGKFSPVYQPLSGKDKHADFASVARVQPRTSKGXHRPVIAQF

SEQ ID NO: 159251 - protein, 149 aa, Heterodera glycines
  Coding regions on vcDNA: vcDNA=SeqID_85674; Strand=+; Position=3-452
GAREQFTKQLARFRGFEKAEQQNVKLFDAKLRQRLCVADIDRERVLSLEDELGKVKTELTVQARENRQLKRKYAALETRTREYETELENGREQMERAKRYIDQEKRPENDARRTLLKLAEMFESPIPTTSNVARLRKQFDDDDNDADDN

SEQ ID NO: 159252 - protein, 46 aa, Heterodera glycines
  Homolog annotation: Hit_ID=NP_497227.1; Match level="QueryCoverage =100%, HitCoverage=25%, E-value=1e-11, Identity=69%"; Hit description= cysteine-rich hydrophobic protein similar to CHIC1 and CHIC2 (19.8 kD) (3B256) [Caenorhabditis elegans]
  Coding regions on vcDNA: vcDNA=SeqID_85675; Strand=-; Position=332-472
HENQQLYDKLGLHWKLARLPVEPSNRLTEYVLLLETLPRIPLSMPD

SEQ ID NO: 159253 - protein, 162 aa, Heterodera glycines
  Homolog annotation: Hit_ID=Q27666; Match level="QueryCoverage=96%, HitCoverage=97%, E-value=2e-56, Identity=63%"; Hit description =Superoxide dismutase [Cu-Zn] emb|CAA93447.1| cytoplasmic superoxide dismutase [Haemonchus contortus]
  Gene Ontology: Mol. function=copper, zinc superoxide dismutase activity; Cellular component=cytoplasm; Biological process =neurogenesis
  Coding regions on vcDNA: vcDNA=SeqID_85676; Strand=+; Position=59-547
MADPKKAVCVLVGDADPSVKGMITFTQDKEGSPVSVQGEISGLEPGLHGFHVHAYGDLSNGCTSAGPHFNPTNKTHGGPQDQIRHVGDLGNVHAGSDGIAKLTFSDHLISLCGANNIVGRALVVHKSEDDLGRGLGEKEDESKKTGNAGARLACGIIGLAKP

SEQ ID NO: 159254 - protein, 36 aa, Heterodera glycines
  Coding regions on vcDNA: vcDNA=SeqID_85677; Strand=+; Position=1-108
FFFFFFFFSFFFFFFFFGDFVLVFGEGKKNKKTFGG

SEQ ID NO: 159255 - protein, 74 aa, Heterodera glycines
  Coding regions on vcDNA: vcDNA=SeqID_85678; Strand=+; Position=75-296
QNEKHCERGSILFHFYLTFESFHIASPFQGFHFSRLNCVPTLSSRVHLGHFVSQCLKFHLLFGTFLNFLGVSEC

SEQ ID NO: 159256 - protein, 111 aa, Heterodera glycines
  Coding regions on vcDNA: vcDNA=SeqID_85679; Strand=+; Position=3-335
FFFFFFFFFCSSTALIFCCCLLISTMGMANKLHIFEKHLKFQVVVLVNFVVELLRGAGAVHFDVPFPQPTFFWVVPENDFVFGALPIIANEPVVRVELPIGVLFGPLHPFA

SEQ ID NO: 159257 - protein, 149 aa, Heterodera glycines
  Coding regions on vcDNA: vcDNA=SeqID_85680; Strand=+; Position=3-452
RAREQFTKQLARFRGFEKAEQQNVKLFDAKLRQRLCVADIDRERVLSLEDELGKVKTELTVQARENRQLKRKYAALETRTREYETELENGREQMERAKRYIDQEKRPEKDARRTLLKLAEMFESPIPTTSNVARLRKQFDDDDNDADDN

SEQ ID NO: 159258 - protein, 78 aa, Heterodera glycines
  Coding regions on vcDNA: vcDNA=SeqID_85681; Strand=-; Position=151-387
APLDGFPQFTTGDVIGCGLNAFNRHVFFTLNGEKLDMGILAADPVRLFAAVTLVDNKDAIRANFGPSLVFNLSSVLPF

SEQ ID NO: 159259 - protein, 108 aa, Heterodera glycines
  Coding regions on vcDNA: vcDNA=SeqID_85682; Strand=-; Position=1-324
TGEHAIAPQKNKVFGGAFAPRLSNGLSAGQFGQDSVAPAGKSHFLVKFCPVNPLRKKGKRPNKRDSRLLLCVHSIIVLLLHFRYSRNCYQKFRYQISSFWQKKKKKKK

SEQ ID NO: 159260 - protein, 92 aa, Heterodera glycines
  Coding regions on vcDNA: vcDNA=SeqID_85683; Strand=-; Position=147-425
DVEDEYVYLLARFVGPDTQQIWSIYAQQLHQAIEESLPPNFELANERQGAVIDGDLLKALELSEAEEKRRLEEFKEEEEMPRKALELSMVEK

SEQ ID NO: 159261 - protein, 48 aa, Heterodera glycines
  Coding regions on vcDNA: vcDNA=SeqID_85684; Strand=-; Position=1-144
SSCPCCGNSSSWHTVKNQKLNFWQNVFFSYNKTFARFRACQTCTLTKK

SEQ ID NO: 159262 - protein, 105 aa, Heterodera glycines
  Coding regions on vcDNA: vcDNA=SeqID_85685; Strand=+; Position=46-360
ISISPQNNKKILWQIWSKSPSSPIHPLKFVSVQNHPPPQILAVQQLFVEHNHRIVKAIIVLRGTTQFENGRETIAQVDQSVGVGHGGAHGHQLGRDFKQMLDPDG

SEQ ID NO: 159263 - protein, 125 aa, Heterodera glycines
  Coding regions on vcDNA: vcDNA=SeqID_85686; Strand=+; Position=149-523
DTIIQSLQLGSYVGIGSVECILLLLPFRGVSFASFPIHRSFVVSFHRVLLRPFTGISVVLLAVVAVNNRDVHFQRTIRIRVAKKRKDGEQHFRNGQRRRPMRRLQDVQTNATLLVDVRMVNGRFE

SEQ ID NO: 159264 - protein, 29 aa, Heterodera glycines
  Coding regions on vcDNA: vcDNA=SeqID_85687; Strand=+; Position=1-90
FFFFFFFFFFFFFFFFRGLNLFKKIQNNQ

SEQ ID NO: 159265 - protein, 77 aa, Heterodera glycines
  Coding regions on vcDNA: vcDNA=SeqID_85688; Strand=-; Position=43-276
GHTYANLLRKCRSMNRSVCHRVDPTHIIIRAMDGSNGGRKNGCLVFRFYSILFYLLVFQNKFFPQLFKLFVVLNLFR

SEQ ID NO: 159266 - protein, 85 aa, Heterodera glycines
  Coding regions on vcDNA: vcDNA=SeqID_85689; Strand=-; Position=296-553
KNGKKKEPKPRKKREISGKFYKIKEKINQKGKKYSNREWSKIEGKIAKKLGINRNNIYEWIKKIGLNQRINKCYKIRRKLLTLSK

SEQ ID NO: 159267 - protein, 79 aa, Heterodera glycines
  Coding regions on vcDNA: vcDNA=SeqID_85690; Strand=-; Position=2-238
RQRSEIPRPIPNNWQMGRNQSVCRHLQVKQRKMMEVIGPEFWMFWLGFGCQYVKMFFLNQMFSIIFILLLKKKKKKKKK

SEQ ID NO: 159268 - protein, 46 aa, Heterodera glycines
  Homolog annotation: Hit_ID=ZP_00357698.1; Match level="QueryCoverage =100%, HitCoverage=24%, E-value=5e-13, Identity=75%"; Hit description= hypothetical protein Chlo02002738 [Chloroflexus aurantiacus]
  Coding regions on vcDNA: vcDNA=SeqID_85691; Strand=+; Position=3-143
FFFFFFFFSLFFFFFFFFFFFFFFFFFFFFFFFFKKGKWVFFLKIF

SEQ ID NO: 159269 - protein, 93 aa, Heterodera glycines
  Coding regions on vcDNA: vcDNA=SeqID_85692; Strand=+; Position=36-314
ILFIFNDMPKMINNILCHLSRFVPFVICPVGHYSAIWLSISVSSPMPSNSSASPSMASYSSSSPFANWSKSDFSAPKLSTASVPKLFSFATTS

SEQ ID NO: 159270 - protein, 72 aa, Heterodera glycines
  Homolog annotation: Hit_ID=AAO33477.1; Match level="QueryCoverage =100%, HitCoverage=29%, E-value=2e-32, Identity=91%"; Hit description= gland-specific protein g4g05 [Heterodera glycines]
  Coding regions on vcDNA: vcDNA=SeqID_85693; Strand=-; Position=197-415
NRVAERAAARVYGWLPENNHPKAIYDAAEKAKNTPKPPGDYNVERVAQKAARLVYGVLPIGFQPNFAGPSTN

SEQ ID NO: 159271 - protein, 72 aa, Heterodera glycines
  Coding regions on vcDNA: vcDNA=SeqID_85694; Strand=-; Position=38-256
FPQAANQNRTKGAGNKRKLRGHYYANFHLNLHMHIYTHLFMFSFGHFGLNLIFINLNIFRCFIYFWFLPSKE

SEQ ID NO: 159272 - protein, 56 aa, Heterodera glycines
  Coding regions on vcDNA: vcDNA=SeqID_85695; Strand=-; Position=1-168
NVRNVSYYCKIAHFLMNYSMMQLIFEKMCQCFFWHSWTVLINWKVSKKKKKKKNVK

SEQ ID NO: 159273 - protein, 138 aa, Heterodera glycines
  Homolog annotation: Hit_ID=CAE69228.1; Match level="QueryCoverage =74%, HitCoverage=13%, E-value=1e-20, Identity=48%"; Hit description =Hypothetical protein CBG15268 [Caenorhabditis briggsae]
  Gene Ontology: Mol. function=translation factor activity, nucleic acid binding; Cellular component=ribosome; Biological process =protein biosynthesis
  Coding regions on vcDNA: vcDNA=SeqID_85696; Strand=-; Position=110-526
QLIPLSSEAGLRPHVVNMAGPLIRILGERHPVPVKVAAVNALLRLLENVSLLLKAFLPQMQSVLLKILQDPSFQNLRQLASQAVVHLIDLHPKPETILKELNKLREADKSPEGLDLHTDKLINELIAKIDLKNGNTSK

SEQ ID NO: 159274 - protein, 74 aa, Heterodera glycines
  Homolog annotation: Hit_ID=AAO33474.1; Match level="QueryCoverage =100%, HitCoverage=53%, E-value=9e-36, Identity=95%"; Hit description= gland-specific protein g4g12 [Heterodera glycines]
  Coding regions on vcDNA: vcDNA=SeqID_85697; Strand=-; Position=221-445
EAIGRSNVQGGNAAGLVPSHVTNRSMAPPPPPVQFEMGANRLEKMRAHLRELVEKMPVNESKGLSPSGPDPHHH

SEQ ID NO: 159275 - protein, 99 aa, Heterodera glycines
  Homolog annotation: Hit_ID=XP_309868.1; Match level="QueryCoverage =90%, HitCoverage=26%, E-value=2e-12, Identity=38%"; Hit description =ENSANGP00000018210 [Anopheles gambiae]
  Gene Ontology: Mol. function=ATP binding; Cellular component =cytoplasm; Biological process=protein kinase cascade
  Coding regions on vcDNA: vcDNA=SeqID_85698; Strand=+; Position=232-528
MVNITGIASSKAPPFSHGTPWANRHHIHQPFQSRPMTCCFGMVPTPQVTMGACFVSLLHNIPIHVNCCAQYFHPANRKQFMIIGAEQGIFAMDLTHLTT

SEQ ID NO: 159276 - protein, 80 aa, Heterodera glycines
  Homolog annotation: Hit_ID=AAM50038.1; Match level="QueryCoverage =100%, HitCoverage=33%, E-value=2e-31, Identity=83%"; Hit description= putative gland protein G27D09 [Heterodera glycines]
  Coding regions on vcDNA: vcDNA=SeqID_85699; Strand=-; Position=217-459
RNSLPSYTSTATNLDMADDNDDYQNYYYGTEASSREFDASAEEEDDLYEEEVGAMSGQTDDYGIGSGQDEYGHQPVDVPP

SEQ ID NO: 159277 - protein, 94 aa, Heterodera glycines
  Coding regions on vcDNA: vcDNA=SeqID_85700; Strand=+; Position=113-394
WEIHTTSSSTPATAQQKSQFHTFNRLSHEPVHSAVPSLGTPKHQIRLSWPEIIPVLSTRIESHKLQLKSSHPTNSKRPDLEKATLVTPQMMLSC

SEQ ID NO: 159278 - protein, 127 aa, Heterodera glycines
  Coding regions on vcDNA: vcDNA=SeqID_85701; Strand=-; Position=83-466
FFFTLQFYCPNNLFMYNTKLDIAFVRSQLEMSADHLSTVALFTIRYEHNVSIVVRALKHGVSRMIQFRAKVEQTDGAKQTIFEPTVEADVVEHVVTDGAHLTDLGHFLQADQTNGAPVGSLHFAMNE

SEQ ID NO: 159279 - protein, 142 aa, Heterodera glycines
  Homolog annotation: Hit_ID=AAH87138.1; Match level="QueryCoverage =66%, HitCoverage=53%, E-value=1e-30, Identity=64%"; Hit description =Unknown (protein for MGC:95078) [Rattus norvegicus] gb|AAH31719.1| Dctd protein [Mus musculus] dbj|BAC3022
  Coding regions on vcDNA: vcDNA=SeqID_85702; Strand=+; Position=97-522
MIPSVGQPQPQQHGLLLTVSPKKSTAVVTDAENASAIVPNGDDEQAMTNSANKKRTDYLSWDEFFMGVALMAAQRSKDPITQVGACIVKENSIIGIGYNGMPIGCNDDEMPWGKGDANPLNNKYLYVCHAEMNAILNKNSAS

SEQ ID NO: 159280 - protein, 197 aa, Heterodera glycines
  Coding regions on vcDNA: vcDNA=SeqID_85703; Strand=+; Position=2-592
GLTLVIYSLDTVLLMLFPRPSAGVGMDFGPYLKLTAIFIVLSTFGLGLSLAHMKKMLQIGKELAKQNETTKTASATFVGQDNLRTLRAFTGCQAGLSVLSIYVAASLAFMKFWYVRTHLVQEFSCSLMAITLAVVQFFVLRMANGGGLLLIKGIVLANACQIVQELNMSLSAFYTFFYAGRIYDAVEERTSFFTGPE

SEQ ID NO: 159281 - protein, 122 aa, Heterodera glycines
  Coding regions on vcDNA: vcDNA=SeqID_85704; Strand=-; Position=63-431
MKLAICNLVLDTTTRPNFVADYLLYFMNKYRDFSYVDFLRIREPSDDIKQVLIAVFKLRNCMSDSYKVPGIEVTWDLHSAALQFLNLFRKYAKAPFLDRDLLGFRDSWTGTESNDVESKKAH

SEQ ID NO: 159282 - protein, 34 aa, Heterodera glycines
  Coding regions on vcDNA: vcDNA=SeqID_85705; Strand=-; Position=310-414
LLKYFNNISRNRWLIIKVFGVLKAFFVFFGIFLT

SEQ ID NO: 159283 - protein, 180 aa, Heterodera glycines
  Coding regions on vcDNA: vcDNA=SeqID_85706; Strand=+; Position=3-542
VNRNSLPIPQKALPKKVVGFKSISIKYIDQNVIAFLRHFRQLFASCTINLDIYTDDDRTLDLMLRNIWPMIAKNICSMELSGHAFSGLRQFVPSILNDCPSLRVVDTYFGGFFAEFPADDNANASNGQAWAKWLFTPRPDNVPKVFKCWLDGNLSSRIGALKAAFANASSPVNFIVVIWQ

SEQ ID NO: 159284 - protein, 204 aa, Heterodera glycines
  Coding regions on vcDNA: vcDNA=SeqID_85707; Strand=+; Position=2-613
GSTPVLQTTTAPKQITDKAKCNDKEEIRRVCESCEEYACVPKDGFVANSACCTDNFQFQCCPNNQQQRHPGHCANETKKIMDLCGCGTYWCRPNKGYRGFGCCPSDYEFVCCHVGNQTIQMSTVTTVTPELTTTTTLPTTPNLGKIENDPPLFCALKKTCNPSNNMTGSEKFGRRFNTHKKKCAALIKRQQSAPSTELKSELRQ

SEQ ID NO: 159285 - protein, 70 aa, Heterodera glycines
  misc_feature (18)..(18): Xaa can be any naturally occurring amino acid
  Coding regions on vcDNA: vcDNA=SeqID_85708; Strand=-; Position=2-211
LFLPVFALLQFHAFFVRXITSQIVVPTNPVEHLQLLFVLRWLHNRRFRRINLDIQIVGQRHSLFGQLDCP

SEQ ID NO: 159286 - protein, 114 aa, Heterodera glycines
  Coding regions on vcDNA: vcDNA=SeqID_85709; Strand=-; Position=39-383
DSILSMFERKWKGQQVEEGEKNGTENDERERADRTVDEKMDSLEALVVFIRRHRMGLIQPPQQLRFCWKTIVDWLVKNEKKEEKGKEENQSPAKIATELNHINEENWQIIDKCV

SEQ ID NO: 159287 - protein, 165 aa, Heterodera glycines
  misc_feature (25)..(25): Xaa can be any naturally occurring amino acid
  Homolog annotation: Hit_ID=AAK85303.1; Match level="QueryCoverage =100%, HitCoverage=46%, E-value=3e-91, Identity=99%"; Hit description= beta-1,4-endoglucanase-4 [Heterodera glycines]
  Coding regions on vcDNA: vcDNA=SeqID_85710; Strand=+; Position=84-576
MLVQLVLLAIIGISFVGAAAPPYGXQLSVSGTKLVGSNGKPVQLIGNSLFWHQWYPQFWNTETVKALKCNWNSNVVRTAMGVEQGGYLSDANTAYRLTAAVIEAAIAQGIYVIVDWHAHEANADKAIEFFTKVAKAYGSNPHLLYETFNEPLDVSWNDVLVPYHK

SEQ ID NO: 159288 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_85711; Strand=+; Position=59-475

SEQ ID NO: 159289 - protein, 38 aa, Heterodera glycines
  Coding regions on vcDNA: vcDNA=SeqID_85712; Strand=-; Position=1-114
VRPPIDEYLCDLSRDKVAKLSKNANYGTQRKFRPWESP

SEQ ID NO: 159290 - protein, 105 aa, Heterodera glycines
  Homolog annotation: Hit_ID=NP_498663.1; Match level="QueryCoverage =99%, HitCoverage=67%, E-value=3e-28, Identity=51%"; Hit description =deaminase (3I668) [Caenorhabditis elegans] gb|AAK84461.1| Hypothetical protein R13A5.10 [Caenorhabditis e
  Gene Ontology: Cellular component=mitochondrion
  Coding regions on vcDNA: vcDNA=SeqID_85713; Strand=+; Position=3-320
DAEVMALRGASKVLDSFDLSGCILYTSCYPCPMCLGAVLWSRISNAFYAAAPTDAASVGFDDQNFHEFVSNPKKYEKLMALEHLPVEGHMKVFKMWEQRDEKRMY

SEQ ID NO: 159291 - protein, 42 aa, Heterodera glycines
  Coding regions on vcDNA: vcDNA=SeqID_85714; Strand=+; Position=36-161
KFYLNYKLFYGHIKSEKLKFFSSNQASHNFSISFSMVFGSLG

SEQ ID NO: 159292 - protein, 134 aa, Heterodera glycines
  Coding regions on vcDNA: vcDNA=SeqID_85715; Strand=-; Position=1-402
SANFRHLHLLRIFNRIVRLSPRCVCQTTELFSERFLSTSFLLLQKRFTPKPTGPVRRVPAVSIGSDVRQKHSERTAGKGDGTNGFWHPWNASDDYSEIKKRLLRPPKDFSELREIIRKDIERMAQKKKKKKKKK

SEQ ID NO: 159293 - protein, 113 aa, Heterodera glycines
  Coding regions on vcDNA: vcDNA=SeqID_85716; Strand=+; Position=1-342
GDTFFHLSHHFKIFPKMRVLPLLFSALLLLSVGLCFAQFDQSPSAALNHVRAKRGYKPWKKQSFSSSSSEMYRRRRPSGNGHYRDYNSYGSNGYYRRKPGILERALGKITRSY

SEQ ID NO: 159294 - protein, 91 aa, Heterodera glycines
  Coding regions on vcDNA: vcDNA=SeqID_85717; Strand=-; Position=2-274
FSRRPRAVRVAQQQFQFVGRAVAPTPSDVRVETVVAQQTQKNIEEIPLKRGQTDGMGNDVAYNYRHFPYFISQLFVNCSFYLCQKKKKKKK

SEQ ID NO: 159295 - protein, 107 aa, Heterodera glycines
  Coding regions on vcDNA: vcDNA=SeqID_85718; Strand=+; Position=1-324
GIHCISSYHFIPKMSFLRLITFVLLITLCSLPSLVESGLIGIVGTPVEAAWCGVLGKESSHCPTAGGGQHGGGGGGGGGGNYGGGAPGGNYGGSSGSYNGHRARRFP

SEQ ID NO: 159296 - protein, 155 aa, Heterodera glycines
  Homolog annotation: Hit_ID=CAE74685.1; Match level="QueryCoverage =99%, HitCoverage=16%, E-value=2e-10, Identity=25%"; Hit description =Hypothetical protein CBG22497 [Caenorhabditis briggsae]
  Coding regions on vcDNA: vcDNA=SeqID_85719; Strand=-; Position=2-466
NVPHLCASFFRLLIFVSDIAAEGIAQSPPQMLDDILRCVKAALDYSFGGDRVRSALEIVNGLAANCVEDSVKKTGKYATMTERLLALVPKMFQLAMEYSFELDLLSDASSALFSLILLGPDSFKAFVTHLLNLPSNQENRERLEEAFSQLLTPFP

SEQ ID NO: 159297 - protein, 179 aa, Heterodera glycines
  Coding regions on vcDNA: vcDNA=SeqID_85720; Strand=+; Position=1-540
GDAAEKFPLSAFTRPPPTKIVKADGDNDGTPAPPLIQTATIALQSLLRLLQQQKKVRVNALLVTQIGVNGPEYGEFACVNVRLEHGYGLRIEGRFARMTRNRRNRQIQPLCEKVCNAVVQLLKCDSAASATARIRRANCWARTACCWASGRLEDTECAGPCHSEAHSDEHGGGRELTEN

SEQ ID NO: 159298 - protein, 37 aa, Heterodera glycines
  Homolog annotation: Hit_ID=ZP_00357698.1; Match level="QueryCoverage =100%, HitCoverage=20%, E-value=3e-11, Identity=83%"; Hit description= hypothetical protein Chlo02002738 [Chloroflexus aurantiacus]
  Coding regions on vcDNA: vcDNA=SeqID_85721; Strand=+; Position=2-115
FFFFFFFFFLFFFFFFFFFFFFFFFFFKNLLFFSGFF

SEQ ID NO: 159299 - protein, 100 aa, Heterodera glycines
  Homolog annotation: Hit_ID=ZP_00362133.1; Match level="QueryCoverage =89%, HitCoverage=6%, E-value=8e-37, Identity=80%"; Hit description =COG0086: DNA-directed RNA polymerase, beta' subunit/160 kD subunit [Polaromonas sp. JS666]
  Coding regions on vcDNA: vcDNA=SeqID_85722; Strand=-; Position=2-301
VDSGMTPLKKFSIMSEDDYDAKRVEYGDEFIALMGPEGIKKLLEEMDLDIEIDRLRNDMTGSELKVKKNSKRLKVMEAFKKSGIKPNWMVPKKKKKKKKK

SEQ ID NO: 159300 - protein, 57 aa, Heterodera glycines
  Coding regions on vcDNA: vcDNA=SeqID_85723; Strand=-; Position=255-428
PHHSSSSSPVMPSSPKHFFLPSSPKHHFFEDEAEVKQSPPHHHSFSDWEKEEQKLHA

SEQ ID NO: 159301 - protein, 187 aa, Heterodera glycines
  Homolog annotation: Hit_ID=NP_033485.1; Match level="QueryCoverage =100%, HitCoverage=96%, E-value=1e-76, Identity=72%"; Hit description= ubiquitin-conjugating enzyme E2H [Mus musculus] gb|EAL24098.1| ubiquitin-conjugating enzyme E2H (UBC8 ho
  Gene Ontology: Mol. function=ubiquitin conjugating enzyme activity; Cellular component=cytoplasm; Biological process=protein modification
  Coding regions on vcDNA: vcDNA=SeqID_85724; Strand=+; Position=83-643
MSSPSAGKRRMDTDVLKLIESNHEVVITGGLNEFPVKFYGPKGTAYEGGVWRVRVDLPEKYPFKSPSIGFMNRIYHPNIDEASGTVCLDVINQSWTALYDLSNIFESFLPQLLTYPNPADPLNGEAASLYMHKPDEFKAKCMEYVRKYANKEALEALDKKTMKGTENEGDAGEESDDSTISDFYEDE

SEQ ID NO: 159302 - protein, 35 aa, Heterodera glycines
  Coding regions on vcDNA: vcDNA=SeqID_85725; Strand=-; Position=1-105
SFPFQLFVVTYSCHNHIYYPINKPIMQKKKKKKKK

SEQ ID NO: 159303 - protein, 72 aa, Heterodera glycines
  Coding regions on vcDNA: vcDNA=SeqID_85726; Strand=-; Position=3-221
MWRLISTEESKSAVRYTSLNPKSFGWTEKMRWRNSSCGRPGALCCCHREKKETEEQRERGGRNLPHCCVQSS

SEQ ID NO: 159304 - protein, 125 aa, Heterodera glycines
  Homolog annotation: Hit_ID=XP_308817.1; Match level="QueryCoverage =90%, HitCoverage=10%, E-value=7e-09, Identity=36%"; Hit description =ENSANGP00000021787 [Anopheles gambiae]
  Coding regions on vcDNA: vcDNA=SeqID_85727; Strand=-; Position=2-376
AGQSIEPETLIPITRFATRNTRVVLWGDHQQLGPVVKAHFFKAYKWCHLSLMERLMAPMRAEENFFRINGQKRVYTEGRTFCQLRDSYRGHPKIIHFSSVNFYDGTFRAVNEENRKKKKKKKKKK

SEQ ID NO: 159305 - protein, 105 aa, Heterodera glycines
  misc_feature (97)..(97): Xaa can be any naturally occurring amino acid
  Homolog annotation: Hit_ID=AAL31950.1; Match level="QueryCoverage =84%, HitCoverage=19%, E-value=1e-15, Identity=55%"; Hit description =CDH1-D [Gallus gallus]
  Coding regions on vcDNA: vcDNA=SeqID_85728; Strand=+; Position=39-352
IGSSLHTDRSRNTNRPRISRNGSVPGSDGRCVQRAGTYSERVDDSPLQGIPRSRTIIAMSDPNHGKFSPVYQPLSGKDKHADFASVARVQPRTSKGXHRPVIAQL

SEQ ID NO: 159306 - protein, 65 aa, Heterodera glycines
  Coding regions on vcDNA: vcDNA=SeqID_85729; Strand=+; Position=56-250
IPKFGVVFLSLHFLHLLLHFFNGRLCGGDEIGGRSEISRSLPRRLLLLHWRHNFQPMDRGKPNAR

SEQ ID NO: 159307 - protein, 116 aa, Heterodera glycines
  Coding regions on vcDNA: vcDNA=SeqID_85730; Strand=-; Position=2-349
HFQIYLFFPMASLKIPLYVIKGQLTFFLFCPNISRKLLTPQVKGAPLPFSQKLRFKAIACLYKGDYPFFTLIFPKSLAPFPIFKGIWFHFYSELTFFLKKKKKKKKNKKKKKKKKK

SEQ ID NO: 159308 - protein, 70 aa, Heterodera glycines
  Coding regions on vcDNA: vcDNA=SeqID_85731; Strand=-; Position=59-271
KKRSATPCPPFCFSPSVQFPSHFCSPFTGALWKWTQWPPKGRKRRRGDERQKESQSRPMGIWLLRHIDIL

SEQ ID NO: 159309 - protein, 167 aa, Heterodera glycines
  Homolog annotation: Hit_ID=CAC19674.1; Match level="QueryCoverage =79%, HitCoverage=19%, E-value=3e-09, Identity=31%"; Hit description =RalB-binding protein [Xenopus laevis]
  Coding regions on vcDNA: vcDNA=SeqID_85732; Strand=+; Position=1-501
GRNVQLVIQKESANKMNLPAMGALLHTILEMPRNVVKVFITNAALEECAESGGEPTTQLFDSVDIVPYLKPKSVVELQKNPPSEKNELENEIRKQQFLLEHLHGQVQQMREERLAERTAKEETMWEVQAAITMLKRRLKTLNEKGQRHDGREGEEGDGNVTGGTADG

SEQ ID NO: 159310 - protein, 70 aa, Heterodera glycines
  Coding regions on vcDNA: vcDNA=SeqID_85733; Strand=+; Position=80-292
NDSFKNDERIVKSEGNGGTDTTESPKAALVTEKQNRKDCDKTEKDSGSRQSNKLIAVSSVVHTVLLEPNQ

SEQ ID NO: 159311 - protein, 147 aa, Heterodera glycines
  Homolog annotation: Hit_ID=NP_493307.1; Match level="QueryCoverage =65%, HitCoverage=4%, E-value=5e-16, Identity=41%"; Hit description =cdc42 guanine nucleotide exchange factor zizimin 1 (1N773) [Caenorhabditis elegans] emb|CAB07369.1| Hypoth
  Coding regions on vcDNA: vcDNA=SeqID_85734; Strand=+; Position=1-444
RHHRLINCGYDKSVLKRVDVKQLQLFLQGAVMPTVNAGLLAYAETFTAPAQQKRYGNKGLLRLWNALKTLLDELDEAMRVNEATMGNERREYQQMLRNAYENTVEKLNRAFARGRESPAMDKRRSMSIDRAKRSSKQGMLIRPIFAL

SEQ ID NO: 159312 - protein, 188 aa, Heterodera glycines
  Homolog annotation: Hit_ID=CAG11319.1; Match level="QueryCoverage =99%, HitCoverage=31%, E-value=7e-50, Identity=51%"; Hit description =unnamed protein product [Tetraodon nigroviridis]
  Gene Ontology: Mol. function=glutamine-tRNA ligase activity; Cellular component=cytoplasm; Biological process=glutaminyl-tRNA aminoacylation
  Coding regions on vcDNA: vcDNA=SeqID_85735; Strand=+; Position=2-565
GVAQSSIDPAMFDASLRDHLNVTAPRTMAVLEPLRLRITNYRELGFIPAKSTLRVKQFPSSINESTDEWEISFDEFVYIEQADFREVAEKSYRRLTLEQPVGLRHVNLAVKIDKLERDEHGNPIELVVTANPVSSECKPKAFIHWVARPVLCEVRLYDKLFVHKNPEDPAEVPGGFLTDINPNSLHVL

SEQ ID NO: 159313 - protein, 193 aa, Heterodera glycines
  Homolog annotation: Hit_ID=CAE63785.1; Match level="QueryCoverage =92%, HitCoverage=32%, E-value=1e-57, Identity=58%"; Hit description =Hypothetical protein CBG08326 [Caenorhabditis briggsae]
  Gene Ontology: Mol. function=tRNA dihydrouridine synthase activity; Cellular component=mitochondrion; Biological process=tRNA modification
  Coding regions on vcDNA: vcDNA=SeqID_85736; Strand=+; Position=2-580
GRTLRGKKYLAPLTTVGNLPFRRLCVELGAEVTCGEMAIATHLLQGLPSELSLMKRHPSEKIFGVQLAGGYPDSLGKAVQLITDNFNVDFIDLNLGCPLDSVNEKGAGCSLANKSNKLVSVLQCMQKSATGVPVSVKMRYGVKEGERTAHYTMGTIAERSPPQLLTLHPRSREQRYTKAAEWDYVLECEQRIN

SEQ ID NO: 159314 - protein, 49 aa, Heterodera glycines
  Coding regions on vcDNA: vcDNA=SeqID_85737; Strand=+; Position=2-151
FFFFFFFFFFLFMGLLNRKLEEKNKPKFFIGNEKLEIFSPKIKSLINIV

SEQ ID NO: 159315 - protein, 65 aa, Heterodera glycines
  Coding regions on vcDNA: vcDNA=SeqID_85738; Strand=+; Position=179-373
PVKTEQKLIAYNWGDKAHDDGNYGTMKLLDLMFEIKLKRNSLRELTTQSFPLIKLSDFLRKFSLD

SEQ ID NO: 159316 - protein, 50 aa, Heterodera glycines
  Coding regions on vcDNA: vcDNA=SeqID_85739; Strand=-; Position=3-152
FKSFFVIILLKSKKCLAIHSFFCIFLLFAKSLLYFDKKCHFKKKKKKKKK

SEQ ID NO: 159317 - protein, 60 aa, Heterodera glycines
  Coding regions on vcDNA: vcDNA=SeqID_85740; Strand=+; Position=1-180
GELMRITGTYALNDQNRLLAVVPFLVRTNFNGARVVQRALISLVQCCIVRQVDSQPSMVT

SEQ ID NO: 159318 - protein, 82 aa, Heterodera glycines
  Coding regions on vcDNA: vcDNA=SeqID_85741; Strand=+; Position=3-248
FFFFFFFFTKTNTFISGTTKKARINITQFNSIQSHRIKLKIVGDRNTHIQKYRRVLSLHLELLFRDINKHPSPICNYREQEN

SEQ ID NO: 159319 - protein, 74 aa, Heterodera glycines
  Coding regions on vcDNA: vcDNA=SeqID_85742; Strand=+; Position=81-302
KAQVFFIKSGLQQFLNFLLNGLRFFGRRITLHHFAVFIDQKLGKVPFDRIKAEDAALDPLQIGVNRMLIGPVDV

SEQ ID NO: 159320 - protein, 182 aa, Heterodera glycines
  Homolog annotation: Hit_ID=CAE70753.1; Match level="QueryCoverage =97%, HitCoverage=34%, E-value=3e-24, Identity=32%"; Hit description =Hypothetical protein CBG17501 [Caenorhabditis briggsae]
  Gene Ontology: Cellular component=mitochondrion
  Coding regions on vcDNA: vcDNA=SeqID_85743; Strand=+; Position=1-546
GAGFIPNWQHLQRVLALFALPCMGLILFLSESPRFLISARKMKEAKEAIIRMHKFDGRPYDEKALDALLEKELQQMLELSVTKKKYNYLHLFYNTKFTMYTLSVSFSLFVVTLITYALVYNIEKMSGNIFLNMIWMGMFKYTMNLAIAFADLKFKWLGRKLPHLLSEVLVLAALGLFVTLRL

SEQ ID NO: 159321 - protein, 103 aa, Heterodera glycines
  Coding regions on vcDNA: vcDNA=SeqID_85744; Strand=-; Position=72-383
HDIIEQMLEEEEFEQCLQKGAILCTELSKCTPSADEGQRVGGDQRKMAFQCRQEELARQKQWRRKDQQREDLSARVGTLIPIVNNSCPVSISNGEEAMSKDCY

SEQ ID NO: 159322 - protein, 38 aa, Heterodera glycines
  Coding regions on vcDNA: vcDNA=SeqID_85745; Strand=+; Position=1-114
FFFFFFFFLHAPFLTFCVKNLWMAKQKKWGKKRSKVRA

SEQ ID NO: 159323 - protein, 117 aa, Heterodera glycines
  Coding regions on vcDNA: vcDNA=SeqID_85746; Strand=+; Position=117-470
QQQHQPVAAAPMHLVNESVKQYIAQQLEQTQLMTTSKKKQQVVQQQKQMVEKNNDEGPFLIHQQNWMTERRPVSPSSSSSALSVHQPLFTFRHSVGSSQAVRRDIRIGTLFSAFDQK

SEQ ID NO: 159324 - protein, 137 aa, Heterodera glycines
  Homolog annotation: Hit_ID=CAE70297.1; Match level="QueryCoverage =90%, HitCoverage=8%, E-value=1e-12, Identity=29%"; Hit description =Hypothetical protein CBG16818 [Caenorhabditis briggsae]
  Coding regions on vcDNA: vcDNA=SeqID_85747; Strand=-; Position=73-486
VRFVSIGHCRPWLIRTREGQGFVPNPWLFPSGRVNWKVLRWMLEGVLSVVFHRSGLTQQELVSHFAPVLQPVLTLELVQILSKLGCLSQFEKILTEARKSDPFLRFGKAKPVRFVKTNIDGLERFVLFTEFKLKSFL

SEQ ID NO: 159325 - protein, 154 aa, Heterodera glycines
  Homolog annotation: Hit_ID=CAE62925.1; Match level="QueryCoverage =96%, HitCoverage=36%, E-value=1e-51, Identity=68%"; Hit description =Hypothetical protein CBG07125 [Caenorhabditis briggsae]
  Gene Ontology: Mol. function=acyl-CoA dehydrogenase activity; Cellular component=mitochondrion; Biological process=lipid metabolism
  Coding regions on vcDNA: vcDNA=SeqID_85748; Strand=+; Position=8-469
MTPDMPGFQLGKDENKLGWCTQPTRILTFEDVKVPVTNQVGADDEGFTIAMEGLNGGRVNIAACSLGAAQMSMDLAIEHTKVRQAFGKSISQFQWTQFKLAEMATKLVTSRLLLREACHHLQEDTPNASAMSAMAKMYITDEAFTVVNQALQMF

SEQ ID NO: 159326 - protein, 67 aa, Heterodera glycines
  Coding regions on vcDNA: vcDNA=SeqID_85749; Strand=-; Position=2-202
RFDFFRASQIPLIVPISQFSFQLHLTSFCPPQLMCVGMSCFSSCFVIFSLQFIKLCILQKKKTKKKP

SEQ ID NO: 159327 - protein, 55 aa, Heterodera glycines
  Coding regions on vcDNA: vcDNA=SeqID_85750; Strand=+; Position=2-169
FFFFFFFFFFGKINLSSFLDRNGTVKISYSSLKIPEKFNYLTTVDAKICCLISGI

SEQ ID NO: 159328 - protein, 23 aa, Heterodera glycines
  Coding regions on vcDNA: vcDNA=SeqID_85751; Strand=+; Position=1-72
FFFFFFFFFFGGLDLSKKIQNNK

SEQ ID NO: 159329 - protein, 32 aa, Heterodera glycines
  Coding regions on vcDNA: vcDNA=SeqID_85752; Strand=-; Position=2-97
IHLSCLSALIVYINNIVCMINRDSKKKKKKKK

SEQ ID NO: 159330 - protein, 158 aa, Heterodera glycines
  Coding regions on vcDNA: vcDNA=SeqID_85753; Strand=+; Position=1-474
GAKFRTLFAYFEDARKLYETRMKNASNGNNEADCRIKNLEKELKVLKRQLSALGDLLDQFLDTSLAMRERTLRMEGELGPRLERLEAQNVQLRANLAAMGQQTHKSGDNEQRNEAEQTIETIHFDELSISDGVPLQQNVQQQPQPPNVSNCPVNDEGG

SEQ ID NO: 159331 - protein, 102 aa, Heterodera glycines
  Coding regions on vcDNA: vcDNA=SeqID_85754; Strand=+; Position=30-338
HFNVFNTHLNKLGMECGIFVHNDNRSPITFGPSDQSGRPLSSLSLPPFRCRLGCPGAGRASVRCTGAPAASARASRARAALRAHSPAKCWPTPPICALCPPS

SEQ ID NO: 159332 - protein, 55 aa, Heterodera glycines
  Coding regions on vcDNA: vcDNA=SeqID_85755; Strand=+; Position=59-223
TKRRHTHERLRMGLAVIHGEEKGVQEDGRQSAPPSPTDKRKGVSYQLFPSQVAKE

SEQ ID NO: 159333 - protein, 73 aa, Heterodera glycines
  Coding regions on vcDNA: vcDNA=SeqID_85756; Strand=-; Position=147-368
FPRQKELPIPTKSLTASKKVRLIRRETNDWRLGEWQIDNLHKENIKFRVVLYIYNDAETGEEAITQFSMDRVH

SEQ ID NO: 159334 - protein, 175 aa, Heterodera glycines
  Coding regions on vcDNA: vcDNA=SeqID_85757; Strand=+; Position=3-530
ESIRRKKLSKRDRQVNRQNLPQIRKVIQFQLTIRSLKVVFVSRLKVVSSKIAFHRHQSVAHRRLPHNQQRKKAKKSLLVWPALLPTVFRLGNSFAMRQPLGRVLSPLSPQSKRSKKMITLKLSNRKSKSHRKRRSTSRDFACQQSSLAATRERTPKRNELLPQTTHSSHFCTKKR

SEQ ID NO: 159335 - protein, 78 aa, Heterodera glycines
  Homolog annotation: Hit_ID=AAP30762.1; Match level="QueryCoverage =100%, HitCoverage=71%, E-value=7e-44, Identity=100%"; Hit description=putative gland protein G7E05 [Heterodera glycines]
  Coding regions on vcDNA: vcDNA=SeqID_85758; Strand=+; Position=45-278
MYKFLFFPHFCILIKAISGLHCWNSNMILLSEMPEKGSVTVHQCPSGHQCVTANCWLGVGNYIVQKCVPDQPGARNYC

SEQ ID NO: 159336 - protein, 111 aa, Heterodera glycines
  Coding regions on vcDNA: vcDNA=SeqID_85759; Strand=-; Position=43-378
HSKHIGIPPVARLLVRVRRVLPVRLSLWLYQGPSAAVRAFEARLFVLLGPSANLWRSQLVREAYPQSASRDERIGQNEEDVLIEQIMYHCVMSRMILCCDSYIMCYVLYVE

SEQ ID NO: 159337 - protein, 156 aa, Heterodera glycines
  Coding regions on vcDNA: vcDNA=SeqID_85760; Strand=-; Position=1-468
TKHEGNGGGGGANVRKVMEENSVLFWSQMRSMGLLDDLLNTLSTTLERLKHIYLNGGNAVSEEFAARRLSGVALALDLCTLFSDKIHNRCIQATLETNLIPKELLELQRKQEEQKRKLESAKRKSQMFELLKNGNASGEGRSADSPPEMKKKKKKK

SEQ ID NO: 159338 - protein, 146 aa, Heterodera glycines
  misc_feature (44)..(44): Xaa can be any naturally occurring amino acid
  Homolog annotation: Hit_ID=AAF76925.1; Match level="QueryCoverage =96%, HitCoverage=100%, E-value=2e-44, Identity=56%"; Hit description= hypothetical esophageal gland cell secretory protein 11 [Heterodera glycines]
  Coding regions on vcDNA: vcDNA=SeqID_85761; Strand=+; Position=32-473
MLIKPLFTFSILLAFFGQIFCDILGREQSAGAKGLLTCEGKPAXNVKVKLYDDDRGIDADDLMGETKTNDKGYFEVTGYTSEYSTIDPKINIYHNCADGYKPCDRKFTIKIKDGYVSSGKNPSKLYDIGRIELEGGFSGESRDCLN

SEQ ID NO: 159339 - protein, 169 aa, Heterodera glycines
  Homolog annotation: Hit_ID=NP_504291.1; Match level="QueryCoverage =99%, HitCoverage=25%, E-value=1e-74, Identity=80%"; Hit description =heat shock protein (70.8 kD) (hsp-6) [Caenorhabditis elegans] gb|AAB42371.1| Heat shock protein protein 6
  Gene Ontology: Mol. function=enzyme regulator activity; Cellular component=mitochondrion; Biological process=mitochondrial translocation
  Coding regions on vcDNA: vcDNA=SeqID_85762; Strand=+; Position=2-508
GDVTPLSLGIETLGGVFTKLITRNTTIPTKKSQVFSTAADGQTQVEIKVFQGERDMALDNKMLGQFSLVGIPPAPRGVPQIEVAFDIDANGIVNVSARDRGTGKEQQIIIQSSGGLNKDQIENMVREAERHAAADAEKKETIEAINHAESVLHDTESKITEYAEHLNAD

SEQ ID NO: 159340 - protein, 132 aa, Heterodera glycines
  Homolog annotation: Hit_ID=AAC41377.1; Match level="QueryCoverage =87%, HitCoverage=2%, E-value=1e-09, Identity=34%"; Hit description =MLL [Takifugu rubripes]
  Coding regions on vcDNA: vcDNA=SeqID_85763; Strand=+; Position=84-479
MPRALINRQPPVISASTKKTGRKRMSASSSAFVPEDEEDAPAAYRLPSNAMGDARGQKRKRSVSSSSSSSSVSSSDSSSSSGSSSSSSASSHTPLKNAKPNASEHPSKRTPNEREKSNDMSGSGGTTISCST

SEQ ID NO: 159341 - protein, 87 aa, Heterodera glycines
  Coding regions on vcDNA: vcDNA=SeqID_85764; Strand=-; Position=91-354
MSAMVGGGEEKTFEAFLKGLDEKKGRKLMKKIMKTEVSDGSDIEKAKKQRRKQKKEEKLKAAKKHKHRRSSSRETSRKRKEGKPPPH

SEQ ID NO: 159342 - protein, 69 aa, Heterodera glycines
  Homolog annotation: Hit_ID=AAH80142.1; Match level="QueryCoverage =98%, HitCoverage=16%, E-value=9e-09, Identity=40%"; Hit description =MGC89709 protein [Xenopus tropicalis] ref|NP_001007877.1| MGC89709 protein [Xenopus tropicalis]
  Coding regions on vcDNA: vcDNA=SeqID_85765; Strand=+; Position=1-207
GYFVLELVHIVWDFGGRLFVLRFLLPFLLAFGSLLFLFFLPGAHSSYVRHSQKKLLWCFYWLGLGVLSS

SEQ ID NO: 159343 - protein, 71 aa, Heterodera glycines
  Coding regions on vcDNA: vcDNA=SeqID_85766; Strand=-; Position=162-377
LQRISQTEALTIKDLAFLTLLTSSVFVFNEGRKYFHLRRQRIKQQFQGEGAQFASVDSQQKFKRANGGSRR

SEQ ID NO: 159344 - protein, 94 aa, Heterodera glycines
  Coding regions on vcDNA: vcDNA=SeqID_85767; Strand=-; Position=1-282
AAVVCNKNVVRKGMNYVNAYQTEVSSAAEWDSGQLYDELLLFTTPPTSIPERDDDDELPLRVMKLEVQTCNKNNANNFMPSNPSGPKKKKKKKK

SEQ ID NO: 159345 - protein, 57 aa, Heterodera glycines
  Coding regions on vcDNA: vcDNA=SeqID_85768; Strand=+; Position=109-282
KHPVSAVLWTFKRVRAVSDHSLLRSVRVFAVPPSVLLILRTALAQLQIFRQNAFPYE

SEQ ID NO: 159346 - protein, 90 aa, Heterodera glycines
  Coding regions on vcDNA: vcDNA=SeqID_85769; Strand=+; Position=96-365
PIKQSNHCVRSIILLPLTPGLFLGFFSSLCRFLFWWLGLRFHRSPPPKSAVLVLRVFRHRLFWSNLLIVHPLHVPPALADVQIDRNAAQF

SEQ ID NO: 159347 - protein, 39 aa, Heterodera glycines
  Coding regions on vcDNA: vcDNA=SeqID_85770; Strand=-; Position=1-117
FSNLTVCLVITFHFSLSFFFNFKGLKLSPLKKKKKKKKK

SEQ ID NO: 159348 - protein, 143 aa, Heterodera glycines
  Homolog annotation: Hit_ID=NP_499819.1; Match level="QueryCoverage =88%, HitCoverage=4%, E-value=1e-36, Identity=59%"; Hit description =myeloid lymphoid mixed-lineage like (3O745) [Caenorhabditis elegans] emb|CAB05024.1| Hypothetical protein
  Gene Ontology: Mol. function=transcription factor activity; Cellular component=nucleus; Biological process=embryogenesis and morphogenesis
  Coding regions on vcDNA: vcDNA=SeqID_85771; Strand=+; Position=182-610
MLRAYRASGISERMLFQMPYLRSNDMAQLVVQYREMKRECKSNVYLARSKIQGMGLYAKRDLDMNQMIIEYIGELIRNEICEIRQSRYIEQNRGEYMFRIDCDWVVDATMAGGLARYINHSCDPNCGTKILPVNDEKKAHLRL

SEQ ID NO: 159349 - protein, 188 aa, Heterodera glycines
  Homolog annotation: Hit_ID=AAP30770.1; Match level="QueryCoverage =100%, HitCoverage=72%, E-value=8e-30, Identity=41%"; Hit description= putative gland protein G17G01 [Heterodera glycines]
  Coding regions on vcDNA: vcDNA=SeqID_85772; Strand=+; Position=46-609
MRKFAYFKLCQAVLTSVFLWQILSTHQFCGEFGEPTAFFNSAVSSSHCEQFTLIGMDSTTGEYGAMPDKQKWHMQLMASSGSGQPIDEQQQNHMDEFSSKLPTVGRHCIPIAFSLVKPWVRDNKSHLQKVADLFAIQLLCGLLSLFVIAMHVLDQPRSWGYESIDYERTTFCAVLWCCPALVSSVLLL

SEQ ID NO: 159350 - protein, 62 aa, Heterodera glycines
  Coding regions on vcDNA: vcDNA=SeqID_85773; Strand=-; Position=175-363
ATKSIRKIMEKYPGAYKRKSNYDFLLQFLWMNVKLDCLVGKGSGLLKYRTTARREERQQKED

SEQ ID NO: 159351 - protein, 38 aa, Heterodera glycines
  Coding regions on vcDNA: vcDNA=SeqID_85774; Strand=-; Position=2-115
YQQQTHCLCFVVFYFVCFQFIYFLEKNWFKKKKKKKKK

SEQ ID NO: 159352 - protein, 130 aa, Heterodera glycines
  Coding regions on vcDNA: vcDNA=SeqID_85775; Strand=+; Position=2-391
GKFETLLINQSLIFVKMLPIFRSGNTDGFSLISAPFLLGLLSAALLLVAQTAALQTDPSASDIDYEIVLPVASLPSLDSPRGTTLNWQDEWVRRFSPRLVVVQNGGWKHRTLPRNDDDAHQRIVLHKKWS

SEQ ID NO: 159353 - protein, 50 aa, Heterodera glycines
  Coding regions on vcDNA: vcDNA=SeqID_85776; Strand=-; Position=2-151
TQLLIMIMILTPPSITPLIFTLYFFFGLNIITGRQKKTIIPKKKKKKKKK

SEQ ID NO: 159354 - protein, 139 aa, Heterodera glycines
  Homolog annotation: Hit_ID=NP_499260.1; Match level="QueryCoverage =98%, HitCoverage=7%, E-value=2e-34, Identity=54%"; Hit description =clathrin heavy (3L297) [Caenorhabditis elegans] emb|CAA83003.1| Hypothetical protein T20G5.1 [Caenorhabdit
  Gene Ontology: Mol. function=structural molecule activity; Cellular component=clathrin coat; Biological process=intracellular protein transport
  Coding regions on vcDNA: vcDNA=SeqID_85777; Strand=+; Position=1-420
GYAAESRQPEIVEDLMQYFLSQGLKDCFSTLLYKCYEFLRPDVVLELAWRNNLVDYAMPFMIQTVRDYGSRLDRLERAEMERKEEVKEQQQRSGSLIEPQLMLTAYSTAATTPNATAYPTGGIGTIPPAQGFPSYPFYK

SEQ ID NO: 159355 - protein, 89 aa, Heterodera glycines
  Homolog annotation: Hit_ID=NP_492582.1; Match level="QueryCoverage =100%, HitCoverage=20%, E-value=4e-20, Identity=47%"; Hit description= zinc metalloproteinase (50.7 kD) (1K288) [Caenorhabditis elegans] emb|CAB03839.1| Hypothetical protein C
  Gene Ontology: Mol. function=metalloexopeptidase activity; Cellular component=membrane fraction; Biological process=proteolysis and peptidolysis
  Coding regions on vcDNA: vcDNA=SeqID_85778; Strand=-; Position=133-402
LIGLLIIGRFVMAPYTELLSVLMNVITRKCEFSADRFSAQLGHASQLCSGLKKMCKDNLSLPIDDVLYSWCNHSHPPILERIEALKKYE

SEQ ID NO: 159356 - protein, 122 aa, Heterodera glycines
  Coding regions on vcDNA: vcDNA=SeqID_85779; Strand=+; Position=39-407
AFTQTKKPNNISIFLIFPYSSIYSSNPSTSFILLRLLLTRGLVKHCCCFVHAQTQHFLVSKQQHNLGIFHLEKHSRDFADFLDITIPEATRNHRVQTLTKHLLLCGYVSLGKQLCVQRLLVC

SEQ ID NO: 159357 - protein, 103 aa, Heterodera glycines
  Coding regions on vcDNA: vcDNA=SeqID_85780; Strand=-; Position=97-408
HIRVMRMRCSLCDAGAFFCSDMRVHLMYRHCDKLNLAPDDFISPGTPCMSREKADLLTQLVDPYHPGRVMYTTGKIVSWANPKAYFPDPKSERNILGPALPGY

SEQ ID NO: 159358 - protein, 50 aa, Heterodera glycines
  Coding regions on vcDNA: vcDNA=SeqID_85781; Strand=+; Position=140-289
KGKFSNIKIHMIKKGASNGLTISQSVWRRQTEGIIIKAIQMGVLSQPFVD

SEQ ID NO: 159359 - protein, 102 aa, Heterodera glycines
  Coding regions on vcDNA: vcDNA=SeqID_85782; Strand=-; Position=68-376
DFATGPTKKFCEICRSWIDLFEDKIQVEKLMMHKRCFVCAICDCPLEPGNCSRDDGIIYCQFMCNDRVPVRFCSAHMMLGSGEKCQLLKEKWMKENEEKQEI

SEQ ID NO: 159360 - protein, 108 aa, Heterodera glycines
  Homolog annotation: Hit_ID=XP_395383.1; Match level="QueryCoverage =51%, HitCoverage=10%, E-value=5e-12, Identity=62%"; Hit description =similar to ENSANGP00000004283 [Apis mellifera]
  Gene Ontology: Biological process=regulation of protein activity, epigenetic
  Coding regions on vcDNA: vcDNA=SeqID_85783; Strand=+; Position=3-329
ERDSGGGGTTASSAGGGAANAKATGAEQQQLPHAQHPLDAVATDDVLRYVLESYNALSWLSLDPVTGARRSCLPVHMQAIQRLNLAVNTFWGSAEQNQQHQQQQQQPK

SEQ ID NO: 159361 - protein, 89 aa, Heterodera glycines
  misc_feature (50)..(50): Xaa can be any naturally occurring amino acid
  Homolog annotation: Hit_ID=NP_001003835.1; Match level="QueryCoverage= 77%, HitCoverage=5%, E-value=3e-13, Identity=50%"; Hit description =TATA box binding protein (TBP)-associated factor 150kDa [Danio rerio] gb|AAT68099.1| TATA box binding p
  Coding regions on vcDNA: vcDNA=SeqID_85784; Strand=-; Position=2-268
LSSLKLRFYETIPNSDDDSLKTLCYQLLVPTSAANIGFAIGDFQIHVQPXRPGGYNFVVPELIPLLKHTMKSLNRIFVFFEELLSCRFP

SEQ ID NO: 159362 - protein, 62 aa, Heterodera glycines
  Coding regions on vcDNA: vcDNA=SeqID_85785; Strand=+; Position=83-268
KAQVFFIKSGLQQFLNFLLNVLRFFGRRITLHHFAVFIDQKPGKVPFDRIKAQDAPLDPLQI

SEQ ID NO: 159363 - protein, 159 aa, Heterodera glycines
  Homolog annotation: Hit_ID=NP_741092.1; Match level="QueryCoverage =99%, HitCoverage=77%, E-value=2e-59, Identity=72%"; Hit description =RAB family member (22.6 kD) (rab-18) [Caenorhabditis elegans] gb|AAM44401.1| Rab family protein 18, isofo
  Gene Ontology: Mol. function=RAB small monomeric GTPase activity; Cellular component=endoplasmic reticulum membrane; Biological process=Golgi to plasma membrane transport
  Coding regions on vcDNA: vcDNA=SeqID_85786; Strand=+; Position=61-537
MDTGDNFLTTLKILTIGESGVGKSSLIARFVDDKFDPDMAATIGVDFRVRSISIDDRIVKLAIWITAGQERFRTLTPSYYRGGQGVILVYDVSNRPSFENLDHWLLEVDTYCTKSDTVKMLVGNKIDAERRMVSREEGLQSAKKHRMLFIEASAKTREG

SEQ ID NO: 159364 - protein, 98 aa, Heterodera glycines
  Coding regions on vcDNA: vcDNA=SeqID_85787; Strand=-; Position=36-332
THKESSVIKVLSNEKIVSSKRWVLAQIVQVGRWCNHVQMVGPRCRGHVGVEQVRLTTVLQWGDQHVLHVERICTGAAHLFDRSARLGRRSVAFWRIWR

SEQ ID NO: 159365 - protein, 123 aa, Heterodera glycines
  Homolog annotation: Hit_ID=CAE72788.1; Match level="QueryCoverage =91%, HitCoverage=22%, E-value=3e-35, Identity=62%"; Hit description =Hypothetical protein CBG20050 [Caenorhabditis briggsae]
  Gene Ontology: Mol. function=cystine/glutamate antiporter activity; Cellular component=integral to membrane; Biological process=protein complex assembly
  Coding regions on vcDNA: vcDNA=SeqID_85788; Strand=+; Position=3-374
DLAFGDNALTLINYIAISYWLAIGLAIASLFYFRMKMPNAPRPIKVNLIFPAIFLLGCVALVVIPLVGKPKDTAIGIAIMLTSVPVYLVFICWKERPSFFNKASASITIFCQKLFLVSNEAEK

SEQ ID NO: 159366 - protein, 181 aa, Heterodera glycines
  Homolog annotation: Hit_ID=NP_506245.1; Match level="QueryCoverage =97%, HitCoverage=78%, E-value=6e-28, Identity=40%"; Hit description =signal recognition particle receptor (5N446) [Caenorhabditis elegans] emb|CAB01443.1| Hypothetical protei
  Gene Ontology: Mol. function=signal recognition particle binding; Cellular component=integral to endoplasmic reticulum membrane; Biological process=protein-ER targeting
  Coding regions on vcDNA: vcDNA=SeqID_85789; Strand=+; Position=1-546
GGLSGSGKTTLFTKLINSKNCWDSFISLKENQFDSYATDNGQTLTLLDFPGSDSFKKTLCRKRLNEKRNSLKGVVFVLDSATFSKKDAAELLYDVLFESGNAVPVLIACNKQDIGHAKSHSLIKKALENEFGLINVSREAALSSISGESEKRILTKSGREFAWSELKNKKIDFFGVHHAKR

SEQ ID NO: 159367 - protein, 42 aa, Heterodera glycines
  Coding regions on vcDNA: vcDNA=SeqID_85790; Strand=-; Position=1-126
CVTGSNNNYPCRCKFTHPNLQCAGNFAGFGLGKPKKKKKKKK

SEQ ID NO: 159368 - protein, 102 aa, Heterodera glycines
  Coding regions on vcDNA: vcDNA=SeqID_85791; Strand=+; Position=2-310
GEVDKFQSSQSLTGKRTHKFTLWVDKYAPSTFLDLLTKDETNRIVLLWLRLWDECVFEKRGGKKWEGNHRRISQRNNANATSLWDNLEERDRTLRNVTVKGH

SEQ ID NO: 159369 - protein, 155 aa, Heterodera glycines
  Homolog annotation: Hit_ID=XP_220829.2; Match level="QueryCoverage =57%, HitCoverage=13%, E-value=2e-09, Identity=35%"; Hit description =similar to hypothetical protein FLJ20315 [Rattus norvegicus]
  Coding regions on vcDNA: vcDNA=SeqID_85792; Strand=+; Position=2-469
GVSTPFIIPIFSLTKHLNNFWKPKHSFIHSSFIMARPRGSGRDPFKARSARARRRAGNKRKAAAGTAANVQAANRRPICLICLKKMTQVRQVRTICDHVFHYVCFHRWLKYRLFCPVCLLNFRTELYHSGNAVFEGAYDDGHVVLIPDGEQSNSG

SEQ ID NO: 159370 - protein, 130 aa, Heterodera glycines
  Homolog annotation: Hit_ID=AAB05072.1; Match level="QueryCoverage =100%, HitCoverage=23%, E-value=2e-56, Identity=84%"; Hit description= CCT-1 pir||JC4083 chaperonin - Caenorhabditis elegans sp|P41988|TCPA _CAEEL T-complex protein 1, alpha sub
  Gene Ontology: Mol. function=chaperone activity; Cellular component =actin filament; Biological process=protein folding
  Coding regions on vcDNA: vcDNA=SeqID_85793; Strand=+; Position=80-469
MASPGDALLALQGKRTTGQSIRTQNVMTAVAIANVVKSSLGPVGLDKMLVDDVGDVTVTNDGATILKLLEVEHPAGKILVDLAQLQDEEVGDGTTTVVIIAAELLKAADELVRKKIHPTNIINGYRLACK

SEQ ID NO: 159371 - protein, 118 aa, Heterodera glycines
  Coding regions on vcDNA: vcDNA=SeqID_85794; Strand=+; Position=1-357
GDGANSFLTRFGWSILDYQATELFDFALQLANPNSPTLLSKSHYYAKVRLQYAQLLDELGGFKHAVELYRLENSNYSKTPSPPPLVPSVHKTKLAHLKRQDHEPTPAVAPAPPTFLPV

SEQ ID NO: 159372 - protein, 139 aa, Heterodera glycines
  Homolog annotation: Hit_ID=S74181; Match level="QueryCoverage=82%, HitCoverage=82%, E-value=3e-22, Identity=46%"; Hit description=tumor antigen UK114 - goat
  Gene Ontology: Cellular component=cytoplasm; Biological process =regulation of translational termination
  Coding regions on vcDNA: vcDNA=SeqID_85795; Strand=+; Position=56-475
NHHSPNGCSLHSSHHHVQGASCDGHSQAVLLNNQTLYISGQTGIAAGSTNVVPGGARAEAKQAMTNIGEILTYAGSSFKHVINCNIMVADMSDFQAVNETIKNFFTEDTYPARSFFQVVKLPKSAYVMIDVVAIVQGQS

SEQ ID NO: 159373 - protein, 49 aa, Heterodera glycines
  Homolog annotation: Hit_ID=ZP_00357698.1; Match level="QueryCoverage =79%, HitCoverage=22%, E-value=2e-12, Identity=79%"; Hit description =hypothetical protein Chlo02002738 [Chloroflexus aurantiacus]
  Coding regions on vcDNA: vcDNA=SeqID_85796; Strand=+; Position=6-155
FFFFFFFLFFFFFFFFFFFFFFFFFFFFFKQNFFKWEIFPWAQKNPKSF

SEQ ID NO: 159374 - protein, 126 aa, Heterodera glycines
  Coding regions on vcDNA: vcDNA=SeqID_85797; Strand=-; Position=1-378
GAPPGWAPPPPSQQKVRLLSASTGASQLSLHSREQFPILSGASSSTAQQQQNNIWGQKATIDLFKNKPEQLRTKKEEPKRSKVIPPPDIWPEGMQEQLKARELGLPDPHPIVPPHWLNPPKKKKKK

SEQ ID NO: 159375 - protein, 79 aa, Heterodera glycines
  Coding regions on vcDNA: vcDNA=SeqID_85798; Strand=-; Position=131-370
SLPGEVLDQIPAPPGFERLPDDVKNRVKQINRQTNKAWAVKQKELQEYVKTLPQEQRAILMMGPMGGPPPPPPSFGRRR

SEQ ID NO: 159376 - protein, 112 aa, Heterodera glycines
  Coding regions on vcDNA: vcDNA=SeqID_85799; Strand=-; Position=281-619
QEGESRPYSPSSPSSSSSLSFSSLSSSSSFSSSSSSSSSSSAFPCASPPCCWASSSLSSFISPNSICARASLASCHRANVLCQMRDTAVENNLPSSLPSSFWWSSKVPNWCS

SEQ ID NO: 159377 - protein, 58 aa, Heterodera glycines; identical to SEQ ID NO: 159209
  Coding regions on vcDNA: vcDNA=SeqID_85800; Strand=-; Position=1-174

SEQ ID NO: 159378 - protein, 120 aa, Heterodera glycines
  Coding regions on vcDNA: vcDNA=SeqID_85801; Strand=+; Position=3-362
FFFFFFFFHFSAIYFYFNVINFDNDAGNKCTILLFVVSQLYCICCLFHFLLLLSDASHLLRFSQIMRLQKKSELVHFSFFGGKCGHQTEQSLLRVQLQLALLSVRNIPLIKMRNFPTFAQ

SEQ ID NO: 159379 - protein, 130 aa, Heterodera glycines
  Homolog annotation: Hit_ID=AAS38609.1; Match level="QueryCoverage =100%, HitCoverage=15%, E-value=1e-09, Identity=28%"; Hit description= hypothetical protein [Dictyostelium discoideum]
  Coding regions on vcDNA: vcDNA=SeqID_85802; Strand=-; Position=1-390
KKYGREADREREESQWKKYGREVAREREKGEVKTAQKETKEQQGEKQTEKMINKTEKPKEKMEQFTGEEQFGMDVWKKIKQFFEMKQHKENGKGDEKTKQYSAENKKGWREMGNGKETKQNRKKKKKKKK

SEQ ID NO: 159380 - protein, 62 aa, Heterodera glycines
  Coding regions on vcDNA: vcDNA=SeqID_85803; Strand=+; Position=142-330
ISRQMKKIVCVPCHSFHYPSVSGRRSMLLPLAAAVPLLFVRIAGPRGFVANARHPISGRVVQ

SEQ ID NO: 159381 - protein, 85 aa, Heterodera glycines
  Coding regions on vcDNA: vcDNA=SeqID_85804; Strand=+; Position=2-259
FFFFFFFFEKNNIFVPQNLTKSNVAFNKQIQFENELMIALLQYISELEQNYSLQFDNLSSYCSPSPGFAFASSASKRALIAFLLR

SEQ ID NO: 159382 - protein, 221 aa, Heterodera glycines
  misc_feature (3)..(3): Xaa can be any naturally occurring amino acid
  Homolog annotation: Hit_ID=NP_498913.2; Match level="QueryCoverage =90%, HitCoverage=15%, E-value=6e-67, Identity=60%"; Hit description =adenylyl Cyclase Homolog, flightless I homolog, related to gelsolin actin-binding proteins and leucine-ri
  Gene Ontology: Mol. function=actin binding; Biological process=muscle contraction
  Coding regions on vcDNA: vcDNA=SeqID_85805; Strand=-; Position=1-663
VNXRNHLGASCRTIREEMNEETDEFLEMFSEEIVYYDGARTQSGFYAVEKVAFSNKLYRAFVNGPSVEMEAVPLNAESLDPRFVFLLDCDKVIWIWSGARSKVTIANKVRLFAVKMNKRDKKGKAEIESCNQLKTPEEFWLALTGSSKRPDEPIFEHILEDRKPERKRLYEVQLGMGFLELPQVELRNGVLHKELLKPKGVITSEFAAACRSTIWRAPNAW

SEQ ID NO: 159383 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_85806; Strand=+; Position=53-469

SEQ ID NO: 159384 - protein, 205 aa, Heterodera glycines
  Homolog annotation: Hit_ID=NP_083296.2; Match level="QueryCoverage =99%, HitCoverage=28%, E-value=6e-42, Identity=44%"; Hit description =ATP-binding cassette, sub-family B (MDR/TAP), member 8 [Mus musculus] gb|AAH15301.1| RIKEN cDNA 4833412N0
  Gene Ontology: Mol. function=ATP-binding cassette (ABC) transporter activity; Cellular component=mitochondrial membrane; Biological process=transport
  Coding regions on vcDNA: vcDNA=SeqID_85807; Strand=+; Position=2-616
GFQSQSQSALAAGVSGEALQNIRTVKVFAMEEAETELYRKEVQTACSLGERLGVGIGLFQALSNFFLNGIVLGVLYGGGQLVADQQLSAGDLMSFMATAQIIQRSVSQFSLIFGNGIKAWTSCARILQFLRIDPNCHNHLNGNEQIPRHSLIGDIHLHNICFSYPTRPEKAVLNGIDLHFAGGQTTAICGPSGAGKSTIAALVER

SEQ ID NO: 159385 - protein, 181 aa, Heterodera glycines
  Homolog annotation: Hit_ID=AAH80337.1; Match level="QueryCoverage =95%, HitCoverage=44%, E-value=7e-49, Identity=53%"; Hit description =MGC79578 protein [Xenopus tropicalis] ref|NP_001008439.1| MGC79578 protein [Xenopus tropicalis]
  Gene Ontology: Biological process=cell cycle
  Coding regions on vcDNA: vcDNA=SeqID_85808; Strand=+; Position=1-543
GKPTKSFKNAEVTDRIGKFAKTYGTTPVENMLSHQVERFKTVGEKQIIQNPSDEQKSKVEKCSFENFEVYSIDILISTGEGKVKTHDARTTVFKKADDIVYSLKLKASRAFLYEAQRRFGVMPFSLRQFEDEKMAKVGSTECSKHDLMQPYQVFYEREGEVVAQFKCTAIIMPSGIFKITG

SEQ ID NO: 159386 - protein, 117 aa, Heterodera glycines
  misc_feature (23)..(23): Xaa can be any naturally occurring amino acid
  Homolog annotation: Hit_ID=AAH76547.1; Match level="QueryCoverage =96%, HitCoverage=41%, E-value=9e-20, Identity=39%"; Hit description =Unknown (protein for IMAGE:7042040) [Danio rerio]
  Gene Ontology: Mol. function=electron transporter activity; Biological process=tetrahydrobiopterin biosynthesis
  Coding regions on vcDNA: vcDNA=SeqID_85809; Strand=+; Position=2-356
RLFIVNITSLLSVKAFPSFTQYXLAQAAREAYFRAFAVEHPKCRVLNYAPGPVDTEMHAEVKEKTYDSSVREVFANRRHDANLHRKLLKPEETVRRLIQMIVEDQFESGARVDYFDF

SEQ ID NO: 159387 - protein, 183 aa, Heterodera glycines
  Coding regions on vcDNA: vcDNA=SeqID_85810; Strand=-; Position=1-549
QWEPLAGQNHNAGQREQRLAVFLLTDGGQLAIDSNVLFDAEKVHHTHCLSVHFEANVVHLALTDRVDHNHSRRRVGQIAADAAEESAEFDPKTVHLSRVISVGALLLQHPIDNVLQIFVGKKGTCFHVRHQSRFGLSAVVNDSHAFCDSLPRDNARRLLQLFADLSLEETTRADNVMRFCVDP

SEQ ID NO: 159388 - protein, 171 aa, Heterodera glycines
  Coding regions on vcDNA: vcDNA=SeqID_85811; Strand=+; Position=1-513
GDFVGCGINLATRRIIFTKNGQPLNTSDLFLSPPFGLPLFPFISLSDSGDLIETNFGPKFEFDPAKVQQQASSNFRQNYWDANFCHENLEIIGNKSLIVHYKKNSYDAWRSVFAKYPILLNKDSSNIFYYEILVKNKNYWFISFGFAVKQKTKLDGIILYEKGIYVYESDG

SEQ ID NO: 159389 - protein, 64 aa, Heterodera glycines
  Coding regions on vcDNA: vcDNA=SeqID_85812; Strand=+; Position=186-377
NKFCFLNFILERLILLIIIPRAFHRHQMLFRRLAGFQQHFYCCCCLSKAALFRCPTRSIRTQCE

SEQ ID NO: 159390 - protein, 76 aa, Heterodera glycines
  Coding regions on vcDNA: vcDNA=SeqID_85813; Strand=-; Position=45-275
SHRNNPVQTFNYFQSVKNGEIITMSSFPADLSIDGRKIFLSRIDHFYCLPLLISLFSMSLSVGYIMFKNYNFKTYT

SEQ ID NO: 159391 - protein, 84 aa, Heterodera glycines
  Coding regions on vcDNA: vcDNA=SeqID_85814; Strand=-; Position=46-300
KLPFHPHLLFLKLKNQMQFNRQQKKSSKYFTSIFISDWTIKRKLNFFSNKNYNYYFRLLNKIRILINFKMTNPLVFKILIFCFR

SEQ ID NO: 159392 - protein, 39 aa, Heterodera glycines
  Homolog annotation: Hit_ID=ZP_00357698.1; Match level="QueryCoverage =82%, HitCoverage=20%, E-value=2e-09, Identity=86%"; Hit description =hypothetical protein Chlo02002738 [Chloroflexus aurantiacus]
  Coding regions on vcDNA: vcDNA=SeqID_85815; Strand=+; Position=2-121
FFFFFFFFLFFFFFFFFFFFFFFFFLLFPPSFSSPSFSL

SEQ ID NO: 159393 - protein, 61 aa, Heterodera glycines
  Coding regions on vcDNA: vcDNA=SeqID_85816; Strand=+; Position=1-186
FFFFFFFFGSRTIHRKIKIIGTLSGIQKWCGVKGIMELFYTQSDQRQTNEWIRILSLSSIS

SEQ ID NO: 159394 - protein, 76 aa, Heterodera glycines
  Coding regions on vcDNA: vcDNA=SeqID_85817; Strand=+; Position=1-228
GRSVDISDAVSGVDFASLSCLSTITQSTSDELGKKSKGSPTIELLRAESDCLPPEWLLPNSSDIILKPLIPMAEHS

SEQ ID NO: 159395 - protein, 68 aa, Heterodera glycines
  Coding regions on vcDNA: vcDNA=SeqID_85818; Strand=-; Position=158-364
GPHGPGFGSTQVVNSNAGEMEESARPPPPNRQQEEEHSEVKDCFRCCCFRRRRRKVPQQNVKCPLTFN

SEQ ID NO: 159396 - protein, 58 aa, Heterodera glycines
  Coding regions on vcDNA: vcDNA=SeqID_85819; Strand=-; Position=2-175
MAGRVRWDTSLWTGVPNHQIRFFVANFALTSAHFKAPVGRRSFFAQQIIRIKRVSLHP

SEQ ID NO: 159397 - protein, 177 aa, Heterodera glycines
  Homolog annotation: Hit_ID=NP_501783.1; Match level="QueryCoverage =94%, HitCoverage=29%, E-value=9e-35, Identity=45%"; Hit description =tbc1 domain family protein (56.5 kD) (4K665) [Caenorhabditis elegans] emb|CAB03042.1| Hypothetical protei
  Gene Ontology: Biological process=signal transduction
  Coding regions on vcDNA: vcDNA=SeqID_85820; Strand=+; Position=2-532
GQREPIPGVNPLPSSANSSGSLPSSLYPRLPEVSLSRPTHTYSAVTSSPNMSINKSIAMSPGRAVAVQIKESKNEDVSRFHRLRRILGLLDREKPVPDTVVDLDELRKECWLGIPHRIRPLAWRLLSEYIPTSLDRCEMTLNRKRDEYWHYVEQYFHTRYDEQHQITFRQIHIDIPR

SEQ ID NO: 159398 - protein, 163 aa, Heterodera glycines
  Coding regions on vcDNA: vcDNA=SeqID_85821; Strand=-; Position=1-489
MCFQWLDTAFLVTVSEKYNAANNAGATVPSPPTTVAEQQQPLENGGGQVAPPPMVNGGSGKLHQIVVESEPKKASVVVDHSPQKEPEKKPDAPSDAAPTVVDSLPSPTSTPNKKDEVMAISAVAPLSSIVDVPKTVDTAPPPSLSQPVAATAAAAPPPTSEQQ

SEQ ID NO: 159399 - protein, 170 aa, Heterodera glycines
  Coding regions on vcDNA: vcDNA=SeqID_85822; Strand=+; Position=32-541
QNRTNLISKIIMTKSKSSSGTTRTKKRTADQVVKTVFRRKICLFCFMASLIVFALVLGLAITLTVITVNNWKEIGVLLSKQSALKSRSDIEAFYEIDCPIYSDNSKLPDKWDQFDLAFCNRYCDRNQMFEFMYRQLDPNRKSSAKSKDNQELMCPIYIEFKQCQMEEGGH

SEQ ID NO: 159400 - protein, 76 aa, Heterodera glycines
  Coding regions on vcDNA: vcDNA=SeqID_85823; Strand=+; Position=50-280
AVEKHCFVCRCLPNSFMCRKSCDAWALRLCLIRAVAVSPRRGFQKYRRSIDKASCRYISFKRRIPEANNFECIQET

SEQ ID NO: 159401 - protein, 176 aa, Heterodera glycines
  Homolog annotation: Hit_ID=AAB96704.1; Match level="QueryCoverage =100%, HitCoverage=44%, E-value=6e-87, Identity=88%"; Hit description= Hypothetical protein F33D11.10 [Caenorhabditis elegans] ref|NP _491703.1| initiation factor (45.5 kD) (1G4
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_85824; Strand=+; Position=4-531
MIRRRNLRTRSIRMLVLDEADEMLTKGFKEQIYDIYRYLPPNAQVVLLSATLPHDVLEMTSKFMTDPIRVLVKRDELTLEGIKQFFVAVEREEWKFDTLCDLYDTLTITQAVIFCNTRRKVDWLADKMREANFTVSSMHSDTEQKDRDAIMKSFRAGESRVLISTDVWARGLDVPQ

SEQ ID NO: 159402 - protein, 121 aa, Heterodera glycines
  Coding regions on vcDNA: vcDNA=SeqID_85825; Strand=+; Position=108-473
ICTWPGFRLFFTIAFPPQNFLIHVNNVKHYYPYSCIRRANCSFAAVFEVFFDAVTSAVPSVRSFVRLVVPSSSPLPPTLPQTAIGRAKLTSLVGEFRAQCPSLAYRVFQATNNKRTQRHRH

SEQ ID NO: 159403 - protein, 111 aa, Heterodera glycines
  Coding regions on vcDNA: vcDNA=SeqID_85826; Strand=+; Position=84-419
IKCTHNTNHINEHFVSAAFCLSIVLSKSSLFSFVPFHCEKDGALAVRTPTGCCIRMSCKNSAACSGVSGPFFSSPRSFSPISLPIRASGTLTSIGRNWKFTMCGRRSFTSF

SEQ ID NO: 159404 - protein, 129 aa, Heterodera glycines
  misc_feature (93)..(93): Xaa can be any naturally occurring amino acid
  misc_feature (104)..(104): Xaa can be any naturally occurring amino acid
  Homolog annotation: Hit_ID=AAP30755.1; Match level="QueryCoverage =100%, HitCoverage=54%, E-value=1e-48, Identity=78%"; Hit description= putative gland protein 29D09 [Heterodera glycines]
  Coding regions on vcDNA: vcDNA=SeqID_85827; Strand=-; Position=59-447
YNLGFARAMFDLAAAAAGHAGNDTEWQNMKSKFVQESQAIKAIGQEMNIEVTDVHIGHPSKGISAHQNVPSPSHVIANPGQHSSVGHGKENTXVVIGFRFLRAXKSRKIRRKIHSTENHFVDMSNTYLK

SEQ ID NO: 159405 - protein, 123 aa, Heterodera glycines
  Coding regions on vcDNA: vcDNA=SeqID_85828; Strand=+; Position=2-370
FFFFFFFFFTLSSIYIGKKNIDNNRRFAVSTSFDGFFCPVSSLSQITAADTARAVPRPAPSALRRRCCRHGTPHDLHRRPNCGHSGAGRIRSASLPPLPNSEQSQADPDEEAPKKAIYCICSR

SEQ ID NO: 159406 - protein, 52 aa, Heterodera glycines
  Coding regions on vcDNA: vcDNA=SeqID_85829; Strand=-; Position=44-202
DSNDNWWEEPLRRQRRRRRRTVLILGLIEFFRENPPKNKKIQMFQIQKIVKK

SEQ ID NO: 159407 - protein, 107 aa, Heterodera glycines
  Coding regions on vcDNA: vcDNA=SeqID_85830; Strand=+; Position=1-324
GIHCISSYHFIPKMSFLRLITFVLLITLCSLPSLVESGLIGIVGTPVEAAWCGVLGKESSHCPTAGGGQHGGGGGGGGGGNYGGGAPGGNYGGSSGSYNGHRARRFA

SEQ ID NO: 159408 - protein, 61 aa, Heterodera glycines
  Coding regions on vcDNA: vcDNA=SeqID_85831; Strand=-; Position=1-183
SNGRKGKVIKWKKRASDQMEEKGKGSNGRKGKVSNGRKGKVIKWKKRDSDQMEKKKKKKKK

SEQ ID NO: 159409 - protein, 148 aa, Heterodera glycines
  Homolog annotation: Hit_ID=NP_032645.1; Match level="QueryCoverage =75%, HitCoverage=11%, E-value=1e-14, Identity=37%"; Hit description =Moloney leukemia virus 10 [Mus musculus] pir||A39611 probable GTP -binding protein - mouse emb|CAA36803.1|
  Gene Ontology: Mol. function=ATP dependent RNA helicase activity; Cellular component=intracellular; Biological process=negative regulation of cell cycle
  Coding regions on vcDNA: vcDNA=SeqID_85832; Strand=+; Position=1-444
GKGVTVDTVERYQGSQRRVIIVSTVRNNEKEAIGFLMSDKRFNTIITRAEELLIIVGNAKVMMRDSSWKEMIDYCRKNGATVDMPSEAELFPSGQFQNDVLTDSDKSSSSSNSEVDEKERTDQLVKKGTSSAAAAEQQNLRAKASSAE

SEQ ID NO: 159410 - protein, 167 aa, Heterodera glycines
  Homolog annotation: Hit_ID=CAE69165.1; Match level="QueryCoverage =99%, HitCoverage=32%, E-value=3e-67, Identity=79%"; Hit description =Hypothetical protein CBG15197 [Caenorhabditis briggsae]
  Gene Ontology: Mol. function=protein binding; Cellular component=COPI vesicle coat; Biological process=intracellular protein transport
  Coding regions on vcDNA: vcDNA=SeqID_85833; Strand=+; Position=42-542
MVLIAASIFTKSGKALVTRQYVADMTRARLEGLLNAFPKLITSDKAQRQHTFVETNSVRYVYQPMDNIYMVLITTKASNILEDLETLRLFSRVIPEYCRSNDESEITDKAFDLIFAFDEIVVLGYRESVNLAQIRTFTEMDSHEERVFNQIQIAQQRAAHTLMKEKE

SEQ ID NO: 159411 - protein, 45 aa, Heterodera glycines
  Coding regions on vcDNA: vcDNA=SeqID_85834; Strand=-; Position=141-278
DPYFKDDPQGNEHERFRNAEERLEKPHRKKVTKVITEWSELFFTT

SEQ ID NO: 159412 - protein, 65 aa, Heterodera glycines
  Homolog annotation: Hit_ID=CAE67866.1; Match level="QueryCoverage =96%, HitCoverage=39%, E-value=1e-17, Identity=60%"; Hit description =Hypothetical protein CBG13458 [Caenorhabditis briggsae]
  Coding regions on vcDNA: vcDNA=SeqID_85835; Strand=-; Position=173-370
DQARMVLEGSAYYDVEAKDGVWIRIFCEYGDLLIILKGIAHRMTTTPKNYVKVPRFFKSSDSDED

SEQ ID NO: 159413 - protein, 113 aa, Heterodera glycines
  Homolog annotation: Hit_ID=NP_505473.1; Match level="QueryCoverage =96%, HitCoverage=17%, E-value=2e-12, Identity=35%"; Hit description =plasmodium falciparum glutamic acid-rich protein like (67.8 kD) (5K60) [Caenorhabditis elegans] emb|CAB03
  Gene Ontology: Biological process=growth
  Coding regions on vcDNA: vcDNA=SeqID_85836; Strand=+; Position=1-339
GVRDLQQQVNELEEKAKKIEHQRTKNLSAISAINQRNRDHMKQTFLGAGMVREEQEKDDDPFTRKSARMKVVSGSVKSKTAGEGNGANAELSVMDTMVSSLGSLSSSSESSPN

SEQ ID NO: 159414 - protein, 57 aa, Heterodera glycines
  Coding regions on vcDNA: vcDNA=SeqID_85837; Strand=+; Position=2-175
GIVTIVGAPMDVEKVSAPSDELVNKLHAEYCARLRELFNAHKVKHGGLGHDVQLEIV

SEQ ID NO: 159415 - protein, 84 aa, Heterodera glycines
  Homolog annotation: Hit_ID=NP_635515.1; Match level="QueryCoverage =97%, HitCoverage=7%, E-value=9e-17, Identity=51%"; Hit description =TonB-dependent receptor [Xanthomonas campestris pv. campestris str. ATCC 33913] gb|AAM39439.1| TonB-depend
  Coding regions on vcDNA: vcDNA=SeqID_85838; Strand=-; Position=3-254
PGFQPAVSGQYGYNDLSQDWSPRFAGLVSNTWADGQLGALFSLAYSERDSLEEGFSSVRWGPASADGGFLNGSAALANPARTYH

SEQ ID NO: 159416 - protein, 98 aa, Heterodera glycines
  Coding regions on vcDNA: vcDNA=SeqID_85839; Strand=-; Position=102-398
NKNFFVKLFYRRNQILEPMAIPGCEAKCDLINFLQILNPRSIRGGERELKILSDRKVPNSPPRRMGNIPGFAKSLIIAIFISIAPINPGTQSPVINVR

SEQ ID NO: 159417 - protein, 90 aa, Heterodera glycines
  Coding regions on vcDNA: vcDNA=SeqID_85840; Strand=+; Position=1-270
FFFFFFFFFSTCSAVYFYFNGVNFDNDAGNKCTIFLFVESQLYCLWWLFHSLLLLSDASHLLRFSQIMRLQKRSKLVHLRFFGGKCGHQT

SEQ ID NO: 159418 - protein, 84 aa, Heterodera glycines
  Homolog annotation: Hit_ID=NP_504988.1; Match level="QueryCoverage =98%, HitCoverage=16%, E-value=2e-15, Identity=45%"; Hit description =cytochrome p450 2C33v4 family member (5I160) [Caenorhabditis elegans] gb|AAA98571.1| Hypothetical protein
  Coding regions on vcDNA: vcDNA=SeqID_85841; Strand=-; Position=137-391
FMPSRFLEEDGKMRRVDELIPFGIGKRSCPGETLGRMELVLFTANFFHKFHVYPCDPLNPPKFEKRQTFAVKLADYKCKVTKRK

SEQ ID NO: 159419 - protein, 160 aa, Heterodera glycines
  Homolog annotation: Hit_ID=NP_495527.2; Match level="QueryCoverage =96%, HitCoverage=91%, E-value=6e-39, Identity=49%"; Hit description =ribosomal protein L14b/L23e (19.9 kD) (2H598C) [Caenorhabditis elegans] gb|AAA68795.2| Hypothetical prote
  Coding regions on vcDNA: vcDNA=SeqID_85842; Strand=+; Position=1-480
GQFLLNLSSSYSQWISKAFASTGKGRWYAQPLDEMSRHRSRPPCYGMARRSKVLCVDNSEIAKEANMSGKLAYVIWVYKDGYRKRHMPKAELGDRVLLSIRGEMKRAVVVGCKQHLAIRKHGLPSTDTNNVVLLNNDGNPLGNRILAPVPAYFMRYRKWL

SEQ ID NO: 159420 - protein, 38 aa, Heterodera glycines
  Coding regions on vcDNA: vcDNA=SeqID_85843; Strand=+; Position=2-118
FFFFFFFWAQVGLSTNKTKTIENEIFNEKKYLGECRNT

SEQ ID NO: 159421 - protein, 59 aa, Heterodera glycines
  Coding regions on vcDNA: vcDNA=SeqID_85844; Strand=+; Position=166-345
KYLSSINYNRHLTKQTVLVLNGREQELGHKPLINKVDECVDARVSFVLSEHYYQDKAVS

SEQ ID NO: 159422 - protein, 69 aa, Heterodera glycines
  Coding regions on vcDNA: vcDNA=SeqID_85845; Strand=-; Position=46-255
VHFDDHCHDVEGMADFVRPFGPYFGQIAFGFTHLGLSVEQLKGPRSRSNWKSQSDLNSFEQKNGKVLII

SEQ ID NO: 159423 - protein, 148 aa, Heterodera glycines
  Homolog annotation: Hit_ID=CAE72971.1; Match level="QueryCoverage =100%, HitCoverage=44%, E-value=3e-56, Identity=74%"; Hit description= Hypothetical protein CBG20308 [Caenorhabditis briggsae]
  Coding regions on vcDNA: vcDNA=SeqID_85846; Strand=+; Position=1-444
GRPSSADFASPVPHVRNGASLVDFYIGLGLAISSSLFIGSSFIIKKKALIKLAGSAEYNQRASEGGDGYLKEWLWWMGVITMGVGEACNFAAYAFAPASLVTPMGALSVLVTAVLSSKLLKERLNLLGKIGCAICLLGSTSIVIHSPK

SEQ ID NO: 159424 - protein, 112 aa, Heterodera glycines
  Coding regions on vcDNA: vcDNA=SeqID_85847; Strand=+; Position=2-337
FFFFFFFFFRCKRIYFARTFVGISCVVRLNWAFLVIHPPFVHSFLFVLPICSSVRPSFTTNTPNSPGKRGRSTTRRKGKRRPIRRMRRSNTDSNVWHAPPRLDVARLRTLAL

SEQ ID NO: 159425 - protein, 47 aa, Heterodera glycines
  Coding regions on vcDNA: vcDNA=SeqID_85848; Strand=-; Position=201-344
RDMKLNYTCLFKSILEKIHGSGENGWLAPFSRAIKNTVPGRAQCIEE

SEQ ID NO: 159426 - protein, 128 aa, Heterodera glycines
  Homolog annotation: Hit_ID=BAB14535.1; Match level="QueryCoverage =86%, HitCoverage=62%, E-value=5e-12, Identity=33%"; Hit description =unnamed protein product [Homo sapiens]
  Gene Ontology: Mol. function=growth factor activity; Cellular component=extracellular; Biological process=cell-cell signaling
  Coding regions on vcDNA: vcDNA=SeqID_85849; Strand=-; Position=52-438
AHSAHCCPAGFACAREEERCVSEQNGISLSTQMFPTHHATKRRFHGTKMPTECPDGTFCGSPTDICCAHSLPTNEGEQTTTFGCCPLSKGICCKESQKCCPMGYKCSAEGCERMEVRERIVRLFLDKN

SEQ ID NO: 159427 - protein, 80 aa, Heterodera glycines
  Coding regions on vcDNA: vcDNA=SeqID_85850; Strand=-; Position=2-241
LNISHSSIMTIISGSSSQLKLCRGRHLANHRQLLLLMGGRHLCLGRHASGHRFAVLRVRRGRRDVNRWLFDLDVVGQRIA

SEQ ID NO: 159428 - protein, 143 aa, Heterodera glycines
  Coding regions on vcDNA: vcDNA=SeqID_85851; Strand=+; Position=2-430
GSLAEEMFITVAPSDNARQMIYSSMEQMQQFLNFDEQIEAAEKQTEREKDDQNSEESEKMALKKLFEQKSAEFEINKAKATEKLSEMLAVRFEPILQKEEERMMEVQRKHFWEWAERRKRLIHSQAQRAEHLARLNEIQKRRA

SEQ ID NO: 159429 - protein, 105 aa, Heterodera glycines
  Homolog annotation: Hit_ID=CAE63460.1; Match level="QueryCoverage =80%, HitCoverage=82%, E-value=2e-11, Identity=41%"; Hit description =Hypothetical protein CBG07924 [Caenorhabditis briggsae]
  Coding regions on vcDNA: vcDNA=SeqID_85852; Strand=-; Position=1-315
GPFKVIPFRPRRPLDILESDGFGGFRKRPLNVMDANGFGSFQKRALDSLEGDDFMGLKKKKALTTADGDDFTDLGKRALDVLDGNDFVGFRKRSEMQKKKKKKKK

SEQ ID NO: 159430 - protein, 184 aa, Heterodera glycines
  Coding regions on vcDNA: vcDNA=SeqID_85853; Strand=-; Position=1-552
RRFVQTIILAHQTPTVLYVKSDVFQWLDTAFLVTVSEKYNAANNAGATVPSPPTTVAEQQQPLENGGGQVAPPPMVNGGSGKLHQIVVESEPKKASVVVDHSPQKEPEKKPDAPSDAAPTVVDSLPSPTSTPNKKDEVMAISAVAPLSSIVDVPKTVDTAPPPSLSQPVAATAAAAPPPTSEQQ

SEQ ID NO: 159431 - protein, 70 aa, Heterodera glycines
  Coding regions on vcDNA: vcDNA=SeqID_85854; Strand=-; Position=199-411
LENFEKANEIANDCNQAQKKWKPFNGQVLHGFRLEYDADLHPLKVSTSINSTRKVRSNAQANDVKRANLL

SEQ ID NO: 159432 - protein, 172 aa, Heterodera glycines
  Coding regions on vcDNA: vcDNA=SeqID_85855; Strand=+; Position=69-584
LDEKMTSPAESLNLDAAEVPELLRKELDTLHKALGENMQRYTECKEIKVDEGLRTLEAKVGRLALSINSHKGILKRERMRLAETAKRLGLDQRIAHNVQRTRDNLAKSPQFGRAHSVDFLHEVATQNDQSLAEQCETVEKLRKLLDRLSNSDEEPSLSRNDLVDHLTRFDRI

SEQ ID NO: 159433 - protein, 45 aa, Heterodera glycines
  Coding regions on vcDNA: vcDNA=SeqID_85856; Strand=+; Position=68-202
YLFFSSFLHFFLLFLPLASLRSFRLQFSLKPLNFSLRSLRLQFSL

SEQ ID NO: 159434 - protein, 148 aa, Heterodera glycines
  Homolog annotation: Hit_ID=NP_499055.1; Match level="QueryCoverage =100%, HitCoverage=91%, E-value=1e-67, Identity=76%"; Hit description= protein i-126 (18.5 kD) (3K421) [Caenorhabditis elegans] emb|CAA79557.1| Hypothetical protein C40H1.6 [C
  Coding regions on vcDNA: vcDNA=SeqID_85857; Strand=+; Position=117-560
MDESAKKTLKQIPLLKTNAGPRDGPLWLERLKEEYNSLIAFIEHNKQGDADWFRLESSADGTRWFGKCWTYHNKIKYEFDVEFDVPITYPKTAPEIALPELDGKTAKMYRGGKICLSDHFKPLWARNVPKFGIAHAFSLGLGPWMAVE

SEQ ID NO: 159435 - protein, 43 aa, Heterodera glycines
  Coding regions on vcDNA: vcDNA=SeqID_85858; Strand=+; Position=162-290
LLSEYKMQMFKNLRNMFLQKSWCSSIEHYRLWWHFHRLMTVLL

SEQ ID NO: 159436 - protein, 132 aa, Heterodera glycines
  Homolog annotation: Hit_ID=AAP30763.1; Match level="QueryCoverage =100%, HitCoverage=33%, E-value=3e-69, Identity=100%"; Hit description=putative gland protein G8H07 [Heterodera glycines]
  Coding regions on vcDNA: vcDNA=SeqID_85859; Strand=+; Position=72-467
MLRIALLISILALFGDCMDMGKRKLGGISINEPSEYGTKEKEAIATKENAQTSKDPPTSAGGQNEAIPSPKKPSPKGKLKSDFGLNLAKAFPRPVPKGRRGKEKVGEKISVMNTAERIEKMDIAQDKAKMEI

SEQ ID NO: 159437 - protein, 81 aa, Heterodera glycines
  Coding regions on vcDNA: vcDNA=SeqID_85860; Strand=-; Position=2-244
SPFLPPQFFGFFIYLGNGNFPDLDSVFVFFGIYPIPFFDRVVGGKCPVLLTILGRVKNKFCDKKKKKKKKKKKEKKKKKKK

SEQ ID NO: 159438 - protein, 71 aa, Heterodera glycines
  Coding regions on vcDNA: vcDNA=SeqID_85861; Strand=+; Position=54-266
FLQDVYWVFMFISFTSILISCKIPSAAAPSLLPVALDQCQKCVSVSSPGVPFDPLLQALLVQRVKSVFDVS

SEQ ID NO: 159439 - protein, 118 aa, Heterodera glycines
  Coding regions on vcDNA: vcDNA=SeqID_85862; Strand=-; Position=1-354
HSNKGGQGNQPHSHCIEDICRPPRRWFFSRRSHPHSHCFEEIFRQRRKQYFSLLSPSVVWNEKERRQGETEIEKWNGSNDGSKKDKFDGKLRCVFYPIFFAPIHKDLTGQKKKKKKKK

SEQ ID NO: 159440 - protein, 103 aa, Heterodera glycines
  Homolog annotation: Hit_ID=NP_505633.1; Match level="QueryCoverage =90%, HitCoverage=14%, E-value=3e-11, Identity=40%"; Hit description =putative RNA binding protein with KH domain(s) family member (65.6 kD) (5K718) [Caenorhabditis elegans] e
  Coding regions on vcDNA: vcDNA=SeqID_85863; Strand=+; Position=24-335
MQTAVSQAAQLHSTQMQQQQIHQQQQATIAQPQQAVSAGMGAVSSSGGPAINPQTGQPDYSAQWAEYYRTMGMHEQAALIEAQMKQTHAAAQAQRPQQQLYMQ

SEQ ID NO: 159441 - protein, 79 aa, Heterodera glycines
  Coding regions on vcDNA: vcDNA=SeqID_85864; Strand=-; Position=111-350
MNNRRQILTTYPQQIRDLDCHHEVVHTFSNFCFKFSENPYALKYAYVLANLCERPELDAERIKMALIEQCAEVELSGVI

SEQ ID NO: 159442 - protein, 132 aa, Heterodera glycines
  Homolog annotation: Hit_ID=CAE57243.1; Match level="QueryCoverage =86%, HitCoverage=23%, E-value=2e-19, Identity=50%"; Hit description =Hypothetical protein CBG00121 [Caenorhabditis briggsae]
  Gene Ontology: Mol. function=zinc porter activity; Cellular component= synaptic vesicle; Biological process=transport
  Coding regions on vcDNA: vcDNA=SeqID_85865; Strand=+; Position=32-427
MCVFWVEMRKILDTNVSYLSMGLLLYLGGHSHSHSHHGHGTHSQRQTDRTNFAENEWGTVDGRPGQNGGNRQTHGTRRQTNINVRAAFVHVLGDLIQSVGVLFAGLLIYWKPNWHILDPICTLLFSAIVLST

SEQ ID NO: 159443 - protein, 55 aa, Heterodera glycines
  Coding regions on vcDNA: vcDNA=SeqID_85866; Strand=+; Position=1-165
FFFFFFFFFFQKNSIVFCLFLLLFFDFIIIITSRSSRRFLRVVDIALVSARAGEA

SEQ ID NO: 159444 - protein, 145 aa, Heterodera glycines
  Coding regions on vcDNA: vcDNA=SeqID_85867; Strand=+; Position=3-437
FFFFFFFFFFLHNYNFTFVIKLFFPLGRDSKVPSLSLVWRLTGDSLRPPFFFPSLHSVFLHCQHFLFPGVSFPPVFSLPPSFFQCLPQVFPWRPNADSAPLLLSRESAPFSQALPRVWTFRCPPPILQNSRRVPYSQTPTHFPAS

SEQ ID NO: 159445 - protein, 89 aa, Heterodera glycines
  Coding regions on vcDNA: vcDNA=SeqID_85868; Strand=-; Position=197-466
ITNTMPFHEDLPNQQIVDSQRKRRYKYPSWPNITKQCRTAIDALLTYQPAFRPNISECAKLEWFAQDSASLCCGGRRPGVGVMGQVRGR

SEQ ID NO: 159446 - protein, 101 aa, Heterodera glycines
  Coding regions on vcDNA: vcDNA=SeqID_85869; Strand=+; Position=36-338
FTHKRRERKGRNHYRNKTKGVQIRRQKSVKFPSLFTHCAPTHCSLPLLFLPPHHHPLLFSFVISLVPSVALRRLKPSTTASTSTMFLPTAPAFAAPIVRHG

SEQ ID NO: 159447 - protein, 104 aa, Heterodera glycines
  Coding regions on vcDNA: vcDNA=SeqID_85870; Strand=-; Position=2-313
ASKLRPFLQKLIQQASPPQVMTPPASRKSSSITSQNTPSTSSRKPSDSAINQLNVSGATYKQQKSCDVPEKTQKVGNKSGRERDCWWLNPKDKKRKKKKKKKKK

SEQ ID NO: 159448 - protein, 118 aa, Heterodera glycines
  Homolog annotation: Hit_ID=EAA76175.1; Match level="QueryCoverage =60%, HitCoverage=10%, E-value=2e-14, Identity=79%"; Hit description =hypothetical protein FG09652.1 [Gibberella zeae PH-1] ref|XP _389828.1| hypothetical protein FG09652.1 [Gib
  Coding regions on vcDNA: vcDNA=SeqID_85871; Strand=-; Position=1-354
RKTPGGGGFFWGGFINPFFPPPGGVSPPPPFFFPPQIGGAPQKKNPPGGKKTPPKWPLFFFLKKKFFWGPFFSPKNFFPKKKKKKKKKKKKKKKKKKKKKKKKKKKKGQKKKKKKKKK

SEQ ID NO: 159449 - protein, 137 aa, Heterodera glycines
  misc_feature (23)..(23): Xaa can be any naturally occurring amino acid
  misc_feature (35)..(35): Xaa can be any naturally occurring amino acid
  Coding regions on vcDNA: vcDNA=SeqID_85872; Strand=-; Position=1-411
SVPSDQFVPPRVFPSVPSDQSVXRGFRSVRSVYSXGLFRPFCFRLSPAAQNGIIACHSAFSPPSSALLNVALKSADSASTVKCPIGSLRFTPSWLNSTTLKDNGRGTPSPSIPTLSGSTNSSQSSALNTGLSVRLIP

SEQ ID NO: 159450 - protein, 126 aa, Heterodera glycines
  misc_feature (3)..(3): Xaa can be any naturally occurring amino acid
  misc_feature (5)..(7): Xaa can be any naturally occurring amino acid
  Coding regions on vcDNA: vcDNA=SeqID_85873; Strand=-; Position=2-379
FFXFXXXVDAEFFSLSVLIRFFSIIRDKEIVRQNKNVFFCALPIYWFISRFLKRCVYWSSICSFSVFVLLRLLLLLLLVSLFVFDRLHIVRKPKCPSANVAKILASLRPLLLLLLRLSPVQLFVQF

SEQ ID NO: 159451 - protein, 91 aa, Heterodera glycines
  Homolog annotation: Hit_ID=NP_499173.1; Match level="QueryCoverage =96%, HitCoverage=17%, E-value=1e-17, Identity=52%"; Hit description =suppressor of bimD6 (58.6 kD) (3K892) [Caenorhabditis elegans] emb|CAA80180.1| Hypothetical protein ZK632
  Coding regions on vcDNA: vcDNA=SeqID_85874; Strand=+; Position=1-273
GEFNLLYHLDTVYVIDLAQAMDISHPSSLRFLHRDITNVLNFFGRIGCEPLPTPHAFFHEVTDIEFDPNKNLYVQVESFERENRNMDLKGA

SEQ ID NO: 159452 - protein, 166 aa, Heterodera glycines
  Homolog annotation: Hit_ID=CAE69300.1; Match level="QueryCoverage =96%, HitCoverage=65%, E-value=3e-47, Identity=55%"; Hit description =Hypothetical protein CBG15355 [Caenorhabditis briggsae]
  Gene Ontology: Cellular component=integral to plasma membrane; Biological process=mitochondrial translocation
  Coding regions on vcDNA: vcDNA=SeqID_85875; Strand=+; Position=3-503
DLQLDPSIFKESQPQIIMPEGYESGRGKFEFALGYIGCSVIGGFGVGSVRGMFGELGNPQNRTLAWNPWYTRMLNAATKHGSGYAQTAGTAMFLYSVTELGLKLSRADDLLNSFIAGPIAGGLFHGLPHGLRAGGVGALAGLGLVTVWNLCDRDSRRELREILRLS

SEQ ID NO: 159453 - protein, 88 aa, Heterodera glycines
  Homolog annotation: Hit_ID=AAH48271.1; Match level="QueryCoverage =45%, HitCoverage=7%, E-value=7e-11, Identity=82%"; Hit description =KIAA0663 protein [Homo sapiens]
  Coding regions on vcDNA: vcDNA=SeqID_85876; Strand=-; Position=1-264
NPPPPPPRGALFFFGGVSPRGGGKKPLFFFFGPPFPPPPVFLVFFFPLGKGGKNPPKKKKKKKKKKKKKKKKKKKKKKNQKKKKKKKK

SEQ ID NO: 159454 - protein, 80 aa, Heterodera glycines
  Coding regions on vcDNA: vcDNA=SeqID_85877; Strand=-; Position=2-241
SHNSVVWVVANEIFTAFVENEKVKADDGGEKPNEHRRRLDIHQILEGRLNSDCDYASSRRGGGGSWYSSNLRGKHTHNFS

SEQ ID NO: 159455 - protein, 41 aa, Heterodera glycines
  Coding regions on vcDNA: vcDNA=SeqID_85878; Strand=-; Position=1-123
YESATFLQLKEGESDRKRRNLLITPLNWQMPSLRFPPPPLS

SEQ ID NO: 159456 - protein, 175 aa, Heterodera glycines
  misc_feature (14)..(14): Xaa can be any naturally occurring amino acid
  Homolog annotation: Hit_ID=AAM69107.1; Match level="QueryCoverage =97%, HitCoverage=11%, E-value=2e-46, Identity=54%"; Hit description =Multidrug resistance protein family protein 1, isoform c [Caenorhabditis elegans]
  Gene Ontology: Mol. function=ATP-binding cassette (ABC) transporter activity; Cellular component=integral to plasma membrane; Biological process=transport
  Coding regions on vcDNA: vcDNA=SeqID_85879; Strand=+; Position=1-524
DLIIDPQHNILTPXITFVAISLFNILRFPIAIFAMIGSQAIQTAVSNRRLKHFLAAEEMEPLLRGRPTSEISITIKNADFAWEKDRSLVLKDINLSVRKGTLFAIVGRTGSGKSSLLSAMLGELYRKSGENSLNGSVAYVPQQAWIQNMTLENNVLFGHEFDSDRYQSVLDVCAL

SEQ ID NO: 159457 - protein, 198 aa, Heterodera glycines
  Homolog annotation: Hit_ID=CAE63259.1; Match level="QueryCoverage =96%, HitCoverage=66%, E-value=1e-57, Identity=54%"; Hit description =Hypothetical protein CBG07631 [Caenorhabditis briggsae]
  Gene Ontology: Biological process=cell organization and biogenesis
  Coding regions on vcDNA: vcDNA=SeqID_85880; Strand=+; Position=2-595
GCSLLGLNVYLNALMMFKVGPNSQRNVLPSVVKRDFHFCHLCQSNSPPRSFHCPVCNFCVFRRDHHCSFTGSCVGHFNQRYFVAAVFNLWPVVFSCCVWNWHALLLAFSPISLSDFLKWVFPHMALLFRFVSFHQFFVILAFAFSFITLLFTTYLIFAQIFCFWHGQTRVEYLMDVHAYNLSFRENLSACLGSRWPFI

SEQ ID NO: 159458 - protein, 63 aa, Heterodera glycines
  Coding regions on vcDNA: vcDNA=SeqID_85881; Strand=+; Position=101-289
KITKKQPKKIIYFKFLFFGPPIRSSDSQFNCQSVEAIQFVHGASLKAATPGRTLPSSSSRLAP

SEQ ID NO: 159459 - protein, 76 aa, Heterodera glycines
  Coding regions on vcDNA: vcDNA=SeqID_85882; Strand=+; Position=2-229
FFFFFFFFFRNFFFNTKRINKLKITIVGWFSVLVHSFAPIMPQATISNLTGASRSTLVLFTLTKCAPRGSFGFRFS

SEQ ID NO: 159460 - protein, 129 aa, Heterodera glycines
  misc_feature (16)..(16): Xaa can be any naturally occurring amino acid
  misc_feature (89)..(89): Xaa can be any naturally occurring amino acid
  Coding regions on vcDNA: vcDNA=SeqID_85883; Strand=+; Position=1-387
RGKSKRRNVQKFSYLXPLLSSFKCFKTKMQNALRAKLAELQNSRRTKEEEKEQQKEEPPQKLDFSLFDDSEFANRSWVELIEEEEAAAXKTQKTKAATAETTAASAAPPIASVAAVASSSASPSNKRRN

SEQ ID NO: 159461 - protein, 93 aa, Heterodera glycines
  Homolog annotation: Hit_ID=BAB18763.1; Match level="QueryCoverage =82%, HitCoverage=4%, E-value=6e-21, Identity=68%"; Hit description =kinesin like protein KLP-12 [Caenorhabditis elegans]
  Gene Ontology: Mol. function=plus-end-directed kinesin ATPase activity; Cellular component=plus-end kinesin complex; Biological process=vesicle-mediated transport
  Coding regions on vcDNA: vcDNA=SeqID_85884; Strand=+; Position=70-348
MHRNLVIFYNPQLALGNVISALGGAKGRIGSVHVPYRDSKLTRLLQDSLGGNRSELQFLLCVSPNEVDANETLSSLNYANRAKNIKNKVKSIS

SEQ ID NO: 159462 - protein, 97 aa, Heterodera glycines
  Homolog annotation: Hit_ID=NP_491085.1; Match level="QueryCoverage =90%, HitCoverage=66%, E-value=2e-14, Identity=48%"; Hit description =NADH dehydrogenase Fe-S protein 5 like (1D570) [Caenorhabditis elegans] gb|AAF60773.1| Hypothetical prote
  Coding regions on vcDNA: vcDNA=SeqID_85885; Strand=+; Position=1-294
GRQIPGDDCGFFEDQSVRCFTAFGAKLGRLYCDLEHRDLQECVSRTKKNKRFWKIRDVRFKKWLRGETPHIFEPLADYLKSVHGAPTSYPTGHRVKK

SEQ ID NO: 159463 - protein, 96 aa, Heterodera glycines
  Coding regions on vcDNA: vcDNA=SeqID_85886; Strand=-; Position=219-509
PVPFCIYFLMSSPLDFIVPFDLINEVTGEELALIQSSANDFWLIRFQIGWDERKWDNVKDKLKNRTNPIVIRIKDGGFDDGLLDDASPGPNDQQQK

SEQ ID NO: 159464 - protein, 91 aa, Heterodera glycines
  Homolog annotation: Hit_ID=NP_004573.2; Match level="QueryCoverage =89%, HitCoverage=24%, E-value=3e-29, Identity=72%"; Hit description =Rab geranylgeranyltransferase, beta subunit [Homo sapiens] emb|CAI22393.1| OTTHUMP00000058696 [Homo sapie
  Gene Ontology: Mol. function=RAB-protein geranylgeranyltransferase activity; Cellular component=Rab-protein geranylgeranyltransferase complex; Biological process=protein modification
  Coding regions on vcDNA: vcDNA=SeqID_85887; Strand=-; Position=1-273
GGLCGRPEKLPDVCYSWWVLASLAIIKRLHWIDGESLTHFIIASQDDEKGGIADRPGDESDPFHTVFGLYGLSLLGHKGLEAKKKKKKKKK

SEQ ID NO: 159465 - protein, 88 aa, Heterodera glycines
  Homolog annotation: Hit_ID=NP_502729.1; Match level="QueryCoverage =80%, HitCoverage=15%, E-value=7e-25, Identity=70%"; Hit description =sulfide quinone reductase-like (4O987) [Caenorhabditis elegans] emb|CAB05173.1| Hypothetical protein F02H
  Coding regions on vcDNA: vcDNA=SeqID_85888; Strand=-; Position=130-396
INKNLQYDGYASCPLVVDRRHVILAEFSPDGALETSPYDQSRPTIFAYLMKRYLMPSLYWMFLLNGYWEGPANLRKAFGLFSRRPSGK

SEQ ID NO: 159466 - protein, 55 aa, Heterodera glycines
  Coding regions on vcDNA: vcDNA=SeqID_85889; Strand=-; Position=1-165
MSCIVFGIRGAYSIPILTPNFVKPCCVAFVHNLCKIKKKKKKKKKSKKKKKKKKK

SEQ ID NO: 159467 - protein, 102 aa, Heterodera glycines
  Coding regions on vcDNA: vcDNA=SeqID_85890; Strand=+; Position=55-363
FSGNKYRKIVTRNLCQSKLCTQKTKEEMGQAELVIIIINQYGQGSPWLRIRLASHEVCRSPMFRRRRKVTGPNKPPSGKKTLTAEPSEVEAAKVEDVEEDGH

SEQ ID NO: 159468 - protein, 108 aa, Heterodera glycines
  Coding regions on vcDNA: vcDNA=SeqID_85891; Strand=-; Position=54-380
TDEDVGLMSLTSGNIRRCYGPTNADEEKNNGIGPTTGGTSNTKQVMEYTAGDHFAMRSWHGLEDNSGNNFCISADGVTERQCPCELKQGMDGIATRYANEPFNSDVQK

SEQ ID NO: 159469 - protein, 36 aa, Heterodera glycines
  Coding regions on vcDNA: vcDNA=SeqID_85892; Strand=+; Position=3-113
FFFFFFFLQSIIYLPNNQNTKSTYEFKTKQQKADER

SEQ ID NO: 159470 - protein, 89 aa, Heterodera glycines
  Homolog annotation: Hit_ID=AAO33474.1; Match level="QueryCoverage =73%, HitCoverage=47%, E-value=1e-26, Identity=96%"; Hit description =gland-specific protein g4g12 [Heterodera glycines]
  Coding regions on vcDNA: vcDNA=SeqID_85893; Strand=+; Position=3-269
GSKSTRHSNKILKDPKKCQHFQILLIVLLAVVSFRLSASTGDKKTANDGSGNNSSAGIGTKIKRTVTAGLLFTSLATGGAEAIGRRMLR

SEQ ID NO: 159471 - protein, 146 aa, Heterodera glycines
  Coding regions on vcDNA: vcDNA=SeqID_85894; Strand=+; Position=77-517
KTIFEQGITYVHNRNSVIFKSSGESLTHKDVLELRHRFHGILGRFFVFLNFPFSKGRRRKLPTFIPIVKDFVHIRTFLRMSTIVPSRHPKAVQSDIIENQRGSGHLDRVFGHSSVSDHAPAVGQRSDKVNCAFPTDAIQRQFCSNF

SEQ ID NO: 159472 - protein, 159 aa, Heterodera glycines
  Coding regions on vcDNA: vcDNA=SeqID_85895; Strand=+; Position=49-525
IFVCFPTVEFMQLLATDDYYFIKSVKTILRCCRTTATIAAFRHCDLAALEDIELLGDVFAFIGKITVDDISHLLLVSECSEIAEIDTVNATLTRVERVCALPVLTDGMIHKKLFDIPSLDRFERLKNRPRNLLKLMSHKVPIKNLPTSPKLIDEIIAFF

SEQ ID NO: 159473 - protein, 79 aa, Heterodera glycines
  Coding regions on vcDNA: vcDNA=SeqID_85896; Strand=-; Position=0-236
PSFLLQLIPCLILRPPRRCSESSSTTAGRLNQQQTDGATVTNANEPGATTATDTEAPAATTPTTTTNADGATVTNANEP

SEQ ID NO: 159474 - protein, 50 aa, Heterodera glycines
  Homolog annotation: Hit_ID=AAB26418.1; Match level="QueryCoverage =100%, HitCoverage=37%, E-value=7e-14, Identity=76%"; Hit description= ribosomal protein 49 [Drosophila pseudoobscura] emb|CAA70881.1| ribosomal protein 49 [Drosophila persimil
  Coding regions on vcDNA: vcDNA=SeqID_85897; Strand=-; Position=136-288
DVLLMQNKRYCGEIGHAVSSKKRKQIVERAQQLRIVLTNGNARLRTEENE

SEQ ID NO: 159475 - protein, 124 aa, Heterodera glycines
  Homolog annotation: Hit_ID=CAE67927.1; Match level="QueryCoverage =100%, HitCoverage=57%, E-value=7e-35, Identity=57%"; Hit description= Hypothetical protein CBG13527 [Caenorhabditis briggsae]
  Gene Ontology: Mol. function=receptor-associated protein activity; Cellular component=integral to plasma membrane; Biological process =immune response
  Coding regions on vcDNA: vcDNA=SeqID_85898; Strand=+; Position=143-514
MTLQWTVVAFILYAEIATIIVLLLPWVRPTMWKKVFNSRVVHKLKQFSNVYAYAFIFVLILLFVDATREVRKYSHVDTTREMVGRVAEADAVVHMRLFRAQRNLYLSGFSLLMALIISRIVTLL

SEQ ID NO: 159476 - protein, 89 aa, Heterodera glycines
  Homolog annotation: Hit_ID=CAE59815.1; Match level="QueryCoverage =100%, HitCoverage=19%, E-value=6e-27, Identity=60%"; Hit description= Hypothetical protein CBG03281 [Caenorhabditis briggsae]
  Gene Ontology: Cellular component=mitochondrion
  Coding regions on vcDNA: vcDNA=SeqID_85899; Strand=-; Position=193-462
GTFALSNVGSIGGTYMSPLLLPPQLVIGAIGSIRKIPRFDGNGNLVATHVVTFSWSADHRVVDGATLARFSNCLKEFLEQPETMLAELR

SEQ ID NO: 159477 - protein, 74 aa, Heterodera glycines
  Coding regions on vcDNA: vcDNA=SeqID_85900; Strand=-; Position=142-366
DGRVCMEIGHQNSEPGDSGGPLMQLTQNGTVWTQIGVSSISTLKKDNRLAILYTRVSRYCGWIEKNTDGEVKCL

SEQ ID NO: 159478 - protein, 210 aa, Heterodera glycines
  misc_feature (199)..(199): Xaa can be any naturally occurring amino acid
  Coding regions on vcDNA: vcDNA=SeqID_85901; Strand=+; Position=35-664
SHCQPSRNDMSINCHSLNNIEVSDDEDDVQPNNKRRPESVRNKIHEIEKRLNDSKLEEKDRFKSPITNSLNSSIAKMTPIRVIAMDDVQEILNRKDKRDAEFNKIIAAIKSPALEQRTTPGFKVTSAAKNPNREQHTSPIPITPTSTKNQGMKRSAGYNETIAAESRFRKQYAPPPPPITETSTSISTKNDKVFRPVTXTDQIIGSLLDD

SEQ ID NO: 159479 - protein, 78 aa, Heterodera glycines
  Coding regions on vcDNA: vcDNA=SeqID_85902; Strand=-; Position=47-283
SGKSLALKLATNAAISVLKIDQIIMAKPVGGIKPKAPKGRTTTTMTLGWLNQHSHRTHCRVFALRKYCCCFIFVNFNT

SEQ ID NO: 159480 - protein, 61 aa, Heterodera glycines
  Homolog annotation: Hit_ID=ZP_00357698.1; Match level="QueryCoverage =83%, HitCoverage=30%, E-value=1e-15, Identity=81%"; Hit description =hypothetical protein Chlo02002738 [Chloroflexus aurantiacus]
  Coding regions on vcDNA: vcDNA=SeqID_85903; Strand=+; Position=2-187
FFFFFFFFFFFFFFFFFFFFFFFFFFFFFFFFFFKGGGVFPKKTPTPKVFKRGGKNFFYHP

SEQ ID NO: 159481 - protein, 103 aa, Heterodera glycines
  Homolog annotation: Hit_ID=NP_956763.1; Match level="QueryCoverage =80%, HitCoverage=22%, E-value=2e-11, Identity=37%"; Hit description =hypothetical protein MGC63632 [Danio rerio] gb|AAH55174.1| Hypothetical protein MGC63632 [Danio rerio]
  Gene Ontology: Mol. function=GTPase activator activity; Biological process=small GTPase mediated signal transduction
  Coding regions on vcDNA: vcDNA=SeqID_85904; Strand=-; Position=101-412
RFVTWLRYNVWLLLYPLGLFLEALVLLISVPFFYSSGVYSLQLPNALNFSYNFGVVLALFSFICFPFIGFTLIKHMFKQRRKKMDELYREEAAMKRSRQKKPQ

SEQ ID NO: 159482 - protein, 86 aa, Heterodera glycines
  Coding regions on vcDNA: vcDNA=SeqID_85905; Strand=-; Position=38-298
GSILAFRLMTVPAATTKRTRGARQFKCESKGPNRRRAAQMKRDDMPFLIDYNVHICGQSYCIIPTFHMAVRCMYVYVFIVYSIICA

SEQ ID NO: 159483 - protein, 53 aa, Heterodera glycines
  Coding regions on vcDNA: vcDNA=SeqID_85906; Strand=+; Position=122-283
RNRSCKKSFRDCSRRGRIREGKWALHCPFYDWMTFCYSLPFCDFSVYKANESN

SEQ ID NO: 159484 - protein, 113 aa, Heterodera glycines
  Homolog annotation: Hit_ID=AAN32886.1; Match level="QueryCoverage =99%, HitCoverage=60%, E-value=4e-57, Identity=98%"; Hit description =gland-specific protein G2D01 [Heterodera glycines]
  Coding regions on vcDNA: vcDNA=SeqID_85907; Strand=+; Position=1-342
GGCSNGGDRTLLADIEASLATHSADECALSLGFVRAMFAIAASASSHASNNSEWQTLSGQFGQKVTEIDSKCAEFGISIGKVPINGPKGAHVQNVPNSESVISMPGLAGSHTQ

SEQ ID NO: 159485 - protein, 73 aa, Heterodera glycines
  Homolog annotation: Hit_ID=ZP_00357698.1; Match level="QueryCoverage =49%, HitCoverage=22%, E-value=5e-10, Identity=77%"; Hit description =hypothetical protein Chlo02002738 [Chloroflexus aurantiacus]
  Coding regions on vcDNA: vcDNA=SeqID_85908; Strand=+; Position=2-223
FFFFFLLFFFFFFFFFFFFFFFFFFFFFKKRALFYPQKGGPPKLGGFKKGKVPTPKKFWPPLKFFFQKLKKFF

SEQ ID NO: 159486 - protein, 98 aa, Heterodera glycines
  Coding regions on vcDNA: vcDNA=SeqID_85909; Strand=-; Position=90-386
AKFFESNNRGEWNFNGNHARRLLCGRGNFKLENMFKRFFSIAPQFHRAQSDCEALLQVCLSYGMDFVKFVARNCSYFPDCFYTSSKKTQTLNSLNTDL

SEQ ID NO: 159487 - protein, 175 aa, Heterodera glycines
  Coding regions on vcDNA: vcDNA=SeqID_85910; Strand=+; Position=1-525
GDFQSVDNEFDALMMKHMYATVRFLLLLTAIAAKSTNCATNVQGTQTVTTSDATHDEAGKISRDSSSSSDEDDSTTAASQMLLNEANNAFSKDNDEPINQQQKMRPEANFSVKYLPPRLNAAQIDIIAQRASSVITLRTLKHVKEVFSKFAPDSWLEALEDIPLPTTRCTVKVSA

SEQ ID NO: 159488 - protein, 77 aa, Heterodera glycines
  Homolog annotation: Hit_ID=CAC21848.1; Match level="QueryCoverage =80%, HitCoverage=27%, E-value=1e-09, Identity=53%"; Hit description =hypothetical protein [Globodera rostochiensis]
  Coding regions on vcDNA: vcDNA=SeqID_85911; Strand=-; Position=125-358
PNAEYLYGAGDTVGIGVNSATRQIIFTKNGLRLDTSDFFVDPSFADDSLYPFVSLLDSGDKIEANFGPNFKFDLATL

SEQ ID NO: 159489 - protein, 86 aa, Heterodera glycines
  Homolog annotation: Hit_ID=AAO33474.1; Match level="QueryCoverage =100%, HitCoverage=62%, E-value=2e-43, Identity=98%"; Hit description= gland-specific protein g4g12 [Heterodera glycines]
  Coding regions on vcDNA: vcDNA=SeqID_85912; Strand=-; Position=198-458
GLLFTSLATGGAEAIGRSNAQGGNAAGLVPSHVTNRSMAPPPPPVQFEMGANRLEKMRAHLRELAEKMPVNESKRLSPSGPGPHHH

SEQ ID NO: 159490 - protein, 102 aa, Heterodera glycines
  Homolog annotation: Hit_ID=NP_496721.1; Match level="QueryCoverage =92%, HitCoverage=12%, E-value=1e-30, Identity=67%"; Hit description =carnitine palmitoyltransferase 1A (84.1 kD) (2N80) [Caenorhabditis elegans]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_85913; Strand=-; Position=198-506
DKIFPPQYLLSTSQTPLNQFDSEQEGISMAQKLKLVSAGGGFGPVTDAGYGVSYIVAGEDQISFHISSKKSATNTSSIRFREDLKKTLLEMKQLLTVEQRMT

SEQ ID NO: 159491 - protein, 142 aa, Heterodera glycines
  misc_feature (7)..(7): Xaa can be any naturally occurring amino acid
  Coding regions on vcDNA: vcDNA=SeqID_85914; Strand=+; Position=2-427
GLMGNGXRTSRHQIPSVSMEKSNLPSNKNTWRTPSRLICNFEESILNGRIPANSVVSGFRLQLTVIGNGVSTDNRLSFPASKRLTLPVLTYFFNDLMSQHSGRFPVAVPPSPLHLARCELAAENVPIPKRCTLQIVLLRPCG

SEQ ID NO: 159492 - protein, 70 aa, Heterodera glycines
  Coding regions on vcDNA: vcDNA=SeqID_85915; Strand=+; Position=253-462
KALIVHIHARRWAPFSQCCSSSSSVSVKNSSPSPEEEDSSKSSSSSSSSSSSSSSVVVSPATLESSSSSS

SEQ ID NO: 159493 - protein, 86 aa, Heterodera glycines
  Homolog annotation: Hit_ID=AAO33474.1; Match level="QueryCoverage =74%, HitCoverage=46%, E-value=6e-26, Identity=96%"; Hit description =gland-specific protein g4g12 [Heterodera glycines]
  Coding regions on vcDNA: vcDNA=SeqID_85916; Strand=+; Position=2-259
GKSSKSTRHSNKILKDPKKCQHFQILLIVLLAVVSFRLSASIGDKKTANDGSGNNSSAGIGTKIKRIVTAGLLFTSLATGGAEAIG

SEQ ID NO: 159494 - protein, 69 aa, Heterodera glycines
  Homolog annotation: Hit_ID=NP_418925.1; Match level="QueryCoverage =95%, HitCoverage=28%, E-value=2e-10, Identity=46%"; Hit description =hypothetical protein CC0106 [Caulobacter crescentus CB15] gb|AAK22093.1| conserved hypothetical protein [
  Coding regions on vcDNA: vcDNA=SeqID_85917; Strand=+; Position=3-209
SIAAACAVSFVCFALTGSLSRLLGEVGMAIIVKVLGLILCALAIQFILLGLGEAIPGMISGAVTTPYPA

SEQ ID NO: 159495 - protein, 136 aa, Heterodera glycines
  Coding regions on vcDNA: vcDNA=SeqID_85918; Strand=+; Position=3-410
FFFFFFFCFFFFFFFFFFFFFFYLGLGVKPNASRKIKIKPTGGKCPSYSGTIPLRQKKPFFFPPGFFLQGRLPVRRKKHLPRPGIPKGRGAGLPRPKQGILCQIPRLGGPFHFLRKKFGAPVRYLDFAPGLGEKFR

SEQ ID NO: 159496 - protein, 87 aa, Heterodera glycines
  Coding regions on vcDNA: vcDNA=SeqID_85919; Strand=-; Position=1-261
MGRQAKGTAGVCQDIAAGTTCHSDDGPNGRSAAATAQLWPAPMKQCLCAYMLCLLINGSSISFSISFVFDEFNDKIGSKKKKKKKKK

SEQ ID NO: 159497 - protein, 92 aa, Heterodera glycines
  Homolog annotation: Hit_ID=CAE62813.1; Match level="QueryCoverage =88%, HitCoverage=9%, E-value=6e-16, Identity=49%"; Hit description =Hypothetical protein CBG06989 [Caenorhabditis briggsae]
  Coding regions on vcDNA: vcDNA=SeqID_85920; Strand=+; Position=9-284
MLNISSPNPIADKEVLNGFEDLYEAFVHFFTRGAPAERCMVNDAAFDRMIHTVEDKHLRAQHYIGGNAALMAQKIASSFPAATAYLVGPIGP

SEQ ID NO: 159498 - protein, 89 aa, Heterodera glycines
  misc_feature (45)..(45): Xaa can be any naturally occurring amino acid
  misc_feature (75)..(75): Xaa can be any naturally occurring amino acid
  Homolog annotation: Hit_ID=XP_523367.1; Match level="QueryCoverage =91%, HitCoverage=57%, E-value=3e-16, Identity=60%"; Hit description =PREDICTED: similar to rRNA intron-encoded homing endonuclease [Pan troglodytes]
  Coding regions on vcDNA: vcDNA=SeqID_85921; Strand=-; Position=1-266
NSWTVARRTTAKAFGKNVFINQERKSEVRRRSDTALVLTVNDANXAIRRRIYSPWWGASRKRKSSGSGGSMVQSXTKGIDGRAPPGVEP

SEQ ID NO: 159499 - protein, 132 aa, Heterodera glycines
  misc_feature (95)..(95): Xaa can be any naturally occurring amino acid
  Homolog annotation: Hit_ID=CAE72912.1; Match level="QueryCoverage =78%, HitCoverage=45%, E-value=3e-39, Identity=73%"; Hit description =Hypothetical protein CBG20230 [Caenorhabditis briggsae]
  Gene Ontology: Mol. function=ATP binding; Cellular component=Golgi apparatus; Biological process=two-component signal transduction system (phosphorelay)
  Coding regions on vcDNA: vcDNA=SeqID_85922; Strand=+; Position=302-697
MLCCCSLLASTLHRRPCTLFQEFPTSTFPMYHYQYRIIVIGDSTVGKSSLLRYFTEGKNAEISDPTVGVDFYARMIETKPNYRIKLQLWDTAGQXKFRSITGRIVEFRRSIVVYDITNRRTFEHVVDWMTEA

SEQ ID NO: 159500 - protein, 103 aa, Heterodera glycines
  misc_feature (20)..(20): Xaa can be any naturally occurring amino acid
  Homolog annotation: Hit_ID=CAE71194.1; Match level="QueryCoverage =96%, HitCoverage=18%, E-value=5e-37, Identity=77%"; Hit description =Hypothetical protein CBG18052 [Caenorhabditis briggsae]
  Gene Ontology: Mol. function=chaperone activity; Cellular component =cytoskeleton; Biological process=cell organization and biogenesis
  Coding regions on vcDNA: vcDNA=SeqID_85923; Strand=+; Position=2-310
GVEQYAFRAFADALESIPAXLAENSGLPPIDTLTELKAKQIEAQNPWLGVDCLQTGTNDMKEQGIIETLLSKREQISLATQVVRMVLKIDDVRVPDDDERSFA

SEQ ID NO: 159501 - protein, 99 aa, Heterodera glycines
  misc_feature (41)..(41): Xaa can be any naturally occurring amino acid
  Homolog annotation: Hit_ID=CAE59495.1; Match level="QueryCoverage =90%, HitCoverage=24%, E-value=3e-15, Identity=42%"; Hit description =Hypothetical protein CBG02880 [Caenorhabditis briggsae]
  Coding regions on vcDNA: vcDNA=SeqID_85924; Strand=-; Position=132-432
QSTDYDPFKADVWSLGIVGYVMLTNRMPFRGDVSTAHLVEXQRSRRYRFPSQMSVTEHCRCTIDNMLTFEPDDRPSIFDVRNLPWFASAVNDANSDALS

SEQ ID NO: 159502 - protein, 73 aa, Heterodera glycines
  Coding regions on vcDNA: vcDNA=SeqID_85925; Strand=+; Position=2-223
GRPAGGREFTSDSVDFFLNEFVMSDGNTFVTYSANPLRIYWAMLQHRSQLLWFRYLYLAISRYIYVNNFVVII

SEQ ID NO: 159503 - protein, 56 aa, Heterodera glycines
  Coding regions on vcDNA: vcDNA=SeqID_85926; Strand=-; Position=1-168
MNIRCSGVCIAHIGRTLSVPRLLTASVVWCKSPWSTRTLGTRVPPLRPPPPLPSPS

SEQ ID NO: 159504 - protein, 102 aa, Heterodera glycines
  Coding regions on vcDNA: vcDNA=SeqID_85927; Strand=-; Position=153-461
PMACCGHFAWDFFKNNFALLIEKYGSVNSNVFLHCFDCVTSGFCSNAMAEDIMEFFKKELDEHSLKTLERPLRQAVESIKVKESLLKNNVPDLDKYLQNVGY

SEQ ID NO: 159505 - protein, 170 aa, Heterodera glycines
  misc_feature (111)..(111): Xaa can be any naturally occurring amino acid
  Homolog annotation: Hit_ID=CAE56085.1; Match level="QueryCoverage =97%, HitCoverage=31%, E-value=2e-58, Identity=57%"; Hit description =Hypothetical protein CBG23668 [Caenorhabditis briggsae]
  Gene Ontology: Mol. function=sphingomyelin phosphodiesterase activity; Cellular component=integral to plasma membrane; Biological process=sphingomyelin metabolism
  Coding regions on vcDNA: vcDNA=SeqID_85928; Strand=+; Position=6-514
MQCAYRFNVATLNCWLLPHPWPIGSKHKQFRLQKLIDELKNSRFDVIALKEVWSEKIFLQIAHELNGFFPHSHYFHSGFTGSGTCVISKHPIVSTLLHRYSLNGFPHHVHXGDWFGGKIVGMVEIMVEQYRVAFYTTHLHAEYNRENDLFLPHRISQCFEMSQFIRHTSR

SEQ ID NO: 159506 - protein, 96 aa, Heterodera glycines
  Homolog annotation: Hit_ID=XP_311142.1; Match level="QueryCoverage =85%, HitCoverage=6%, E-value=7e-15, Identity=42%"; Hit description =ENSANGP00000020415 [Anopheles gambiae]
  Gene Ontology: Cellular component=cytoplasmic vesicle
  Coding regions on vcDNA: vcDNA=SeqID_85929; Strand=-; Position=2-289
QLTNRKGDDQLSEQLLVASKHREFVLASRTLDKIGAVLTHPHGPWSSPDDKKKIFWKLDVWEDDSRRRRRFVQNPWGKRHKLAATMHQKKKKKKKK

SEQ ID NO: 159507 - protein, 96 aa, Heterodera glycines
  misc_feature (13)..(13): Xaa can be any naturally occurring amino acid
  Coding regions on vcDNA: vcDNA=SeqID_85930; Strand=-; Position=2-289
PRHRMVTLSLAVXTTTAAEVGWDGSVPPASFSFVALLAFLHEGKKQPFAVFCCCPSLALLRRCRGRGSITRRGRRRTKVDGRGGRGHGVMLTISHP

SEQ ID NO: 159508 - protein, 58 aa, Heterodera glycines
  Coding regions on vcDNA: vcDNA=SeqID_85931; Strand=-; Position=195-371
PRSCVPCARSTGSTLSSPTSNWPFSGTLATTFVRLKIDGLLAVVTVFPSSPRLPLKCA

SEQ ID NO: 159509 - protein, 139 aa, Heterodera glycines
  misc_feature (36)..(36): Xaa can be any naturally occurring amino acid
  Coding regions on vcDNA: vcDNA=SeqID_85932; Strand=+; Position=36-455
KMAIIAKVFPLLLLFLMSMASLSFCANWPKNTVPLXTYVDESLHLHCKLCNKIANSASDGAKWLQKSEEGYVSLLKFCIDELRNSDERSQTLPAEEGHHQFLFACHGFTADKRKLSETIGAIAKKEADFCKEQKYCQMF

SEQ ID NO: 159510 - protein, 101 aa, Heterodera glycines
  Homolog annotation: Hit_ID=XP_418200.1; Match level="QueryCoverage =70%, HitCoverage=7%, E-value=2e-10, Identity=45%"; Hit description =PREDICTED: similar to BTB (POZ) domain containing 2 [Gallus gallus]
  Coding regions on vcDNA: vcDNA=SeqID_85933; Strand=+; Position=1-306
GAALRWADKKCRQNGTERSAENRRAVLGPALFKIRFPLFTKEQFSEKIVLSGVLTHREVISVFLYHSLPTKRSAQMFPLQFAAKHRAGHHAYSAYYDDGYY

SEQ ID NO: 159511 - protein, 161 aa, Heterodera glycines
  Homolog annotation: Hit_ID=CAE60358.1; Match level="QueryCoverage =95%, HitCoverage=89%, E-value=3e-65, Identity=77%"; Hit description =Hypothetical protein CBG03955 [Caenorhabditis briggsae]
  Gene Ontology: Mol. function=calcium ion binding; Cellular component =plasma membrane; Biological process=regulation of action potential
  Coding regions on vcDNA: vcDNA=SeqID_85934; Strand=+; Position=1-486
GRSSQISADELQQALSNGTWKPFNPETCRMMISMFDSNNDGGINFQEFGALWEYINDWTRTFRTFDRDNSGNIDRDELVNALTQFGYRLSGTFYDMLMRKFDRTQSGRINFDDFIQLCVVLQTLTTAFREKDTDRDGWIRIYYEEFLAMVFSLKMSMMAKQ

SEQ ID NO: 159512 - protein, 91 aa, Heterodera glycines
  Coding regions on vcDNA: vcDNA=SeqID_85935; Strand=-; Position=2-274
EECLVPLLIVMRLAMRFLPFSIYASTNISPTDAPPPPPIVFFSPLIISLAPQILLSVCLIVLLRVQLLLGLFLKKIYRLKPFAKKKKKKKK

SEQ ID NO: 159513 - protein, 170 aa, Heterodera glycines
  misc_feature (11)..(11): Xaa can be any naturally occurring amino acid
  Coding regions on vcDNA: vcDNA=SeqID_85936; Strand=-; Position=0-509
KCDIELALLGXVFVKLQLVLLLLHQLLHNLFVFNQRRLIGGRGKESAMDSWPNDAQILETTDKQTDKVKLSRKGKIERVMREWRGGGERRRDTVPKAEDEVQKAAEVFQWQSPTFVGLFVLLLTLMLLFERNMHQSGQEISAELQNVSEKSGERESPSKVSKTKATKESP

SEQ ID NO: 159514 - protein, 169 aa, Heterodera glycines
  Coding regions on vcDNA: vcDNA=SeqID_85937; Strand=+; Position=1-507
GGQIFTISLDLADGNGVRVRFSFGSVSPTPWYSVRYPPYKSDFSLVIEVDKKAVLRRSYEETRLLKSGWTAEEREAQWDSGEQRAEVNIGLNTELVKGECVMCLEPNSDTLFYPCCHLNVHRKCLRDENVEECYACREKCEELISIRQRDIDCQFCHPNECREFNSFFY

SEQ ID NO: 159515 - protein, 131 aa, Heterodera glycines
  Coding regions on vcDNA: vcDNA=SeqID_85938; Strand=-; Position=0-392
ARISMHCARLHRHTGEARGHYEQSGKIAKHPRLGKCCKHLQTVEHFQVVPAQLLRFNGIRCFQQQRDHRWQFTKNCMSTVQIANWFRVNALVIHEFFPGTDFVVFRVVYLSMRNTDANWSTDNEQQTVGSP

SEQ ID NO: 159516 - protein, 77 aa, Heterodera glycines
  Coding regions on vcDNA: vcDNA=SeqID_85939; Strand=-; Position=42-275
GHTYANLLRKCRSMNRSVCHRVDPTLIIIRAMDGSNGGRKNGCLVFRFYSILFYLLVFQNKFLPQLFKLFVVLNLFR

SEQ ID NO: 159517 - protein, 51 aa, Heterodera glycines
  Coding regions on vcDNA: vcDNA=SeqID_85940; Strand=+; Position=96-248
MERTFVCIKPESVRRCLVGKIIERFEANVFRLIAIKMIVATRKQAMDHYVA

SEQ ID NO: 159518 - protein, 108 aa, Heterodera glycines
  Coding regions on vcDNA: vcDNA=SeqID_85941; Strand=-; Position=0-323
QKLNNKNNKDERRRKISQKGKGRRWKIVLCKVYRGFCPKVTTYIVFVCLRFLIYVFRFFNQRCTAFFFSSANFFLFAFGVLPVVGRFCFAFSRFSSSTISFRMLSICP

SEQ ID NO: 159519 - protein, 139 aa, Heterodera glycines
  Homolog annotation: Hit_ID=CAE73810.1; Match level="QueryCoverage =55%, HitCoverage=6%, E-value=8e-29, Identity=76%"; Hit description =Hypothetical protein CBG21360 [Caenorhabditis briggsae]
  Gene Ontology: Cellular component=cytoplasmic vesicle; Biological process=ommochrome biosynthesis
  Coding regions on vcDNA: vcDNA=SeqID_85942; Strand=+; Position=79-498
GEQREKEEKRWSKARYIAACIDEIKVELRQDSIFVKANAIEKLAYLHMLGYDISWAAFNIIEVMSSTRYSEKRIGYLAAVQAFNDETDCQQCHRRFGRNVTHQIIRCARPVAQRVRAKHCQAVHLPTVQIGGGRRLGQN

SEQ ID NO: 159520 - protein, 99 aa, Heterodera glycines
  Homolog annotation: Hit_ID=NP_509854.1; Match level="QueryCoverage =100%, HitCoverage=28%, E-value=4e-41, Identity=79%"; Hit description= phosphoribosyl pyrophosphate synthetase-associated protein (39.0 kD) (XL693) [Caenorhabditis elegans] em
  Gene Ontology: Mol. function=enzyme inhibitor activity; Biological process=nucleobase, nucleoside, nucleotide and nucleic acid metabolism
  Coding regions on vcDNA: vcDNA=SeqID_85943; Strand=-; Position=125-424
IIDDAQSFVAAAEVLKARGAYKIYVVATHGLMSLDAPSLLESSPIDEIIVTNTVPHEMQKLRCHKIKTVDISLLLSEAIRRIYNNESMGPLFRDLTIDD

SEQ ID NO: 159521 - protein, 214 aa, Heterodera glycines
  Homolog annotation: Hit_ID=AAM33404.1; Match level="QueryCoverage =83%, HitCoverage=35%, E-value=2e-26, Identity=39%"; Hit description =putative protein phosphatase FEM-2 [Caenorhabditis remanei]
  Gene Ontology: Mol. function=protein phosphatase type 2C activity; Cellular component=cytoplasm; Biological process=inactivation of MAPK (osmolarity sensing)
  Coding regions on vcDNA: vcDNA=SeqID_85944; Strand=+; Position=1-642
GEYFTQFLQQIVDGSRPLPPSLFAHCRVLPLSFCAQKNRKPKMEDRHLLLPSLDIVEPEISQKLSKKVDPSAALFAVFDGHNGAECATFASAHLTECFLDAFAQSDDIEKILNDAFERLDKRITEKCTSENIKSGTTVSCVYLEGTTSAYLAWCGDSAIGLLTDTAVDTLSTPHKPEDKGEMRRIEQAGGMVVSIHGVPRLNGVLNLSRSLGDV

SEQ ID NO: 159522 - protein, 71 aa, Heterodera glycines
  Coding regions on vcDNA: vcDNA=SeqID_85945; Strand=+; Position=140-352
NLTPFAYLIYTLIHHHMLFLQTLDHSPDCPLSNSDRSWFLIRVLCLDFVLCCDFCFMMKTILSSFSPFFYF

SEQ ID NO: 159523 - protein, 148 aa, Heterodera glycines
  Homolog annotation: Hit_ID=AAP30834.1; Match level="QueryCoverage =99%, HitCoverage=61%, E-value=2e-78, Identity=78%"; Hit description =putative gland protein G10A06; Hg-G10A06 [Heterodera glycines]
  Coding regions on vcDNA: vcDNA=SeqID_85946; Strand=+; Position=73-516
MLRIALLISILALFGDCMDKGKRKLGGISINEPSEYGTKEKEAIATKENALTSKDPPTSAGGQNEAIPSPKKPSPKGKLKSDFGLNLAKAFPRPVPKGKKVENTLSSKDSASEAHKELAKEKNEENAQTSKVPTSMERQNEPIPSPKN

SEQ ID NO: 159524 - protein, 176 aa, Heterodera glycines
  Homolog annotation: Hit_ID=AAP30760.1; Match level="QueryCoverage =100%, HitCoverage=63%, E-value=1e-93, Identity=100%"; Hit description=putative gland protein G10A07 [Heterodera glycines]
  Coding regions on vcDNA: vcDNA=SeqID_85947; Strand=+; Position=41-568
MRTILFIAMVCLVMAVLMEMANSKAVKKDNKKGAVAASPAKGKASPKGGKSPAKGKAAKKLKPKKDAKGIKAKKAKPAKKGKAAKAVKGAPKTVKKLAIAKTAQAKDKKSPAKPMVLKAVPPHQMHLMNEKVQTAVSPPAHARSLATVPYSTPVAADRNSLPSYTSDGTNLDMAHE

SEQ ID NO: 159525 - protein, 44 aa, Heterodera glycines
  Homolog annotation: Hit_ID=ZP_00357698.1; Match level="QueryCoverage =84%, HitCoverage=22%, E-value=1e-12, Identity=91%"; Hit description =hypothetical protein Chlo02002738 [Chloroflexus aurantiacus]
  Coding regions on vcDNA: vcDNA=SeqID_85948; Strand=+; Position=2-136
FFFFFFFFFFFFFFFFFFFFFFFFFFFFFFKKKKIFSKKNPPFF

SEQ ID NO: 159526 - protein, 55 aa, Heterodera glycines
  Homolog annotation: Hit_ID=CAE71709.1; Match level="QueryCoverage =100%, HitCoverage=65%, E-value=8e-15, Identity=69%"; Hit description= Hypothetical protein CBG18686 [Caenorhabditis briggsae]
  Gene Ontology: Mol. function=RNA binding; Cellular component=nucleus; Biological process=mRNA cleavage
  Coding regions on vcDNA: vcDNA=SeqID_85949; Strand=+; Position=1-168
GVVTNVRIVYDRETNRPKGFGFCEFQDQQGAQNAVTNLNGAELNGRALRVNWTNK

SEQ ID NO: 159527 - protein, 76 aa, Heterodera glycines
  Coding regions on vcDNA: vcDNA=SeqID_85950; Strand=+; Position=1-228
FFFFFFFFQPLVLVRAKTFKAYGNKPNLSRGKFNPLNSHHRGKPWTGGPKAKPGPQTPPYFHFASAGGFLSNLALF

SEQ ID NO: 159528 - protein, 43 aa, Heterodera glycines
  Coding regions on vcDNA: vcDNA=SeqID_85951; Strand=-; Position=225-356
QGFGAGNFKALFESIEAEQNERGNLFYKDVAVGGEKIEAKKSE

SEQ ID NO: 159529 - protein, 129 aa, Heterodera glycines
  Homolog annotation: Hit_ID=CAF97140.1; Match level="QueryCoverage =95%, HitCoverage=16%, E-value=1e-13, Identity=28%"; Hit description =unnamed protein product [Tetraodon nigroviridis]
  Gene Ontology: Mol. function=damaged DNA binding; Cellular component =nucleus; Biological process=DNA damage response, signal transduction resulting in induction of apoptosis
  Coding regions on vcDNA: vcDNA=SeqID_85952; Strand=+; Position=158-544
MSEESEEALFCISKHDVKEISQVVKAMAFRGHCTLNVSNEGIRLAVDDQHNQQGSAYFRSEHFQDFNFRTQTCSIKIPMRPLMEALNMFSGTMTMVQISWNGKGFPLLVILEDEGVVVHTEIRTLIAPE

SEQ ID NO: 159530 - protein, 159 aa, Heterodera glycines
  Homolog annotation: Hit_ID=NP_499556.1; Match level="QueryCoverage =99%, HitCoverage=34%, E-value=4e-62, Identity=73%"; Hit description =NitFhit related protein, nitrilase and fragile histidine triad fusion protein (49.9 kD) (nft-1) [Caenorha
  Gene Ontology: Mol. function=nitrilase activity
  Coding regions on vcDNA: vcDNA=SeqID_85953; Strand=+; Position=2-478
GSEFSSRGHKLVSPVAETPVGRLGLSICYDLRFPELSLYQRNRGAQVLSFPSSFTLNTGLAHWEPLLRARAIECQCYVVAAAQTGKHNDKRISYGHSMVVDPWGTVVAQCTDREDLCFAELDLDYVEEVRTNMPVFSHRRSDLYSLHFNEWDEPKDSDT

SEQ ID NO: 159531 - protein, 147 aa, Heterodera glycines
  Coding regions on vcDNA: vcDNA=SeqID_85954; Strand=+; Position=36-476
YIKIVRGFYGWLLRSLDWINRQILHRLSLSAHNREDMIIEKFPADRHPGLLQRLNELKRSETVYNGGVFILFTIPYRYYEDYASITVNQAVNDINAMDKTGVLQNLKIAYIECNVGYWHEWDTTKKEPKSIFKTDETLGLRQLPTLL

SEQ ID NO: 159532 - protein, 109 aa, Heterodera glycines
  Coding regions on vcDNA: vcDNA=SeqID_85955; Strand=-; Position=141-470
LTARSARSNSKSKRTAKDARKKALLLAIMIFRRRLPVVKVAQGTKRRRNVHGHGTTTKRIRGQHYQEGSPIVQIRLRVKEQAQTECDHIKLISLLYKCVPSFCSSPKQM

SEQ ID NO: 159533 - protein, 92 aa, Heterodera glycines; identical to SEQ ID NO: 158780
  Homolog annotation: Hit_ID=AAP30756.1; Match level="QueryCoverage =100%, HitCoverage=100%, E-value=4e-52, Identity=100%"; Hit description=putative gland protein 10C02 [Heterodera glycines]
  Coding regions on vcDNA: vcDNA=SeqID_85956; Strand=-; Position=192-470

SEQ ID NO: 159534 - protein, 104 aa, Heterodera glycines
  Homolog annotation: Hit_ID=NP_498935.1; Match level="QueryCoverage =91%, HitCoverage=55%, E-value=8e-11, Identity=34%"; Hit description =single-strand binding protein like (3J859) [Caenorhabditis elegans] gb|AAA50616.1| Hypothetical protein P
  Coding regions on vcDNA: vcDNA=SeqID_85957; Strand=-; Position=171-485
GSQPLVKQTAQGPAFASFNLYTNVERRLGDGTTTTNTEVHSVVAFGSMAKYVEKNVERGTRVYLTGCLHYTGGALFPDGTRSPRICSVNLESIYPLSKQGAILR

SEQ ID NO: 159535 - protein, 185 aa, Heterodera glycines
  Coding regions on vcDNA: vcDNA=SeqID_85958; Strand=+; Position=3-557
DSVITFLRYNKQIFDKGINLRLDVHFLYKNAKDAQPIWDVFARKIWPIVVPNIRHLAFSEADHLDNMRRRISPTILTDLDQLDSIDYEYLLPDAIISDDGPNATAGQALAKWLNTPTTNGQPKQFHCDFMSATIKWVNAFKEAFLHATTSSANYIIRLALIDEETPIESFELVNGRTNEKADNGE

SEQ ID NO: 159536 - protein, 190 aa, Heterodera glycines
  Coding regions on vcDNA: vcDNA=SeqID_85959; Strand=+; Position=1-570
GRVLLERNEIWRDVRTDGQRSAILEKANKTQRIGPAFAALIAKICFAASIDPSDDGFSFKDRHGFSLMLAKLAELLAEDTGESCNLSRKTIFELLGSSSEWNLGLIGPLLPKYSFFMTKRASRSFSVRSFHRSFDVIISRVPTRPFPPLSKHCSALTHSRRPFPGRLTSSFHTFWIPVFRHEISSVPSAK

SEQ ID NO: 159537 - protein, 155 aa, Heterodera glycines
  Coding regions on vcDNA: vcDNA=SeqID_85960; Strand=+; Position=71-535
IQLNVNTMEIFDEFIVVDEEAIGQFRGAFTGKSSHWKMIRFVKLEFTIVTTDFNKVLKIADIGNASSSNPLNEEPLAQIIHWNWDKNGTQQISETKTLDKGSEVNFAIFDDTSSFVIRILKKREKKSEEKRNTLTNFPAPSDSSPDDDLTVKIGE

SEQ ID NO: 159538 - protein, 66 aa, Heterodera glycines
  Homolog annotation: Hit_ID=CAB58173.1; Match level="QueryCoverage =98%, HitCoverage=20%, E-value=3e-12, Identity=46%"; Hit description =putative nucleosome binding protein [Anisakis simplex]
  Gene Ontology: Mol. function=chaperone activity; Cellular component =cytoplasm; Biological process=nucleosome assembly
  Coding regions on vcDNA: vcDNA=SeqID_85961; Strand=-; Position=168-368
TEEMDDIEEQKTNDDFEVGQIIREQLIPRAVLFFTGEAAEEDEYDEFDDEEEMGDEQSEEEDNAMH

SEQ ID NO: 159539 - protein, 69 aa, Heterodera glycines
  Coding regions on vcDNA: vcDNA=SeqID_85962; Strand=+; Position=88-294
LNRCGVRLRCRRDISASRSICSALPIFLFVSHRNDIHHQSANKNDKSETDNTNVYAKPNICFTKAILTA

SEQ ID NO: 159540 - protein, 59 aa, Heterodera glycines
  Coding regions on vcDNA: vcDNA=SeqID_85963; Strand=-; Position=40-219
IYLCFKFVNCLLMICCFSLLWNFKNFFFVFFFFFIHFDQSAAMSFLFVSWSNICFNFGN

SEQ ID NO: 159541 - protein, 65 aa, Heterodera glycines
  Coding regions on vcDNA: vcDNA=SeqID_85964; Strand=+; Position=56-253
IGQKMLQSNTNKHPNQTKRINRTGQTFATNLEEASVDTRTSVALFVQHLLLFLLLLLLINRKFAV

SEQ ID NO: 159542 - protein, 113 aa, Heterodera glycines
  Homolog annotation: Hit_ID=NP_492711.1; Match level="QueryCoverage =78%, HitCoverage=8%, E-value=5e-16, Identity=45%"; Hit description =glutamyl (E) tRNA Synthetase, glutaminyl (Q) tRNA Synthetase (125.2 kD) (ers-2) [Caenorhabditis elegans] e
  Gene Ontology: Cellular component=mitochondrion; Biological process =protein complex assembly
  Coding regions on vcDNA: vcDNA=SeqID_85965; Strand=-; Position=113-454
KRAENFAVKTVRFDHLISTPIIGKEEDWKEFVNRDSEHFGTLLAEPALQKVNCGDILQIQRKSFYICDAKTANSMTLIEIPDDRETKNAAQKGPEGKETKKEGKETKKAKIVN

SEQ ID NO: 159543 - protein, 116 aa, Heterodera glycines
  Homolog annotation: Hit_ID=AAH56559.1; Match level="QueryCoverage =99%, HitCoverage=26%, E-value=3e-32, Identity=56%"; Hit description =Zgc:66068 [Danio rerio]
  Gene Ontology: Mol. function=dolichyl-diphospho-oligosaccharide -protein glycosyltransferase activity; Cellular component=endoplasmic reticulum
  Coding regions on vcDNA: vcDNA=SeqID_85966; Strand=+; Position=2-349
GKFPLAFFSLCLFAFAEVAADRVLLLIDNPTIRESHSVFIKSLEERGHSVIIAMADDPNLSLIKFGEFLYDHLIIFAPSVDDFGGNINVDEITKFIDGGGNVLVAADQNLGDAIHD

SEQ ID NO: 159544 - protein, 175 aa, Heterodera glycines
  Coding regions on vcDNA: vcDNA=SeqID_85967; Strand=+; Position=1-525
GGIIINQMLFFLLLLSLSLFLLLVPNVCCHNAELVLLDPSQIGFFLPNYFVKKFEKKLFVKFAREFRPVFVAFAMLEPPYLYVDQSENIRSVDRAEVEKLMKFKLVSRLRKEKKLMETAQFNLTLAHDIQGALFSVPVPSDERSLKFDRNSVIFEHCNANLIDNDNNPRCIYFYL

SEQ ID NO: 159545 - protein, 110 aa, Heterodera glycines
  Coding regions on vcDNA: vcDNA=SeqID_85968; Strand=-; Position=209-541
LKRRNVQFDCLYRMEFALREFFGESPADVFAEEIISRVKRFHLHAVAQFLRLNSKTVDGENCTKIVQVKNEANEFSPPDTFLATLLKKKRKKNNSKGDEWAEWDAENGAF

SEQ ID NO: 159546 - protein, 133 aa, Heterodera glycines
  Homolog annotation: Hit_ID=AAQ75554.1; Match level="QueryCoverage =93%, HitCoverage=43%, E-value=2e-46, Identity=70%"; Hit description =EXC-4 [Caenorhabditis elegans] emb|CAD21669.2| Hypothetical protein Y105E8A.22 [Caenorhabditis elegans] sp
  Coding regions on vcDNA: vcDNA=SeqID_85969; Strand=+; Position=51-449
MSAKPLLELYVKASGIDSRRIGACLFCQEFWMELYALYEVGCVRVEVKTVNVDSEGYKKHFSGAQPPIMVEQDKGTANADNTDIERRIFQLCNQFHVPLFEKDPEVAKTIQDLYRNFKIFLQAKTNFGQRQAA

SEQ ID NO: 159547 - protein, 90 aa, Heterodera glycines
  Homolog annotation: Hit_ID=CAE62352.1; Match level="QueryCoverage =84%, HitCoverage=31%, E-value=2e-09, Identity=42%"; Hit description =Hypothetical protein CBG06429 [Caenorhabditis briggsae]
  Coding regions on vcDNA: vcDNA=SeqID_85970; Strand=+; Position=3-275
EIQQIHDDGSLSAEQKMERIDSIICTLPENVIDQIPDPPEVAQLPADVRQRVKQIERQQGKSFSTKFEEIMKYVDTLPEGTKSAAKNIFH

SEQ ID NO: 159548 - protein, 103 aa, Heterodera glycines
  Coding regions on vcDNA: vcDNA=SeqID_85971; Strand=+; Position=88-396
ANNKYNNFAMSAHTYKQITTELAYQYIWVAYRNSSGTVRLCVVFGHPSSSPSQFRRRFPSCCCASDELGFAGPRRGAQLAHADVCSCHSHGGAALLHLLRRLC

SEQ ID NO: 159549 - protein, 90 aa, Heterodera glycines
  Coding regions on vcDNA: vcDNA=SeqID_85972; Strand=+; Position=88-357
ANNKYNNFAMSAHTYKQITTELAYQYICVAYRNSSGTVRLCVVFGHPSSSPSQFRRRFPSCCCASDELGFAGPRRGAQLAHADVCSCHSH

SEQ ID NO: 159550 - protein, 127 aa, Heterodera glycines
  Coding regions on vcDNA: vcDNA=SeqID_85973; Strand=-; Position=116-499
KESKDKLLSPPPPLFGKSASRKGRSNSICLARKTTDSTPTILSTSKNNLSESFLSNAWQSDDRRQNNESSAFSTLSCPPSVVPGPFIFFSIDCTNWRRRKVTKLVPNLCCCCCASKSEQKNVKIEWT

SEQ ID NO: 159551 - protein, 146 aa, Heterodera glycines
  Coding regions on vcDNA: vcDNA=SeqID_85974; Strand=-; Position=2-439
ERANQTKEEEERMNNKEAELNSRKDNKEYHSKNAENKSNDEFYEETEINGLYQQEVPSMPQDKFYNNFEQNREQHQNRAESGNYDDQRAKEQIYANPLDENESQYYLNRPETYPYDNQREDQHTQVDTYVHDGQNSPKKKKKKKKK

SEQ ID NO: 159552 - protein, 160 aa, Heterodera glycines
  Homolog annotation: Hit_ID=AAO53196.1; Match level="QueryCoverage =95%, HitCoverage=18%, E-value=6e-28, Identity=37%"; Hit description =similar to Arabidopsis thaliana (Mouse-ear cress). F13F21.2 protein [Dictyostelium discoideum]
  Gene Ontology: Mol. function=Pol II transcription elongation factor activity; Cellular component=transcription elongation factor complex; Biological process=regulation of transcription from Pol II promoter
  Coding regions on vcDNA: vcDNA=SeqID_85975; Strand=+; Position=10-489
HPKRLELLSSGANQTVVRWSYSDSDSIWLPISRFGDIVGDEVNCYDITYSPCGRYALCHSFLGGFHFWQIDSKGAVLPKCFPISGHFAEVTDLCWSPDGSFLLSCSADMTTRIFAKHKQLDFFFEIARPQTHGHPINCLTSVDRNLFVSGGEEKIFRVFQ

SEQ ID NO: 159553 - protein, 127 aa, Heterodera glycines
  Homolog annotation: Hit_ID=CAE66708.1; Match level="QueryCoverage =62%, HitCoverage=20%, E-value=1e-14, Identity=46%"; Hit description =Hypothetical protein CBG12053 [Caenorhabditis briggsae]
  Coding regions on vcDNA: vcDNA=SeqID_85976; Strand=+; Position=67-450
TFDRLNYQITPFLFVLLSLLNISRLYIGSAINCFAKAEFRAGWVQYAHDYCLVESTYYLRTDESIPIEHEMRGQKRVAYYQALKSTQLLPLRKMPWNNRRTKAKRRRTKLRGRFCMPRGTESEHFFA

SEQ ID NO: 159554 - protein, 91 aa, Heterodera glycines
  Coding regions on vcDNA: vcDNA=SeqID_85977; Strand=+; Position=95-367
EHEKLTNNNVKNEGQQVEQREFIHSVHNVRVVLVQVAQIAMETDLNAKVQVAWVADVRDNAKNAMDFLVFLHCQRFVKVKDCLFPMRVFAV

SEQ ID NO: 159555 - protein, 128 aa, Heterodera glycines
  Coding regions on vcDNA: vcDNA=SeqID_85978; Strand=-; Position=0-383
IIQIDRSLLNNSFHSLLLITRVGSCVEKPVADLIAKNFNVNFVPLIRIFPSNRFLLPFCPFAFVSRNWTTDQQKTVDVVSSFQCQLFPGQFVGKIKGQNGVSKRQRSANENDEIDGGRSIGKCRFEFP

SEQ ID NO: 159556 - protein, 52 aa, Heterodera glycines
  Coding regions on vcDNA: vcDNA=SeqID_85979; Strand=-; Position=123-281
GRIDAKTDAGKCNGKCEETVSGRRWKYHSMKAPKLPIYFNPFVLCLTIFSIF

SEQ ID NO: 159557 - protein, 168 aa, Heterodera glycines
  Homolog annotation: Hit_ID=NP_060458.3; Match level="QueryCoverage =98%, HitCoverage=18%, E-value=7e-23, Identity=37%"; Hit description =similar to mouse D10Ertd802e protein [Homo sapiens] gb|AAH63798.1| Similar to mouse D10Ertd802e protein [
  Coding regions on vcDNA: vcDNA=SeqID_85980; Strand=+; Position=1-504
GEPWMVTDQLLPALPKITSKDPSVLMAVLGIYKIVHENTKFGINKEQCARSVLPYLISTAVEPTLNLQQFGQYMELVHQLIRRVETEQRHCLEQLSASQEEQRKITDFADFLNAQSNEMNKTNQSEVDLGDLARALSGTSANDGICNRTTDKRDSTTENSGETMAKGA

SEQ ID NO: 159558 - protein, 97 aa, Heterodera glycines
  Homolog annotation: Hit_ID=CAE60388.1; Match level="QueryCoverage =97%, HitCoverage=11%, E-value=2e-17, Identity=50%"; Hit description =Hypothetical protein CBG03989 [Caenorhabditis briggsae]
  Gene Ontology: Mol. function=ATP-binding cassette (ABC) transporter activity; Cellular component=mitochondrial inner membrane; Biological process=transport
  Coding regions on vcDNA: vcDNA=SeqID_85981; Strand=-; Position=137-430
SGRTSLFIAHRLATIVDADIIYVLDRGMVVEYGTHSQLVGLPGGKYADLWHSQHRIGAELELAQREAERQKKREEEEVMLDMELSEGKCCGGMTCNR

SEQ ID NO: 159559 - protein, 196 aa, Heterodera glycines
  Homolog annotation: Hit_ID=NP_871644.1; Match level="QueryCoverage =98%, HitCoverage=21%, E-value=6e-15, Identity=30%"; Hit description =putative cytoplasmic protein of ancient origin (3H529) [Caenorhabditis elegans]
  Coding regions on vcDNA: vcDNA=SeqID_85982; Strand=+; Position=3-590
DLKGVLFRPDRVVIAARNLANNAAESKRDGNTVCHFLNACSTYSPEATTHFYSYLGLEKFHKGVAKAMESGRSDEVLARLEAVRRRVLAAPMNVHFGGDPSQIRLGTCSSSASSPPITDIASQWAFLEQPIHQLLQCPADYGASEAQFGQSRAIVVGGADSAFLLQKTRFDDDWNGPSTMSTLLLCSYLQQSEGPL

SEQ ID NO: 159560 - protein, 35 aa, Heterodera glycines
  Coding regions on vcDNA: vcDNA=SeqID_85983; Strand=+; Position=1-105
FWFFFFFFFWNTPIFFIITQMTEYDATQTNILRRS

SEQ ID NO: 159561 - protein, 173 aa, Heterodera glycines
  Coding regions on vcDNA: vcDNA=SeqID_85984; Strand=+; Position=1-519
GNEPKTIPMDTETLTAADSLRSHFGSLTKGIPNRMHRSSLLSAWEPPTSSASILKNPEQQQPPLLSDITEVFSAQQNVLGPSTSIGKITEMTHNVPSQFNDKDTVKELISQSFGETKGEELGRIVQAKGRPVTMGKDRSTEQLNKSGETHRKDNLRRKSGVDNALLPSPFTDG

SEQ ID NO: 159562 - protein, 82 aa, Heterodera glycines
  Coding regions on vcDNA: vcDNA=SeqID_85985; Strand=-; Position=1-246
TSKKRERFNWQKEIGNGFHLNEGVQKGSPFAHPQHGSPVALFKMAFTRSNWGKKKASISRAHTSPKTTAKHSQTLNVMKMSP

SEQ ID NO: 159563 - protein, 160 aa, Heterodera glycines
  Coding regions on vcDNA: vcDNA=SeqID_85986; Strand=+; Position=3-482
GINKSMLNGQNVLVSDVHYPFPNGNDVMYVDQEEEAEHFAEGTSTQHQPNLRSDQQRRLSFIQTTALIKDELRKAEQGQASGNAIEILFEQVHRSNVEIDNVDNLRTLCRGGETLDQLIQLSVTQVEGMKDETAHCLDPGKLVARLKSFAISHRKTGDSD

SEQ ID NO: 159564 - protein, 108 aa, Heterodera glycines
  Coding regions on vcDNA: vcDNA=SeqID_85987; Strand=+; Position=1-327
YFFLFFIFYALCPSSPLFPLHPHLSAPTLPPALPPPGALTFSVSSKSQICSKCCPPPLTAVAVLPTFSFLRLIAHLFTGAAQSAHFHIPLQGFLIEPQKSEFNGRNGK

SEQ ID NO: 159565 - protein, 76 aa, Heterodera glycines
  Coding regions on vcDNA: vcDNA=SeqID_85988; Strand=+; Position=1-228
FFFFFFFFFPGFYFFFPSPLLYSYGPSFQWIFPFLPFPPPFFPFFPPRVSPPFLPIGNQLIFRVGKTQGLLFPGPL

SEQ ID NO: 159566 - protein, 137 aa, Heterodera glycines
  Coding regions on vcDNA: vcDNA=SeqID_85989; Strand=-; Position=2-412
TLSSVLAVPFIPSLLGPTILLVRLLIVNPGIVVEHLNGLFGTGKRNIGHRWRWHRHLRIGNGRLRNIGQTVQQSLVVVLMRHRLRRIVKHLLWVNARVLLLCWLLEVVVLPLVVIRRVRKGRLLRWCLAVVVVVHHP

SEQ ID NO: 159567 - protein, 97 aa, Heterodera glycines
  Coding regions on vcDNA: vcDNA=SeqID_85990; Strand=-; Position=113-406
KGQKMANESVPPLLPPVNLYDVRQIVVGPSNSASEKTYVFSQQQQGNLGGGANVFWDLVFFFGGLVACVMLAVFGYKELRKRGFFVADGERQNENLI

SEQ ID NO: 159568 - protein, 74 aa, Heterodera glycines
  Coding regions on vcDNA: vcDNA=SeqID_85991; Strand=+; Position=274-498
TKRKTIKWKTKTINQNPSITNLSGVDAQLPQVGGVEERKDFGHVRISAQRPFHPFVLCEELQIFAVVNTVLGVV

SEQ ID NO: 159569 - protein, 138 aa, Heterodera glycines
  Homolog annotation: Hit_ID=AAO33474.1; Match level="QueryCoverage =100%, HitCoverage=100%, E-value=3e-72, Identity=99%"; Hit description=gland-specific protein g4g12 [Heterodera glycines]
  Coding regions on vcDNA: vcDNA=SeqID_85992; Strand=+; Position=53-469
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPGNESKRLSPSGPDPHHH

SEQ ID NO: 159570 - protein, 143 aa, Heterodera glycines
  Coding regions on vcDNA: vcDNA=SeqID_85993; Strand=+; Position=65-493
KLFYCTKIMVASSFSNNGKNILESPFKLTGECKLLYYCTNELGHFLNQTSNALIGNPLRIVPFDGLSSPQKQVCTNTSNSLEFNCTERYISLTNGTALWIYDLQKGSTLRELHDHDGNISGVAWHRQSPWLLASVGDDCTLRL

SEQ ID NO: 159571 - protein, 50 aa, Heterodera glycines
  Homolog annotation: Hit_ID=NP_501725.2; Match level="QueryCoverage =82%, HitCoverage=2%, E-value=5e-10, Identity=63%"; Hit description =putative protein, with 2 coiled coil-4 domains, of eukaryotic origin (4K462) [Caenorhabditis elegans] emb|
  Coding regions on vcDNA: vcDNA=SeqID_85994; Strand=+; Position=164-313
MRPPKSLSEIVINYFRNEHFMCRVPVANCPPFSLFYPHRCPEPKKKKKKK

SEQ ID NO: 159572 - protein, 98 aa, Heterodera glycines
  Coding regions on vcDNA: vcDNA=SeqID_85995; Strand=+; Position=47-340
KKKRKKERKKLQTYESVEAKFDLQKIEKMSTLTNRLNKLADHLGEIGHLHFEKGELNAMDLEEKLMFEIVRLAEQKQHEIEEGRRNGKSKKKKKKKKK

SEQ ID NO: 159573 - protein, 224 aa, Heterodera glycines
  Homolog annotation: Hit_ID=AAL78214.1; Match level="QueryCoverage =66%, HitCoverage=75%, E-value=6e-10, Identity=28%"; Hit description =putative esophageal gland cell protein Hgg-20 [Heterodera glycines]
  Coding regions on vcDNA: vcDNA=SeqID_85996; Strand=+; Position=77-748
MNRRWLCSDVWMDILPSFDHAQLGLKMALLSDCFDVLVDKHFDRKSELTIWREIIIRGDKGQKPLLSVEVDGKFVDFPLPDDSLPNKISFNNLHIQYIDHSVIKFLRSKKRFFDKSGTKLEVFVDAIDTDVQPIWDVFIREIWPIFEKSIRHLGFHNGDHLDNFRRRTSPTILTDLDQLVSIDCGYLRPDGIADDGPNATAGQALTKWVRTPSKNGQPKRLHRN

SEQ ID NO: 159574 - protein, 209 aa, Heterodera glycines
  misc_feature (7)..(7): Xaa can be any naturally occurring amino acid
  Homolog annotation: Hit_ID=NP_495161.1; Match level="QueryCoverage =99%, HitCoverage=26%, E-value=5e-48, Identity=45%"; Hit description =mitofusin 2 (87.5 kD) (2G124) [Caenorhabditis elegans] gb|AAC71095.1| Fzo (fzo mitochondrial fusion prote
  Gene Ontology: Mol. function=protein binding; Biological process =mitochondrial fusion
  Coding regions on vcDNA: vcDNA=SeqID_85997; Strand=+; Position=30-656
PVLDLAXQEQKRLALEFQLKTKEFASCRDNFKFFERTYFTEQQKLRSEVHLKVSADFLDEIGRLEAIIDRFKHPFVDDPELISDYKRQLAIHVNGMLSEGLQNQCTGGLMAQIWSLEQSMHAFVKKILNERHAAQLDKIWQYKQPFKFAIVVNCPELMSDFYEDLEFRFSLGVENVARWILSITRGQPITAIDRNVLRMNVLSRQGHND

SEQ ID NO: 159575 - protein, 186 aa, Heterodera glycines; identical to SEQ ID NO: 158778
  Homolog annotation: Hit_ID=AAP30754.1; Match level="QueryCoverage =100%, HitCoverage=100%, E-value=1e-103, Identity=100%"; Hit description=putative gland protein G11A06 [Heterodera glycines]
  Coding regions on vcDNA: vcDNA=SeqID_85998; Strand=+; Position=84-644

SEQ ID NO: 159576 - protein, 222 aa, Heterodera glycines
  Homolog annotation: Hit_ID=NP_700900.1; Match level="QueryCoverage =100%, HitCoverage=93%, E-value=7e-32, Identity=33%"; Hit description= hypothetical protein PF11_0035 [Plasmodium falciparum 3D7] gb|AAN35624.1| hypothetical protein [Plasmodi
  Gene Ontology: Mol. function=cytoskeletal protein binding; Cellular component=cell-cell adherens junction; Biological process=N-linked glycosylation
  Coding regions on vcDNA: vcDNA=SeqID_85999; Strand=+; Position=2-667
EEMEEMAEKTKSQRKGEKSLKRRRKSDERWKKRRKRRKKKWKIKRKLTERKEEEVEEKEKEPERMEEEKKMLERMEEEAEEKEEKREWAADEMVEKEEKREWTEKDLEEMEENDENPVEEDPEEENMEKTESNEKELDDTEEKQEEKEEKEEMAEEMKEEEEEMEQVAEEEEKLEFKANEMQQNMEEKQEEKEEKRELTEDQMEEKQEEKEQKTKSDERWKK

SEQ ID NO: 159577 - protein, 106 aa, Heterodera glycines
  Homolog annotation: Hit_ID=CAC44263.1; Match level="QueryCoverage =72%, HitCoverage=62%, E-value=2e-20, Identity=57%"; Hit description =zn finger motif protein [Ostertagia ostertagi]
  Coding regions on vcDNA: vcDNA=SeqID_86000; Strand=+; Position=3-323
WLCCSASSLSPILRDFGLCLLFHTLLFTTYLIFAQIFCFWHGQTRVEYLMDVHAYNLSFRENLSACLGSRWPFIFISPFIPSQLETDGTFFRTREREEIGKSTKYF

SEQ ID NO: 159578 - protein, 248 aa, Heterodera glycines
  Homolog annotation: Hit_ID=CAE64662.1; Match level="QueryCoverage =100%, HitCoverage=25%, E-value=1e-116, Identity=87%"; Hit description=Hypothetical protein CBG09434 [Caenorhabditis briggsae]
  Gene Ontology: Mol. function=sodium/potassium-exchanging ATPase activity; Cellular component=sodium/potassium-exchanging ATPase complex; Biological process=neurotransmitter uptake
  Coding regions on vcDNA: vcDNA=SeqID_86001; Strand=+; Position=1-744
KRVLGFCDFRLDPTISKGFEFDVEGPNFPVEGFRFVGLISMIDPPRAAVPDAVAKCRSAGIKVVMVTGDHPITAKAIAKSVGIISEGMETVEDIAVRKEISVDQVDPREAKAIVIHGSDLREMNEDQLAEVINNHDEIVFARTSPQQKLMIVEGFQRQGQIVAVTGDGVNDSPALKKADIGVAMGIAGSDVSKQAADMILLDDNFASIVTGVEEGRLIFDNLKKSIAYTLTSNIPEISPFLMYILFGI

SEQ ID NO: 159579 - protein, 68 aa, Heterodera glycines
  misc_feature (35)..(35): Xaa can be any naturally occurring amino acid
  Homolog annotation: Hit_ID=NP_636484.1; Match level="QueryCoverage =98%, HitCoverage=9%, E-value=1e-15, Identity=59%"; Hit description =catalase [Xanthomonas campestris pv. campestris str. ATCC 33913] gb|AAM40408.1| catalase [Xanthomonas camp
  Coding regions on vcDNA: vcDNA=SeqID_86002; Strand=+; Position=1-204
PSPALRILGKYPDTLEGRKIGILVADGSDGAGVSXVPKAVEGDGGSVFIVAPKIGGAKLADGSTLAGD

SEQ ID NO: 159580 - protein, 51 aa, Heterodera glycines
  Coding regions on vcDNA: vcDNA=SeqID_86003; Strand=+; Position=72-224
MDDAAIKRKLVDLFDDEASLSGDDVGSDSDGETQDEPDEYEAEEGDLDQLP

SEQ ID NO: 159581 - protein, 231 aa, Heterodera glycines
  misc_feature (11)..(11): Xaa can be any naturally occurring amino acid
  Homolog annotation: Hit_ID=CAE70938.1; Match level="QueryCoverage =96%, HitCoverage=48%, E-value=7e-22, Identity=31%"; Hit description =Hypothetical protein CBG17741 [Caenorhabditis briggsae]
  Gene Ontology: Cellular component=dynactin complex
  Coding regions on vcDNA: vcDNA=SeqID_86004; Strand=+; Position=2-695
CPNCWKSHPPXHRHKTSRCAKCNECPLCKNVLSGRSQADVYYLQCNSCQWTSRTSEGAERNMAKESWTEPTNPMEGELGKVMAIMKRLSNFERFEREMNRRSGMSKLDKFGTFERETPTKRMSGRGILRNDRFSLQNAYNSRRKALQKQDDVDEVLELLAPSADVPELDPDIFSVPPKFALSIEQTIAHPLCVSAAHLQPTKVKMMTRRAFRCSECATMLYRGQLSPNDVK

SEQ ID NO: 159582 - protein, 119 aa, Heterodera glycines
  Homolog annotation: Hit_ID=CAE57516.1; Match level="QueryCoverage =97%, HitCoverage=23%, E-value=1e-27, Identity=49%"; Hit description =Hypothetical protein CBG00491 [Caenorhabditis briggsae]
  Gene Ontology: Biological process=gametogenesis
  Coding regions on vcDNA: vcDNA=SeqID_86005; Strand=+; Position=2-361
TWDSAATVMLQGRDFIMPGETVELEFLFNTPQFVRPQQRFTLRHDKTTIACGVFLEALPESEGEIRDKKWRKMQMRGVMERVGFNPFGNRSFERACKPDYTNSPKDNPAEALFKAEAKA

SEQ ID NO: 159583 - protein, 182 aa, Heterodera glycines
  misc_feature (118)..(118): Xaa can be any naturally occurring amino acid
  Homolog annotation: Hit_ID=AAH61653.1; Match level="QueryCoverage =92%, HitCoverage=42%, E-value=3e-53, Identity=56%"; Hit description =MGC68640 protein [Xenopus laevis]
  Gene Ontology: Mol. function=aminoacylase activity; Cellular component=cytosol; Biological process=amino acid metabolism
  Coding regions on vcDNA: vcDNA=SeqID_86006; Strand=+; Position=1-548
WSKLTSFWPFNAFRERQRHLLLADPNLRLGDVTSVNLTKIEGGVQTNVIPAQFVAYFDMRVTPTDDFQQMEAMIANWCKEAGPDVTFEFVQKGMCKSLTPTDASSPWWHAFSSALSEXEIFIGGTDARFLREKGIPAIGFSPMNNTPILLHDHNEFLNEGVFLRGVKIYTKMIPRLANLPSF

SEQ ID NO: 159584 - protein, 194 aa, Heterodera glycines
  misc_feature (30)..(30): Xaa can be any naturally occurring amino acid
  Homolog annotation: Hit_ID=NP_510638.2; Match level="QueryCoverage =92%, HitCoverage=60%, E-value=4e-40, Identity=45%"; Hit description =solute carrier family 25 member 21 (31.8 kD) (XQ807) [Caenorhabditis elegans] emb|CAB04651.3| Hypothetica
  Gene Ontology: Mol. function=intracellular transporter activity; Cellular component=mitochondrial inner membrane; Biological process =mitochondrial transport
  Coding regions on vcDNA: vcDNA=SeqID_86007; Strand=+; Position=3-588
CPDCYRSTEAVLVCPFEVVKVRLQSELNTXSLTTVAREIVHSNGWGTEGLYRGIGANLWRHGVWNSCYFGIYHNLRLFLCSIPSKNSQSSADRLETASLTMRLTIASLSAIVANLANIPFDVAKSRIQGPQPTTGRLYFSTWQSIGLLQRQHGFCSIYRMLFPFAFIFGPGGGMMLVIYEGIYEWLIRRSMALE

SEQ ID NO: 159585 - protein, 245 aa, Heterodera glycines
  Homolog annotation: Hit_ID=NP_035732.1; Match level="QueryCoverage =99%, HitCoverage=9%, E-value=2e-46, Identity=45%"; Hit description =talin 1 [Mus musculus] pir||S11661 talin - mouse emb|CAA39588.1| talin [Mus musculus] sp|P26039|TLN1_MOUSE
  Gene Ontology: Mol. function=structural molecule activity; Cellular component=focal adhesion; Biological process=cell adhesion
  Coding regions on vcDNA: vcDNA=SeqID_86008; Strand=+; Position=1-735
MSRTSVSDLLLIVRAAASSAEHVELKYRMLSNGRDVALNVKHLLASLLFLLTRPDDPTTKSAVLTTANEIAKMVAELAQCSDQLRSNGASTAMSVEESVMAVGNELLVAANSVEAVSYKLAQMRPREIHKPDENLTYDEQILSSAKSITQAVQTLVKAASSAQQELVAQGRVADPGPANGSEEQQWTAGLVSAAKLVAAATNQLCEAANGLVQGHSTEEKLIAAAKQVASSTAHLLVACKVKCDL

SEQ ID NO: 159586 - protein, 191 aa, Heterodera glycines
  misc_feature (44)..(44): Xaa can be any naturally occurring amino acid
  misc_feature (72)..(72): Xaa can be any naturally occurring amino acid
  Homolog annotation: Hit_ID=CAE60358.1; Match level="QueryCoverage =87%, HitCoverage=96%, E-value=2e-70, Identity=76%"; Hit description =Hypothetical protein CBG03955 [Caenorhabditis briggsae]
  Gene Ontology: Mol. function=calcium ion binding; Cellular component =plasma membrane; Biological process=regulation of action potential
  Coding regions on vcDNA: vcDNA=SeqID_86009; Strand=+; Position=1-574
PSLRVSQKHFCPIWSPSSPDIQLIFQSVDRDRSGQISADELNRXLSNGTWKPFNPETCRMMISMFDSNNDGXINFQEFGALWEYINDWTRTFRTFDRDNSGNIDRDELVNALTQFGYRLSGTFYDMLMRKFDRTQSGRINFDDFIQLCVVLQTLTTAFREKDTDRDGWIRIYYEEFLAMVFSLKMSMMAKQ

SEQ ID NO: 159587 - protein, 227 aa, Heterodera glycines
  misc_feature (165)..(165): Xaa can be any naturally occurring amino acid
  misc_feature (183)..(183): Xaa can be any naturally occurring amino acid
  misc_feature (206)..(206): Xaa can be any naturally occurring amino acid
  Homolog annotation: Hit_ID=AAN32888.1; Match level="QueryCoverage =98%, HitCoverage=65%, E-value=1e-116, Identity=97%"; Hit description= annexin 4C10 [Heterodera glycines]
  Gene Ontology: Mol. function=phospholipase inhibitor activity; Cellular component=plasma membrane; Biological process=skeletal development
  Coding regions on vcDNA: vcDNA=SeqID_86010; Strand=+; Position=6-686
NAPNGLTILLLISVVIGHSLANLGPTIKHNPHFKAVQTAHHLHDAIAKKHEAEVTQVICSISNEQRQALALEFKKQFGTDLIAMLKKEFKSDFEELIISLMQTPAVYDANQMRAALSGSNEAVLIEILATRTNRQITALKQAYEQLDRRHQHNQLEEDIKAKTKXTLPKSVGVFAQLLSRRKXPASIVLAHDEAMKLFREGEGRRXVNAVVFNQVLATRSFAQLRET

SEQ ID NO: 159588 - protein, 249 aa, Heterodera glycines
  misc_feature (32)..(32): Xaa can be any naturally occurring amino acid
  Homolog annotation: Hit_ID=NP_492821.1; Match level="QueryCoverage =99%, HitCoverage=23%, E-value=1e-107, Identity=72%"; Hit description= of Ty 16 (116.9 kD) (1L369) [Caenorhabditis elegans] gb|AAF39835.1| Hypothetical protein F55A3.3 [Caenor
  Gene Ontology: Mol. function=positive transcription elongation factor activity; Cellular component=chromatin; Biological process =histogenesis and organogenesis
  Coding regions on vcDNA: vcDNA=SeqID_86011; Strand=+; Position=1-746
GKPESKDLYVRPNIIAKRISGTLEAHVNGFRXTSLRGDKIEVMYNNIKHAFFQPCDNEMIILLHFHLKNPVLWGKKKYSDVQFFTEVGEITTDLGKYHHMQDRDDIQSEQMEREMRKKLNMAFQNFCDKVFRMTNEQVDFDTPFNDLSFIGAPHRSTVSLKPTSSCLVHLTEWPPFVVTLDEVELVHFERVSSNTSTFDTVIVFKDYTKKPHIIGQIPSNNLDSIKDWLNSCDIRYSEGPMSLNWANIM

SEQ ID NO: 159589 - protein, 208 aa, Heterodera glycines
  Homolog annotation: Hit_ID=XP_318086.1; Match level="QueryCoverage =70%, HitCoverage=44%, E-value=3e-29, Identity=44%"; Hit description =ENSANGP00000017696 [Anopheles gambiae]
  Gene Ontology: Cellular component=mitochondrion; Biological process=G- protein coupled receptor protein signaling pathway
  Coding regions on vcDNA: vcDNA=SeqID_86012; Strand=+; Position=14-637
EQFASFSRIRPNLLNFSACFSSPSDGSAPRLEGSSPPPLASSIRFPHFVSRQKFTLSSTYEKQDWFPKHMGVQLKVMEGKLRTVDLVIEVHDARVALTGRNPSFGAKLYSVRPHILVFNKMDLINMKRYKEPIEEYYRNEQNITNICWTNCKNLTNKTQFQNLMDKMLDLLRNEHRFNRTVKTEYQVMVVGIPNTGKSSLINALRNVN

SEQ ID NO: 159590 - protein, 120 aa, Heterodera glycines
  Coding regions on vcDNA: vcDNA=SeqID_86013; Strand=+; Position=226-585
MTEKRTSLLLSKRFSLALICFAGCALCYALRSNLSFAIVCMVKEGSPTVDDNGTTKKGCGAAHATTEQQRQLPINESDMAISRFRRQTNRSALIGHHDADVEQSLPVPLGPGEFDWSKQV

SEQ ID NO: 159591 - protein, 87 aa, Heterodera glycines
  Coding regions on vcDNA: vcDNA=SeqID_86014; Strand=-; Position=18-281
QININLWPFSPQVFMCCLAKCQGKCLSGFAVDLQQMATPTVPASVIFVRNAILAVSTTRAFLARSFSAGGAIIFAFYFVLKFLRYLK

SEQ ID NO: 159592 - protein, 124 aa, Heterodera glycines
  Coding regions on vcDNA: vcDNA=SeqID_86015; Strand=+; Position=2-376
RLLARLRVLVLAKTERALVGMQVDSLNEAQALPLMAKLNSLPTERRIFQFIRDDQFYLVVTFAPDDQTGVRINFHLFSANENRLTLLDLDAEHIIRTAPAPSLRPQKSESFQNFYKRNKKQREG

SEQ ID NO: 159593 - protein, 208 aa, Heterodera glycines
  Homolog annotation: Hit_ID=NP_505905.2; Match level="QueryCoverage =99%, HitCoverage=39%, E-value=2e-62, Identity=54%"; Hit description =amino acid permease-associated region family member (5L944) [Caenorhabditis elegans] emb|CAA98529.2| Hypo
  Gene Ontology: Mol. function=serine transporter activity; Cellular component=integral to plasma membrane; Biological process=neutral amino acid transport
  Coding regions on vcDNA: vcDNA=SeqID_86016; Strand=+; Position=4-627
GLSAAIALLGAFCYIELGTSIRRSGGDFAYLCHVKWRSIAFSFMACGCVLTFPLTLAIQAETFAQYFLQGFGIEFVDEWTAVMGRKCIGYALTWLLLFLNFFSLGSAVSRFQIFCSAAKLLSIGIVIATGFYLLIFHGQTHNLRDPFANSVWEPGHLVEAFFAGLFSYDGWDILNFGAEEVANPRSTMRFAILVGILFVAFLYFAVNL

SEQ ID NO: 159594 - protein, 108 aa, Heterodera glycines; identical to SEQ ID NO: 147910
  Homolog annotation: Hit_ID=NP_497406.1; Match level="QueryCoverage =96%, HitCoverage=91%, E-value=5e-36, Identity=76%"; Hit description =ATP synthase (12.1 kD) (3C509) [Caenorhabditis elegans] gb|AAK26152.1| Hypothetical protein Y82E9BR.3 [Ca
  Gene Ontology: Mol. function=transporter activity; Cellular component= proton-transporting ATP synthase complex (sensu Eukarya); Biological process=energy pathways
  Coding regions on vcDNA: vcDNA=SeqID_86017; Strand=+; Position=18-344

SEQ ID NO: 159595 - protein, 211 aa, Heterodera glycines
  misc_feature (33)..(33): Xaa can be any naturally occurring amino acid
  Homolog annotation: Hit_ID=CAE69294.1; Match level="QueryCoverage =98%, HitCoverage=43%, E-value=3e-59, Identity=50%"; Hit description =Hypothetical protein CBG15349 [Caenorhabditis briggsae]
  Gene Ontology: Biological process=nucleobase, nucleoside, nucleotide and nucleic acid metabolism
  Coding regions on vcDNA: vcDNA=SeqID_86018; Strand=+; Position=1-632
QEEAHMVEEHKLVERTLESCSKCINSKLFEKHXIVAYGLKTYLSVVNWDGLSPEHCYIAPMAHCASLVQMDEDVYEEMKLWMKGLVAMWRDEKGEDGMDCVFVETAINIREQQHMSIECIPLPKELGELAPIYFKKAIMESEKEWSNNQKLIDLAKTSKANVRGTIPKGFPYFTVNFGLQPGFAHVVEDERKFPFNFAQEIIGGMLDLPHS

SEQ ID NO: 159596 - protein, 69 aa, Heterodera glycines
  Coding regions on vcDNA: vcDNA=SeqID_86019; Strand=+; Position=239-448
LPTDSITQLQRSLSLHSLDIPCQCKCKRPDYVLALENRVALLQEQNKSLMDRLREMKGPNGEKSKKTDD

SEQ ID NO: 159597 - protein, 173 aa, Heterodera glycines
  Coding regions on vcDNA: vcDNA=SeqID_86020; Strand=+; Position=94-612
YQINHRTRAQTMGRRRGAAEAKGRQKNKKAETAATTKRTVVAKRILKRKVPNPSARKLTADASRHLGGQSATAIRVKKRRSRSLDTMLRCKWDTSSSFLDLTSSTDFSSFFDEPKKPRPFEGQKCANSPNTKLNQAKFSFFSSTERMMSEWMKNKNSGTDGRKFEEEKYCQNG

SEQ ID NO: 159598 - protein, 204 aa, Heterodera glycines
  Coding regions on vcDNA: vcDNA=SeqID_86021; Strand=+; Position=1-612
FSHSVMAHFISLFFHLIIFYFRFSMTIVKGADGEDDDSFLKFVEGLPSNKKDLEIFEKKLLKETPSGLFYVAHFGVLSLMRENWDCAKVRKELKEQCRTYVKYVHILYEYFFRLFIKAPLVVPKFHFDDSVLNEHILVNVINSLSMISSFYFEECNGTECLYALFSKPKLQNEDDLPYKIMEDKTFCQKASEKLKKVIKIKSEN

SEQ ID NO: 159599 - protein, 213 aa, Heterodera glycines
  Coding regions on vcDNA: vcDNA=SeqID_86022; Strand=+; Position=30-668
MKQLLEECGGWTEPNRYKIYFSYRNIEHEHISHENVAELASGSTIGNYFGSIEDVENISATVVRPKFHTVQTQTEDTNNNEMLSNSSFCAEPGADNDMDGSKTEGMTAQELRMIDYERDIERLEIQCSKQHEQLIILSERAKHVELLEEQKVGLQTQTDILRRQNAQLIRDHEELKCLFGGGSISRNGLEGVGAQCRPIARKDKELETKLKLL

SEQ ID NO: 159600 - protein, 101 aa, Heterodera glycines
  misc_feature (13)..(13): Xaa can be any naturally occurring amino acid
  misc_feature (18)..(18): Xaa can be any naturally occurring amino acid
  Homolog annotation: Hit_ID=NP_508181.1; Match level="QueryCoverage =69%, HitCoverage=12%, E-value=8e-13, Identity=48%"; Hit description =glucose transporter 1A (XB557) [Caenorhabditis elegans] gb|AAA82340.1| Hypothetical protein F53H8.3 [Caen
  Coding regions on vcDNA: vcDNA=SeqID_86023; Strand=+; Position=1-304
TVAWYLSFVVSRXYLPFXQIVGTSFSFVPFILVSAGGAVFVYCLLPETRGKQATDIVREIRQRVKSISHGQSPFAEGSAEAATTTAQPNGQMSELTALLSF

SEQ ID NO: 159601 - protein, 123 aa, Heterodera glycines
  Homolog annotation: Hit_ID=XP_397332.1; Match level="QueryCoverage =97%, HitCoverage=54%, E-value=9e-49, Identity=77%"; Hit description =similar to ENSANGP00000014175 [Apis mellifera]
  Gene Ontology: Mol. function=small monomeric GTPase activity; Cellular component=soluble fraction; Biological process=protein -vacuolar targeting
  Coding regions on vcDNA: vcDNA=SeqID_86024; Strand=+; Position=7-378
LTKLEIPVWDLGGQTSIRPYWRCYYSNTDAIIYVVDSADRDRVGISKQELVSMLEEELKNAILMVLANKQDIHGCLSLAEVHKALGLEAIRNRTFQIFKTSATKGDGLDEAMEFLAASLQSAK

SEQ ID NO: 159602 - protein, 122 aa, Heterodera glycines
  Coding regions on vcDNA: vcDNA=SeqID_86025; Strand=-; Position=30-398
HRTAITTHGILQRLVTLTARNGAGEVVAAHGAIGVVADPAIQAAAMERMGAAERRPRDGAHVGHTNGTSLAPLRFSCVSCASNCRPPPLGIAQLRLGTPGPRRVCWSGHEGYDVCDVMVRRF

SEQ ID NO: 159603 - protein, 52 aa, Heterodera glycines
  Homolog annotation: Hit_ID=ZP_00357698.1; Match level="QueryCoverage =63%, HitCoverage=24%, E-value=2e-13, Identity=93%"; Hit description =hypothetical protein Chlo02002738 [Chloroflexus aurantiacus]
  Coding regions on vcDNA: vcDNA=SeqID_86026; Strand=-; Position=232-390
FFFFFFFFFFFFFFFFFFFFFFFFFFFFFFFFNDNVLLCNFTTSLNRAHPNK

SEQ ID NO: 159604 - protein, 235 aa, Heterodera glycines
  Homolog annotation: Hit_ID=NP_501211.1; Match level="QueryCoverage =94%, HitCoverage=77%, E-value=6e-45, Identity=42%"; Hit description =voltage-dependent anion channel 2 (30.0 kD) (4I272) [Caenorhabditis elegans] gb|AAB00622.2| Hypothetical
  Gene Ontology: Mol. function=voltage-dependent anion channel porin activity; Cellular component=mitochondrial outer membrane; Biological process=apoptotic program
  Coding regions on vcDNA: vcDNA=SeqID_86027; Strand=+; Position=30-734
MGTLKSIKILEHGLTITEKWKTDNQLTNVLELKDKVLRGLKLTVETAFKPHVEGSRHAIAKADWANDAFHVNGDLTLFGGPLFTGSFVAKMSNDWLVGAQLKANLEQGTVGPTAISIGRKTAEYSLHSHTTDGTDFGASLYHRVHQNLEYGVQMGWKMGDAMASWAIATKYNMSPELTLRAKMDHDSLVSVSAVHNLNGTLKLTLSSHFAMAAFPDAQNKFGFGLEYCPGGTCCA

SEQ ID NO: 159605 - protein, 194 aa, Heterodera glycines
  Coding regions on vcDNA: vcDNA=SeqID_86028; Strand=+; Position=1-582
QEIEGKGHEIEDEEFDLNDEACFEACVNRLNMWDQCLDNAVRLEQRLLPHVIYDDAEHEAHHNDLIDVIQHVEPVRITNSGLEPLNGKLTEFINNPLNSSDNEAPVLPRAITGINHVTPSFDQIKQMIEAIRTQGDCPAVDILAPADNLTVYDAFVCKVLADVLDILKRQRFYTNLELIERDARARGEAKWQNA

SEQ ID NO: 159606 - protein, 160 aa, Heterodera glycines
  misc_feature (6)..(6): Xaa can be any naturally occurring amino acid
  Homolog annotation: Hit_ID=CAE70363.1; Match level="QueryCoverage =96%, HitCoverage=10%, E-value=5e-46, Identity=58%"; Hit description =Hypothetical protein CBG16921 [Caenorhabditis briggsae]
  Gene Ontology: Mol. function=1-phosphatidylinositol-3-phosphate 5 -kinase activity; Cellular component=vacuolar membrane; Biological process=vacuole organization and biogenesis
  Coding regions on vcDNA: vcDNA=SeqID_86029; Strand=+; Position=28-509
MEFLFXRKDIKQIWDLKGSLRNRLASTKNDNNGASSVLLDENYIQNMWRNQIYITTHSKTALSQAIINDSHFLADQGIMDYSLLAGICRGEEDEVIVGIVDYMRTFTFDKKVESAIKNAIPLTNSSTVISPEQYCRRFYEAIDGYFAVAPDQWTSESVFT

SEQ ID NO: 159607 - protein, 74 aa, Heterodera glycines
  Homolog annotation: Hit_ID=AAP30836.1; Match level="QueryCoverage =94%, HitCoverage=42%, E-value=3e-30, Identity=91%"; Hit description =putative gland protein G30C02; Hg-G30C02 [Heterodera glycines]
  Coding regions on vcDNA: vcDNA=SeqID_86030; Strand=+; Position=64-285
GNFQFLLLFSACCYLQRKEVYFAEKTERKIHRAANKKHKEETEGMAEFDFFKVAWACMANRMDFQMADLAAPVS

SEQ ID NO: 159608 - protein, 193 aa, Heterodera glycines
  misc_feature (34)..(34): Xaa can be any naturally occurring amino acid
  Homolog annotation: Hit_ID=NP_493832.1; Match level="QueryCoverage =100%, HitCoverage=47%, E-value=1e-67, Identity=62%"; Hit description= acyl-coa dehydrogenase SHORT-CHAIN SPECIFIC (45.2 kD) (2B138) [Caenorhabditis elegans] gb|AAK85472.1| Hy
  Gene Ontology: Mol. function=acyl-CoA dehydrogenase activity; Cellular component=mitochondrion; Biological process=lipid metabolism
  Coding regions on vcDNA: vcDNA=SeqID_86031; Strand=+; Position=3-580
AALVFEQLAAGCCSTAAYMAVHNMVPWMIDRFAXQELKQRYIPELASFTKLASYCLTEPGSGSDSAALRTNARREGDHYIVNGSKAFISGSGVSSVYLVMMRHKDAPPGPKGIFALIMTPDMPGFQLGKDENKLGWCTQPTRILTFEDVKVPVTNQVGADDEGFTIAMEGLNGGRVNIAACSLGAAQMSMDLA

SEQ ID NO: 159609 - protein, 132 aa, Heterodera glycines
  misc_feature (54)..(54): Xaa can be any naturally occurring amino acid
  Homolog annotation: Hit_ID=CAE61217.1; Match level="QueryCoverage =99%, HitCoverage=31%, E-value=6e-51, Identity=74%"; Hit description =Hypothetical protein CBG05011 [Caenorhabditis briggsae]
  Gene Ontology: Cellular component=extracellular space; Biological process=aspartate catabolism
  Coding regions on vcDNA: vcDNA=SeqID_86032; Strand=+; Position=1-398
QDEAARRCPTKILIRPMISNPPIHGARIASKILSDPKLRQQWLGDVKGMADRIXTMRSQLRDLLAKAGSKRNWDHIVNQIGMFCFTGIGPEQVDRLAKEFSIYLTRDGRISVAGISSKNIDYLANALHEVTK

SEQ ID NO: 159610 - protein, 89 aa, Heterodera glycines
  Homolog annotation: Hit_ID=NP_510553.1; Match level="QueryCoverage =98%, HitCoverage=19%, E-value=4e-19, Identity=56%"; Hit description =kynurenine aminotransferase (49.6 kD) (XQ61) [Caenorhabditis elegans] emb|CAA93673.2| Hypothetical protei
  Coding regions on vcDNA: vcDNA=SeqID_86033; Strand=+; Position=3-269
IIPDGGYFMIADFSHLDGQFKLRNESDEMENALDFGFCRWLCREKKLAAIPPSAFYSPENRKGNDYFIRLCFFKKDETLQKKKKKKKKK

SEQ ID NO: 159611 - protein, 46 aa, Heterodera glycines
  misc_feature (21)..(21): Xaa can be any naturally occurring amino acid
  Coding regions on vcDNA: vcDNA=SeqID_86034; Strand=-; Position=350-490
FFFFFFFFFFFFFFFFFFFFXRPVFYTYICTYGKYIMNDNTDHSVQ

SEQ ID NO: 159612 - protein, 138 aa, Heterodera glycines
  Homolog annotation: Hit_ID=NP_501998.1; Match level="QueryCoverage =100%, HitCoverage=28%, E-value=8e-58, Identity=75%"; Hit description= 6-phosphogluconate dehydrogenase (53.2 kD) (4L541) [Caenorhabditis elegans] emb|CAA94380.1| Hypothetical
  Gene Ontology: Mol. function=electron transporter activity; Cellular component=cytosol; Biological process=pentose-phosphate shunt
  Coding regions on vcDNA: vcDNA=SeqID_86035; Strand=+; Position=1-417
SREFDWNLNYGAIALMWRGGCIIRSRFLDRIQNAFEKNPSLVNLLLDDFFMKAIGDAQDSWREVISTAVQLGIPMPAFSSALAFFDGYRTEALPANLIQAQPDYFGAHTYELLAQPGVAVHTNWTGRGGKVTSNAYSA

SEQ ID NO: 159613 - protein, 59 aa, Heterodera glycines
  Coding regions on vcDNA: vcDNA=SeqID_86036; Strand=-; Position=204-383
LIILGFAFISHRITNYLHFFALKSSDQSVIIAFPFFPLFFWFYRRRFVRPEFPPQRPPA

SEQ ID NO: 159614 - protein, 124 aa, Heterodera glycines
  Coding regions on vcDNA: vcDNA=SeqID_86037; Strand=-; Position=47-421
CAPAAILRRSGHFSGPFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSAG

SEQ ID NO: 159615 - protein, 95 aa, Heterodera glycines
  Homolog annotation: Hit_ID=CAE58648.1; Match level="QueryCoverage =86%, HitCoverage=22%, E-value=2e-12, Identity=41%"; Hit description =Hypothetical protein CBG01816 [Caenorhabditis briggsae]
  Coding regions on vcDNA: vcDNA=SeqID_86038; Strand=+; Position=31-318
KMCNTPGSFECQCVDGFKRLDSGECSIDVEAHPNVPWLQPGEKLRLFSYFGLFLITVFVFTMHRSTLAVFLAVSAIFAVLLVDLFFGDGFLLLFR

SEQ ID NO: 159616 - protein, 196 aa, Heterodera glycines
  Coding regions on vcDNA: vcDNA=SeqID_86039; Strand=+; Position=4-591
MTEIGNGSSGFIPKGFRPSPISAFFSAEAVRYMTEAEFHRFRLKYITPQPFADRMRESWPTVEQPISEWLAQCWDSAAAYGEQCRRVSKARLFNLICMHCRDCPDAIAEMFCLVLRCKDDDPQACKELVLVDLKNSEFYARMFDLRGNPMKMDAISKCLEPQCIFPELRKRNANEYAPLLARVEALYKRSLKHGNG

SEQ ID NO: 159617 - protein, 194 aa, Heterodera glycines
  Homolog annotation: Hit_ID=CAE62609.1; Match level="QueryCoverage =37%, HitCoverage=15%, E-value=5e-19, Identity=58%"; Hit description =Hypothetical protein CBG06727 [Caenorhabditis briggsae]
  Gene Ontology: Mol. function=cysteine-type peptidase activity; Cellular component=extracellular space; Biological process =embryogenesis and morphogenesis
  Coding regions on vcDNA: vcDNA=SeqID_86040; Strand=+; Position=78-659
MILQFPFGDFNVLLLLTISTVLLARCLGTIVQFEDELELMENTGTADESADGPLGAFWEWHRMVAGADKFGSISQRMLHLRPSLKVPSVSKRIAFPSTAFPNPNPNNAIPPPNVVRRRAHNIPRDKPPCLRPMDRPFREHRTYPRSWEMPGFEATIPRQWDWRNVSGTNFCSPNRNQHIPVYCGGCWVFGTLGS

SEQ ID NO: 159618 - protein, 220 aa, Heterodera glycines
  misc_feature (23)..(23): Xaa can be any naturally occurring amino acid
  Homolog annotation: Hit_ID=NP_499779.1; Match level="QueryCoverage =99%, HitCoverage=82%, E-value=4e-98, Identity=52%"; Hit description =ATP-binding cassette sub-family F member 2 like (70.4 kD) (3O548) [Caenorhabditis elegans] emb|CAB04880.1
  Gene Ontology: Mol. function=ATP-binding cassette (ABC) transporter activity; Cellular component=membrane; Biological process=transport
  Coding regions on vcDNA: vcDNA=SeqID_86041; Strand=+; Position=2-663
CLFPINQNTLHLQNLDFGIDLDXRVALVGPNGAGKSTLLKLFSRDVEPTDGMIRRHLHCKIGKYHQHLVEELPLELSALEYMQREFPDVREKEEMRKIIGRYGPTGREQVCPMKQLSDGQRCRVAFAWLAWQQPHLLLLDEPTNHLDMESIDALAEAINNFAGGMILVSHDFRLVQQVTEEIWVCDKQTITKWDGDIFSYKEHLRKKIESNDRKGTMTER

SEQ ID NO: 159619 - protein, 137 aa, Heterodera glycines
  Homolog annotation: Hit_ID=BAC87222.1; Match level="QueryCoverage =74%, HitCoverage=89%, E-value=2e-12, Identity=29%"; Hit description =unnamed protein product [Homo sapiens]
  Coding regions on vcDNA: vcDNA=SeqID_86042; Strand=+; Position=25-522
MFFHESRNTLKKSGNFWKKLISHCRKRRKSQKQKQRNKKQREKKQLNQKMKKKKHQKEKLNRKRQKLKRRRRKGAEWRRTERKRQQQRREIKGKSSRRNQKELTKMGRIDLISNSLMFCLATAIIETVTILIKYFGA

SEQ ID NO: 159620 - protein, 233 aa, Heterodera glycines
  Coding regions on vcDNA: vcDNA=SeqID_86043; Strand=+; Position=48-746
SAVEERQLRGNSLRLFFCPLAVISALFFGVGCNANHLYSEGGSFPVLSSDNSPPIPNDPPTFGSPADLLDNELQQPNQQYQTEFAPSMEQMVDEQRRNRLAKIIEQMRDNGQFSQQEIADGPGLFLEEGEANVPIERPSETETYWDGLKEGELESSEMFGENEGKKIAAVKKGQNEFVEFVEPRQHQNNRHKEWMDKRVPTDSTHAFYFLTNSGNILFMAYLAVCCFGIVAGA

SEQ ID NO: 159621 - protein, 120 aa, Heterodera glycines
  Coding regions on vcDNA: vcDNA=SeqID_86044; Strand=+; Position=2-364
KNEATNVKKIWICTTFWMDILPFLTVFKLDSIWDVFVRQIWPIFTTPNSHNLSPSYADHLDNLLRLTTPTILSDLNINSIHSSSFLSVPALLSITTCSFICPCQRQLCHLNWRMSGRKKS

SEQ ID NO: 159622 - protein, 94 aa, Heterodera glycines
  misc_feature (17)..(17): Xaa can be any naturally occurring amino acid
  Homolog annotation: Hit_ID=AAP30755.1; Match level="QueryCoverage =95%, HitCoverage=39%, E-value=4e-38, Identity=87%"; Hit description =putative gland protein 29D09 [Heterodera glycines]
  Coding regions on vcDNA: vcDNA=SeqID_86045; Strand=+; Position=3-283
KRRRSQIVDEIDRQLKXIAKMAITYEDECPYNLGFARAMFDLAAAAAGHAGNGTEWQNMKGQFEQESQAIKAIGQELNIEPTDVHFGHPSKGFS

SEQ ID NO: 159623 - protein, 98 aa, Heterodera glycines
  misc_feature (74)..(74): Xaa can be any naturally occurring amino acid
  Homolog annotation: Hit_ID=AAG12204.1; Match level="QueryCoverage =92%, HitCoverage=74%, E-value=2e-19, Identity=53%"; Hit description =Orf122 [Chlorobium tepidum]
  Coding regions on vcDNA: vcDNA=SeqID_86046; Strand=-; Position=99-395
LNKPPTHPLNPIKPDNACTFRLTAAAGTELAGAYSYSTLKNLRRGFFVPVQKQFTTQKAFVLHAAWLVQAYAHXPIFPTAASRRSLARISVPVWGTFH

SEQ ID NO: 159624 - protein, 111 aa, Heterodera glycines; identical to SEQ ID NO: 149987
  Homolog annotation: Hit_ID=NP_501562.1; Match level="QueryCoverage =80%, HitCoverage=28%, E-value=1e-14, Identity=42%"; Hit description =UDP n-acetylglucosamine transporter like (35.5 kD) (4J751) [Caenorhabditis elegans] emb|CAA92454.1| Hypot
  Coding regions on vcDNA: vcDNA=SeqID_86047; Strand=+; Position=327-659

SEQ ID NO: 159625 - protein, 154 aa, Heterodera glycines
  Coding regions on vcDNA: vcDNA=SeqID_86048; Strand=+; Position=3-467
IRHRLRNAQHCPSLRVVTFDGPIFIEFPPDESANASDGQAVTKWLFLPRPDNLMKELTICIVNSSVEHWLATVEQIEAAFSSASSPVNFVITVYFPPSSSLSAVMPFKLTNEFTVEQLALFKEDGEEDLIRDDGVGDGLLDGSPGPSGDQKQQK

SEQ ID NO: 159626 - protein, 206 aa, Heterodera glycines
  misc_feature (206)..(206): Xaa can be any naturally occurring amino acid
  Coding regions on vcDNA: vcDNA=SeqID_86049; Strand=+; Position=20-637
ANYFLMASSDRKKEKFSSDNRRLISSAAIGEHEQQQPMGSHGKRRNVRVAKKMNKSLGTTKPKRCCSLHNNFWMDIFPFFDHAQLGLKLAMLSPRFNVLVDKHFDGKSELTIWKLIQIRNPRTAPKLSVLVNNRKLVPFPLPFHPLPSKIHFKNLRIDYFDHSVVAFLRSNQQIFERGGLNLYLVVRAAHKRLLQPTLDVFVREIX

SEQ ID NO: 159627 - protein, 167 aa, Heterodera glycines
  Coding regions on vcDNA: vcDNA=SeqID_86050; Strand=+; Position=3-506
RAEEVLGQFVVRLLHADDDQPIGSWNFVLCLRPPLLSYIATVLQHSKNPSLVQLGLRSLFHLLTKCNSVDDCPPLSDTIGSVAGHLTSAVFVIIRSELVTGNINVVADILHALASKYPNVARSTVLALSGGDSQRLIALFARPNKFDFRQICATMHQTALLQKDPVI

SEQ ID NO: 159628 - protein, 104 aa, Heterodera glycines
  Coding regions on vcDNA: vcDNA=SeqID_86051; Strand=-; Position=1-312
FFFFFFFFDRRIIFSFWNKTFARNSEKEMWEKGGGGEKHRQKDKQSNFETELKVEKCHSSAFLGDSETKGKAKRQKKGGKVMEDKSKDGWSDRRRKRHSLVKKL

SEQ ID NO: 159629 - protein, 188 aa, Heterodera glycines
  Coding regions on vcDNA: vcDNA=SeqID_86052; Strand=+; Position=1-567
NLGVGRKSDCDLARWFSSFNSVRLVKSGLTRSKSQKFTQHVSTLLDCFSPFNVDYPQQDDTDDSADDESDKEKYDFLSWQKKLRQPQRSFKLPSESKYNPFQRFDPFQRLGPFQRLGVYGSRKEMENYLDIFGNEPSSSVTAPLIGSIKNAEIDQQNSEDEKGSSTSTKRVNPFLKPDGSSYNKDKDE

SEQ ID NO: 159630 - protein, 127 aa, Heterodera glycines
  Coding regions on vcDNA: vcDNA=SeqID_86053; Strand=-; Position=112-495
KESKDKLLSLPPPLFGKSASRKGRSNSICLARKTTDSTPTILSTSKNNLSESFLSNAWQSDDRRQNNESSAFSTLSCPPSVVPGPFIFFSIDCTNWRRRKVTKLVPNICCCCCASKSEQKNVKIEWT

SEQ ID NO: 159631 - protein, 167 aa, Heterodera glycines
  Coding regions on vcDNA: vcDNA=SeqID_86054; Strand=+; Position=1-504
HVCSAFGPLIVFALVLGLAITLTVITVNNWKEIGVLLSKQSALKSRSDIEAFYEIDCPIYSDNSKLPDKWDQFDLAFCNRYCDRNQMFESMHRQLDPNRKSSAKSKDNQELMCPIYIEFKQCQMGEGGHCEEKLFSEEFTEFVQPGGAGTSSKGENETIGTCVPCPS

SEQ ID NO: 159632 - protein, 113 aa, Heterodera glycines
  Homolog annotation: Hit_ID=ZP_00357698.1; Match level="QueryCoverage =52%, HitCoverage=34%, E-value=1e-15, Identity=69%"; Hit description =hypothetical protein Chlo02002738 [Chloroflexus aurantiacus]
  Coding regions on vcDNA: vcDNA=SeqID_86055; Strand=-; Position=160-501
FFFFFFFFFPGFFLGFFFFFFFFWVFFFFFFFFFFFFFFFFFFFFFFFFFLGYYKFILLRIQKAHCNHQHPNRELDVKEETELNPRALHPIARHVGPIPALFLQPIVFHFHPA

SEQ ID NO: 159633 - protein, 186 aa, Heterodera glycines
  Coding regions on vcDNA: vcDNA=SeqID_86056; Strand=+; Position=136-693
MTRTMALAEDLNMAEHLLLRSARDTSADEDDGGGDFDGSSNETESDSAQFGSQLKRDGAAGGISIGTFLGNISASARAQLHNIVNNASMTKKEMSEALDTWAQAQGQLFNTVYLGLKAAYESARQQLDQRHAAQMQNQTQAVREADAKIQTIANNQFITLAEEKQQMVEQMAKFPADVQQTLLQFA

SEQ ID NO: 159634 - protein, 166 aa, Heterodera glycines
  Coding regions on vcDNA: vcDNA=SeqID_86057; Strand=+; Position=123-620
RSRFRIQKLDQSWEHKSFEEDNDEEPKKLTIPDEYDQSDFLIENKSVGEQEKEIIREEIGFNGQAENGEKPSFEEEKCPPEGCRLYRDDLVESEEVLRNEHDLGRKLSKTEDLSKKMEVKGNEITKEDEHSAETHIVKEDENWMEHKEEEKREKKEGKREEEEEKR

SEQ ID NO: 159635 - protein, 108 aa, Heterodera glycines
  Homolog annotation: Hit_ID=CAE61639.1; Match level="QueryCoverage =90%, HitCoverage=62%, E-value=2e-32, Identity=63%"; Hit description =Hypothetical protein CBG05572 [Caenorhabditis briggsae]
  Gene Ontology: Biological process=mechanosensory behavior
  Coding regions on vcDNA: vcDNA=SeqID_86058; Strand=+; Position=217-543
MRDIRRGSPPKHARKPHDRKPIKGTAFRKGIVIKVVVKHPKKPNSGNRQCVLVRLSTGRQCIAYIPGEGHNLQEHSQIYVRGGRRRDLIGVRANVMRGKLDCAAVKKK

SEQ ID NO: 159636 - protein, 126 aa, Heterodera glycines
  misc_feature (16)..(16): Xaa can be any naturally occurring amino acid
  Homolog annotation: Hit_ID=NP_508280.1; Match level="QueryCoverage =92%, HitCoverage=10%, E-value=3e-48, Identity=81%"; Hit description =atp citrate lyase (XC101) [Caenorhabditis elegans] gb|AAB00585.1| Hypothetical protein D1005.1 [Caenorhab
  Gene Ontology: Mol. function=ATP citrate synthase activity; Cellular component=mitochondrion; Biological process=ATP catabolism
  Coding regions on vcDNA: vcDNA=SeqID_86059; Strand=+; Position=1-382
PGQRVEILKEIAKKRXLKQETPLLDYALKVEQITTSKKPNLILNVDGAIATIFVDILRHSGMFTPQEARETIEIGSLNGLFVLGRSLGFIGHYLDQRRLKQPLYRHPWDDISYIMPEHEFAGQPSL

SEQ ID NO: 159637 - protein, 160 aa, Heterodera glycines
  Coding regions on vcDNA: vcDNA=SeqID_86060; Strand=+; Position=39-518
QSCWDELEEAKSKTEFNVGLMDVWDFGALALFHKIGTKNVVLTHNFLIMSHMYKYMEKAGWQTENSELFNYQKQILDKGVPELFSAVINDKNVGKAGAYKEKHNESSDIFSKVYEIADQKFKDLFKNNAFPTLEKLFGDAKALFVNTTPLLDYDIGSLPK

SEQ ID NO: 159638 - protein, 106 aa, Heterodera glycines
  Coding regions on vcDNA: vcDNA=SeqID_86061; Strand=-; Position=2-319
SMKRSTAFWSFEICSIQQNGHFFKYVELGSSFPLLRLSSLLFKPSGTRHCAAASASVPVFVALLRPTDNVIDAQNHNGRLNGCFDGLQSHSERVPNALGLRHAANS

SEQ ID NO: 159639 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_86062; Strand=+; Position=15-431
MPNIFKILLIVLLAVVSFRLSASTGDKKTANDGSGNNSSAGIGTKIKRIVTAGLLFTSLATGGAEAIGRSNAHGGNAAGLVPSHVTNRSMAPPPPPVQFEMGANRLEKMRAHLRELAEKMPVNESKRLSPSGPDPHHH

SEQ ID NO: 159640 - protein, 156 aa, Heterodera glycines
  Homolog annotation: Hit_ID=AAK26377.1; Match level="QueryCoverage =99%, HitCoverage=52%, E-value=4e-87, Identity=99%"; Hit description =putative alpha/beta hydrolase [Heterodera glycines]
  Gene Ontology: Biological process=amino acid and derivative metabolism
  Coding regions on vcDNA: vcDNA=SeqID_86063; Strand=+; Position=149-616
QKTLKLTPFVVLGWSEGGRTSIHVAGQGKGLVSHMVLLSSGSQVDMRGDLAFKGMRNTDQWMPAAKAPYLEHYSNEFLKEQWAGLCDVVAKVYKDLGGSFPCDRVLNTLKIPVLIVNGNMDRFVLDPSLMSKKLENARIEIHAQGGHDLHIKYPRW

SEQ ID NO: 159641 - protein, 215 aa, Heterodera glycines
  Homolog annotation: Hit_ID=NP_609917.2; Match level="QueryCoverage =80%, HitCoverage=9%, E-value=4e-23, Identity=35%"; Hit description =CG18397-PA [Drosophila melanogaster] gb|AAF53722.3| CG18397-PA [Drosophila melanogaster]
  Coding regions on vcDNA: vcDNA=SeqID_86064; Strand=+; Position=1-645
NLEELPEKREDEAIGKERAQSEWDGREGQTQANSAEPSHYRNPGELAQLRAKLLSPTKRRRAEDIDQSSENKLRRAEELRALLKQEKAQRLHLLHRRVGEVRTEREQIQQKKTAHLEMVKERIQKAEENRQKSLEEIVQKAQEDEMKIIEINLLNSFEAANQRLGKRFTQIRERNRHAKVVRKAEEERQKRIEENKQQREEAEKRRKDAEEQRTK

SEQ ID NO: 159642 - protein, 236 aa, Heterodera glycines
  misc_feature (18)..(18): Xaa can be any naturally occurring amino acid
  misc_feature (198)..(198): Xaa can be any naturally occurring amino acid
  Homolog annotation: Hit_ID=CAE56085.1; Match level="QueryCoverage =97%, HitCoverage=45%, E-value=5e-73, Identity=51%"; Hit description =Hypothetical protein CBG23668 [Caenorhabditis briggsae]
  Gene Ontology: Mol. function=sphingomyelin phosphodiesterase activity; Cellular component=integral to plasma membrane; Biological process=sphingomyelin metabolism
  Coding regions on vcDNA: vcDNA=SeqID_86065; Strand=+; Position=4-710
MHVPQVHVATLNCWLLPXPWPIGSKHKQFRLQKLIDELKNSRFDVIALQEVWSEKIFLQIAHELNGFFPHSHYFHSGFTGSGTCVISKHPIVSTLLHRYSLNGFPHHVHRGDWFGGKIVGMVEIMVEQYRVAFYTTHLHAEYNRENDLFLPHRISQCFEMSQFIRHTSRGSDFVVVVGDFNLEPNDLGHHLIKNIAQXYDAWEIRSNLVDISQDNGMTCERPRHYTCKYVLQQCPS

SEQ ID NO: 159643 - protein, 121 aa, Heterodera glycines
  misc_feature (85)..(85): Xaa can be any naturally occurring amino acid
  Homolog annotation: Hit_ID=CAE64879.1; Match level="QueryCoverage =98%, HitCoverage=40%, E-value=2e-22, Identity=41%"; Hit description =Hypothetical protein CBG09691 [Caenorhabditis briggsae]
  Coding regions on vcDNA: vcDNA=SeqID_86066; Strand=+; Position=1-367
IVDAKLISAQRLKLVAFGQPRTGNGEWATAMDQKVGPFNYRVVNNRDLVPHMPPLWFEGYRHHMTEVFYNNAKNKTEEFVITRGXAESEECAGKYWFYNVRDHLNYFGKSVSEWGEKGCAN

SEQ ID NO: 159644 - protein, 208 aa, Heterodera glycines
  Homolog annotation: Hit_ID=T31423; Match level="QueryCoverage=95%, HitCoverage=99%, E-value=2e-34, Identity=36%"; Hit description =polyprotein allergen/antigen ABA-1 - pig roundworm  (fragment) gb|AAC06015.1| polyprotein allergen/antigen [As
  Coding regions on vcDNA: vcDNA=SeqID_86067; Strand=+; Position=18-641
NGGGTPPTPNSWLSRTQKQMLKKLRNRGHEDHEIHEQIHEFYEVSPEEVKATARGILQRGCESIFKRIFGEYNAEEIIQMRDEGASNVEIEEKITEALNQIRSPQKRQEAGRFAMSCRRIFAMIERRRRSADNAEHSLDQLFKSHLIWLNEQQREELKQMKGSGKGRTEMQQRVMEWYGQLEGQEKQKAREHLRDGCRDILAQVLGKE

SEQ ID NO: 159645 - protein, 130 aa, Heterodera glycines
  misc_feature (37)..(37): Xaa can be any naturally occurring amino acid
  Homolog annotation: Hit_ID=AAT02161.1; Match level="QueryCoverage =100%, HitCoverage=58%, E-value=7e-25, Identity=45%"; Hit description= hypothetical protein L3ni22 [Dictyocaulus viviparus]
  Coding regions on vcDNA: vcDNA=SeqID_86068; Strand=+; Position=5-395
LLFLCSFWQRDLEGYTFSCLDGCECDTDDEAIIVQSXDRHFVQLPPSRLRGFTVLALTRNNIDVLPSEEVLLEKLPDLNAVDVEGNEHFHCSTLDHYRTLMVMSDCGKTPEQLEADRAKLPTDTQPNEDC

SEQ ID NO: 159646 - protein, 143 aa, Heterodera glycines
  Homolog annotation: Hit_ID=NP_496220.1; Match level="QueryCoverage =86%, HitCoverage=83%, E-value=2e-17, Identity=38%"; Hit description =brugia malayi antigen like (2K603) [Caenorhabditis elegans] emb|CAA88891.1| Hypothetical protein ZK970.7
  Coding regions on vcDNA: vcDNA=SeqID_86069; Strand=+; Position=14-442
MSSSSIFLSFASFSLIILALCRAQNESAAQGDAQPPPFLTEASQEKINEFYQYVTSLGHLKETEIAEKVKEWVDKQSEEIQKKYVEFEQERERAKAEDEAAHEEAARKFTEAAKKADKELTEIANNPNLSANDKAEMINRKVH

SEQ ID NO: 159647 - protein, 116 aa, Heterodera glycines
  Homolog annotation: Hit_ID=NP_001007938.1; Match level="QueryCoverage= 83%, HitCoverage=82%, E-value=2e-09, Identity=38%"; Hit description =similar to hypothetical protein 5830457H20 [Gallus gallus] emb|CAG32040.1| hypothetical protein [Gallu
  Coding regions on vcDNA: vcDNA=SeqID_86070; Strand=+; Position=10-360
MDRQNDLRQQQNVPEFICQERLDTNSPIAFKEPLPGAWNLHSEYLSTKTKEEKERKASRFRTELDPEDVKLVNELGHLSADKLMEYVRTLQNTALSLGEEEAAQFSRAKLLKILEK

SEQ ID NO: 159648 - protein, 152 aa, Heterodera glycines
  Homolog annotation: Hit_ID=CAF96846.1; Match level="QueryCoverage =97%, HitCoverage=16%, E-value=6e-19, Identity=29%"; Hit description =unnamed protein product [Tetraodon nigroviridis]
  Gene Ontology: Mol. function=cytoskeletal protein binding; Cellular component=cell-cell adherens junction; Biological process=axon guidance
  Coding regions on vcDNA: vcDNA=SeqID_86071; Strand=+; Position=10-468
SREAPDTRADEENRQVDSADREKRQDNRADREKRQDNRADEENRQVDSADREKRQDNRADREKRQDNRADREKRQDNRADREKRQDNRADREKRQDNRADREKRQDNRADREKRQDNRADREKRQDNRADREKRQDNRADREKRQDNRAIMY

SEQ ID NO: 159649 - protein, 84 aa, Heterodera glycines
  Homolog annotation: Hit_ID=NP_741237.1; Match level="QueryCoverage =82%, HitCoverage=9%, E-value=1e-14, Identity=53%"; Hit description =CaLPain family member (clp-1) [Caenorhabditis elegans] gb|AAM15551.1| Calpain family protein 1, isoform d
  Gene Ontology: Mol. function=signal transducer activity; Cellular component=intracellular; Biological process=digestion
  Coding regions on vcDNA: vcDNA=SeqID_86072; Strand=+; Position=7-261
MKRICPTAKLPYQTNPERIGHSFWRGPKSVAKSASFINLREVTARFRLAPGQYVVVPSTFEPDEEGHFLLRLFCSGQLKANELN

SEQ ID NO: 159650 - protein, 192 aa, Heterodera glycines
  Homolog annotation: Hit_ID=CAE74515.1; Match level="QueryCoverage =87%, HitCoverage=67%, E-value=3e-17, Identity=30%"; Hit description =Hypothetical protein CBG22269 [Caenorhabditis briggsae]
  Coding regions on vcDNA: vcDNA=SeqID_86073; Strand=+; Position=19-594
FSLLKQSRPPEFNTLRFDFKPASISSEASEAYVVQSQNQNENNFQVVVFGEAQKKTIFKGAKKEIKGDKECLLVYNRKSKELCLERVSANINVKKTRDTDLDQKAISEIERLQKRRRPKQSPPSPKAPVENATAVEPPAEQRKERTFSTSSAGDEIDEDDEENVSALEQLMASTKVERSEAEEDIFHPAQQR

SEQ ID NO: 159651 - protein, 129 aa, Heterodera glycines
  Coding regions on vcDNA: vcDNA=SeqID_86074; Strand=-; Position=2-388
RHIILQTECGEFHILLFCTSASGRRRRCQYPSVRQCPQMRCATLCPSVNSACPSLAAVGPQSVACTPPNCPPTICAFQTVDCAHPPISDEFPPPFSAFLSTAFARCLPRSALGPIPPHSVHPIHPQFGP

SEQ ID NO: 159652 - protein, 101 aa, Heterodera glycines
  Coding regions on vcDNA: vcDNA=SeqID_86075; Strand=-; Position=138-443
DAQKNFSEIEIPTIHGIDIFRENMLLQKILGLDLQFCMKSPAIVRFFVGLCRLLGFRARSSHEGDSICSPCREWNPGSGIPIGPALARKFFCFSMIHFFFL

SEQ ID NO: 159653 - protein, 40 aa, Heterodera glycines
  Coding regions on vcDNA: vcDNA=SeqID_86076; Strand=+; Position=159-278
VGLNSEQVKAYGNYEQLLQDADVDIVYMATINSTHLPLII

SEQ ID NO: 159654 - protein, 91 aa, Heterodera glycines
  Homolog annotation: Hit_ID=NP_079514.1; Match level="QueryCoverage =84%, HitCoverage=15%, E-value=4e-18, Identity=58%"; Hit description =BTB (POZ) domain containing 1 [Homo sapiens] gb|AAQ09603.1| NS5ATP8 [Homo sapiens] gb|AAH28097.1| BTB (PO
  Gene Ontology: Mol. function=protein binding
  Coding regions on vcDNA: vcDNA=SeqID_86077; Strand=+; Position=7-282
VFFPLRWFATTFRVLFDEPVEISSNTTYVASAKLTGNESHYGTKGLRKIKLERNGRPDINWHFQYAPGNNNGTSVEDGQIPEIIFCAKHPY

SEQ ID NO: 159655 - protein, 76 aa, Heterodera glycines
  misc_feature (16)..(16): Xaa can be any naturally occurring amino acid
  misc_feature (57)..(57): Xaa can be any naturally occurring amino acid
  Homolog annotation: Hit_ID=NP_497890.1; Match level="QueryCoverage =100%, HitCoverage=19%, E-value=4e-28, Identity=76%"; Hit description= swi Snf related matrix associated actin dependent regulator of chromatin subfamily b member 1 (42.8 kD)
  Gene Ontology: Mol. function=general RNA polymerase II transcription factor activity; Cellular component=SWI/SNF complex; Biological process=embryogenesis and morphogenesis
  Coding regions on vcDNA: vcDNA=SeqID_86078; Strand=+; Position=2-231
KLNIHVGNQSLVDQLXWDMSNPNNSPEQFAQKLCAELGLGGEFVGAIAYSIRGQLSXDQRTYAFSESPLDTVACPF

SEQ ID NO: 159656 - protein, 145 aa, Heterodera glycines
  Homolog annotation: Hit_ID=XP_234345.2; Match level="QueryCoverage =56%, HitCoverage=8%, E-value=6e-18, Identity=52%"; Hit description =similar to RIKEN cDNA 9430020B07 gene [Rattus norvegicus]
  Coding regions on vcDNA: vcDNA=SeqID_86079; Strand=+; Position=1-435
NSEHLRLSDPKYSNICTIKSCSFAGDQYLVTGSDDWNIYVWKVPSNWDDFANGTVNVHSVLDGHRSIVNHVKYGPRSNLLLPCGVEKIIKCWSGLPLRDSYQNPKKRERISTILPDFLGDPDHGSMDSDTEEDLDTLQRFDFYYE

SEQ ID NO: 159657 - protein, 118 aa, Heterodera glycines
  misc_feature (55)..(55): Xaa can be any naturally occurring amino acid
  Homolog annotation: Hit_ID=NP_510362.1; Match level="QueryCoverage =99%, HitCoverage=30%, E-value=1e-35, Identity=61%"; Hit description =isocitrate dehydrogenase (41.6 kD) (XO790) [Caenorhabditis elegans] emb|CAB02822.1| Hypothetical protein
  Gene Ontology: Mol. function=isocitrate dehydrogenase (NAD+) activity; Cellular component=mitochondrial matrix; Biological process=isocitrate metabolism
  Coding regions on vcDNA: vcDNA=SeqID_86080; Strand=+; Position=3-360
LVARPEQCDVMVMPSLYSSIVDNLAAGLVGGAGVDNRESEGSDYVIFHPVARDTXKDVFGKQIANPTAVILCCANMLNHLHLNSYRSALRHSVEKALKEGKLRTRDLGGFANTSDCAQ

SEQ ID NO: 159658 - protein, 111 aa, Heterodera glycines
  misc_feature (30)..(30): Xaa can be any naturally occurring amino acid
  Homolog annotation: Hit_ID=AAL78215.1; Match level="QueryCoverage =100%, HitCoverage=37%, E-value=6e-48, Identity=81%"; Hit description= probable polyprotein allergen Hgg-14 [Heterodera glycines]
  Coding regions on vcDNA: vcDNA=SeqID_86081; Strand=+; Position=8-339
CKAIVRELMGRLSEERSEQVENRMGFCEHXFITGKDGTGKGDGMMQEQHGDEHHHHHYNHTKRRAHRQRRDHHHHHHGEHGLEDYVKTHLAWLTDEQKAEISTMKESGKSR

SEQ ID NO: 159659 - protein, 118 aa, Heterodera glycines
  Coding regions on vcDNA: vcDNA=SeqID_86082; Strand=+; Position=215-568
LSSKFLCSPHFLLYKMNWSAEKNMPTPEQILATLRQALADLDSRLSEKLKTETVKLLKGIDSVLHAKADQHVQKNEKVLSFVEHARNAMLDRAKLMTSQVGKQVKDGLMLAFGRVVFT

SEQ ID NO: 159660 - protein, 171 aa, Heterodera glycines
  Coding regions on vcDNA: vcDNA=SeqID_86083; Strand=+; Position=2-514
IPASSSCSSSSMCCCNALAKMHESFVAKFRVIRPQANLITLDGDNNNDIILHEEADEDEAIAQPCTSSAGQQPRPIGGGTADELQQEAEDNESVLLNGAESPTPGAGTLGYEILAEDSKTPAPFYEMMSESELNAELAKYGHGPMGKRAAIRLLNRIYEATHPVISSDTPI

SEQ ID NO: 159661 - protein, 218 aa, Heterodera glycines
  Homolog annotation: Hit_ID=NP_505633.1; Match level="QueryCoverage =99%, HitCoverage=56%, E-value=2e-48, Identity=37%"; Hit description =putative RNA binding protein with KH domain(s) family member (65.6 kD) (5K718) [Caenorhabditis elegans] e
  Gene Ontology: Mol. function=pre-mRNA splicing factor activity; Cellular component=nucleus; Biological process=transcription from Pol II promoter
  Coding regions on vcDNA: vcDNA=SeqID_86084; Strand=+; Position=12-665
MGAQLAETLVENVDIPESAVGLVIGRGGEQIQLIQQQSSCRVQMSSESNVSGFRQCTLQGARHNIDKAKQLIQEVLERSNRSAPGPQNGANAITIELSIPGPKCGLIIGKNGETIKGLQEQIGVKMMLVQESHQPTMGTKPLRVSGPPDKVENAKRIIEQLLAGDGTQPNLSQTLRGTNVGGGGGNASRSIGEVIVPRTSVGIIIGKGGETIKRLAAE

SEQ ID NO: 159662 - protein, 93 aa, Heterodera glycines
  Coding regions on vcDNA: vcDNA=SeqID_86085; Strand=+; Position=1-282
CECFGGGRLGGTECLFSTDDSRRGVPISIMKANRKKGHRFDLCLRHAFYVFAFEYLLIIFAFICIFMSLFLCFALNAFSPISLTILHFIWSQP

SEQ ID NO: 159663 - protein, 152 aa, Heterodera glycines
  Coding regions on vcDNA: vcDNA=SeqID_86086; Strand=-; Position=2-457
EMVRILKALNRVHRKNTARHVDISTVLSLTLAFCVRMLMQFHFIAKQTTTRPFGMFHEKLLAVFASLDENERKDQSFFDGIQEKSVELCPSVIRFLLRRVNAESIVFSKSEQSIVKNGIFLRASEIIRRKDIWLAKATVNRRKMKRSNGDRT

SEQ ID NO: 159664 - protein, 173 aa, Heterodera glycines
  misc_feature (20)..(20): Xaa can be any naturally occurring amino acid
  Homolog annotation: Hit_ID=CAE70241.1; Match level="QueryCoverage =98%, HitCoverage=23%, E-value=4e-48, Identity=57%"; Hit description =Hypothetical protein CBG16730 [Caenorhabditis briggsae]
  Gene Ontology: Biological process=nonselective vesicle transport
  Coding regions on vcDNA: vcDNA=SeqID_86087; Strand=+; Position=1-518
SLFRKPLTHYQITQNALLKXRFFYEFLLANDRQVAREVKDEYVDTTSKMFFSYFKAYVSRLFKFQMVDSATKSDLLGAEDVVKHPTTISALPSLFTSGKTHQTRSRATVFSLGHRQNLLLDDLLAPLIVPHVAQENNETFQFESLFRSVQYALVDHCSHEFLFICDFFMVNGQ

SEQ ID NO: 159665 - protein, 87 aa, Heterodera glycines
  Coding regions on vcDNA: vcDNA=SeqID_86088; Strand=+; Position=14-277
ITSSQMDRANDLRQQQNVPEFICQERLDTYSPIAFKEPLPGAWNLHSEYLSTKTKEEKERKASRFKTELDPEDVKLVNELGIYRLTN

SEQ ID NO: 159666 - protein, 109 aa, Heterodera glycines
  Homolog annotation: Hit_ID=AAP30762.1; Match level="QueryCoverage =100%, HitCoverage=100%, E-value=6e-63, Identity=98%"; Hit description=putative gland protein G7E05 [Heterodera glycines]
  Coding regions on vcDNA: vcDNA=SeqID_86089; Strand=+; Position=16-345
MYKFLFFLHFCILIKAISGLHCWNSNMILLSEMPEKGSVTVRQCPSGHQCVTANCWLGVGNYIVQKCVPDQPGARNYCKDFNNICQMGFFGMPIHCSSCKGDLCNEARN

SEQ ID NO: 159667 - protein, 154 aa, Heterodera glycines
  Homolog annotation: Hit_ID=NP_701342.1; Match level="QueryCoverage =70%, HitCoverage=5%, E-value=2e-09, Identity=37%"; Hit description =MAEBL, putative [Plasmodium falciparum 3D7] gb|AAL10509.1| erythrocyte binding protein 1 [Plasmodium falci
  Coding regions on vcDNA: vcDNA=SeqID_86090; Strand=+; Position=98-559
MAPKCLPLELLFEIVPFVHAEEAVPNVLLSCRLLHNLLLPCVVKWKKRMAEGKKEEDLTKQFAAMSKHFEDKMKAMFKEFEAKIDAKIEALTKRMEAVEEELKKSTEETKKSTKRIEAAEEELKKSTEETKKSTKRIEAAEEELKKSTEEMKKS

SEQ ID NO: 159668 - protein, 99 aa, Heterodera glycines
  Coding regions on vcDNA: vcDNA=SeqID_86091; Strand=-; Position=60-359
MTKQTKVQSDDGSRAKEGRDYAQSEDDNGHPKMDVSKVALQIMEHDNVSSEQRRKSEKVADHEEGSADERVNGATTEFPVVLLVLHVFVVSKRPKQQHY

SEQ ID NO: 159669 - protein, 140 aa, Heterodera glycines
  Homolog annotation: Hit_ID=CAE56930.1; Match level="QueryCoverage =69%, HitCoverage=46%, E-value=7e-36, Identity=69%"; Hit description =Hypothetical protein CBG24775 [Caenorhabditis briggsae]
  Gene Ontology: Biological process=mesoderm development
  Coding regions on vcDNA: vcDNA=SeqID_86092; Strand=+; Position=91-513
MRCSDLDEHWFDCQSVTESVNATDINQMELLCPYFGISKGPLLFANISCRVLPCIECYGTRNFAKEFPCKKYTGHYFLSALLYSIFLGPFAVDRFYLGYSAIALGKLMTLGGLGVWWLVDIFLPLFGHLKPADESEWQPF

SEQ ID NO: 159670 - protein, 155 aa, Heterodera glycines
  Homolog annotation: Hit_ID=NP_502691.1; Match level="QueryCoverage =99%, HitCoverage=32%, E-value=3e-25, Identity=41%"; Hit description =selenium binding protein like (52.4 kD) (4O819) [Caenorhabditis elegans] emb|CAA19490.1| Hypothetical pro
  Coding regions on vcDNA: vcDNA=SeqID_86093; Strand=+; Position=22-486
MTIEPSTLTSLGVSCPGRVCCASDSVIVGTMGDDRMENNGNFLLLDRLTFEPIGFWAEKEGQKGTKFGGTDFCIQTKQNVLLSVGWGTPAKFRGGLRPRDVTNGHYSNEVNVWEWRQRRLIQTIALEGDCGWMPMAVRFLHNADKCHAFVCTLLG

SEQ ID NO: 159671 - protein, 138 aa, Heterodera glycines
  Coding regions on vcDNA: vcDNA=SeqID_86094; Strand=-; Position=2-415
NCPSDVSACTQSANSSSSGKSPSPISPSSGDQNCDCFERFFNAASFLFCSLSFAFTSSSSVGSAVCFCDVIIRGAGTIGTSRSSREEKLARAACSIDKKCHPKFMVFNFLILCLLRTLAEPLLNHGFVPKPPAHGVRR

SEQ ID NO: 159672 - protein, 111 aa, Heterodera glycines
  misc_feature (97)..(97): Xaa can be any naturally occurring amino acid
  Homolog annotation: Hit_ID=NP_957199.2; Match level="QueryCoverage =95%, HitCoverage=10%, E-value=6e-18, Identity=37%"; Hit description =importin 7 [Danio rerio] gb|AAH66524.1| Importin 7 [Danio rerio]
  Gene Ontology: Mol. function=RAN protein binding; Cellular component =nuclear pore; Biological process=EGF receptor signaling pathway
  Coding regions on vcDNA: vcDNA=SeqID_86095; Strand=+; Position=50-383
GYSVGVAGILSTLETILGLLEEHPDIVKRVEPVVRSCITTIFDAYCETYFEEALSLTHSLVLVHISPEMWTVFDHIYKAFLEEGTSFFSDCAPVLHXFLTNDTDNFLSVFD

SEQ ID NO: 159673 - protein, 105 aa, Heterodera glycines
  Coding regions on vcDNA: vcDNA=SeqID_86096; Strand=+; Position=3-317
EQFFNNTAQLAGWGKITKCVAKEKAISAPYLIGRAVQLSECRKLYRGDRICFRGIASQSGDTGSAVLASNGTDYVQIAVSSYVECISSAPEASYAIYSRIDAKWL

SEQ ID NO: 159674 - protein, 172 aa, Heterodera glycines
  misc_feature (102)..(102): Xaa can be any naturally occurring amino acid
  Homolog annotation: Hit_ID=CAE65983.1; Match level="QueryCoverage =85%, HitCoverage=28%, E-value=1e-18, Identity=38%"; Hit description =Hypothetical protein CBG11172 [Caenorhabditis briggsae]
  Coding regions on vcDNA: vcDNA=SeqID_86097; Strand=+; Position=1-520
IEGEHYAKSAQNEIQFVIVRLLFTLVMFFGFAIQMYVVVEMLWPEFVKFLRNLCPNFGVYNENDHKNMVGIELLFRAALVTVSMLIGLAVPELENIIPLVGXTAGMLLALIFPALLDLLVFLPIHLQRHRIRQTFWLLLDNWTLVAIGVFGLIAGLRANLRNIFTPAEDIVA

SEQ ID NO: 159675 - protein, 102 aa, Heterodera glycines
  Homolog annotation: Hit_ID=S52850; Match level="QueryCoverage=99%, HitCoverage=16%, E-value=2e-40, Identity=82%"; Hit description =intermediate filament protein A - common roundworm emb|CAA60045.1| cytoplasmic intermediate filament protein [
  Gene Ontology: Mol. function=structural constituent of cytoskeleton; Cellular component=intermediate filament; Biological process =pronuclear envelope synthesis
  Coding regions on vcDNA: vcDNA=SeqID_86098; Strand=+; Position=1-306
KEEAKLLRTQLGDMRGKLADLEGRNSLLERQAEELAYQVEDDQRAYESALNDKDAQIRKLRDEAQALMLELQMLLDTKQTLDAEIAIYRKMLEGEEDRSGLY

SEQ ID NO: 159676 - protein, 113 aa, Heterodera glycines
  Coding regions on vcDNA: vcDNA=SeqID_86099; Strand=+; Position=1-342
FQRFWMWTYVDRLLKKKKQYDTECRIDYEEYFTKEERELLSPIPAFQSIMDVRYNSELLESNIRVSLLHFGGLPADCRWPNGKSPPKRDEIKKVKILKTISASTRRTIICSIA

SEQ ID NO: 159677 - protein, 128 aa, Heterodera glycines
  Coding regions on vcDNA: vcDNA=SeqID_86100; Strand=-; Position=2-385
PILDQIGLLRLEVLKGGADLCRHFHHQLLLRVRATAVGDAHGGEFVLKQGVQRAGPRAAWHSPAVCRCLLIVAIVRQLLLLLLLGCAECGQWINARVQQMSSGQHGQRGHQRHHPGTVVHRSSAPPLA

SEQ ID NO: 159678 - protein, 188 aa, Heterodera glycines
  Coding regions on vcDNA: vcDNA=SeqID_86101; Strand=+; Position=1-564
TTRFDFLFFFFLPMASAPSSDRFSSDRFSSDHFFSDRSLRPQCLPNCASLSFGFVVDKLAQHCHCFSHLFECGQRIFEVSATELSPTNGFTSRVFRCEFEFGAFVGEKRMPTPKKRTMSAIAKVISLERMDTLWENFVGKKQMEKMRNSREQTEMIKSTLLQLHRNECNLYKFIGSSAPLPLPKVFYT

SEQ ID NO: 159679 - protein, 175 aa, Heterodera glycines
  Coding regions on vcDNA: vcDNA=SeqID_86102; Strand=+; Position=3-527
AHGLRARKREFPAKIFRPTPIVPTSKYRHSVADGMLTRDLRDSQVWKTVVTVDGISGGQAERRGQRSTAKDEKRHGDTEAVALRRHFYAEKPTNEQWQQNGRVALDEDGHNANQQKLDRAPNGGQIRQLVFSVGRTQFSMGGGQSAGPLVQCHARGESHDSLGSNSTANMHRCIS

SEQ ID NO: 159680 - protein, 107 aa, Heterodera glycines
  Homolog annotation: Hit_ID=CAE70079.1; Match level="QueryCoverage =72%, HitCoverage=14%, E-value=6e-11, Identity=42%"; Hit description =Hypothetical protein CBG16520 [Caenorhabditis briggsae]
  Coding regions on vcDNA: vcDNA=SeqID_86103; Strand=+; Position=2-325
SARDYATAVHKQHSSIQPKCSSNNIHQQQQATIAQPQQAVSAGMGAVSSSGGPAINPQTGQPDYSAQWAEYYRTMGMHEQAALIEAQMKQTHAAAQAQRPQQQLYMQ

SEQ ID NO: 159681 - protein, 42 aa, Heterodera glycines
  Coding regions on vcDNA: vcDNA=SeqID_86104; Strand=+; Position=72-200
TTVHVNKHSVRLLKVHILQLIYFSFYRGILDSIYVLGWTSHN

SEQ ID NO: 159682 - protein, 195 aa, Heterodera glycines
  Coding regions on vcDNA: vcDNA=SeqID_86105; Strand=+; Position=3-587
LLVRLLLMTQHYWHFHHLFLFFGISLWHNILSIFVDFSFLVAFPYGTTFLAFSLISSCFLAFPYGTTFLAFSSTFRFLWHFPMAQHSWHFHHLFLFLVAFPYGTTLLAFSSSLLVYWHFLMAQHFLSFPRLFLFLVAFPYGTTLLAFSSSLLVYWHFLMAQHFLPYGTTFLAFSSSLLVSCGISLWHNTIGIFII

SEQ ID NO: 159683 - protein, 189 aa, Heterodera glycines
  Homolog annotation: Hit_ID=AAH03209.1; Match level="QueryCoverage =71%, HitCoverage=32%, E-value=3e-14, Identity=29%"; Hit description =C77668 protein [Mus musculus]
  Coding regions on vcDNA: vcDNA=SeqID_86106; Strand=+; Position=3-569
MCLFSLHFALRSVPFFSYGSPHKLLRVICASIDPRQLSRLMSEIVRENIVLFSPDEILVLLHDSLKWESMEQFMLWQLIQVEAVELDKFLDLLQRLNYAQHPEATAAILVIIRNMEPDPDPAVMRSLLRNLFLRQPDRDLFTVDALKLIVDYSDNIPPMSDCISKMVKHAIHNDEIIAPFGQTKLGKAR

SEQ ID NO: 159684 - protein, 138 aa, Heterodera glycines
  Homolog annotation: Hit_ID=AAO33474.1; Match level="QueryCoverage =100%, HitCoverage=100%, E-value=8e-72, Identity=98%"; Hit description=gland-specific protein g4g12 [Heterodera glycines]
  Coding regions on vcDNA: vcDNA=SeqID_86107; Strand=+; Position=29-445
MPNIFKILLIVLLAVVSFRLSASTGDKKAANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHYH

SEQ ID NO: 159685 - protein, 178 aa, Heterodera glycines
  Coding regions on vcDNA: vcDNA=SeqID_86108; Strand=-; Position=2-535
ERKDDKNGFGRMINWAKINECRVISFGQKNNTKIRLRGKKWLFLGGHGWVKDPSKVSAWPLIPQFVSFVVGRQSPVQTVKQFANFFEYWRRDLQTVQRTPQLQHASGDQFETETEQFLVRYSLLKSFDASTSRSWYSKSIVASVSVSSNPKTATAFTFLLPFDIVPPKLQDDKKKNQR

SEQ ID NO: 159686 - protein, 171 aa, Heterodera glycines
  Homolog annotation: Hit_ID=NP_497509.2; Match level="QueryCoverage =76%, HitCoverage=7%, E-value=2e-29, Identity=47%"; Hit description =yeast translation activator GCN1 like (3D287) [Caenorhabditis elegans] gb|AAK29920.2| Hypothetical protein
  Gene Ontology: Mol. function=translation factor activity, nucleic acid binding; Cellular component=cytosolic ribosome (sensu Eukarya); Biological process=regulation of translation
  Coding regions on vcDNA: vcDNA=SeqID_86109; Strand=+; Position=28-543
MRFPGWQPFLAILREALLMGGVEIKEVAANCLSQLIPLSSEAGLRPHVVNMAGPLIRILGERHPVPVKVAAVNALLRLLENVSLLLKAFLPQMQSVLLKILQDPSSQNLRQLASQAVVHLIDLHPKPETILKELNKLREADKSPEGLDLHTDKLINELIAKIDLKNGNTSK

SEQ ID NO: 159687 - protein, 124 aa, Heterodera glycines
  Homolog annotation: Hit_ID=NP_491076.1; Match level="QueryCoverage =95%, HitCoverage=43%, E-value=4e-15, Identity=39%"; Hit description =translocon-associated protein (28.6 kD) (1D497) [Caenorhabditis elegans] gb|AAK66027.1| Hypothetical prot
  Gene Ontology: Mol. function=signal sequence binding; Cellular component=integral to membrane; Biological process=cotranslational membrane targeting
  Coding regions on vcDNA: vcDNA=SeqID_86110; Strand=+; Position=11-382
MRHFYSILFALALLCSAFVFLSAEEDAAEGEEKPKAEERTQREVDPEAADLIGPSSDVQSSFLFTNLKSGASTTDLIAGEIVKFLVGFANKGEKDFIVKHCETSFRYPLDFSYHIQNFSAVRYE

SEQ ID NO: 159688 - protein, 141 aa, Heterodera glycines
  misc_feature (114)..(114): Xaa can be any naturally occurring amino acid
  Homolog annotation: Hit_ID=AAO85452.1; Match level="QueryCoverage =100%, HitCoverage=26%, E-value=3e-72, Identity=99%"; Hit description= putative gland protein G12H04 [Heterodera glycines]
  Coding regions on vcDNA: vcDNA=SeqID_86111; Strand=+; Position=44-465
MALSALLLLLPLLLNVQNIPDESVQSDMKAVYSAISSPEQWKNSQNSLASLESQLTEPQRALAKMHWELETIQKEKPEAPPQFDLGLFSEALEVMVEMDEEAKEVKLRKDKLIXMGRRRGSKKKLKEKMTEEDTVPEVRVN

SEQ ID NO: 159689 - protein, 210 aa, Heterodera glycines
  Homolog annotation: Hit_ID=XP_517630.1; Match level="QueryCoverage =85%, HitCoverage=38%, E-value=3e-40, Identity=41%"; Hit description =PREDICTED: similar to membrane-associated RING-CH protein VI; similar to S. cerevisiae SSM4 [Pan troglody
  Coding regions on vcDNA: vcDNA=SeqID_86112; Strand=+; Position=14-643
KSCSCPVFLLVRVFAAAFPLLAVIPFMLGLYFQMLVISPLRVAIFQSPLFFPWKEWAMGVVHFKIVCASVLMGPDWWLKTAFEQIYADGIWNIRLRDLYTNLVFPIVNTLTFLIAFPYVLSNFLLFFVDASREEQIIVIRFAYPFLLGSICFCALITWQWQKLKLLAQKIRNDKYLIGTQLVNFYRENTSAIVGNSTVKKSVTPMESIVN

SEQ ID NO: 159690 - protein, 57 aa, Heterodera glycines
  Coding regions on vcDNA: vcDNA=SeqID_86113; Strand=-; Position=310-483
FFFFFFFFFFLFVFFFFFFFLGFFFFKPNKCIQTKEATNAISRSTSIHNDHSFVISQ

SEQ ID NO: 159691 - protein, 208 aa, Heterodera glycines
  Homolog annotation: Hit_ID=XP_517630.1; Match level="QueryCoverage =86%, HitCoverage=38%, E-value=3e-40, Identity=41%"; Hit description =PREDICTED: similar to membrane-associated RING-CH protein VI; similar to S. cerevisiae SSM4 [Pan troglody
  Coding regions on vcDNA: vcDNA=SeqID_86114; Strand=+; Position=8-631
KSCPCPVFLLVRVFAAAFPLLAVIPFMLGLYFQMLVISPLRVAIFQSPLFFPWKEWAMGVVHFKIVCASVLMGPDWWLKTAFEQIYADGIWNIRLRDLYTNLVFPIVNTLTFLIAFPYVLSNFLLFFVDASREEQIIVIRFAYPFLLGSICFCALITWQWQKLKLLAQKIRNDKYLIGTQLVNFYRENTSAIVGNSTVKKSVTPMESI

SEQ ID NO: 159692 - protein, 225 aa, Heterodera glycines
  Homolog annotation: Hit_ID=NP_509429.1; Match level="QueryCoverage =97%, HitCoverage=33%, E-value=5e-80, Identity=63%"; Hit description =transmembrane 9 superfamily member 2 (75.3 kD) (XJ38) [Caenorhabditis elegans] gb|AAB71307.1| Temporarily
  Gene Ontology: Mol. function=transporter activity; Cellular component= membrane fraction; Biological process=transport
  Coding regions on vcDNA: vcDNA=SeqID_86115; Strand=+; Position=13-687
MNLRILLFFAVFIPSARSFYLPGLAPVNFCEGKDKKPTCPNKVTLFVNKLDSDQSVIPYEYHSFDFCIGSEQESPVENLGQVLFGERIRPSPYEINFKENKQCSYLCEKDYKSSDKSHQEKLRLLQRGMKLNYQHHWIIDNMPVTFCFINQQNMNVCTTGFPMGCYVTKEGKPKDACVLDGRYRQQDSFYLFNHVDIKIEYRDMSDDPNFLDEKIGGRIIRIKVQ

SEQ ID NO: 159693 - protein, 235 aa, Heterodera glycines
  Homolog annotation: Hit_ID=CAE56905.1; Match level="QueryCoverage =99%, HitCoverage=59%, E-value=2e-79, Identity=57%"; Hit description =Hypothetical protein CBG24746 [Caenorhabditis briggsae]
  Gene Ontology: Biological process=sulfur amino acid metabolism
  Coding regions on vcDNA: vcDNA=SeqID_86116; Strand=+; Position=2-706
YSRKLATLESARHCRIFSSGLAAIAAVSHLLNSGQHVIVSGDCNGGTKNYFDKICVPHHGLELIFVDLTRLENLENEFKPNTKMVLFETPSNPLLKIVDIEAVCRMVRARSKDCVVVVDNTFMTPYFQRPLELGADVTVQSLTKYINGHTDVLMGTVVTNKEQLDQHIYAQQIYAGAVPSAFDAFLVLRGIKTLPLRMRQHMENALAIGRWLEKDPRVENVLYPELESHPQHQIH

SEQ ID NO: 159694 - protein, 238 aa, Heterodera glycines
  misc_feature (124)..(124): Xaa can be any naturally occurring amino acid
  Homolog annotation: Hit_ID=NP_499846.2; Match level="QueryCoverage =70%, HitCoverage=42%, E-value=7e-28, Identity=34%"; Hit description =parkin, Parkinson's Disease Related (44.1 kD) (pdr-1) [Caenorhabditis elegans] emb|CAB04599.2| Hypothetic
  Gene Ontology: Mol. function=ubiquitin-protein ligase activity; Biological process=central nervous system development
  Coding regions on vcDNA: vcDNA=SeqID_86117; Strand=+; Position=83-797
MQISTLELGPTTSLTLLMDTAPNLDLSSSIGHPSIDWPVGACSTGNDSADEEQWVKLSSDQFAENAVNFSDESAFSAFFVFCKSCVSLECAKLRAYCRTCESSAIIFLNEPQQWDDVKENNSIXFFCHYCDKESCVSFRFKCVKCGEPASPLQHISRNFSLPPSECVICGSNSFPLGVRLRDCTHLSCVQCFVAYAEELLSRMSLKWHPQVGYTVGCPFYGCTAVVTDVHTLYLLGKP

SEQ ID NO: 159695 - protein, 42 aa, Heterodera glycines
  Coding regions on vcDNA: vcDNA=SeqID_86118; Strand=+; Position=25-153
SKATNKHDQKKTMITLTLSKREIPNSYCWKIIKPSLIAFLKI

SEQ ID NO: 159696 - protein, 186 aa, Heterodera glycines
  misc_feature (51)..(51): Xaa can be any naturally occurring amino acid
  misc_feature (99)..(99): Xaa can be any naturally occurring amino acid
  misc_feature (105)..(105): Xaa can be any naturally occurring amino acid
  Homolog annotation: Hit_ID=NP_781232.1; Match level="QueryCoverage =88%, HitCoverage=75%, E-value=6e-42, Identity=60%"; Hit description =hypothetical protein CTC00549 [Clostridium tetani E88] ref|NP _780925.1| hypothetical protein CTC00214 [Cl
  Coding regions on vcDNA: vcDNA=SeqID_86119; Strand=-; Position=3-559
CQSRSQASLCHCTRRAISDRSELTIARLRYTLGGDRPSQTTHHAMSRDRIXGPRLDVNDSKGGISRTTPPELAPRFHSLPPILHIRSLTPRRSYSKGSXGSFRLXREPRIFTGNSISLSLCWRQWGSRYAIRAGRNLPDKEFRYLRTVIVTAAVYLGFSSELSLLPLTFRHRAGVRPYTSHCCFAE

SEQ ID NO: 159697 - protein, 140 aa, Heterodera glycines
  misc_feature (10)..(10): Xaa can be any naturally occurring amino acid
  Homolog annotation: Hit_ID=XP_316218.1; Match level="QueryCoverage =97%, HitCoverage=44%, E-value=2e-29, Identity=47%"; Hit description =ENSANGP00000005949 [Anopheles gambiae]
  Coding regions on vcDNA: vcDNA=SeqID_86120; Strand=+; Position=1-422
EVSPDGDCLXSAVAHQANVSGLGKFSAFEIRRMAADYIQQNPEDFLPFLANENGEMFKDEQFDEYCSKVARMCASGGTWGGEPELRALSCVLRCPIEVLHADGATIKFGEVFSGHPLIVTYHKFAYTLGEHYNSTKPTGE

SEQ ID NO: 159698 - protein, 36 aa, Heterodera glycines
  Coding regions on vcDNA: vcDNA=SeqID_86121; Strand=+; Position=69-176
MGFNFEFTEEQKQLQAAVKKFTQDEIIPKASHYDKT

SEQ ID NO: 159699 - protein, 155 aa, Heterodera glycines
  Homolog annotation: Hit_ID=NP_501768.1; Match level="QueryCoverage =54%, HitCoverage=43%, E-value=7e-12, Identity=44%"; Hit description =Sperm-Specific family, class Q SSQ-1, putative protein (24.4 kD) (ssq-1) [Caenorhabditis elegans] emb|CAA
  Coding regions on vcDNA: vcDNA=SeqID_86122; Strand=+; Position=148-615
RGLSCVGVASEWFTGTTTGEGGAAQSAATTTGEGGAAQSAATTTGEGGAAQSATTTTGEGGATQSAATTTGEGGAAQSATTTTGEGGAAQSAATTTGHGWRCRHRRQQTLCRIQVTNITLRTFLTTQRAIGTYLTRFWITMIGMRRRMTRNVTRS

SEQ ID NO: 159700 - protein, 230 aa, Heterodera glycines
  Homolog annotation: Hit_ID=NP_501200.1; Match level="QueryCoverage =92%, HitCoverage=9%, E-value=5e-09, Identity=25%"; Hit description =rough Deal protein like (4I249) [Caenorhabditis elegans] gb|AAB00646.1| Rod (drosophila roughdeal) homolog
  Gene Ontology: Biological process=embryogenesis and morphogenesis
  Coding regions on vcDNA: vcDNA=SeqID_86123; Strand=+; Position=3-692
NRAAYASYSSALRESLVVIETEFLLANNAVLNTDTVSLTQKSEELVNYLLCRNEIDWAESESISRCFNIVDSISKIHSVDVERVFLALIDRWVIEGQEQSDQAVSQITSDPDSTIDFTGPSVLSNSVNTDDSDFFVPVLYDDIQTTRIIVLLRRIREPTKKILEFSHKSEIDVSVLPGGYLTKVRIACCILRFLTDEQMRTMFNISIDQYGNFVTMLNQRYSLCRIDSSP

SEQ ID NO: 159701 - protein, 201 aa, Heterodera glycines
  Homolog annotation: Hit_ID=AAP30759.1; Match level="QueryCoverage =100%, HitCoverage=90%, E-value=1e-111, Identity=100%"; Hit description=putative gland protein G13A06 [Heterodera glycines]
  Coding regions on vcDNA: vcDNA=SeqID_86124; Strand=+; Position=35-637
MAMVCLVMAVLMEMANSKAVKKDNKKGAVAASPAKGKASPKGGKSPAKGKAAKVSKKDNKLKAKKETKGIKVKNAKPTKKGKSAKGAPKTAKKVQAAKKAPGKDKKSLVKPIVLKAPVPPHKMHPMIESEAVPPPAHARSLATVPYSTPGAADRNSLPSYTSAGTNLDMADDNDDYQNYYYGTEDGSREFDASAEEEDELY

SEQ ID NO: 159702 - protein, 205 aa, Heterodera glycines
  Homolog annotation: Hit_ID=XP_318086.1; Match level="QueryCoverage =71%, HitCoverage=44%, E-value=8e-29, Identity=43%"; Hit description =ENSANGP00000017696 [Anopheles gambiae]
  Gene Ontology: Cellular component=mitochondrion; Biological process=G- protein coupled receptor protein signaling pathway
  Coding regions on vcDNA: vcDNA=SeqID_86125; Strand=+; Position=1-615
SLLRSSEFDQFANFSACFSSPSDGSAPRLEGSSPPPLASSIRFPHFVSRQKFTLSSTYEKQDWFPKHMGVQLKVVEGKLRTVDLVIEVHDARVALTGRNPSFGAKLYSVRPHILVFNKMDLINMKRYKEPIEEYYRNEQNITNICWTNCKNLTNKTQFQNLMDKMLDLLRNEHRFNRTVKTEYQVMVVGIPNTGKSSLINALRNV

SEQ ID NO: 159703 - protein, 66 aa, Heterodera glycines
  Coding regions on vcDNA: vcDNA=SeqID_86126; Strand=-; Position=157-357
TQQCGKFLPPLSLCSPVSFFSLFLSVAAAEGTGRPHQLFLHLIFSVHPNDLDLTTYNAPHFYSLPY

SEQ ID NO: 159704 - protein, 22 aa, Heterodera glycines
  Coding regions on vcDNA: vcDNA=SeqID_86127; Strand=+; Position=40-108
PPSPSLFRNKLIEMRCCCCCCC

SEQ ID NO: 159705 - protein, 78 aa, Heterodera glycines
  misc_feature (12)..(12): Xaa can be any naturally occurring amino acid
  Homolog annotation: Hit_ID=AAB94166.1; Match level="QueryCoverage =100%, HitCoverage=51%, E-value=5e-13, Identity=50%"; Hit description= Neuropeptide-like protein protein 13 [Caenorhabditis elegans] ref|NP _504170.1| Neuropeptide-Like Protein
  Coding regions on vcDNA: vcDNA=SeqID_86128; Strand=+; Position=52-287
RDFMAFGKRSPXEAFQREFMAFGKRGAPSDHFQRDFMAFGKRVPDGFQREFMTFGKRSSDVGRGGSFDREFMAFGRRK

SEQ ID NO: 159706 - protein, 80 aa, Heterodera glycines
  Coding regions on vcDNA: vcDNA=SeqID_86129; Strand=+; Position=59-301
TSRHRQMAKEDTWQWLMKRKTKPTILLPFCALNVHVHPRVKKKIVLLLCVLYAVSADERFKIGRRKEHLRRDDKMNGKKM

SEQ ID NO: 159707 - protein, 75 aa, Heterodera glycines
  misc_feature (8)..(8): Xaa can be any naturally occurring amino acid
  Homolog annotation: Hit_ID=CAF90396.1; Match level="QueryCoverage =100%, HitCoverage=52%, E-value=4e-20, Identity=54%"; Hit description= unnamed protein product [Tetraodon nigroviridis]
  Gene Ontology: Mol. function=ATP binding; Cellular component=nucleus; Biological process=negative regulation of cell proliferation
  Coding regions on vcDNA: vcDNA=SeqID_86130; Strand=+; Position=3-226
MERTFVCXKPESVRRGLVGKIIERFEANGFRLIAIKMIVASRKQAMDHYVACAGQPFFPKVIGYMTSGPVVAMIW

SEQ ID NO: 159708 - protein, 61 aa, Heterodera glycines
  Coding regions on vcDNA: vcDNA=SeqID_86131; Strand=-; Position=1-183
QVSNEPVQIAKESTILFTRAQLSENVQKSDVFLRSTTVCAKQKNGAVESLGKMKRCVRETL

SEQ ID NO: 159709 - protein, 87 aa, Heterodera glycines; identical to SEQ ID NO: 138961
  Coding regions on vcDNA: vcDNA=SeqID_86132; Strand=+; Position=2-265

SEQ ID NO: 159710 - protein, 195 aa, Heterodera glycines
  Homolog annotation: Hit_ID=NP_508889.1; Match level="QueryCoverage =75%, HitCoverage=41%, E-value=5e-25, Identity=39%"; Hit description =i-01 protein like (41.5 kD) (XF865) [Caenorhabditis elegans] gb|AAF59637.2| Hypothetical protein Y34B4A.7
  Coding regions on vcDNA: vcDNA=SeqID_86133; Strand=+; Position=161-745
MLEKKIGAEAILKCPANADAPEGCVPDHGRLSWPYVATMAIMPFVVGTLHHPTQMQQRTQSALVIGMGGGTLDMFLHRKTPSLDPMVVQMARKWFGTVEDSTRRTFVEDGIVGIEKAAENGEQFDLVALDACEVYIDLICPASVFSDEKILQKIKAILKPTGAFVVNILMSDEKEEDKYVAEQKRKLLNIFPICL

SEQ ID NO: 159711 - protein, 133 aa, Heterodera glycines
  misc_feature (21)..(21): Xaa can be any naturally occurring amino acid
  misc_feature (26)..(26): Xaa can be any naturally occurring amino acid
  Homolog annotation: Hit_ID=NP_504455.1; Match level="QueryCoverage =70%, HitCoverage=16%, E-value=1e-18, Identity=49%"; Hit description =nuclear Hormone Receptor (64.6 kD) (nhr-47) [Caenorhabditis elegans] gb|AAC19212.2| Nuclear hormone recep
  Coding regions on vcDNA: vcDNA=SeqID_86134; Strand=+; Position=19-420
LFLGSIGRLLEHRSFICMGNXNCPLXGVRCACRACRLEKCLQVGMDPNAIQSERDRIGYTKRTRREKLVGFDEGIGHERGDLCAESFASNDADLEESDEDDVIFRDTEPTGGSPSVNIAQRSKVGTKNYINLR

SEQ ID NO: 159712 - protein, 117 aa, Heterodera glycines
  Homolog annotation: Hit_ID=XP_456171.1; Match level="QueryCoverage =54%, HitCoverage=30%, E-value=4e-10, Identity=53%"; Hit description =unnamed protein product [Kluyveromyces lactis] emb|CAG98879.1| unnamed protein product [Kluyveromyces lac
  Coding regions on vcDNA: vcDNA=SeqID_86135; Strand=+; Position=15-365
MVAANLKLSLIFVAGFCLLFIADSDAGKSCKPGEKGPPGPPGKPGNKGKPGVCKPKYETTSKYGTTTSKYDTTTSKYGTTTPEYDTTASKYDTTTSKYDTTTSDYGTTTSKYDTTTS

SEQ ID NO: 159713 - protein, 229 aa, Heterodera glycines
  Homolog annotation: Hit_ID=CAE72569.1; Match level="QueryCoverage =92%, HitCoverage=15%, E-value=9e-25, Identity=31%"; Hit description =Hypothetical protein CBG19756 [Caenorhabditis briggsae]
  Coding regions on vcDNA: vcDNA=SeqID_86136; Strand=+; Position=25-711
MFKFAKPMTTTAARMIARKSRLEVMPMAKKYTESDYQRELTYRRSDYSFPAFCESDVTHFKRGEVHHKLMQGGASEGGFTLTAYVLVALLENHVQNKVTELARSNLVSHLADFKEDPYALTLCTYVLHLANSPEKGDVLKMLEGLQTTDGMVHWTTKVSNGAKDGSGGAAKNIGDVAWDTNQYFSQPQSANVEMSAYALLTYMLLDNKEHALPIVRWLTAQRNSLGGFS

SEQ ID NO: 159714 - protein, 118 aa, Heterodera glycines
  misc_feature (103)..(103): Xaa can be any naturally occurring amino acid
  Coding regions on vcDNA: vcDNA=SeqID_86137; Strand=+; Position=264-617
RGFLLDNNRCEARLCFNHCIDLTSTVGTSQSANLLDLVAESTSPLEVPMCKKCANAVTAELNKQLGHLEKECIQYKKSLDHLLQRRADCPFDMEASRIKLDAXKSEERDLLEQLTLLE

SEQ ID NO: 159715 - protein, 190 aa, Heterodera glycines
  misc_feature (18)..(18): Xaa can be any naturally occurring amino acid
  Homolog annotation: Hit_ID=AAD27589.1; Match level="QueryCoverage =100%, HitCoverage=31%, E-value=3e-81, Identity=79%"; Hit description= chaperonine protein HSP60 [Onchocerca volvulus]
  Gene Ontology: Mol. function=heat shock protein activity; Cellular component=mitochondrion; Biological process=mitochondrial translocation
  Coding regions on vcDNA: vcDNA=SeqID_86138; Strand=+; Position=3-571
DGEALTTLVLNRLKVGLXVCAVKAPGFGDNRKNTLKDMAVSTGGTVFGEEASLIKLEDIQIQDFGEADEVTVTKDDTLILRGKGSQEDVEKRIASIQDELDASTSDYEKEKLNERLAKLSTGVALLKIGGASEVEVNEKKDRVTDALCATRAAVEEGIVPGGGVALLRALKKLDTLKPDNDDQKSGIKIV

SEQ ID NO: 159716 - protein, 179 aa, Heterodera glycines
  Coding regions on vcDNA: vcDNA=SeqID_86139; Strand=-; Position=57-596
IHCKRKSDSLCDESYTIISLRFSSQALRTIRPKGLGCTPRGNTAAYATRLFSHQFHCRPFRKGANGGDSRASSKHICGSSAGMANSPSLFHRWRKFCQGTTFGVQHNKPQCLALRFGKYNRRQRAANSAILSEVRPFLRLSLSSLWLAFLSGSPNRSFASPAMKFHLSSRMLVNSRSPL

SEQ ID NO: 159717 - protein, 163 aa, Heterodera glycines
  Coding regions on vcDNA: vcDNA=SeqID_86140; Strand=+; Position=166-657
GERNHNEKTTEWRNIVEFARQLKGENERRLLTGCRTFKFPTKWARIPSGSSSFSLMAKPREICELADNCFFDVQELKKKIKHREAFSPVDIAHSVDVSGKGDPCSFINENYEVRWAYDSNTANVNFVMKQKAKSGKWWSAVGDWRQYERHGHWRCVPRRRRAK

SEQ ID NO: 159718 - protein, 131 aa, Heterodera glycines
  Coding regions on vcDNA: vcDNA=SeqID_86141; Strand=-; Position=273-668
SEPEPDAEDDPEPLSEVSVVDPSVVSSVSSVVSSFVALFSASAASAAPSFGCSSAVTASSSFFSAVWSPPSSSFFCSSSSCSNGTVTPKRVAGDSIRGSVFVSSVGPFSTSASPSPSSSPVPSLFGFINSR

SEQ ID NO: 159719 - protein, 226 aa, Heterodera glycines
  Homolog annotation: Hit_ID=AAN32884.1; Match level="QueryCoverage =100%, HitCoverage=67%, E-value=1e-132, Identity=100%"; Hit description=cellulase ENG-5 [Heterodera glycines] gb|AAP97436.1| cellulase ENG-5 [Heterodera glycines]
  Coding regions on vcDNA: vcDNA=SeqID_86142; Strand=+; Position=31-708
MSAWICPGFLLFFVLILITDHCPMTQAVTQPPYGQLAVSGKNLVQKSTKKAVALHGLSMYWSQWVPKFWVKQTVNKLKCSCNANVVRAAMASSFGGYISNPTAEYKKMTAIIDGAIDQGLYVVVDWHTGDDLATTEIKYATEFFTKIAKAYNKYPHILYEIWNEPNKFVAWEAVVKPYAKTMIDVIRKYDKNNVIIVGTPNWDQDVDIVAKSPLKDANIIYTMHFY

SEQ ID NO: 159720 - protein, 202 aa, Heterodera glycines
  Homolog annotation: Hit_ID=NP_498174.1; Match level="QueryCoverage =67%, HitCoverage=80%, E-value=9e-19, Identity=36%"; Hit description =immature colon carcinoma transcript 1 like (3G589) [Caenorhabditis elegans] gb|AAL06045.1| Hypothetical p
  Coding regions on vcDNA: vcDNA=SeqID_86143; Strand=+; Position=96-701
MLPSPSFSIQLVSRLFSQFFNRPLCSSAHLLSKDPSNSRNSGRDHNFFEGLYFEGEIPRDRIKQKYTLSSGPGGSNVNSHPTKAEIRFTVDEADWIPRRVRERLVERYPRYMNNRGEFAFTSQKTRYQIQNMNDCFDRLHNMLLNCSEELVKEEHRTHVSPQRISIMEERKKRSEEFRLASKKFSFAEKTKPTFGLQHLNGP

SEQ ID NO: 159721 - protein, 203 aa, Heterodera glycines
  Coding regions on vcDNA: vcDNA=SeqID_86144; Strand=+; Position=5-613
HEAKATDTEVKTTDNEAKALKKKKKKAIGEPSKDFRIKEEGLCSMFLIKVEEGRKAYRYDIEVMNMVKQKSLTRGTDDGLRAFNRKICYELLIIAYEKTGQFGMKPDEKGRMGEIVYDSKATMYSSMPFHLECPKIEITHEEIVDDYVRDHTAMDSFLVTITPNHQKPVLDISDYRQYYSKKSLFDEDRTVRTFLEKEKKKKK

SEQ ID NO: 159722 - protein, 185 aa, Heterodera glycines
  Homolog annotation: Hit_ID=CAF96846.1; Match level="QueryCoverage =84%, HitCoverage=18%, E-value=1e-20, Identity=28%"; Hit description =unnamed protein product [Tetraodon nigroviridis]
  Gene Ontology: Mol. function=cytoskeletal protein binding; Cellular component=cell-cell adherens junction; Biological process=axon guidance
  Coding regions on vcDNA: vcDNA=SeqID_86145; Strand=+; Position=1-555
SLRSVEYFAENEIDIFAILFVALFIAIAEADGNVRAKRHEERLKRQDNRADEENRQVDSADREKRQDNRADREKRQEDSADREKRQDNRADREKRQDNRADREKRQDNRADREKRQDNRADREKRQDNRADREKRQDNRADREKRQDNRADQENRQEDSADREKRQDNRADREKRQDNRADREKR

SEQ ID NO: 159723 - protein, 129 aa, Heterodera glycines
  misc_feature (61)..(61): Xaa can be any naturally occurring amino acid
  Homolog annotation: Hit_ID=CAE56905.1; Match level="QueryCoverage =96%, HitCoverage=32%, E-value=4e-35, Identity=57%"; Hit description =Hypothetical protein CBG24746 [Caenorhabditis briggsae]
  Gene Ontology: Biological process=sulfur amino acid metabolism
  Coding regions on vcDNA: vcDNA=SeqID_86146; Strand=+; Position=22-412
MENALAIGRWLEKDPRVEKVLYPELESHPQHQIHKKQSSGMSGMLSFYIRTDFDGALKFLXLKVFLVARSLGGFESLASLPAAMSRDSVPAKVRAQTGISDNLIRLSIGCEDKADLINDLDMAMRVVTE

SEQ ID NO: 159724 - protein, 132 aa, Heterodera glycines
  Homolog annotation: Hit_ID=BAC03887.1; Match level="QueryCoverage =93%, HitCoverage=56%, E-value=3e-09, Identity=40%"; Hit description =unnamed protein product [Homo sapiens]
  Coding regions on vcDNA: vcDNA=SeqID_86147; Strand=-; Position=314-712
PEADDDAEPEPLSEVSGVPEVSSVVSVVSSVVSSVVADFSPPVSAAASSFFSSAADPPSSFFSSSALSPPSSSFCCSSTTRSDGTATTSPAAEGGVSFLSSSAPFSTSPSAPPLPSSSSSSPSAFFGFMNRR

SEQ ID NO: 159725 - protein, 123 aa, Heterodera glycines
  Coding regions on vcDNA: vcDNA=SeqID_86148; Strand=+; Position=2-370
NVRKLEEWLKDGAAQFGPDFDVDSAIKLLRSAELFHLASKLAAKSDRPFTFLDILCQDTREWGKAVKFISERPLSVSCELLETYGPILLEHVEEQTLALIGRLIWSEGVNLKNLTKKKKKKKK

SEQ ID NO: 159726 - protein, 88 aa, Heterodera glycines
  Coding regions on vcDNA: vcDNA=SeqID_86149; Strand=-; Position=0-263
KIQWKMFLAADFVPSGKVSTYFMISSNLVLNDFPCWRSICLTRWRTSAGSCATSGGSGIWSMTFSGRVQMIESIRSIFCSALNDPSSG

SEQ ID NO: 159727 - protein, 101 aa, Heterodera glycines
  Homolog annotation: Hit_ID=AAH67650.1; Match level="QueryCoverage =60%, HitCoverage=15%, E-value=4e-17, Identity=72%"; Hit description =LOC407686 protein [Danio rerio]
  Coding regions on vcDNA: vcDNA=SeqID_86150; Strand=+; Position=98-400
LIDCRAPRVSFIIPCCSDLYSLFRVVSPMYILYVCIFYIVYYVYLFDLYYVFVCNKQFMGKKKKKKKKKKKKKKKKKKKKKKKKKKKKKKKKKKKKKKKKN

SEQ ID NO: 159728 - protein, 136 aa, Heterodera glycines
  Coding regions on vcDNA: vcDNA=SeqID_86151; Strand=+; Position=167-574
QHWTTVRCSNCSVLLPIVCPTLAFTERMKTWYVKKDFAQQMLQNLRSNQPSTIHENQLHLRVEFIKALRDFQYNVEQCHDPLLHSLQSEEAVLKLLELMFPRTNPDEESENGDVMKFTNPSVVSNGVLVLNALMET

SEQ ID NO: 159729 - protein, 157 aa, Heterodera glycines
  Coding regions on vcDNA: vcDNA=SeqID_86152; Strand=+; Position=2-475
EHLRDCKERGYYIKETSIDNDMLRFAFILSLQNDSPSSSRIDKAANCKHHTDENDEKLEELLLILNDNTIKRDIPELIEEAMNWLKEHIGEEEYVKLEKVLEEKRQAEQKPSIIEKKHDKDGENSEEGMGKRIKDKISQAKENLKGIIKQKLMKKTN

SEQ ID NO: 159730 - protein, 126 aa, Heterodera glycines; identical to SEQ ID NO: 141921
  Homolog annotation: Hit_ID=AAH47137.1; Match level="QueryCoverage =78%, HitCoverage=78%, E-value=1e-21, Identity=51%"; Hit description =Histone 2, H2bb [Mus musculus] ref|NP_783597.1| histone 2, H2bb [Mus musculus] gb|AAO06250.1| histone prot
  Gene Ontology: Mol. function=DNA binding; Cellular component =nucleosome; Biological process=nucleosome assembly
  Coding regions on vcDNA: vcDNA=SeqID_86153; Strand=+; Position=101-481

SEQ ID NO: 159731 - protein, 134 aa, Heterodera glycines
  Coding regions on vcDNA: vcDNA=SeqID_86154; Strand=+; Position=3-407
LFLWPYRDCRNNYYSKDDLTKSTLKHLAFIICGLTLWSQLTKSFIICGLTFWSQLSQFGSIQLCTRRTNLSSKMRKTKMADRMDRMPKWSINNMPKLCQCQFNHLAQNGFFLKNNDKSEIFLMKEHLVSPAKTC

SEQ ID NO: 159732 - protein, 126 aa, Heterodera glycines
  Coding regions on vcDNA: vcDNA=SeqID_86155; Strand=+; Position=45-425
MVYEEYCFDVRLDTSQESVSGEQRRHRTQQLPLCGTDESELHDLPWRHYDIFVCEKTISGLKDDRSENVFNRRQGACASGDDRCDNVFNRGQVASARNGEGRDSILIQGLAFVIVKVVNAVYDMIV

SEQ ID NO: 159733 - protein, 224 aa, Heterodera glycines
  Homolog annotation: Hit_ID=CAE72569.1; Match level="QueryCoverage =91%, HitCoverage=15%, E-value=1e-23, Identity=31%"; Hit description =Hypothetical protein CBG19756 [Caenorhabditis briggsae]
  Coding regions on vcDNA: vcDNA=SeqID_86156; Strand=+; Position=23-694
MFKFAKPMTTTAARMIARKSRLEVMPMAKKYTESDYQRELTYRRSDYSFPAFCESDVTHFKRGEVHHKLMQGGASEGGFTLTAYVLVALLENHVQNKVTELARSNLVSHLADFKGDPYALTLCTYVLHLANSPEKGDVLKMLEGLQTTDGMVHWTTKVSNGAKDGSGGAAKNIGDVAWDTNQYFSQPQSADVEMSAYALLTYMLLDNKEHALPIVRWLTAQRNF

SEQ ID NO: 159734 - protein, 156 aa, Heterodera glycines
  Coding regions on vcDNA: vcDNA=SeqID_86157; Strand=+; Position=259-726
LQFDDEAFLAFVKGPANFDKFCAGKGVTNDQSKELLAQIYGTHLGILFYMRKNWHCANVRKEFEEFIGPEECQLFQNYLCIVYEFLFNVYAEQEDIMKPIFKQPIGFRISILMSLMSALELMAKFSKFCLYELKLIERNDSTLAETIQLENEQETL

SEQ ID NO: 159735 - protein, 225 aa, Heterodera glycines
  Homolog annotation: Hit_ID=NP_505680.2; Match level="QueryCoverage =80%, HitCoverage=35%, E-value=2e-47, Identity=47%"; Hit description =amino acid/polyamine transporter, family II (57.3 kD) (5K912) [Caenorhabditis elegans] emb|CAD54163.1| Hy
  Coding regions on vcDNA: vcDNA=SeqID_86158; Strand=+; Position=5-679
MMEMTILGNRICITADGAKVSPFGSKMDMGDYYVENNKLRKTRGLGWVMAALFVVADMAGGGIVALPTAVVRCQFFSGLLILLCMAIISTFSAVMLGQCWEILLRRFPVYRTHCRKPYAEIGLKALGPKIRTIVSICVNVTQYGATTVFLLLCAKNIRDFIRAFLDKEISFCYLIVVIALVLLPVTLLKSPNGFWPVIVGGMLSTIVAIVFICIGAMMDWRSCAP

SEQ ID NO: 159736 - protein, 118 aa, Heterodera glycines
  Coding regions on vcDNA: vcDNA=SeqID_86159; Strand=+; Position=272-625
RGFLLDNNRCEARLCFNHCIDLTSTVGTSQSANLLDLVAESTSPLEVPMCKKCANAVTAELNKQLGHLEKECIQYKKSLDHLLQRRADCPFDMEASRIKLDALKSEERDLLEQLTLLE

SEQ ID NO: 159737 - protein, 223 aa, Heterodera glycines
  misc_feature (207)..(207): Xaa can be any naturally occurring amino acid
  misc_feature (214)..(214): Xaa can be any naturally occurring amino acid
  Coding regions on vcDNA: vcDNA=SeqID_86160; Strand=+; Position=2-670
IFESLKYLKIGKICKPNSKPKQKLYSSNFLLLQYFILTMADLRMEASNDVIIPVNVAIRIFSFVSRDDLENCKLTCKSWKDVIDYADNRKNSELQLRHIDAICLSTNSEFSIKIYYNQTIREFYYKKYFADMEIDEIEVKKVRHLTNQFDEKKYVFPCGEHLPIRQSHSFVFPAVDIFHQHRCKMVRPTVYQDHVNYTRKLFTPPLXFYERLQXMLKKCKIRL

SEQ ID NO: 159738 - protein, 63 aa, Heterodera glycines
  Coding regions on vcDNA: vcDNA=SeqID_86161; Strand=+; Position=210-398
FYPDITMIDKTSAHNKTIASKPMCMNALIFYKMLHVVYERYTEIKAIRYQNPGALINRFPFES

SEQ ID NO: 159739 - protein, 205 aa, Heterodera glycines
  Homolog annotation: Hit_ID=NP_040275.1; Match level="QueryCoverage =86%, HitCoverage=46%, E-value=6e-10, Identity=25%"; Hit description =ORF 73~ECLF1 [Saimiriine herpesvirus 2] emb|CAA45696.1| unnamed protein product [Saimiriine herpesvirus 2
  Coding regions on vcDNA: vcDNA=SeqID_86162; Strand=+; Position=4-618
FLEQEIGKEEEKDNGTSEEKGMERTEEQQTKTPTEEEKRGEEDKTEGQRMADFQRENAPSPEERDEAKQSPIEEKAFVWQTVQTHPAEERAEDTYAESVDHPAKFEEITAKTDEREGEDSARSVDHHFEEVNATSDHVGEEGSPRLADHHFEEVNARSEASPGSVDHHFEEVNARSEASPGSVDHHFEEVNARSEASPRSVDHHF

SEQ ID NO: 159740 - protein, 212 aa, Heterodera glycines
  misc_feature (10)..(10): Xaa can be any naturally occurring amino acid
  Homolog annotation: Hit_ID=XP_424742.1; Match level="QueryCoverage =77%, HitCoverage=38%, E-value=1e-11, Identity=28%"; Hit description =PREDICTED: similar to Cockayne syndrome WD-repeat protein CSA (DNA excision repair protein ERCC-8) [Gallu
  Gene Ontology: Mol. function=protein binding; Biological process=DNA repair
  Coding regions on vcDNA: vcDNA=SeqID_86163; Strand=+; Position=1-638
WIWDADTLSXVEKFAFEQPISSFHWFVPCDCNSSLISIATSSSNVVLLGPRLGNTAQQIRCLQQRIWSVRWDRFRDYVLVTGSDSGEIALWDIRSGKNELKRVKGPYENDNAKSESDRKRTANRMRNSAKLFHSDRIVCLRCTSDGRFLLSLSQNRNVCVWDAETMRMLCHLKVPESEGDLSTFPVQFELCDEGRLIWLFIPNSNNVTVGNC

SEQ ID NO: 159741 - protein, 174 aa, Heterodera glycines
  Homolog annotation: Hit_ID=CAE57411.1; Match level="QueryCoverage =89%, HitCoverage=19%, E-value=1e-11, Identity=25%"; Hit description =Hypothetical protein CBG00366 [Caenorhabditis briggsae]
  Coding regions on vcDNA: vcDNA=SeqID_86164; Strand=+; Position=43-564
MPPSLLGKPYKFKHLPRELSERWTEPTWVEAVKQAHENDAGKLKPWQQRYLDWMILQARLCGYLTVKKNDKKAQLQQEVNFSWNSATNQFCFRFLANHMQDNGVIVPIEHRYLLKSAPPRALALLSKGNDPENGPWEVTSKKHDALFAALNYCSAREIRQGLWQSYVTRSAFSS

SEQ ID NO: 159742 - protein, 95 aa, Heterodera glycines
  Coding regions on vcDNA: vcDNA=SeqID_86165; Strand=-; Position=134-421
MVSNWMNCLGLISRRPTPPPSPPSPPSGPFSTTISAPSSSSSLITSSSSSSSSSSSSESITCTVTAGASFCCCCFCLYCLPSSWPPSVPWAPPFL

SEQ ID NO: 159743 - protein, 125 aa, Heterodera glycines
  Coding regions on vcDNA: vcDNA=SeqID_86166; Strand=-; Position=26-403
SFVTKTIINILDHVKKKGREKCGNDREKKEREKQCSIRHWNQNNKINNSRHLVVVCSRPILSHHPSIVFLCIPLPSIRRGGTIHFPPHCLCNGPYSRVWNFRCPKRLGWNCWCACICAALARCPR

SEQ ID NO: 159744 - protein, 162 aa, Heterodera glycines
  misc_feature (36)..(36): Xaa can be any naturally occurring amino acid
  Homolog annotation: Hit_ID=CAE59495.1; Match level="QueryCoverage =83%, HitCoverage=37%, E-value=6e-33, Identity=47%"; Hit description =Hypothetical protein CBG02880 [Caenorhabditis briggsae]
  Gene Ontology: Mol. function=protein tyrosine kinase activity; Cellular component=nucleus; Biological process=protein amino acid phosphorylation
  Coding regions on vcDNA: vcDNA=SeqID_86167; Strand=+; Position=1-488
KGIAHRDLKLENVLLCENGVIKVTDYGFSKQSSDLXLTFCGSRSYSSPEILLGIAYDMFKSDIWSLGVTAFIMITNTMPFHEDSPNQQIVDSQRKRRYKYPSWLNITKQCRTAIDALLTYQPAFRPNIFECAKLEWFAQDSASLWCGGRRAGVGVMGQVRGR

SEQ ID NO: 159745 - protein, 189 aa, Heterodera glycines
  Homolog annotation: Hit_ID=XP_394169.1; Match level="QueryCoverage =57%, HitCoverage=17%, E-value=6e-25, Identity=52%"; Hit description =similar to helicase RM62-like protein E [Apis mellifera]
  Gene Ontology: Mol. function=RNA binding; Cellular component =cytoplasm; Biological process=pole plasm RNA localization
  Coding regions on vcDNA: vcDNA=SeqID_86168; Strand=+; Position=27-593
MYSPIFEPNKVPSTTINGDRPQKLRHAALDDFRAGRYQVVVTTDVCARGIDLKELDHVINMDLPIDYTTYVHRIGRTGRIKEGASTSFFDLAEDVELAKELVEGLQKQDQEVPDWLKLVAEGKMPLDESEAASGANSVPIAVRVPSETVPDTNSLPAAVTVPTDNVAATGANSVPLGTRVQDDGTPNGE

SEQ ID NO: 159746 - protein, 186 aa, Heterodera glycines
  Coding regions on vcDNA: vcDNA=SeqID_86169; Strand=-; Position=15-575
SVAVCSCLPHLLLSHHHPSAHFRRFFARRRRCLAVHRCPIQCQCQCRRCRGANLNVLLDALSSTCSDNICRFNASLFVGSITVRICFLLLIHRWSAAAPALLAELVHAGASREEKLGARLGHRKIARISIPMSVLLLLVLAKTHFGQCRVQKRFSLTFRRFVLLPVTLNPLGTNDIRGGKARIGSV

SEQ ID NO: 159747 - protein, 192 aa, Heterodera glycines
  Homolog annotation: Hit_ID=NP_491681.1; Match level="QueryCoverage =96%, HitCoverage=25%, E-value=2e-30, Identity=39%"; Hit description =Germ-Line Helicase GLH-3, germline DEAD box RNA helicase-3; contains 2 CCHC type zinc fingers (79.7 kD) (
  Gene Ontology: Mol. function=RNA helicase activity; Cellular component=cytoplasm; Biological process=translational initiation
  Coding regions on vcDNA: vcDNA=SeqID_86170; Strand=+; Position=39-614
MIRCGKHFVDAFSDESQITVLTGGGTTQIELIRSFDECELPEPIKRNIELKKYTQPTPIQKAVIPLIANTKRDIMGHAQTGTGKTAAFLLPIVCHVQKLVEARGSGVVNGTHPVALIVVPTKELAEQLYEEARAFAAGTSVSVCHTYGHMPMALSLREKSDGCDIFIGTCGRIQQFVEERYIQLDILRYLVL

SEQ ID NO: 159748 - protein, 197 aa, Heterodera glycines
  misc_feature (20)..(20): Xaa can be any naturally occurring amino acid
  Homolog annotation: Hit_ID=CAE64949.1; Match level="QueryCoverage =100%, HitCoverage=97%, E-value=7e-61, Identity=59%"; Hit description= Hypothetical protein CBG09780 [Caenorhabditis briggsae]
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_86171; Strand=+; Position=21-611
MGFSTKHIIIDGKDRLLGRXGAGTSKKLLLGQKMVIVRCESINISGNFHRSKLKFLGFLHRRCNVNPSRGPFHYRAPYQILWRTGRGMLPHKTARGMEALKKLKCFDGCPQPYDTKKKFVLPNSLRHIALKPRRKYCTVGRLAHEDGWQYQRVVDKLETNRKVRGAALHEKKKALLKLKRKAVENAKPKTALFDKIL

SEQ ID NO: 159749 - protein, 150 aa, Heterodera glycines
  Coding regions on vcDNA: vcDNA=SeqID_86172; Strand=+; Position=3-455
RTATLRAPVSRRFEWLRRALHASSAGLDLIGSDATLILNQQQQMIRQGDTVEPIADDLLRADFSMPKLREFFECQKAMGVPNFAEDFDEFWLLVVKARLFNVFKYRGPDAYNRVVLKIRDIAHQLRAQVEENEHSDGTEKPKRGKKQMTN

SEQ ID NO: 159750 - protein, 64 aa, Heterodera glycines
  Coding regions on vcDNA: vcDNA=SeqID_86173; Strand=+; Position=3-197
AKTTTENVKVRIAVATWRNSESRRRRTMEMAAVGPALRPFQPDQFCQSFAYPFTIIYRFPLFKH

SEQ ID NO: 159751 - protein, 216 aa, Heterodera glycines
  Homolog annotation: Hit_ID=NP_502093.1; Match level="QueryCoverage =96%, HitCoverage=53%, E-value=8e-22, Identity=33%"; Hit description =tau-tubulin kinase family member (4L926) [Caenorhabditis elegans] emb|CAA97422.1| Hypothetical protein C0
  Coding regions on vcDNA: vcDNA=SeqID_86174; Strand=+; Position=2-649
TESVHKKWEVERTLSSGAYGVVFLCKDPLMDIKGVVKVARAESGSETAEWEAAVMDKVTKNTHGKSINIVKLLDKGVLVAPDNSRLNFMVLEFCELTVKKYLSYRPAGPPRRARICQVLLGALKAIYDMHNQGLLHRDLKPENMGILSRADPVTVLYDLGMSRMFTNQLGQVREPRTVVPFKGAVEWASGHALNGREQTRWDDLIAWLYIAVELFD

SEQ ID NO: 159752 - protein, 196 aa, Heterodera glycines
  Coding regions on vcDNA: vcDNA=SeqID_86175; Strand=+; Position=2-589
KKKLQLFFLFAVFIAANAFDSAQSVGKTSAEDEVRAVTEGAAPQRQTPTRKSLKMFGHGLRHHTGMDLLMKLGQQQAEEPKSFSSMDILRLFDGLDHQFYHDLEKAQSLFEENAKVVKSLENRVVKLESAMAKAAEHCEPGKVQLVSAHYDTAIVLLALLIVLLLCLSLLFANLMLANFKRKGVVQMPLAMMRGES

SEQ ID NO: 159753 - protein, 44 aa, Heterodera glycines
  Coding regions on vcDNA: vcDNA=SeqID_86176; Strand=-; Position=2-133
NKANRTGESITEQQSLLCVSTVSVYPRSAHFDEHCNLSRPDHVP

SEQ ID NO: 159754 - protein, 178 aa, Heterodera glycines
  Homolog annotation: Hit_ID=AAF01032.1; Match level="QueryCoverage =100%, HitCoverage=42%, E-value=2e-86, Identity=84%"; Hit description= casein kinase I epsilon [Xenopus laevis]
  Gene Ontology: Mol. function=casein kinase I activity; Cellular component=nucleus; Biological process=signal transduction
  Coding regions on vcDNA: vcDNA=SeqID_86177; Strand=+; Position=26-559
MELRVGGRYRLERKIGSGSFGDIYLGENIMTHEEVAIKLECVKTKHPQLHIEAKLYKMMSGGVGIPQVRWCGFEGEYNVMVMELLGPSLEDLSNFCSRKFTLKTVLLLADQMLARIQYIHSKDFIHRDIKPDNFLMGLGKRGNLVYIIDFGLAKRYRDQRTKQHIPYRDHKNLTGTAR

SEQ ID NO: 159755 - protein, 30 aa, Heterodera glycines
  Coding regions on vcDNA: vcDNA=SeqID_86178; Strand=-; Position=172-264
FFFFFFWLHSFDSTRIRPFLSFRRFPFLRG

SEQ ID NO: 159756 - protein, 166 aa, Heterodera glycines
  Coding regions on vcDNA: vcDNA=SeqID_86179; Strand=+; Position=38-538
MECQFDGTEAGKCAFCVKLPCKFGAVNCAEEVSISCVNPQELEKCCKARDNECCVCVLCEKNKVMKVLVECCGKRTETSAEAGKALCICVPKIGGGKCGGQVQVKQCDAKLVDECCAANTESGDCCCVCLSCNDQKCVVTVRCPTGEAKSTGPTCTASKCESVKCC

SEQ ID NO: 159757 - protein, 227 aa, Heterodera glycines
  Coding regions on vcDNA: vcDNA=SeqID_86180; Strand=+; Position=2-682
LFFAVRVHNVNSFNVMATTVNGNASSLVAPLSPPKTGPSGPQVAIVSAKLIITSNGIEKEGDQMSTAASVARRTPLSIVQTAGGAVHRQLSDSMCYKSGHSNGSGNENNDGGADSDTTLDRPAYCGDGLPPRSATMPPLRSILKKPRAPQPPSPVPANNDSTLLMMTKMAFANGAASGQQQQLRQHQQPNRFTMVPSPMPRNHLRRVPTRLVLERSVSDSVLDDAAI

SEQ ID NO: 159758 - protein, 115 aa, Heterodera glycines
  Coding regions on vcDNA: vcDNA=SeqID_86181; Strand=+; Position=1-348
EPSTNKHLMCPFKLENFGVYLPAWHKPVTNRYGKRKRVVREAGGMEVPGDTETQATETDSNNQIDEDGWITVTRKHKFSFRNKVSRSDEGNATFMGMEGSADEPYDRPRKKKRTR

SEQ ID NO: 159759 - protein, 124 aa, Heterodera glycines
  Coding regions on vcDNA: vcDNA=SeqID_86182; Strand=-; Position=0-371
RTDTNYSTTRRGMDNPNQANHRSLVISRRPVIPVLLWALLRWRQVRLRLFPSSPRSAVLPWALLRCPAAASTAVSLVSAKDTSQLRNSHVFTLLGGCGTCLVGYEVGVMYGFDRPLGYGFFVSA

SEQ ID NO: 159760 - protein, 63 aa, Heterodera glycines
  Coding regions on vcDNA: vcDNA=SeqID_86183; Strand=-; Position=0-188
RSFFSSTILCRLSNAFGWVLLFAQCLAWVCEFGLGMPVVLTRWSSSSGGRVAPEGAVQMAPRR

SEQ ID NO: 159761 - protein, 190 aa, Heterodera glycines
  Coding regions on vcDNA: vcDNA=SeqID_86184; Strand=+; Position=17-586
MVVLPIFAAVAGAVGEDKKRQRTGEAEEQLDGDGVITSAEQPTTTANSECSSIVGEATDGGGKTPTGGETVTNEYQQQCHRNNIINSGGSCPLALSSSERMVSELIAAVIEQSRQRQQLQKHQQQLLISTNKVEETNNSGGSEMRAEGEERGDEMAPEEGGSIWQQSKGENGTVTAEAVPNHPTTANAGG

SEQ ID NO: 159762 - protein, 187 aa, Heterodera glycines
  Coding regions on vcDNA: vcDNA=SeqID_86185; Strand=+; Position=1-564
KRTLLLLDGCVSGVKTACKGKVKVEFTEPGTGFFSGNCYEEAKTALENDFELSKGNDLSGFSEKDDNGTITEQAYDSTVFTLPVLLQHRKCSGLGSATMDNTFKDITLTISGGDCESQSFKLKDVDASKGRVQEMRGLELIMIDGTAKQWTDDSGNYQYTKKDQLMFKPMENIDKIDEFGKFESPSY

SEQ ID NO: 159763 - protein, 102 aa, Heterodera glycines
  misc_feature (90)..(90): Xaa can be any naturally occurring amino acid
  Homolog annotation: Hit_ID=AAH72894.1; Match level="QueryCoverage =88%, HitCoverage=30%, E-value=2e-32, Identity=73%"; Hit description =Cdk5 protein [Xenopus laevis] sp|P51166|CDK5_XENLA Cell division protein kinase 5 (Neuronal cyclin-depende
  Gene Ontology: Mol. function=protein binding; Cellular component =filopodium; Biological process=cell-matrix adhesion
  Coding regions on vcDNA: vcDNA=SeqID_86186; Strand=+; Position=358-727
MKMSNSNDMSGYEKLGKIGEGTYGTVFKARNKDTEQIVALKIVRLDDEDEGVPSSALREICLLRELRHANVVRLQNVVHTNKTLNLVFEXCDLDLRKFMLLS

SEQ ID NO: 159764 - protein, 234 aa, Heterodera glycines
  misc_feature (21)..(21): Xaa can be any naturally occurring amino acid
  misc_feature (146)..(146): Xaa can be any naturally occurring amino acid
  Homolog annotation: Hit_ID=NP_490840.1; Match level="QueryCoverage =100%, HitCoverage=16%, E-value=2e-77, Identity=60%"; Hit description= death-associated protein kinase 1 (1B801) [Caenorhabditis elegans] gb|AAK18971.1| Temporarily assigned g
  Gene Ontology: Mol. function=calmodulin-dependent protein kinase I activity; Biological process=induction of apoptosis by extracellular signals
  Coding regions on vcDNA: vcDNA=SeqID_86187; Strand=+; Position=1-702
RIKPTRGMEQTMQSIFPRIQXALRRSMQTFQDSIEAELAQWRYCSKMQSSKMEALIRLVGESVEVQIRGPPEKATACIYFLEDLSTLVELTSAEVAPGISTERHFLSPAHLREHRTTPAIFTPETIMEMQQNESLVIVNSDGEEEXEFTDVVCFGSKEAAGLLTLGVDISVSQLQLSARSELAALLDAPNTLGMDWSILAVKLNLTEQIPEVDSSGQSLSRTDQLLTEWALHSP

SEQ ID NO: 159765 - protein, 184 aa, Heterodera glycines
  Coding regions on vcDNA: vcDNA=SeqID_86188; Strand=+; Position=4-555
RPTDPITDAWAPRTNLSANRTSDQAMANQRCPDDSVNARTQQIHANNAMMPTNRSNLSLNQPNVTPVHRQNGPSNVAQMLADRRAGAVTPNHRLATNSTIRIGGQSSQLGPFQQMKMRMNWSMRPPSGLAVSTPVQPRPIGQANNSSTSMLRQFPIRGGRGQPQQQQMRRAPPPGNCDVPSPPQ

SEQ ID NO: 159766 - protein, 117 aa, Heterodera glycines
  Homolog annotation: Hit_ID=NP_508085.2; Match level="QueryCoverage =74%, HitCoverage=10%, E-value=2e-09, Identity=36%"; Hit description =glutamate carboxypeptidase ii homolog family member (85.5 kD) (XA925) [Caenorhabditis elegans] gb|AAU0554
  Coding regions on vcDNA: vcDNA=SeqID_86189; Strand=+; Position=183-536
MAQAEEFERHAQGQSAGANLAQLAWANDRLRKLEQCFVNPAMGLAREEPLKRHVLFATGNDNSYAATTLANVYNKIGQFRGAKSDNERTKRGNELALELTVVQQAIRCAVSTLSKGI

SEQ ID NO: 159767 - protein, 52 aa, Heterodera glycines
  Homolog annotation: Hit_ID=NP_501725.2; Match level="QueryCoverage =78%, HitCoverage=2%, E-value=5e-10, Identity=63%"; Hit description =putative protein, with 2 coiled coil-4 domains, of eukaryotic origin (4K462) [Caenorhabditis elegans] emb|
  Coding regions on vcDNA: vcDNA=SeqID_86190; Strand=+; Position=165-320
MRPPKSLSEIVINYFRNEHFMCRVPVANCPPFSLFYPHRCPEPKKKKKKKKK

SEQ ID NO: 159768 - protein, 215 aa, Heterodera glycines
  Coding regions on vcDNA: vcDNA=SeqID_86191; Strand=+; Position=9-656
WKRHKIAKECYEKMGKDGISAGGRHWRGIKVKTKPKSGPNGEQMRNFELETSFTSQIINVGLNRRQFSIRFDGNDQSDSFTMFSPSNNDSSSFADQSDLQNEFLNNLPKSAFLGEFAGFWLLGLDMLPPMNAVPSSSLRHENVQLYIHRGAQCTMEAWFTQPSDSVNPIDPKVATVVPKSFPPVSTSPPMSTADQQFTTNVTDSEHQSINISTTA

SEQ ID NO: 159769 - protein, 77 aa, Heterodera glycines
  Homolog annotation: Hit_ID=AAA98565.1; Match level="QueryCoverage =97%, HitCoverage=47%, E-value=7e-14, Identity=51%"; Hit description =fatty acid binding protein homolog As-p18 [Ascaris suum] sp|P55776|FABH_ASCSU Fatty acid-binding protein h
  Coding regions on vcDNA: vcDNA=SeqID_86192; Strand=+; Position=1-231
PGRLILSENFDEYLEAQGYGWFMRQVVKLVGITKTFSKNENGTYACKIETTKKNVDWSSFKLGEEFQAEYLDDSVHK

SEQ ID NO: 159770 - protein, 228 aa, Heterodera glycines
  misc_feature (164)..(164): Xaa can be any naturally occurring amino acid
  misc_feature (169)..(169): Xaa can be any naturally occurring amino acid
  misc_feature (178)..(179): Xaa can be any naturally occurring amino acid
  Homolog annotation: Hit_ID=NP_740995.1; Match level="QueryCoverage =100%, HitCoverage=40%, E-value=2e-86, Identity=67%"; Hit description= DeHydrogenase, Short chain (dhs-6C) [Caenorhabditis elegans] gb|AAK68188.1| Hypothetical protein C17G10.
  Coding regions on vcDNA: vcDNA=SeqID_86193; Strand=+; Position=2-684
FADVTERYFSEKMWPDEKIVEKVVGTDNRLFIILYKELYYRDLYTRMQRVTLMHRFHSYMNYQRLFSEILNQKDPNNPQNYIAVNLQLPNIWLWDIIDEFVYQFQAFCLYKANPSKRSPEEIEDLHELEQSQDAWNIYPVLNILYSLLTKSQINEQLKAIRGGXGEPDXVADEFGRNXXLYFKLGYFSLIGLLRTHVLLGDYHQALQTVEYLEMDAKGLYNTVPSCLV

SEQ ID NO: 159771 - protein, 211 aa, Heterodera glycines
  Homolog annotation: Hit_ID=CAE57713.1; Match level="QueryCoverage =99%, HitCoverage=38%, E-value=5e-85, Identity=74%"; Hit description =Hypothetical protein CBG00721 [Caenorhabditis briggsae]
  Gene Ontology: Mol. function=chaperone activity; Cellular component =actin filament; Biological process=protein folding
  Coding regions on vcDNA: vcDNA=SeqID_86194; Strand=+; Position=3-635
NGYRLACKEAVRYMTENLSFPVEELDRASLIRAAKTSMSSKLIGSESDFFAELCVDATVAVKRTDKAGRVSYPINSVNVLKAHGKSSKESQLISGYALNCTRASDAMPRKILNAKIACLDFSLQKAKMHLGISIIVEDPEKLEAIRREELDITKRRVEKIIKSGANVVLTTGGIDDLCLKEFVEAGAIGVRRCKKADLKRIAKATGATLTA

SEQ ID NO: 159772 - protein, 123 aa, Heterodera glycines
  Coding regions on vcDNA: vcDNA=SeqID_86195; Strand=-; Position=22-393
ASTPPRLCSSITIISSSIKCDCSCCCCCCLCCSAIVVVAEDGNPSWSSPPSSFIFLCPPPAPWSCDCCCCCCSSASNSANMRFSACCCCSICCNRFVSSSNSMTRLRNCSFSARSRVISLLGR

SEQ ID NO: 159773 - protein, 153 aa, Heterodera glycines
  Homolog annotation: Hit_ID=AAL78216.1; Match level="QueryCoverage =100%, HitCoverage=45%, E-value=4e-85, Identity=99%"; Hit description= aspartic protease precursor Hgg-33 [Heterodera glycines]
  Gene Ontology: Mol. function=aspartic-type endopeptidase activity; Cellular component=lysosome; Biological process=induction of non -apoptotic programmed cell death
  Coding regions on vcDNA: vcDNA=SeqID_86196; Strand=+; Position=94-552
MKGFVSKDIVCMANICVQKQEFTEATSEPGLTFVAAKFDGILGMGFSEISVQKLPTVFDNMVTQQKVPEPVFAFWLNRDPTSEFGGEITIGGTDQRRFVAPITYTPVTHKAYWQFKMDSISGGNGKLACQNGCQAIADTGTSLLAGPKNDIEK

SEQ ID NO: 159774 - protein, 237 aa, Heterodera glycines
  misc_feature (28)..(28): Xaa can be any naturally occurring amino acid
  Homolog annotation: Hit_ID=CAE75369.1; Match level="QueryCoverage =93%, HitCoverage=33%, E-value=9e-62, Identity=52%"; Hit description =Hypothetical protein CBG23353 [Caenorhabditis briggsae]
  Gene Ontology: Mol. function=calmodulin binding; Cellular component =membrane; Biological process=actin cytoskeleton organization and biogenesis
  Coding regions on vcDNA: vcDNA=SeqID_86197; Strand=+; Position=1-710
QPRLACYYREITASSFAKISVDGCVIDXGITPLGINQAGYVLHSAIHAARHDVNCVLHLHTASAAAVSAMKCGLLPIIQEAMILGPVAYHEYRGILTDVQERKEIVKSLGDKKVLMLRNHGFATCGATIEEAFHLAYETIVACETQVAAMRTDLNKNLVLPRESAVAHAYQIAKHGTNGMNRTAVPEENGKMEHTFERMGNIQWGVGELEWEAWMRQLDGAGYQTGHKYRLPILLEP

SEQ ID NO: 159775 - protein, 136 aa, Heterodera glycines
  misc_feature (24)..(24): Xaa can be any naturally occurring amino acid
  Homolog annotation: Hit_ID=CAE60278.1; Match level="QueryCoverage =96%, HitCoverage=31%, E-value=9e-14, Identity=32%"; Hit description =Hypothetical protein CBG03859 [Caenorhabditis briggsae]
  Gene Ontology: Mol. function=protein tyrosine kinase activity; Cellular component=plasma membrane; Biological process=cell proliferation
  Coding regions on vcDNA: vcDNA=SeqID_86198; Strand=+; Position=11-418
LLPREDVVELLPNDGDFLVRMTEXISGTERVYALSVDVGGFLNHVIFRRHKGMFTVDLNSDKGFRTIERFVDNYLRTGVSVTTQQYVALIMAVPRAHWELSHTSIILGNELGRGTFGVVKSGVYVDQQGTRAAVAI

SEQ ID NO: 159776 - protein, 58 aa, Heterodera glycines
  Coding regions on vcDNA: vcDNA=SeqID_86199; Strand=+; Position=67-243
SLPIFFLLLIRIYFASAADDPLRMTNGISQINPWDCLDLCQNNFPILSLELGSPAGFR

SEQ ID NO: 159777 - protein, 161 aa, Heterodera glycines
  Coding regions on vcDNA: vcDNA=SeqID_86200; Strand=+; Position=137-619
WDDKILEMRVKNSTDKCNGRIWTDLHDQFIRLATPHTCPADASRVDAQMVTTTIKRRAIATFEPPSVIRAEALQNVPSPSAILVSKQAAKDVKNCTDSVFAENARMITSVAFVPLCDIRMAVAALDTEFGNLAVFQPLIDWSNGTWSQPTFRPEQWNVYTR

SEQ ID NO: 159778 - protein, 107 aa, Heterodera glycines
  Coding regions on vcDNA: vcDNA=SeqID_86201; Strand=+; Position=263-583
TAPSASPGRSPSAAFVPLRPAITPSSRSDWHSLIRQFWHSFTPCHPIQRTYSICDFDDYRREVIAHPITWPRVPVFRPIRSAYVCRPHWTYRSYWPYNASRFESPPI

SEQ ID NO: 159779 - protein, 194 aa, Heterodera glycines
  Coding regions on vcDNA: vcDNA=SeqID_86202; Strand=+; Position=23-604
MEHETALAVPADPQSQHSELLEMNDVLQWEMATRSEDEQVLDPEGDLEGFTVLIFQKLEKFLQNVPPSEEYTKITEELAKMVENWKQSVQPIDVDQETRQLFEVENSLENLDEQLTEQNLSGINATPAVLDIVLDIIKNDVHEKEKSEFMWKMVNRKATHYVKNLGQLLGGIPIAIKYLDQVVFVGKWALDNSF

SEQ ID NO: 159780 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_86203; Strand=+; Position=17-433

SEQ ID NO: 159781 - protein, 227 aa, Heterodera glycines
  Coding regions on vcDNA: vcDNA=SeqID_86204; Strand=+; Position=62-742
MNRRWLCNDVWMDILPFFDRPQLGLKLAMLSPRFNALVDIHFDAKTELTLWRPIAIRNDGGTATPHLAVLVDGVHSVPFELPDAHSPPMPNNIRFKDLRINCIDHSVIAFLRANQLIFQKGTNLRLSAPFGPFNIDDVQPIWDDFACRIWPIFASTIRHFCFPNGHHLDMLLRLVSPTILTDDLINIHSIDSGRQFPEAIGDDHFDGPTITNFDGSIVTSVAAGQAL

SEQ ID NO: 159782 - protein, 150 aa, Heterodera glycines
  Homolog annotation: Hit_ID=CAE67074.1; Match level="QueryCoverage =82%, HitCoverage=38%, E-value=1e-44, Identity=69%"; Hit description =Hypothetical protein CBG12483 [Caenorhabditis briggsae]
  Coding regions on vcDNA: vcDNA=SeqID_86205; Strand=+; Position=222-671
MADKETIRLDGQQQQNDQQQQQKRSQEQSWHRIMMLIIAITAHNFPEGLSVGVGFGGAGRSESVSLEKASNLALSIGLQNFPEGMAVALPLAAFGHSKWKAFLYGQISGMVEPMAALIGASLVLSIEFVLPYALSFAAGAMIFVVFDSII

SEQ ID NO: 159783 - protein, 233 aa, Heterodera glycines
  Coding regions on vcDNA: vcDNA=SeqID_86206; Strand=+; Position=2-700
TVLWALPSLALPSRKLRTKCHKLCTESTTTTAAGHQKEAQPTDEGEEYYEEEYEEDEYEEGEEREEEAENISGDGSCSNSLASSLEGDHLLREPPKVFTTPHHPPPPPAAVHSHHQQQRQPQFPFDGKRHFSNGFHGHAKLGHKTVQAIGDSQQLAAELAKQGLQVICAPDCEPKAFAILIDFVYSDFDVRSLSVRGQLTDDNVMNTLYAAKKYAIDALVTECVRYCTARLTA

SEQ ID NO: 159784 - protein, 149 aa, Heterodera glycines
  Homolog annotation: Hit_ID=NP_492588.1; Match level="QueryCoverage =99%, HitCoverage=22%, E-value=3e-12, Identity=36%"; Hit description =protein phosphatase 1 regulatory, GEI-4(Four) Interacting protein GFI-2 (53.7 kD) (gfi-2) [Caenorhabditis
  Coding regions on vcDNA: vcDNA=SeqID_86207; Strand=+; Position=61-510
LQREGSDLIRSWSKEDVSNGEMSAHHFGNGGPSTSHQPTANQQRRDSPPKRMQKQSQQKQKQMSPDEWLKKLEAESGGLRDEEEEQAEKDVLKGSAGESMRKGAKAQKGNGVIRRDQQQQQQHDMNGMNLKGSLGGQNRRRKKSCCCII

SEQ ID NO: 159785 - protein, 137 aa, Heterodera glycines
  Coding regions on vcDNA: vcDNA=SeqID_86208; Strand=+; Position=63-476
IRAIGAEQVQYSCEFAQLLYTGGGHVDSVFCNIFSGYPPTFFEELIEYALTTHRPDALIRRICVWLAADEPWPDIATLFPSAVQRRVSNDRVLYEFQNIGKSCGQQQHKRSEFVLRIRAPSRPMLFRAMSNFSLCRK

SEQ ID NO: 159786 - protein, 105 aa, Heterodera glycines
  Coding regions on vcDNA: vcDNA=SeqID_86209; Strand=-; Position=1-315
VSAQVASVWAVVSSYLSSVVIQGAVRASICNGTRGFLWRHELEQPQVGKSRGRCPKYRRSRASLASYDRTPWEISRWRSCTPSPPILAPAPDSLPLNLVKERSAV

SEQ ID NO: 159787 - protein, 191 aa, Heterodera glycines
  Homolog annotation: Hit_ID=NP_501860.1; Match level="QueryCoverage =93%, HitCoverage=52%, E-value=3e-23, Identity=36%"; Hit description =no mitochondrial derivative (37.7 kD) (4K943) [Caenorhabditis elegans] emb|CAA93516.2| Hypothetical prote
  Gene Ontology: Mol. function=ATPase activity; Cellular component =mitochondrial outer membrane; Biological process=mitochondrial translocation
  Coding regions on vcDNA: vcDNA=SeqID_86210; Strand=+; Position=44-616
MTSEKNLPLTIGVCASSVALGCIAYKLLQRKGSQQELLDEMTLRKKKDEAQLMDSLKLDPNTPLNSHELALASLISFSEDAASFEKVGGCSSILELLRQKVVVPLQLASNRTTLPSLLYSAPKGILLYGPNGCGKTLIARAIAKEVDAYFINFGTSLVDFVNGSSVTMKSLFTLAEKIQPCVIFIDEIDLL

SEQ ID NO: 159788 - protein, 73 aa, Heterodera glycines
  Coding regions on vcDNA: vcDNA=SeqID_86211; Strand=-; Position=126-347
KMCSKFAEQCFDWFRRVVRIVLRLHQIVRVFALRFWRPKQIRPEGNGVVRSRRWDMASTVNLNSKSWLSFLLL

SEQ ID NO: 159789 - protein, 61 aa, Heterodera glycines
  Coding regions on vcDNA: vcDNA=SeqID_86212; Strand=-; Position=1-183
SFFFFFFFRFVPNFFVIFSSILFHSFVECFLPFCFIFSFILYIFNFFSFFSHFFFFFFPFF

SEQ ID NO: 159790 - protein, 223 aa, Heterodera glycines
  Coding regions on vcDNA: vcDNA=SeqID_86213; Strand=-; Position=3-671
RQTLCQALLWQSVLCFVRHWPHRIYEIPNFASVFSLKTPSVQKGKAVVTGRALQLYSPVQCVDSFAGPHFRFVRTIRWHCADSDDKPFSGELVGQKMEKMPRQFVVVPMKSIFTSENDADQSQDIVRKQKQRNSIRRHSVHPSRIFPAGRMTAAGARERIGRNFLCRLMVLLLMMAVVSFGRIGVMVMMEVMDRRRKGKEREKGKSGDGREKGQKRHLEGKRI

SEQ ID NO: 159791 - protein, 190 aa, Heterodera glycines
  Homolog annotation: Hit_ID=NP_504912.2; Match level="QueryCoverage =42%, HitCoverage=28%, E-value=1e-11, Identity=43%"; Hit description =zn-finger, C4-type steroid receptor and Ligand-binding domain of nuclear hormone receptor family member (
  Gene Ontology: Mol. function=transcription factor activity; Cellular component=nucleus; Biological process=regulation of transcription, DNA-dependent
  Coding regions on vcDNA: vcDNA=SeqID_86214; Strand=+; Position=82-651
MELDFIQSVLLGPQRGNLTAIECLLAQNFNKQSSMMPNYGTERKNAKVPKLEMEKAGGGDEAKLDNGSETDQSDQKQKRKGVGRPKRHPSECKVCGRKSFYCYYSVRCCESCKQFFRRIVAKRTLLNCFGAKNCQIGKDGIRCRGCRLDKCLLAGMDPTMINAMQHEGMAQYLDRLELRKRSALLRKNCR

SEQ ID NO: 159792 - protein, 184 aa, Heterodera glycines
  misc_feature (54)..(54): Xaa can be any naturally occurring amino acid
  Homolog annotation: Hit_ID=AAP30754.1; Match level="QueryCoverage =99%, HitCoverage=98%, E-value=2e-78, Identity=79%"; Hit description =putative gland protein G11A06 [Heterodera glycines]
  Coding regions on vcDNA: vcDNA=SeqID_86215; Strand=+; Position=13-568
MSSPSVSLLAIVAIFCSLYKCCVSAPHSCCPGSQKVVSLMANYVGTFAHSFSSXLCSDAQSVAGALKGQLIGCPKGGDAILLADIEASLGTHFADECAHSLGFVRAMFAIAASASSHASNNNEWQALSAQFGQQISEIDSKSAEFDIGIAKVPFDSPKGDHSQRNVPGTNSVISMPGWTGSHKH

SEQ ID NO: 159793 - protein, 191 aa, Heterodera glycines
  Homolog annotation: Hit_ID=XP_448713.1; Match level="QueryCoverage =68%, HitCoverage=98%, E-value=2e-44, Identity=69%"; Hit description =unnamed protein product [Candida glabrata] emb|CAG61676.1| unnamed protein product [Candida glabrata CBS1
  Gene Ontology: Mol. function=DNA binding; Cellular component=nuclear nucleosome; Biological process=chromatin assembly/disassembly
  Coding regions on vcDNA: vcDNA=SeqID_86216; Strand=+; Position=51-626
MSDNRGASVASTGTTNSQESQVASPVKAGKATTKTTASGKGGKAKADGKVKAGGKGAKKAGGKGGKVKIAASGSKNTRSARAGVAFPVGRIHRLLRHGRHAQRIGAGAPVYMASVLEYLAAEVLELAGNAARENKKLRITPRHLQLAVRNDEELNKLLAEVTISRGGVLPNIHAELLSKMQQKKQQNDDSQ

SEQ ID NO: 159794 - protein, 190 aa, Heterodera glycines
  Homolog annotation: Hit_ID=ZP_00349967.1; Match level="QueryCoverage =60%, HitCoverage=15%, E-value=6e-14, Identity=38%"; Hit description =COG1505: Serine proteases of the peptidase family S9A [Crocosphaera watsonii WH 8501]
  Gene Ontology: Mol. function=prolyl oligopeptidase activity; Cellular component=cytoplasm; Biological process=protein metabolism
  Coding regions on vcDNA: vcDNA=SeqID_86217; Strand=+; Position=121-690
MFNQRTNTKNNVLENAVKIPPFKELHANPLGNGIELAKHGQMENEMAAHFHDQRKLSTKSSVAEGKFNPKMRTIDPKFYPQAPRGNVKDTYKSQSGKEVKKISVPDPYRGLENATANATKQFVEEINNISQRYLNATPVRQKLNHSLTKMWNYEIFFTPEFCGGLFYYYHNSGLQNQRVLYQTKSLNSTG

SEQ ID NO: 159795 - protein, 227 aa, Heterodera glycines
  Coding regions on vcDNA: vcDNA=SeqID_86218; Strand=+; Position=3-683
IGGTEMAYRNDNCTTSGGNGGRMPLIEHVVKNGESLMQISLQYSVPVSEIKRVNNIVADHEIHGLPLLRIPMTRAFLLRRQMMEAEEEIGGQSEAKIIDILGDEGTSTANCGTFDAMTEEDNNEGMRTTHRNVMKEFGSHRSQTNRQQNALRKTDFGALLNGRQNDALRSSDESLAAYAKEAIEGILDETDRNVATVRQNLPSPSLEGGRFSFRRCRCARQFIECLA

SEQ ID NO: 159796 - protein, 118 aa, Heterodera glycines
  Coding regions on vcDNA: vcDNA=SeqID_86219; Strand=+; Position=375-728
MSPVIAPFVLAIIGIIALPTIEGAVGRQQVKLGEQYKYENVPGKLMVKRQTAASKEPQYLFAGQTAWTTDGKDRFGHAELDFATGTMTIPNFSENDLGSYTFPLEQPNFSAVNGPNGC

SEQ ID NO: 159797 - protein, 127 aa, Heterodera glycines
  misc_feature (87)..(87): Xaa can be any naturally occurring amino acid
  Coding regions on vcDNA: vcDNA=SeqID_86220; Strand=+; Position=3-383
PPVVFTFREKAIHQSDNWHLLPSVQSESVHQCQLVLPINKYSVTSFSSNTQKINHQRNSRVSKMEHFEGISHCKTSTEPKEDEENAXRLLKYSRNCLSQLPHQSGRNEMFSAKSISQQMRMPFSLWP

SEQ ID NO: 159798 - protein, 149 aa, Heterodera glycines
  Coding regions on vcDNA: vcDNA=SeqID_86221; Strand=-; Position=157-606
FFFFFFFFCTKFGERNVGERGGGGEKHRQKEKQSNFETELKVEKCHSSAFLGDSETKGKAKRQKKGGKVMEDKSKDGWSDRRRKRHSLVKKFHVCVFVSSVPFAVFRKRRRAVGHCHHRCCVRSLLTTVCPRFGHFRDRFRRNASKQAA

SEQ ID NO: 159799 - protein, 214 aa, Heterodera glycines
  Coding regions on vcDNA: vcDNA=SeqID_86222; Strand=+; Position=2-646
VFGEKVAGNSTKTEVNEQGELSAVVKTEAESQNSTEVQNYALVDLDWVNNSQKSHVLLQMMNAMGYEHGKGLGKRGQGIVEPIKTNPNQGKKAFGANHDSRREGRRRRRTRESGHMEGQQTDSGKNAIAEQQQKDEWKRRPNPSRRAQMHYEDNVRDTLRTAGLSEQSAEEIWQALGILARHQIMPLGMGLGLVKRRAGRRRIEMEAKNEGKAE

SEQ ID NO: 159800 - protein, 208 aa, Heterodera glycines
  Homolog annotation: Hit_ID=XP_487330.1; Match level="QueryCoverage =92%, HitCoverage=98%, E-value=4e-27, Identity=37%"; Hit description =similar to Hornerin [Mus musculus]
  Coding regions on vcDNA: vcDNA=SeqID_86223; Strand=-; Position=80-706
PDQLGCLGASPDQLGCLGASRDQPGCLGASPDQLGCLGASRDQHCLPGGSPDQPGCLGASPDQLGCLGASPDQLGCLGASRDQHCFPGASPDQLGCLGASPDQLGCLGASPDQLGCLGASRDQHCFPGASPDQLGCLGASPDQLGCLGASRDQHCLPGASPDQLGCLGASPDQHCLPGGSPHQLGCLGASIVLHGVLPGHCHLLQRWQ

SEQ ID NO: 159801 - protein, 250 aa, Heterodera glycines
  Homolog annotation: Hit_ID=XP_422548.1; Match level="QueryCoverage =95%, HitCoverage=53%, E-value=9e-77, Identity=56%"; Hit description =PREDICTED: similar to Rab geranylgeranyltransferase, beta subunit [Gallus gallus]
  Gene Ontology: Mol. function=RAB-protein geranylgeranyltransferase activity; Cellular component=Rab-protein geranylgeranyltransferase complex; Biological process=protein modification
  Coding regions on vcDNA: vcDNA=SeqID_86224; Strand=+; Position=1-750
EYESSFYLEYIRRDVDIPKSAPTELLTEKHKEFLLSYGQEEKSFEYIMAEHLRMSGIYWCLAALKVLGENINDEEKLADLIKENQNEDGGFAAADGHDSHILHTLSAIQVAVIIGRLDIINLDATVEFIKSLQQNDGSFAGDHGGEIDTRFSFCAAASLYFLNRLGSIDVHKAVEFVINCYNFDGGFGTRPGSESHAGQVYCCLGTLSVCGCLELIDVERTATWLAERQCPSGGLCGRPEKLPDVCYSWW

SEQ ID NO: 159802 - protein, 92 aa, Heterodera glycines; identical to SEQ ID NO: 158759
  Homolog annotation: Hit_ID=AAO33473.1; Match level="QueryCoverage =100%, HitCoverage=100%, E-value=8e-53, Identity=100%"; Hit description=gland-specific protein g4e02 [Heterodera glycines]
  Coding regions on vcDNA: vcDNA=SeqID_86225; Strand=+; Position=12-290

SEQ ID NO: 159803 - protein, 132 aa, Heterodera glycines
  Coding regions on vcDNA: vcDNA=SeqID_86226; Strand=+; Position=2-400
YPPLLHNAKMRSTFHPPMGEGEQHKQQSNSSVASSVRSSTTLDGGGPSCSQSTAGDESDSAVAGGTTPRPFGIGSGEFVTVQHHQQQYNTNNNGTNGGTKMHSTFSRCPTAESNAMLVMNNGDHLNESFSIL

SEQ ID NO: 159804 - protein, 248 aa, Heterodera glycines
  Homolog annotation: Hit_ID=NP_499105.1; Match level="QueryCoverage =97%, HitCoverage=25%, E-value=4e-14, Identity=25%"; Hit description =MUTator MUT-7, HBE269 like (mut-7) [Caenorhabditis elegans] emb|CAA80137.1| Hypothetical protein ZK1098.8
  Coding regions on vcDNA: vcDNA=SeqID_86227; Strand=+; Position=2-745
RFRPPDVAQPTLSLSGVSEYFLNIKLEKTEREGNWSQRPLRLEQKKYAAQDAHCLNRIFRIVASKLKRLKDNELAKELKRHSLIDFNEEKAKPTMAIPLLSGQLVRVKEGEEDFILNVQKAAVEIERSANGVLDGFRTIGDVRFIVDSMLFGLGKRLRKCGFDTRMIGDREQIVEFCKQSKDEKFVVLGAGKGHKQLALQMPDNEVVNVPIATDGTTPPSLLVRNLLDELRIILRPSDMWSRCVECNK

SEQ ID NO: 159805 - protein, 59 aa, Heterodera glycines
  Coding regions on vcDNA: vcDNA=SeqID_86228; Strand=-; Position=38-217
TLSSVGLLCPSCFSMLTPLFIFLHPCVVRDVHGFSFCDKSYPGSCSSSPCTVHVIVSDL

SEQ ID NO: 159806 - protein, 51 aa, Heterodera glycines
  Coding regions on vcDNA: vcDNA=SeqID_86229; Strand=-; Position=3-155
LTPLAGNFTHSKGSISHAFAVRIRTENQDQVSICLFALREVSVLSRLALGH

SEQ ID NO: 159807 - protein, 173 aa, Heterodera glycines
  Coding regions on vcDNA: vcDNA=SeqID_86230; Strand=+; Position=3-521
AALDILPDFAFAVPVSLFVANPPAAILWAGWLAVGEYFAKKSWSLVLRDIVLPTKSGGKFMELLQQTEVPVERVFPKEVEEDADKLGEGSKGQKETMPVIEALAASQVDSNLYQYLFMNTLRAYYVTATSIYSHFMEKIELAKDEHAMTEFAKDVKNKMVENEVMKEKKKKKK

SEQ ID NO: 159808 - protein, 205 aa, Heterodera glycines
  Coding regions on vcDNA: vcDNA=SeqID_86231; Strand=+; Position=65-679
MNRRWLCNDIWMDILPLFDRPQLGLKLAMLSPRFDALVDIHFDGKTELTLWRPIAIRNSVAAVPELHVFFDGANKSVPFPLPDAHSPPMPNNIRFKDLRINCIDHSVIAFLRANQLIFQKGSNLRLSLPFGPFNIDDVQSIWDDFARQIWPIFAPTIRHFGVPDGHLLDTLLRLVSPTILTDDLINIHSINSGRQFLEAIGDDHF

SEQ ID NO: 159809 - protein, 189 aa, Heterodera glycines
  Homolog annotation: Hit_ID=CAE56852.1; Match level="QueryCoverage =95%, HitCoverage=29%, E-value=4e-19, Identity=33%"; Hit description =Hypothetical protein CBG24679 [Caenorhabditis briggsae]
  Coding regions on vcDNA: vcDNA=SeqID_86232; Strand=+; Position=8-574
MSAGIPAGDSDIELVGIDEFYASATGEKNGTEVAKTDEHQLHVARLKHELNERRSMLANLQELEGRKSALLSDIRGKEQRLSQIGSKISAIKKATIPLFDVLGLKAQPSEIGDKAKQSSCPFSVQLRPLYTNEEFCREIFGTHSIELGCDALVLVTEESAGPSNGTKENAEMDETSDGKEKEPMASANS

SEQ ID NO: 159810 - protein, 215 aa, Heterodera glycines
  Coding regions on vcDNA: vcDNA=SeqID_86233; Strand=+; Position=1-645
GTSDCKRRTWPKEDGLALERGHLPQGNNQSPTRLQSTPRIWIQEDDRWRQPMTFSRKDVRERSWLESDTDSDLDSPTSVLRSRRRSRVNILDDDQPTRRTAWGRSPTPSPNGRAVVQRTTTTTTTTTEEEEGGRRTVRFGEVVVVEPEERTVNRRTEVRTQQRETEVERTSEYTLILRIDFIDASVFLDKSLAYFGSLNTARKDERSVQRLCYVL

SEQ ID NO: 159811 - protein, 224 aa, Heterodera glycines
  Coding regions on vcDNA: vcDNA=SeqID_86234; Strand=+; Position=1-672
RCPAQQNDDDAAAIVQPKRKGIKRPYDEFMGDESAVGMVKSPSFTEQMQHTAPPNLNDFCMEHYGFDEQYIRAQPDRVYDILFHSSGRVELQLSRNLSATILSIPCPPEEEHNWGMVRQYRMTTQNREGDTLYFRCSRCESLMRYTNDEYRPKLTMKDGDIQGDCFPAHHPQCYPVNKEWVILQQLDRQARLYMMQFDMAQWEAMRQQQQQQPAEDNDGTAAAE

SEQ ID NO: 159812 - protein, 127 aa, Heterodera glycines
  misc_feature (66)..(66): Xaa can be any naturally occurring amino acid
  Homolog annotation: Hit_ID=BAB28067.1; Match level="QueryCoverage =89%, HitCoverage=44%, E-value=2e-26, Identity=54%"; Hit description =unnamed protein product [Mus musculus]
  Coding regions on vcDNA: vcDNA=SeqID_86235; Strand=+; Position=3-382
RKEKGNSCQFVPTATRNIFLIRHGQYELDSKTKELTALGREQADLLGKRLAEFEVGKGKKITNVLXSTMKRAEETADIALKHLPHAAQIQKHSDLLREGAPCEPEPPLSSWRPQYYEFHEDGARIEA

SEQ ID NO: 159813 - protein, 188 aa, Heterodera glycines
  Homolog annotation: Hit_ID=NP_491710.2; Match level="QueryCoverage =99%, HitCoverage=43%, E-value=1e-19, Identity=30%"; Hit description =prion-like Q/N-rich domain protein PQN-19, Prion-like Q/N-rich domain protein, EAST-like signal transduci
  Gene Ontology: Mol. function=SH3/SH2 adaptor protein activity; Biological process=regulation of protein activity, epigenetic
  Coding regions on vcDNA: vcDNA=SeqID_86236; Strand=+; Position=1-567
TNWWRGSTERGGGASGLFPASFVTENFDNGQISNGTERNGERTEAVETAVVPKVQIDETVLMKCIELLEKCDPEADPSSDPAELPFLEQMAKAQAPLIDQKLVKIDKQLSMLAEVDIAIREVLTAYDTAVQRVPMPMPFSPPAGSLASSAPPPVSFASTASVPSVNTPSFPTQWTMNGQWQQQQNQNQ

SEQ ID NO: 159814 - protein, 217 aa, Heterodera glycines
  Homolog annotation: Hit_ID=NP_496711.1; Match level="QueryCoverage =97%, HitCoverage=95%, E-value=7e-58, Identity=51%"; Hit description =cdp-diacylglycerol-inositol 3-phosphatidyltransferase (24.8 kD) (2N28) [Caenorhabditis elegans] emb|CAB60
  Gene Ontology: Mol. function=CDP-diacylglycerol-inositol 3 -phosphatidyltransferase activity; Cellular component=endoplasmic reticulum; Biological process=phosphatidylinositol biosynthesis
  Coding regions on vcDNA: vcDNA=SeqID_86237; Strand=+; Position=1-651
SVGCPPPVRPSDENVFLFYPNLLGYVRILLAFGALFAMSYEEKPWSAALLYFASALLDAFDGYLARKFNQSSRFGAMLDQLTDRLTFLGVLMTLCHYYPTKMLFFQFVAFLDIAAHWMHLHATDLTGKETHKGSKNPILNVYYTSKTCLFWRCFGNELFYGLLFVNHFWAGPGLLGIHFVPLLACVVCPLALAKSAINVLHLVTASQTVAEHDREKR

SEQ ID NO: 159815 - protein, 203 aa, Heterodera glycines
  misc_feature (120)..(120): Xaa can be any naturally occurring amino acid
  Homolog annotation: Hit_ID=CAE67815.1; Match level="QueryCoverage =96%, HitCoverage=38%, E-value=4e-25, Identity=38%"; Hit description =Hypothetical protein CBG13395 [Caenorhabditis briggsae]
  Gene Ontology: Mol. function=glutathione synthase activity; Biological process=neurogenesis
  Coding regions on vcDNA: vcDNA=SeqID_86238; Strand=+; Position=73-682
INTGQLGGVHLARLLTQLHRRTMQKAGLEASKDQLLNNGSDFVIAEALFMAWTAFGDPKAVFLFVASKTSRNRFGQRQIEYLLEKISNYKMKIIRISLPACARQMKLGQLTLDPQDNTLXLYGQKVAVTYIATEAPKPSDDEWKVRLLFERSTAIKSPTIGQDLANQKKVQQLLTKPGMLERFLPEPEHAAKVEALRRSFAGL

SEQ ID NO: 159816 - protein, 89 aa, Heterodera glycines
  Coding regions on vcDNA: vcDNA=SeqID_86239; Strand=+; Position=70-339
VNWVSMNFCSSFAFLVVLMLLIGEASSGCCISKSRIRAENERRTKSDGTMRYGQALNYGVIKVPQKNWTNGLRRELEECLGLEFIRALE

SEQ ID NO: 159817 - protein, 49 aa, Heterodera glycines
  Coding regions on vcDNA: vcDNA=SeqID_86240; Strand=-; Position=80-229
FFFFFFFLRDHGKIPGEHVPSQFDRKVSLANGVLQIVQSRNPCVIDVQQ

SEQ ID NO: 159818 - protein, 171 aa, Heterodera glycines
  Coding regions on vcDNA: vcDNA=SeqID_86241; Strand=-; Position=2-514
LIIHHSLLVHPFCSDQFTIELSSFSFSLSLHCCCPCCCCWWWLSSNSKPNTLCAFAVVALANSCAGQSMKAATSSQMAANELGSLRLKSECLCRARASVLIRCRMSMSLRNFLSSKFGYMYGASVSNKRRSIRMVRCRNARFTPSTARSFHRNPVSPMYSPMSMYCCASIS

SEQ ID NO: 159819 - protein, 154 aa, Heterodera glycines
  Homolog annotation: Hit_ID=AAL78214.1; Match level="QueryCoverage =94%, HitCoverage=74%, E-value=7e-39, Identity=50%"; Hit description =putative esophageal gland cell protein Hgg-20 [Heterodera glycines]
  Coding regions on vcDNA: vcDNA=SeqID_86242; Strand=+; Position=176-637
MDQIGGTFSDQIWLDTLAWIGRGEVGWHLALVNARFAALVNMQLQQRRWCLEEFHISERKPKRTGAEVLSLANNGSYFSLPLATSPLPDSVIGFNGTFNIWYLDAEVINFLQRFRRLFNTYISLKFTIPITEFRAWQAVAPHIWPLLKHGLGTL

SEQ ID NO: 159820 - protein, 200 aa, Heterodera glycines
  Coding regions on vcDNA: vcDNA=SeqID_86243; Strand=+; Position=94-693
MRENQNALAKKVSETEAKLENGMRENQNALAEKVSETEAKLENGMRENQNALAKKVSETEAKLENGIQNNQKALSLMKNMATLAFFHFPLPIYHRWNASDCDPEIVINESTNAIQHNGTEDIDWRSCRAWPIQMSSAVGRIGIIYAEYRILAIIGGLRIGLSTKEMPLDRWVGNGHVSYGYAYYGEIESTNTNGNRAVIS

SEQ ID NO: 159821 - protein, 182 aa, Heterodera glycines
  Coding regions on vcDNA: vcDNA=SeqID_86244; Strand=+; Position=1-549
GVGADPKSRIEKDTFDLAIIAMAQHYHQQSQTLHVNNLVLPVYQFRCSDRKDEEFGKEFISRLQYLSSFQLTSTETALLSAFVLMDQSQAPGMEAFVGQLKSCLGGQLHQRMPDGDEALRQLLEFLPRLRELAKTHRKCLGRFRLQMVDQQSEHQTDRGAAEANVLASFPPLYTELFAGNSD

SEQ ID NO: 159822 - protein, 88 aa, Heterodera glycines
  misc_feature (18)..(18): Xaa can be any naturally occurring amino acid
  Homolog annotation: Hit_ID=NP_502549.1; Match level="QueryCoverage =94%, HitCoverage=52%, E-value=5e-29, Identity=67%"; Hit description =transthyretin-like precursor family member (4O16) [Caenorhabditis elegans] pir||T23149 hypothetical prote
  Coding regions on vcDNA: vcDNA=SeqID_86245; Strand=+; Position=1-266
HPFFRLDEAFTDSSGSFXMRGSTRELTNIDPVLKIYHDCDDGIMPGQRKVKLRIPSQYITNGGLARRTFEVGVLNLETVFAGEERDFI

SEQ ID NO: 159823 - protein, 232 aa, Heterodera glycines
  Homolog annotation: Hit_ID=NP_499324.1; Match level="QueryCoverage =85%, HitCoverage=49%, E-value=8e-71, Identity=62%"; Hit description =4-HydroxyPhenylpyruvate Dioxygenase (44.4 kD) (hpd-1) [Caenorhabditis elegans] emb|CAA90315.1| Hypothetic
  Gene Ontology: Biological process=tyrosine catabolism
  Coding regions on vcDNA: vcDNA=SeqID_86246; Strand=+; Position=17-712
FSFCSSPFFRLAKWTNPSTNGTVSAATSSSARILCFDHIRFWVGNAKQAAHWYCVNFGFIPFAYRGLETGSRKTVAYAVKQDKIVFVFESALLPNNGEMSAHLAKHGDGVKDVAFEVDNLDWVLDTARRAGAVVAEETAEERDQNGHIRRASIRTYGDTIHSLIERHHYSGPFLPGFCLVAASSVPRFLLGQLPSVGLNFIDHCVGNQPELQMESVAQWYERVLLFHRFWSV

SEQ ID NO: 159824 - protein, 215 aa, Heterodera glycines
  Coding regions on vcDNA: vcDNA=SeqID_86247; Strand=+; Position=1-645
PQGAWPAGRKREFPAKIFRPTPIVPTSKYRHSVADGMLTRDLRDSQVWKTVVTVDGISGGQAERRGQRSTAKDEKRHGDTEAVALRRHFYAEKPTNEQWQQNGRVALDEDGHNANQQKLDRAPNGGQIRQLVFSVGRTQFSMGGGQSAGPLVQCHARGESQDSLGSNSTANMHRCISPMFAPTDYGRLIECTTPFSAQGDNQLSLAIGERVLLVK

SEQ ID NO: 159825 - protein, 84 aa, Heterodera glycines
  Homolog annotation: Hit_ID=XP_291729.5; Match level="QueryCoverage =57%, HitCoverage=3%, E-value=2e-11, Identity=47%"; Hit description =PREDICTED: RNA polymerase II transcription factor TAFII140 [Homo sapiens]
  Coding regions on vcDNA: vcDNA=SeqID_86248; Strand=+; Position=1-255
GQEMVACDDCDRWYHWGCVGILIPPPEKAQWYCTECRRERKKAAQRQQTSTGGGSGSNSRKSSFIGGTPTGGTAPAKKQRIAKA

SEQ ID NO: 159826 - protein, 155 aa, Heterodera glycines
  misc_feature (144)..(144): Xaa can be any naturally occurring amino acid
  Coding regions on vcDNA: vcDNA=SeqID_86249; Strand=-; Position=3-467
SPTVDGAAGEEIVEEVEEPTHLMTGHILLGAVVYSICNCARKFDAKFFLRLIVLKGANFTSQFVLKIGKISQPFTEATFKFIRNFDGTFGRIADFLLFFDWRRSAEIRLAGQSHRKQNSVFVCLNISAFSFFSRSFFVNCKRMXPFEHFHYFDEF

SEQ ID NO: 159827 - protein, 180 aa, Heterodera glycines
  misc_feature (6)..(6): Xaa can be any naturally occurring amino acid
  misc_feature (173)..(173): Xaa can be any naturally occurring amino acid
  Homolog annotation: Hit_ID=NP_499260.1; Match level="QueryCoverage =99%, HitCoverage=10%, E-value=7e-57, Identity=61%"; Hit description =clathrin heavy (3L297) [Caenorhabditis elegans] emb|CAA83003.1| Hypothetical protein T20G5.1 [Caenorhabdi
  Gene Ontology: Mol. function=structural molecule activity; Cellular component=membrane; Biological process=intracellular protein transport
  Coding regions on vcDNA: vcDNA=SeqID_86250; Strand=+; Position=1-542
QLENHXLLEFRRISAFLYKGNNRWKQSVELCKKDKLYNDAMEYAAESRQPEIVEDLMQYFLSQGLKDCFSTLLYKCYEFLRPDVVLELAWRNNLVDYAMPFMIQTVRDYGSRLDRLERAEVERKEEVKEQQQRSGSLIEPQLMLTAYSTAATTPNATAYPTGGIGTIPPAQGXPSYPFYK

SEQ ID NO: 159828 - protein, 183 aa, Heterodera glycines
  Homolog annotation: Hit_ID=CAE68637.1; Match level="QueryCoverage =98%, HitCoverage=76%, E-value=2e-42, Identity=46%"; Hit description =Hypothetical protein CBG14527 [Caenorhabditis briggsae]
  Gene Ontology: Mol. function=chaperone activity; Cellular component =cytosol; Biological process=exocytosis
  Coding regions on vcDNA: vcDNA=SeqID_86251; Strand=+; Position=52-600
MPPDTDQGNARRQRRRSSRGLNDSLSTHCNLYELLALPKTATDEDIKRAYRRMALKYHPDKNRNDPEASKKFQDINYTNAVLSNPTKRQIYDRYGEMGLKMMQQFGEENMSLALRPWLKWLICIIAVLTCGCFCCCCCCFGCFKCCCNFCFGACKPEDASNADFSPFDAFDDVESQPVRAQPA

SEQ ID NO: 159829 - protein, 232 aa, Heterodera glycines
  Homolog annotation: Hit_ID=XP_523820.1; Match level="QueryCoverage =49%, HitCoverage=30%, E-value=5e-14, Identity=38%"; Hit description =PREDICTED: hypothetical protein XP_523820 [Pan troglodytes]
  Gene Ontology: Mol. function=protein binding; Cellular component =centric heterochromatin; Biological process=gene silencing
  Coding regions on vcDNA: vcDNA=SeqID_86252; Strand=+; Position=2-697
ELKKFPSLTDAFKKKRGNILNFEEEEFDEIISNGTSKRDNSPYTDHDYAGTRQLATAKGATGKHQRQKGGGGTAKEPKKKTALVNGTDSVVRSSARPHRPTKRFVEETNESFIRGTSKVRRTSPRKHGKKSTAEGGSEGEESEDDGKEYSVEKVFKKRVKGGKMEYFVKWAGYDDGWNTWEPRESLKHLEVFKQYEKAQQNAAEKNKLEAEETEEDEEEEDEDNEYKVEKVL

SEQ ID NO: 159830 - protein, 157 aa, Heterodera glycines
  Coding regions on vcDNA: vcDNA=SeqID_86253; Strand=+; Position=18-491
MTCHASDGQAITKWLFLPRPDNLMKELTICIEDSAVEQQWLAAVEQIKAAFSNASSPVYFDITVYFPPPSSLSAVVPFKLTNEMTGEKLEMYKEDVEEDLSCFSLIRCPIAPDDKRERMKMIKELDKRWNRINIFLIGDGLLDGFPGASGDQKEQKK

SEQ ID NO: 159831 - protein, 157 aa, Heterodera glycines
  Homolog annotation: Hit_ID=NP_506417.1; Match level="QueryCoverage =95%, HitCoverage=31%, E-value=1e-56, Identity=65%"; Hit description =WD-repeat protein (5O282) [Caenorhabditis elegans] emb|CAB02116.2| Hypothetical protein F53C11.7 [Caenorh
  Coding regions on vcDNA: vcDNA=SeqID_86254; Strand=+; Position=201-671
MATNASQKRKEIYRYKASFNVYAMGWSTKLDNHLKFRLAIGSFIEEYNNKVSIVQLHEDQGEFGHLGTFDHPYPSTKVLWIPDPKSAFPDLLATTGDYLRIWRIGGHNGASLEVRLDNNRSSEYCAPLTSADWNEVDVSLIGTSSIDTTCTIWQIET

SEQ ID NO: 159832 - protein, 230 aa, Heterodera glycines
  misc_feature (217)..(217): Xaa can be any naturally occurring amino acid
  Homolog annotation: Hit_ID=AAH57457.1; Match level="QueryCoverage =96%, HitCoverage=24%, E-value=2e-67, Identity=56%"; Hit description =D10Ertd516e protein [Mus musculus]
  Gene Ontology: Biological process=regulation of transcription, DNA -dependent
  Coding regions on vcDNA: vcDNA=SeqID_86255; Strand=+; Position=22-712
MFVPCCTALRFIIVEQPRPVDDFLRPVIGKFLATVRDSDMTVRRVAIVTLNSVAHNKPKLIKECLPNLLPALYEETKVKQELVREVEMGPFKHIVDDGLDLRKAAFECMYTLADQSLDRVNINEYLTYVENGLKDQHDIKLLTYLMLVRLVHKCPIQMAQRLDAFCEHIKPQLLLRPKQNAVKRENDKQDELKRSAVRSVIALRKVPNSDRSQKMTXFGDVINGNPDLTQ

SEQ ID NO: 159833 - protein, 228 aa, Heterodera glycines
  Homolog annotation: Hit_ID=AAP30765.1; Match level="QueryCoverage =100%, HitCoverage=47%, E-value=1e-133, Identity=100%"; Hit description=putative gland protein G15A10 [Heterodera glycines]
  Coding regions on vcDNA: vcDNA=SeqID_86256; Strand=+; Position=29-712
MEAGDVDIIRQQHIRYYADIDGRKYPTEGPDYDVLLYGTDLLVDGKLYKNAVPTGYINYINRIEERIPVLGSSGRSIQLNAAGDDQGNNARLHTNVVGHQISGSVSLPEIPIGGNSDYINTGHNKHDGKPTFGDTKREEKQKNKQKQQKRGELIGGNFTHINNQNNENIGGTQDIGRIQIGGMPPGGALHLNTGGNRNVGGTQMIGGIKIGKMPTGGTFGLNIGGNRN

SEQ ID NO: 159834 - protein, 140 aa, Heterodera glycines
  Coding regions on vcDNA: vcDNA=SeqID_86257; Strand=+; Position=3-425
EPHAWYGRRPSAARNALPGTAERNATTTAGSTATNCLFVVSAAAEPWRHSTADGWRSEWRWSQRWPCDHFFNTPGAVNTQCLPRLHNRQNNAGASVRWCACFGMGCKNRNHGMLLNGKCQLVCGTEMCVPWTTHRLYQPR

SEQ ID NO: 159835 - protein, 100 aa, Heterodera glycines
  Coding regions on vcDNA: vcDNA=SeqID_86258; Strand=+; Position=66-368
TILINLYQYMEEDYEQLDYDEDQLKNALRKAQQLKNIFPKDQERKKPLIQNAFIAKKEVRNISSKCYLNPKFAKQNIIKNGILNKTLSSIFSSNLLNVNS

SEQ ID NO: 159836 - protein, 91 aa, Heterodera glycines
  misc_feature (12)..(12): Xaa can be any naturally occurring amino acid
  Homolog annotation: Hit_ID=AAG21334.2; Match level="QueryCoverage =96%, HitCoverage=22%, E-value=2e-42, Identity=98%"; Hit description =hypothetical esophageal gland cell secretory protein 4 [Heterodera glycines]
  Coding regions on vcDNA: vcDNA=SeqID_86259; Strand=+; Position=3-277
GGPKMIERALGXVISYSEAPMESKMQLEQVFMTLTDETKTPKEKMERIKDIQQKWTPEIRAALKPSTDDKEIAEAIRFFTDLPAQIELGKK

SEQ ID NO: 159837 - protein, 203 aa, Heterodera glycines
  Homolog annotation: Hit_ID=CAE69120.1; Match level="QueryCoverage =99%, HitCoverage=54%, E-value=7e-43, Identity=46%"; Hit description =Hypothetical protein CBG15146 [Caenorhabditis briggsae]
  Gene Ontology: Mol. function=structural constituent of ribosome; Cellular component=mitochondrion; Biological process=protein biosynthesis
  Coding regions on vcDNA: vcDNA=SeqID_86260; Strand=+; Position=126-734
MQIRFVHHHKELEEPGGFERFMGWRRSNPAKANRNTHINERYMRRLRGAKRLIIDLEEDYAERRQLDQMRPDEVRMYLLWKGEPNIFKDVAPRDWNEHQITLNTFGQAIDPYIPPETSLFSRGAKDIFPDLKAFATRKYQGIFYGLRRIRKKDGFQNFNLKDFTKLAEQIYANAYNALALRDKTKLHELITEAAFSKMWPDVE

SEQ ID NO: 159838 - protein, 245 aa, Heterodera glycines
  misc_feature (207)..(207): Xaa can be any naturally occurring amino acid
  Homolog annotation: Hit_ID=CAE74243.1; Match level="QueryCoverage =90%, HitCoverage=33%, E-value=6e-33, Identity=38%"; Hit description =Hypothetical protein CBG21928 [Caenorhabditis briggsae]
  Gene Ontology: Cellular component=nucleus
  Coding regions on vcDNA: vcDNA=SeqID_86261; Strand=+; Position=8-743
MDCSHEPSLGTECSGEESEAAKTADETEGELKPSQRDEEEENGTTGKRQQKRRKRRIRLTDIGPKAKKKAERREKPMAEKKNEVQDETNPTETHCQSSKMSPPLLEIENELGQNPPNKVKPSPHFFTPFQLLCDNLIRKFMAKDPEKYFAQPVTELEAPGYHSIVDYPMSFSTIHDKIDNNMYLNLDQFKSDICLVSDNAMLYNNTXSVYFLAAQKLKVLAKYYFSEKYLLFLVYSLPFGKALTE

SEQ ID NO: 159839 - protein, 65 aa, Heterodera glycines
  Coding regions on vcDNA: vcDNA=SeqID_86262; Strand=+; Position=2-196
GVHFASLSCLSTITQSTSDELGKKSKGSPTIELLRAESDCLPPEWLLPNSSDIILKPLIPMAEHS

SEQ ID NO: 159840 - protein, 225 aa, Heterodera glycines
  misc_feature (204)..(204): Xaa can be any naturally occurring amino acid
  Homolog annotation: Hit_ID=NP_495449.1; Match level="QueryCoverage =69%, HitCoverage=39%, E-value=1e-57, Identity=68%"; Hit description =cystathionine gamma-lyase (43.1 kD) (2H346) [Caenorhabditis elegans] gb|AAB93432.1| Hypothetical protein
  Gene Ontology: Biological process=cysteine metabolism
  Coding regions on vcDNA: vcDNA=SeqID_86263; Strand=+; Position=47-720
MPCSLATQSSVLKRRAPASPQHAKMHDKKRHFDESANNGQAKADKVPSKGDKVSPTNEEKKKNVAFATLAIHAGNEPEKWDMNHVVPPISLATTYKQQFAGMPKGHDYARGGNPTRDVLQQSIAALENARHCRVFSSGLSATAAMANWLHSGDHIIASDDGYGGTQRYFRQISVQHHGMELSFVDLTKLSNLEKEFKPNTKMVXGFETPSNPLLKVIDIEAVCRA

SEQ ID NO: 159841 - protein, 108 aa, Heterodera glycines
  Coding regions on vcDNA: vcDNA=SeqID_86264; Strand=-; Position=224-550
LNDGFALQGTVADKAHVLLHALLANARVTGQFHGTVLLEHPISEHKMLILFVHSLGAQQLQKMAHRSVIARLRYLRIPNFDHFGGRKKCLHALTPAQIGTATVAQLIL

SEQ ID NO: 159842 - protein, 146 aa, Heterodera glycines
  misc_feature (79)..(79): Xaa can be any naturally occurring amino acid
  Homolog annotation: Hit_ID=NP_477414.1; Match level="QueryCoverage =98%, HitCoverage=92%, E-value=2e-48, Identity=61%"; Hit description =CG5788-PA [Drosophila melanogaster] gb|AAF57787.1| CG5788-PA [Drosophila melanogaster] gb|AAS93730.1| RE4
  Gene Ontology: Mol. function=ubiquitin-protein ligase activity; Cellular component=proteasome complex (sensu Eukarya); Biological process=protein modification
  Coding regions on vcDNA: vcDNA=SeqID_86265; Strand=+; Position=3-441
EKELSELRGNNSGAVRVLEVDESNLLRWSLMLYPDREPYNKGAFRVNVDFPTEYPFKPPSVTFATKIYHPNINDKGQVXCLGIILAENWKPATRAEQVMNALLSLIAEPEIAHPLRSDLAEEFQRDKKKFFKNAEYYTKKYAERRD

SEQ ID NO: 159843 - protein, 109 aa, Heterodera glycines
  misc_feature (22)..(22): Xaa can be any naturally occurring amino acid
  Homolog annotation: Hit_ID=AAA93233.1; Match level="QueryCoverage =100%, HitCoverage=20%, E-value=2e-34, Identity=65%"; Hit description= CCT-2
  Gene Ontology: Mol. function=chaperone activity; Cellular component =cytoplasm; Biological process=regulation of cell cycle
  Coding regions on vcDNA: vcDNA=SeqID_86266; Strand=+; Position=45-372
KVAGKESIAMEAFARAPANCPXIICDNAGLDSAEIISHVRAEHSKGNRQFGIDVENGRMADVYELGVLESYNVKLGVLRSGAEAAEQLLRVDCIIKCAPRPRTKDRRPC

SEQ ID NO: 159844 - protein, 105 aa, Heterodera glycines
  Coding regions on vcDNA: vcDNA=SeqID_86267; Strand=+; Position=2-319
SRILKKSQRTGEWNNSPRKPNNGSPRKDKKALQKERQEERKQKERERENRFLRTKSTAGNTTDATDVETESEVIPTFVAELEDSTVEYPTDIECHVATKTDLGRK

SEQ ID NO: 159845 - protein, 91 aa, Heterodera glycines
  Coding regions on vcDNA: vcDNA=SeqID_86268; Strand=-; Position=1-273
LFRRVGFCRDRRKHEQHEKGLKWRGVVERRAEIACCDSRRTDSKDAFLSTAITEFALLSPLSNKLLLRSLVLLQLCRWPWFCILYGRKAFS

SEQ ID NO: 159846 - protein, 161 aa, Heterodera glycines
  Homolog annotation: Hit_ID=AAD50121.1; Match level="QueryCoverage =80%, HitCoverage=6%, E-value=1e-09, Identity=29%"; Hit description =adenylyl cyclase [Dictyostelium discoideum]
  Coding regions on vcDNA: vcDNA=SeqID_86269; Strand=+; Position=70-555
MNCLPDPPEVEVEFDGEVPMEVSKLLGNAKNKEVTDKVNRAGGTQQQQQNGSRKKVPMRQKSRKDGQPNAKQQQQQTASMGQRKQLQSLQQQQQVELQEVTGGEGERQPFGRNNEVAIQPNNGQMPRKNNHRPQKQQQQQNEAVQGDQQQIFNGGRRATRD

SEQ ID NO: 159847 - protein, 122 aa, Heterodera glycines
  misc_feature (102)..(102): Xaa can be any naturally occurring amino acid
  Homolog annotation: Hit_ID=AAH78516.1; Match level="QueryCoverage =83%, HitCoverage=90%, E-value=6e-26, Identity=51%"; Hit description =MGC85327 protein [Xenopus laevis]
  Coding regions on vcDNA: vcDNA=SeqID_86270; Strand=+; Position=158-526
MAGRAEASLSRFSVVYVTVPSAEIGKRIAHELVRSRLAACVNIVPQITSVYEWKGKVEEDSESLLIIKTGRERLEQLREAVIKLHPYEVPEFVAFPIDYGSXPYLRWISDQISDKDGQTEDK

SEQ ID NO: 159848 - protein, 84 aa, Heterodera glycines
  Coding regions on vcDNA: vcDNA=SeqID_86271; Strand=-; Position=425-679
MDRNARGRWRPFAAGSAVVVVIAVVVGIPGKSCCCISLCCSSTLQVKCVPAGEQVEGLVNATTAPQTVANGHANVHVDGGGFCW

SEQ ID NO: 159849 - protein, 144 aa, Heterodera glycines
  Coding regions on vcDNA: vcDNA=SeqID_86272; Strand=+; Position=233-667
KFITRKFKECPFFSFLSFLKFVPLLYPFQCFCSLSQQVITAVFAPKPQLVLKWLADQQQKLGSASPPGLSSLFHVPGASSAAVSAPAHCPPTHSSAVALSQHNSSASSACASLMMLFPSISLSSATSHQPVAEAAAANGTARSK

SEQ ID NO: 159850 - protein, 241 aa, Heterodera glycines
  Homolog annotation: Hit_ID=NP_741090.1; Match level="QueryCoverage =100%, HitCoverage=24%, E-value=3e-60, Identity=53%"; Hit description= ZYG homolog (3B500) [Caenorhabditis elegans] pir||T33672 hypothetical protein T24C4.6 - Caenorhabditis e
  Coding regions on vcDNA: vcDNA=SeqID_86273; Strand=+; Position=1-723
EDETRHAFLARILAELKHLRTLDLSEWLLTDFTVLQKLENLTSLILYDIHNLEGSIDTLRKFCKLTGLDLSQSDRSSSGLYAQPVTALHKLVSSLPKLKYLDISGTNLTTLPSENDRPFRGAGTIDSDIPGLSYLKKPLKYLGIFNCESSSQYKNIPAEKISGDHGEDQVLTAMEMYLERPKTMQAVLNESYHLYRFGTNLSRQVEALHLVLKSMSLHLNNSNLQIAGSASMFYIIRSVKM

SEQ ID NO: 159851 - protein, 62 aa, Heterodera glycines
  Coding regions on vcDNA: vcDNA=SeqID_86274; Strand=-; Position=99-287
SVGLVSQLVHRRCSRLFCLYCADVRSLEVNRDEVMCGGPTIISGRSSCTGIRKPALPLSRVL

SEQ ID NO: 159852 - protein, 166 aa, Heterodera glycines
  Homolog annotation: Hit_ID=AAN32890.1; Match level="QueryCoverage =100%, HitCoverage=100%, E-value=2e-87, Identity=99%"; Hit description=secretory protein 4D09 [Heterodera glycines]
  Coding regions on vcDNA: vcDNA=SeqID_86275; Strand=+; Position=35-535
MAKFVAIALLSLTIVSMALAKTGKSQTADEVEGFRNMNIGDNNKVDAGKEPAADKATKKGKAQKAGTKSAAATNEPAAAKGTKNGKAPKTKAKQEVATNEPAAANEWNDQLMGMSVEKFNEELAVLLPKANTFMENALSFINEQMEKNGIATGAAGDSCSTGIPAN

SEQ ID NO: 159853 - protein, 205 aa, Heterodera glycines
  Homolog annotation: Hit_ID=XP_315798.1; Match level="QueryCoverage =100%, HitCoverage=55%, E-value=8e-63, Identity=58%"; Hit description= ENSANGP00000018739 [Anopheles gambiae]
  Gene Ontology: Biological process=anion transport
  Coding regions on vcDNA: vcDNA=SeqID_86276; Strand=+; Position=61-675
MSDEGQQLLESTLRNVLDQQSLRWIFVGGKGGVGKTTCSCSLAVQLAKYRRNVLIISTDPAHNISDAFNQKFTRSPTKVNGFDNLFAMEVDGSNFGDHGVPNLGDEDDKSDIFSIGKNFLADFAAGLPGVDDATSFSQMIKLIRSMDFEVVLFDTAPTGHTLRLLQFPTVIEKGLSKFLKAKTQFMPIVSQMDQCLGLPDSTLDS

SEQ ID NO: 159854 - protein, 124 aa, Heterodera glycines
  Coding regions on vcDNA: vcDNA=SeqID_86277; Strand=-; Position=249-623
QSLLFTTIRNIYSSHWDKKYKLIGLKSKARYVRRITPKGNVLEFLSRNKILKTVITNTKVQNWNGKLYMRELKKNYFSDKTNISWSRSSLLNAVSRSSSDFCRMAARAFRNPSPSAYLEICSSK

SEQ ID NO: 159855 - protein, 217 aa, Heterodera glycines
  misc_feature (16)..(16): Xaa can be any naturally occurring amino acid
  misc_feature (180)..(180): Xaa can be any naturally occurring amino acid
  Homolog annotation: Hit_ID=AAK54043.1; Match level="QueryCoverage =100%, HitCoverage=66%, E-value=2e-76, Identity=63%"; Hit description= G protein alpha subunit 3 [Strongyloides stercoralis]
  Gene Ontology: Mol. function=receptor signaling protein activity; Cellular component=membrane fraction; Biological process=oviposition
  Coding regions on vcDNA: vcDNA=SeqID_86278; Strand=+; Position=3-652
ILHDHGFTDEEREKQXAVYNNTVLAMATLLHGMQRLNIPFHNPRIENEAMIVMEVVNHGKESEPLSDELAHAIKTLWADRNIREKESVDRIAKQDYRPTEQDILLSTIKTTGLIEVEFKMKTADFRVFDVGGQRSERKKWIHCFEDVNAIIFITAISECDQVLFEDETTNTMVESMILFXESICNSRWFTNTSMILFLNKMDLFIEKIKRISISVCF

SEQ ID NO: 159856 - protein, 234 aa, Heterodera glycines
  misc_feature (232)..(232): Xaa can be any naturally occurring amino acid
  Coding regions on vcDNA: vcDNA=SeqID_86279; Strand=+; Position=3-704
WWGLGSALFVGPFALSKKKNMKLAFVRLNVLTVLCLFCSMSHSYGNPSDESDDEICEEEENEAQSEAEEADEFFHNFNGTIQSEREEKRTVVEIFCRNTNDKFQFSTDDEGNFKIQMEAKIKWKFHKCTTGLRMAFYKKKVMENKVPKCLPIILRSPKRKLKNAKRLDICVVPIRIKWLKFGPKINAEEAETEENDEILRNEFALDFDVEKNAQMNGQIRNCSDLHSAEHNXEM

SEQ ID NO: 159857 - protein, 208 aa, Heterodera glycines
  Coding regions on vcDNA: vcDNA=SeqID_86280; Strand=+; Position=34-657
IREREVLKELPFYADLFAAANIGTDEPLLDDNEECGVLQQNAEFDAFDDDQNYAPQPKMRKTSNSSSAAVHLPVGNGCAVGGGGFVWPAKSSFTGAAFVAGGANCGQSAAMPNLRVISKWEENCGETNDDGMDEVENQASSSSTPLLVGTICPTEGNSLSFQNASLSTGTRVFSLDFGNVDNISIYPGMKMAAKCTVEDCHGQQLCRM

SEQ ID NO: 159858 - protein, 126 aa, Heterodera glycines
  misc_feature (11)..(11): Xaa can be any naturally occurring amino acid
  misc_feature (76)..(76): Xaa can be any naturally occurring amino acid
  Homolog annotation: Hit_ID=CAE67642.1; Match level="QueryCoverage =100%, HitCoverage=34%, E-value=2e-57, Identity=79%"; Hit description= Hypothetical protein CBG13201 [Caenorhabditis briggsae]
  Gene Ontology: Mol. function=transcription factor binding; Biological process=development
  Coding regions on vcDNA: vcDNA=SeqID_86281; Strand=+; Position=2-384
IPCIYVLNKSXISVEELDILYTVPHCVPISAHHKWNFDDLLEKIWAYLNLIRVYTKPKGQLPDYNAPIILNAEKKXLDDLCMKIHKSLSKDFKCALVWGSSVKHNPQSVGKTHLLNDEDVVQVIKK

SEQ ID NO: 159859 - protein, 201 aa, Heterodera glycines
  Homolog annotation: Hit_ID=NP_501646.1; Match level="QueryCoverage =97%, HitCoverage=19%, E-value=6e-36, Identity=39%"; Hit description =putative protein, with at least 6 transmembrane domains, of eukaryotic origin (4K108) [Caenorhabditis ele
  Coding regions on vcDNA: vcDNA=SeqID_86282; Strand=+; Position=1-603
SARFIPAIGNCIAAHTDIICYCFVIIVHGYTAGLLTLPLPALVFLWGTLASPRPSKLFWIVMIIYTEFEIVAKFAFQFGFWPWNGDTVGNNKVYKTEYVFGVQRIQGFAGKDVALLIALFFHRYMLRKFGLWRDASSDRLINEMPKKRMDNGSSSSSSAEKSPQKSTQSTVVPSSSGENFESVAKAQREQNSDDIEKGIKR

SEQ ID NO: 159860 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_86283; Strand=+; Position=15-431

SEQ ID NO: 159861 - protein, 170 aa, Heterodera glycines
  misc_feature (65)..(65): Xaa can be any naturally occurring amino acid
  Homolog annotation: Hit_ID=NP_499133.1; Match level="QueryCoverage =82%, HitCoverage=87%, E-value=7e-41, Identity=58%"; Hit description =ubiquitin conjugating enzyme (18.9 kD) (ubc-7) [Caenorhabditis elegans] emb|CAA80166.1| Hypothetical prot
  Gene Ontology: Mol. function=ubiquitin conjugating enzyme activity; Cellular component=chromatin; Biological process=establishment and/or maintenance of chromatin architecture
  Coding regions on vcDNA: vcDNA=SeqID_86284; Strand=+; Position=40-551
TNPTDGFAVRGLVGDNIFKWQVIIFGPPESPYEGGTFLAQLDFPISYPQHPPKMRFITNILHPNXDGYVCISILHPPGDGPHGVERAAERWQPVHTVESIVISVQSMLSEPNFLSPANLEALLMFRINPQRYNERVKECVKESNVALDSDYRDSPTNGRTPGAVNGLRSI

SEQ ID NO: 159862 - protein, 203 aa, Heterodera glycines
  Coding regions on vcDNA: vcDNA=SeqID_86285; Strand=+; Position=65-676
MHLNYQKVTEEIFSNWIDDLVKRDVRLPLYQPYKDRREALFQLRINNDGKWPTDTPKQHKIPRQPPPTFVQTFGADILSCMVNPWHLIHLQLLGPRDFEKVAIGLYVRCKVKELCSVERIERVSWDASPPYEIYGRQMQVLLHFYGPSQTPPSPISAVQFPSTEIDRQVVEQQRKCRTFVPPSGNHIKRKSEELQNALYKIHY

SEQ ID NO: 159863 - protein, 212 aa, Heterodera glycines
  Coding regions on vcDNA: vcDNA=SeqID_86286; Strand=+; Position=2-637
VLFLIRCLKLIRFCPVLKGFLFEMFSSEKAKRGAFAKKSLNGNELESEANEGDAEDIGKSLEEQSHQLALPRLFKTLLSFEFANYSRLNESEVDPLLLSWDVLMRFFGDLDVLSRVRFCDAIDAKTLSNALAHLFNSLSDPPGHKDAICVVSNVDDLFTGPFHYKLVDRPFDREHFTSNLFFRTLATIPALFREWHGTLSKTEANTVNEYTQ

SEQ ID NO: 159864 - protein, 224 aa, Heterodera glycines
  Homolog annotation: Hit_ID=NP_740995.1; Match level="QueryCoverage =94%, HitCoverage=39%, E-value=7e-77, Identity=69%"; Hit description =DeHydrogenase, Short chain (dhs-6C) [Caenorhabditis elegans] gb|AAK68188.1| Hypothetical protein C17G10.9
  Coding regions on vcDNA: vcDNA=SeqID_86287; Strand=+; Position=1-672
MQPQQRNKASKYDVIGKTNEQLFHLLTICLSLQPQRIDESIQSQLQDKYGERMLRMANGDIDEFRNAFQQGCPKFLSPTTVVYEGSSVAKEPLLRQCNAFLEGIESQISLPILRGYLKLYTTLPVQKLASFMDIPDSELDSFIGKLLTYKMIVTELGKETIDKTEGADETTDLDFYVDKDMILIADTKVARRVSEYFIKQIGKLREISRKIKSSVTPVGQIHKN

SEQ ID NO: 159865 - protein, 166 aa, Heterodera glycines
  Coding regions on vcDNA: vcDNA=SeqID_86288; Strand=+; Position=1-501
RRPTFFCWCVIIGTVLPVSFFVWLFSKAFGKDGSASLQLFLIGAAISTFVVVMVLCCICPDKDGHSSLEVLYKCSACGKNVHRTYECIIDVTYNWSGGRHRDTFRYRNQTYSVWGKYTANVIKTVLRTRMTMNNFEAVERVMSVVQTDNYYKTSDEWTDDLIRRLE

SEQ ID NO: 159866 - protein, 229 aa, Heterodera glycines
  misc_feature (12)..(12): Xaa can be any naturally occurring amino acid
  Coding regions on vcDNA: vcDNA=SeqID_86289; Strand=+; Position=1-687
DFIKFILFHKIXTFPSKMSLFSPLFCSSFLLLSFCFSICAFLPQISEVENEIAEFIHRNPLAIDHRIALVQLIFEHQTELILANEQISFPKNISLDDLAFPYEMLVSKITSENFEELAQNLRKNALKLAKESTGKFHFLTENHFYGQFINYLAKIAQLKVEEALKQRRENDNLDELSEKETNDFSEGWKSLQMFVEMYSFGSELFMQLAANYGGKISQENAKNNEAISG

SEQ ID NO: 159867 - protein, 210 aa, Heterodera glycines
  misc_feature (22)..(22): Xaa can be any naturally occurring amino acid
  Homolog annotation: Hit_ID=NP_497899.1; Match level="QueryCoverage =98%, HitCoverage=27%, E-value=2e-12, Identity=27%"; Hit description =caenorhabditis KU (cku-80) [Caenorhabditis elegans] emb|CAA83623.1| Hypothetical protein R07E5.8 [Caenorh
  Gene Ontology: Mol. function=ATP dependent DNA helicase activity; Cellular component=nucleus; Biological process=DNA recombination
  Coding regions on vcDNA: vcDNA=SeqID_86290; Strand=+; Position=1-632
FRTLPAMIDLGVVALCRYAFTXNSNPKMACLIPKISKEANYPVLIHYLMPFRDDFRYFDFPLIKTPLSKYQLDLMDSYIDALMLYDEGSQVEQLKKRQVHDPRLQYECQLLRNRAVHPDKKGMELSAEDRQRLLETLSAPKQRMDEAQVVLDEIREEFPRELNENTRMAAFRTTKAKTDTLGQVDDRLQPIVPGAPVKDEQRTAKKEDAD

SEQ ID NO: 159868 - protein, 224 aa, Heterodera glycines
  misc_feature (51)..(51): Xaa can be any naturally occurring amino acid
  Homolog annotation: Hit_ID=NP_495705.1; Match level="QueryCoverage =98%, HitCoverage=58%, E-value=1e-111, Identity=67%"; Hit description= transitional endoplasmic reticulum ATPase TER94 (89.6 kD) (2I431) [Caenorhabditis elegans] emb|CAA88314.
  Gene Ontology: Mol. function=ATPase activity; Cellular component =cytosol; Biological process=microtubule cytoskeleton organization and biogenesis
  Coding regions on vcDNA: vcDNA=SeqID_86291; Strand=+; Position=9-679
CGTLCALAVTMDDFQFALGKNSPSALRETVVETPNVTWEDIGGLENVKREXQELVQYPVEHPEMFLKFGMQPSRGVLFYGPPGCGKTLLAKAIARECQANFISIKGPELLTMWFGESEANVRDVFDKARAAAPCVLFFDELDSIAKSRGGNVGDAGGAADRVINQVLTEMDGMGSKKNVFIIGATNRPDIIDSAILRPGRLDQLIYIPLPDEPSRLQIYRASLR

SEQ ID NO: 159869 - protein, 200 aa, Heterodera glycines
  Homolog annotation: Hit_ID=CAE59496.1; Match level="QueryCoverage =54%, HitCoverage=28%, E-value=8e-33, Identity=61%"; Hit description =Hypothetical protein CBG02882 [Caenorhabditis briggsae]
  Gene Ontology: Mol. function=beta-N-acetylglucosaminyl-glycopeptide beta-14-galactosyltransferase activity; Cellular component=integral to membrane; Biological process=development of secondary sexual characteristics
  Coding regions on vcDNA: vcDNA=SeqID_86292; Strand=+; Position=55-654
MQPCHLFSPFSFYFSGTFSHLFWILLFVSLPSKWRITSDHSFSIISERFEFNSTASKTEQLRNDKLNWIDFSTDNAESLLETVANSSGGSFCPDNDQNGLLLGHIGQATLLIEDLQEEDVELAFPELSPGGHWKPSNCVALHKVGIVIPYRDRKSHLVRLLDFLIPVLKRQQLDFRFIVTEQNGDSLFDKGRIMNAAFRF

SEQ ID NO: 159870 - protein, 234 aa, Heterodera glycines
  misc_feature (20)..(20): Xaa can be any naturally occurring amino acid
  Homolog annotation: Hit_ID=E86336; Match level="QueryCoverage=35%, HitCoverage=32%, E-value=6e-15, Identity=47%"; Hit description =hypothetical protein F14O10.11 - Arabidopsis thaliana gb|AAF88160.1| Contains weak similarity to an unknown pr
  Gene Ontology: Mol. function=protein binding; Cellular component =axoneme; Biological process=eye photoreceptor cell development
  Coding regions on vcDNA: vcDNA=SeqID_86293; Strand=+; Position=1-703
EQEEEKHEEWKRKRRKNQRXEEKEEEKEKDKGMEEKEEEEEKDKGMEEKEEEEEKDKGMEEKEEEEESDRERMTWLKKRKSRKRPIHLHRHVHVWGRNSDHTRTRNNRNNNRHRFGSSASAPKRSNSAHFPPLSTPFKRKLSFVDSSREEAHQKGYSPQSFSDHSWGSANHSSASDHFYSPHDQSPPISAAERSLSIDGHKYSDNWDHFDKRKEHTKKAPRHKINKMTKSNQSQ

SEQ ID NO: 159871 - protein, 219 aa, Heterodera glycines
  Coding regions on vcDNA: vcDNA=SeqID_86294; Strand=+; Position=22-678
IFARATDCCPEDELSFFQNFEGYSDERRSRLLPTSVLFFNSLPEIQFASATVLKGFLFEMFSSENAKRGAFAKKSLNGNELESEANEGDAEDIGKSLEEQSHQLALPRLFKALLSFEFANYSRLNESEVDPLLLSWDVLMRFFGDLDVLSRVRFCDAIDVKTLSNALAHLFNSLSDPPGHKDAICVVSNVDDLFTGPFHYKLVDRPFDREHFTSNLFFR

SEQ ID NO: 159872 - protein, 132 aa, Heterodera glycines
  Coding regions on vcDNA: vcDNA=SeqID_86295; Strand=-; Position=43-441
ICAPAAILRRSGHFSGPFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSGRLNLHMHA

SEQ ID NO: 159873 - protein, 63 aa, Heterodera glycines
  misc_feature (19)..(19): Xaa can be any naturally occurring amino acid
  misc_feature (22)..(22): Xaa can be any naturally occurring amino acid
  misc_feature (28)..(28): Xaa can be any naturally occurring amino acid
  misc_feature (56)..(56): Xaa can be any naturally occurring amino acid
  Homolog annotation: Hit_ID=XP_316880.1; Match level="QueryCoverage =92%, HitCoverage=11%, E-value=5e-13, Identity=63%"; Hit description =ENSANGP00000017843 [Anopheles gambiae]
  Coding regions on vcDNA: vcDNA=SeqID_86296; Strand=+; Position=2-191
KTIGALDMDELERALKESXTMXKAIVVXNPGNPTGQVLSRANIESIIQFAHKHRLXIFADEVY

SEQ ID NO: 159874 - protein, 164 aa, Heterodera glycines
  Coding regions on vcDNA: vcDNA=SeqID_86297; Strand=+; Position=87-578
VPKQSVAVNLHTDSSLAASTVKEASNTQFKLFYTCPDCPRDQSPVRSECSDYVDDDWSSIEDGDNPRTSREAQEAEIEDKYRSALNFLQEGNIERAVSIFSALLVHPVMSKYHIADWSTFDWQKSMTAGDGTSSQRIVPNMAKLYFNINLAMSGLAKDPFQFYV

SEQ ID NO: 159875 - protein, 160 aa, Heterodera glycines
  misc_feature (29)..(29): Xaa can be any naturally occurring amino acid
  Coding regions on vcDNA: vcDNA=SeqID_86298; Strand=+; Position=66-543
RLLLAERPTCADHRWRTDCNHCPARGCCXCCCCCKKRKRRRRHTSADDDKEDNKKRKRRHHTSDDDKKEEDHYHIDQHNKKEGEQHGKEDNKSPIQSELKVSTISAVPSDYNTNKRLGATELDVEAEEVPKTKPVPKKPKSEGGTKRKLSNFFWSTGTTE

SEQ ID NO: 159876 - protein, 142 aa, Heterodera glycines
  Homolog annotation: Hit_ID=CAE69876.1; Match level="QueryCoverage =88%, HitCoverage=27%, E-value=7e-25, Identity=51%"; Hit description =Hypothetical protein CBG16213 [Caenorhabditis briggsae]
  Coding regions on vcDNA: vcDNA=SeqID_86299; Strand=+; Position=1-429
YLAVCCFGIVAGAVGGVYYYNHVRSSRIDDPFNEFTRYSPAGPTKDKLKKSGSPIFGQSGDDTLAYKAQLHHYQQQKQKILGTASGPVVDNVSDNEEDTDEMDHNYSVFECPGLAPTGDLEIQNPNFVGAEKSAAGETRRTE

SEQ ID NO: 159877 - protein, 215 aa, Heterodera glycines
  Homolog annotation: Hit_ID=EAL47348.1; Match level="QueryCoverage =72%, HitCoverage=93%, E-value=2e-35, Identity=47%"; Hit description =ubiquitin-conjugating enzyme, putative [Entamoeba histolytica HM -1:IMSS]
  Gene Ontology: Mol. function=ubiquitin-protein ligase activity; Cellular component=endoplasmic reticulum; Biological process =conjugation with cellular fusion
  Coding regions on vcDNA: vcDNA=SeqID_86300; Strand=+; Position=78-725
MSSSHRETGRSPRSVLMRQYEMLLQNSNDNSGFRAWFDNNNLFKWRILIDGPPGTPYAGCKLTALLHFPASYPNDPPTMTFLTDILHPNIDQSGKVCISILHAPGIDPLGHEQPSERWNPNRSVESILVSIQVLLAEPNFNSPANVDAAILFRNDPAQYRKEVRRRVERASASTPRARSSSTPPPVAQPSGEQQQGTPQPPATPPTPPQEEPQQQ

SEQ ID NO: 159878 - protein, 231 aa, Heterodera glycines
  Homolog annotation: Hit_ID=NP_498263.1; Match level="QueryCoverage =92%, HitCoverage=41%, E-value=2e-89, Identity=74%"; Hit description =ALDH7A2, ALdehyde deHydrogenase (alh-9) [Caenorhabditis elegans] gb|AAC46640.1| Aldehyde dehydrogenase pr
  Gene Ontology: Mol. function=aldehyde dehydrogenase (NAD+) activity; Biological process=aldehyde metabolism
  Coding regions on vcDNA: vcDNA=SeqID_86301; Strand=+; Position=1-693
TGKILSEGRGEVQEFVDIADYATGLSRMFSGRIMPSERKKHLFLEQWNPLGVVGVISAFIFPAAVYGWNAALALVCGNSVLWKPSPSTPLTSIAITRLIGEVLSKNGLSPAICSLICGGGDVGMCLVKDPRVNLLSFTGSTEVGRVVGQHVQARFGKLLLELGGNNAIIVMDDADLSLVVPAVTFSSVGTAGQRCTSTRRLIIHEKVYDVVLERGGQRVQTADGHAHRGRE

SEQ ID NO: 159879 - protein, 99 aa, Heterodera glycines
  Coding regions on vcDNA: vcDNA=SeqID_86302; Strand=-; Position=253-552
MKLLTRIDCCCCCCDGGGGDGLAAATIFVGGVAAAKAATAPLSLLMAEMLFLGLLVVAPALFIFSSMLRFVRVSKTRLHSSSPNTQRPRIQPSSRCTKM

SEQ ID NO: 159880 - protein, 191 aa, Heterodera glycines
  Coding regions on vcDNA: vcDNA=SeqID_86303; Strand=+; Position=1-573
HKERQTYGEEDKSNAQNQMPTRDERRKIRRERKAMSDKADDGTRIPEGLVELKFEAPAAAAEEQLIEGETSTKSAFVSKFSTHPLGPWVPVKKEEKRPDLDSADSELQPHGKKRAKHYDDLPEQSYGPGSADYSQTPAELLEIAEMDPDDLSFKPKQTGQPQKSAKGKAIGFRKPGTSHATKSFRKANKTE

SEQ ID NO: 159881 - protein, 188 aa, Heterodera glycines
  Homolog annotation: Hit_ID=NP_507995.1; Match level="QueryCoverage =55%, HitCoverage=29%, E-value=7e-10, Identity=37%"; Hit description =predicted CDS, kruppel-like factor (5V159) [Caenorhabditis elegans] emb|CAB04459.1| Hypothetical protein
  Gene Ontology: Mol. function=RNA polymerase II transcription factor activity; Biological process=transcription from Pol II promoter
  Coding regions on vcDNA: vcDNA=SeqID_86304; Strand=+; Position=11-574
MALPSYNSFSGTQFAHRFPFAPLSSSVRPISFCGVIPSPPPPHSLNSLPSSSSSLNSNNCSLLLPSEISAKVFCPPSAIDPKLCRRAARRSRHELSHKRTHRCTVGGCDKVYTKSSHLKAHQRLHTGETCAFGTFVGVKSVLFCPFLRLAFKVNNCRFMCGGAQRTFIRADFVLSLLPSLSAFFTSER

SEQ ID NO: 159882 - protein, 196 aa, Heterodera glycines
  Coding regions on vcDNA: vcDNA=SeqID_86305; Strand=+; Position=2-592
MTSQVRSGTTRTKKRTADQVVKTVFRRKICLFCFMASLIVFALVLGLAITLTVITVNNWKEIGVLLSKQSALKSRSDIEAFYEIDCPIYSDNSKLPDKWDQFDLAFCNRYCDRNQMFEFMYRQLDPNRKSSAKSKDNQELMCPIYIEFKQCQMEEGGHCEEKLFSEEFTEFVQPGGAGTSSKGENETIGTCVPCPS

SEQ ID NO: 159883 - protein, 99 aa, Heterodera glycines
  Coding regions on vcDNA: vcDNA=SeqID_86306; Strand=+; Position=1-300
RIALLQPYLRSHKRGCSRPMNTSHYQITSLCTIWHFPMKCLLSKYLLKIMKTWHTIFRITHSNWLQKTLANAILSLKITCMDILSMIWQKLPLLKWNTH

SEQ ID NO: 159884 - protein, 226 aa, Heterodera glycines
  Homolog annotation: Hit_ID=AAL85711.1; Match level="QueryCoverage =96%, HitCoverage=13%, E-value=3e-26, Identity=34%"; Hit description =ABC transporter ABCC.8 [Dictyostelium discoideum]
  Gene Ontology: Mol. function=organic anion transporter activity; Cellular component=integral to plasma membrane; Biological process =transport
  Coding regions on vcDNA: vcDNA=SeqID_86307; Strand=+; Position=2-679
LGYVFSAALSSLVLSFGAYRASLAFTTTSPSLFRSPMAFFDRTPLGRILNRIGNDIDRIDENIPWAVGYSLSILAEAFNSIIAICIVIPFLVLVAVPLMVIFLCITHFYNVSSVQFRRLTSKSRSSHLSFVEDAYSGSDSIRIFKAIKQFRAKGYRISDICNECFIVEIFSNRWLQIRLDIVADVSVFICVAVAIWMASQGVISLGVLALVIGCGYTFTGYLGEVA

SEQ ID NO: 159885 - protein, 221 aa, Heterodera glycines
  Coding regions on vcDNA: vcDNA=SeqID_86308; Strand=+; Position=6-668
KNMRIPIILILLRIVALLIHDACAGKKTPRKANRNRANKNGNSGTPSRQAAAPGKQNKNTPEARTNGQSPKKGGKSIGNQANPAEVKDAPQQSTPKKLLHAASVGVLLLSNLAGPIPAGAYDINQDRNSHMTEQYKMHGRNNMAAYMNQRSNLYGETAAANNIHGKNNNIHAPPKNKAVEEKTKPQMTHNNFARHTRTRYPPPPHKKTLRSPNFSALAAER

SEQ ID NO: 159886 - protein, 232 aa, Heterodera glycines
  Homolog annotation: Hit_ID=AAH32919.1; Match level="QueryCoverage =73%, HitCoverage=33%, E-value=8e-21, Identity=36%"; Hit description =FLJ10826 protein [Homo sapiens]
  Coding regions on vcDNA: vcDNA=SeqID_86309; Strand=+; Position=3-698
VCSSAANSWHSVSEVLSEQKQRLSLNGWFHYAPGTANVAQTGPNCAVEEPICRVEPSMNITLAEVNEWLSPNYIRPGQHRQIKRIFAYKSELSLQQFLNNERYNKALDELEKAQFESVGPPHKRNVWRLVESSLEQNSVLQSLLRLFRSEAITLLLTQWTGLHLYDLKTKRGTAHSPNGAKRAAEPPKKRKRADEEEEGTTSGGLKQGGESRQRRRKRRYKCSNRFFHPSFR

SEQ ID NO: 159887 - protein, 132 aa, Heterodera glycines
  Coding regions on vcDNA: vcDNA=SeqID_86310; Strand=-; Position=0-395
PKRWANELFIILFIHHSYFLNIILATNMLKFVLSVQMNWRHFNVSEEIWQINASQKMAGRVRWDTSLWTGVPNHQIRFFVANFALTSAHFKAPVGRRSFFAQQIIRIKRVSLHQEDFGANVRLSWHHNSPRT

SEQ ID NO: 159888 - protein, 233 aa, Heterodera glycines
  misc_feature (142)..(142): Xaa can be any naturally occurring amino acid
  Homolog annotation: Hit_ID=NP_490840.1; Match level="QueryCoverage =99%, HitCoverage=16%, E-value=3e-77, Identity=60%"; Hit description =death-associated protein kinase 1 (1B801) [Caenorhabditis elegans] gb|AAK18971.1| Temporarily assigned ge
  Gene Ontology: Mol. function=calmodulin-dependent protein kinase I activity; Biological process=induction of apoptosis by extracellular signals
  Coding regions on vcDNA: vcDNA=SeqID_86311; Strand=+; Position=3-702
TRGMEQTMQSIFPRIQVALRRSMQTFQDSIEAELAQWRYCSKMQSSKMEALIRLVGESVEVQIRGPPEKATACIYFLEDLSTLVELTSAEVAPGISTERHFLSPAHLREHRTTPAIFTPETIMEMQQNESLVIVNSDGEEEXEFTDVVCFGSKEAAGLLTLGVDISVSQLQLSARSELAALLDAPNTLGMDWSILAVKLNLTEQIPEVDSSGQSLSRTDQLLTEWALHSPDSA

SEQ ID NO: 159889 - protein, 206 aa, Heterodera glycines
  Homolog annotation: Hit_ID=NP_491999.1; Match level="QueryCoverage =82%, HitCoverage=40%, E-value=1e-19, Identity=31%"; Hit description =putative protein (46.1 kD) (1H635) [Caenorhabditis elegans] emb|CAA95854.1| Hypothetical protein W01A8.1a
  Coding regions on vcDNA: vcDNA=SeqID_86312; Strand=+; Position=90-707
FHKKRRRRRDSIVVFPWNTAIDKRIYAAIEATQEIAKNPSEKLTAHANSFLDIANSLSESILGLPRAVEDPEWGLKERVTFLASRIGHRISSKTNERIVEPLLQQMCVLTEQLSKCIVLVDCAKQRQEWTFNKVSQLSTSVVELRNKIETEATRTRKIPGEVLLKIIRFYSSKLNVQMSKLRDRSSELLSSSMQKQILTLTAYVQQ

SEQ ID NO: 159890 - protein, 142 aa, Heterodera glycines; identical to SEQ ID NO: 158766
  Homolog annotation: Hit_ID=AAO85453.1; Match level="QueryCoverage =100%, HitCoverage=100%, E-value=1e-77, Identity=100%"; Hit description=putative gland protein G16A01 [Heterodera glycines]
  Coding regions on vcDNA: vcDNA=SeqID_86313; Strand=+; Position=65-493

SEQ ID NO: 159891 - protein, 140 aa, Heterodera glycines
  Homolog annotation: Hit_ID=NP_570940.1; Match level="QueryCoverage =66%, HitCoverage=58%, E-value=9e-12, Identity=43%"; Hit description =keratin associated protein 16-1 [Mus musculus] gb|AAK52889.1| keratin-associated protein 16.1 [Mus muscul
  Coding regions on vcDNA: vcDNA=SeqID_86314; Strand=+; Position=56-478
MLLPLLVLMLLSASFPLSAFSPSYSSYSNWPYPNSPRYSDYNRLYPSYSGQYGNYSGYNYGNYYNPYGGNSRGYYGMYDSPSYGSGYSPSYYGGYYGRNGGLGYGGMYPGYGGYSTASYYGGWPYTAGYGAQNGYTSPWR

SEQ ID NO: 159892 - protein, 100 aa, Heterodera glycines
  Coding regions on vcDNA: vcDNA=SeqID_86315; Strand=-; Position=0-299
FFFFFFFFSIFFFFFFFFVLFIFCEILMKFEHKSLKIHFYFYSQTNISFFLSFFVCEKEIFNEILPAANAIVGTANRSGNSEDESAEQEEQVLNSAQSIT

SEQ ID NO: 159893 - protein, 179 aa, Heterodera glycines
  Coding regions on vcDNA: vcDNA=SeqID_86316; Strand=+; Position=141-677
MSAVIPQPPSPAHPKFQKLYLDKKDKSTGQAHKPKTNKGPLHRLRTFFSRVILEKKIDGIVQVYEKIKDSPGGWAVLIQKMFTEMVLAKQFGEGSAGESRKNCQIALQLISNGGDKVGGVHLDKVKPFDSTWSLVKSAAQSLVELFKRNAGGEKARMKRTETILRVFKTFAMDGNALEG

SEQ ID NO: 159894 - protein, 102 aa, Heterodera glycines
  Coding regions on vcDNA: vcDNA=SeqID_86317; Strand=+; Position=3-311
DVRGTAADEGRHGRGQKVNVSNANSLRLCSFLVSLALLLTIAQQKVSSTRVHIFTITLPVAEFLAQNHSRICDGSRHLKQKKGNISFCWSIVRQIAFRLSSQ

SEQ ID NO: 159895 - protein, 28 aa, Heterodera glycines
  Coding regions on vcDNA: vcDNA=SeqID_86318; Strand=+; Position=95-178
MAETPPPPPPADAAAVGGDEAVDLEQRV

SEQ ID NO: 159896 - protein, 129 aa, Heterodera glycines
  misc_feature (25)..(25): Xaa can be any naturally occurring amino acid
  misc_feature (58)..(58): Xaa can be any naturally occurring amino acid
  misc_feature (104)..(104): Xaa can be any naturally occurring amino acid
  Homolog annotation: Hit_ID=NP_509854.1; Match level="QueryCoverage =96%, HitCoverage=34%, E-value=9e-30, Identity=56%"; Hit description =phosphoribosyl pyrophosphate synthetase-associated protein (39.0 kD) (XL693) [Caenorhabditis elegans] emb
  Gene Ontology: Mol. function=enzyme inhibitor activity; Biological process=nucleobase, nucleoside, nucleotide and nucleic acid metabolism
  Coding regions on vcDNA: vcDNA=SeqID_86319; Strand=+; Position=1-386
WKACVHLCINSSKNVNNCVMDMLTXIDACETSMAKSIPVHYAIICPNIKHGRMYHNSXVPMKLACDMVCKSGTTRIVALDSYRKEIQCLNIIPVDNLPASPFFXLQYMKYNIPDYKNAVIVAKTPGVMN

SEQ ID NO: 159897 - protein, 173 aa, Heterodera glycines
  Coding regions on vcDNA: vcDNA=SeqID_86320; Strand=-; Position=3-521
EHAVKKEKGEKAQVIGGKCRQIAFDARSNRCHAGRKTELGALEEHGPRLISLTEFGQQSLGTGRGGRHRLIGAIGGGGRRIGGRAEKGSRREPRGLLLLLLLSLRMTILRRRVHLGSGRIGRKRWIKRLMRDGRGTIAGGGESISFSPSLPFANYDHIVVFLVIFLACLRLFH

SEQ ID NO: 159898 - protein, 38 aa, Heterodera glycines
  Coding regions on vcDNA: vcDNA=SeqID_86321; Strand=+; Position=1-114
SWIYDIKINYGQSSRNKTCQNRTKLTKHETNFHKQFGQ

SEQ ID NO: 159899 - protein, 174 aa, Heterodera glycines
  Homolog annotation: Hit_ID=AAO49799.1; Match level="QueryCoverage =100%, HitCoverage=48%, E-value=6e-97, Identity=99%"; Hit description= arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_86322; Strand=+; Position=3-527
IADTFLFKEGDRFLQEANACRYWPTGRGIFHNAKKTFLVWVNEEDHLRIISMQNGGNVGQVLERLIKGVKAIESKVPFSRDDRLGWLTFCPTNLGTTVRASVHIRLPKISAKPDFKSICDGLKLQIRGIHGEHSESAGGVYDISNKARLGLTEFEAVKQMYDGVKHLIELEKKA

SEQ ID NO: 159900 - protein, 136 aa, Heterodera glycines
  Homolog annotation: Hit_ID=S02771; Match level="QueryCoverage=95%, HitCoverage=6%, E-value=2e-43, Identity=67%"; Hit description=myosin heavy chain A [similarity] - Caenorhabditis elegans
  Gene Ontology: Mol. function=structural constituent of muscle; Cellular component=striated muscle thick filament; Biological process=striated muscle contraction
  Coding regions on vcDNA: vcDNA=SeqID_86323; Strand=+; Position=3-413
ELDGEQRRHQETDKNYRKAERRVKELDFQVEEDKKNTERLTDLIDKLQGKLKVYKRQVDEAEEVAATNLGKYRQLQAQLDEAEERADMAENSLSKLRAKNRSSASIAPASASGLATSASAAVLRSTSFARNSFADY

SEQ ID NO: 159901 - protein, 220 aa, Heterodera glycines
  Homolog annotation: Hit_ID=NP_506361.1; Match level="QueryCoverage =90%, HitCoverage=58%, E-value=1e-64, Identity=56%"; Hit description =complex i intermediate-associated protein 30 mitochondrial (5O46) [Caenorhabditis elegans] emb|CAB01129.1
  Gene Ontology: Mol. function=chaperone activity; Cellular component =respiratory chain complex I (sensu Eukarya); Biological process =mitochondrial electron transport, NADH to ubiquinone
  Coding regions on vcDNA: vcDNA=SeqID_86324; Strand=+; Position=21-680
MWQRIKDRVLIYDRMGRGTVHGETSIKYEFKTDEDFGKWLTGSDSEWSEGFSKCKLYRSDRGSAIFEGTLSTRLVKDGKTQGAGWCSMRSLNDKKAFDRKNFFSDWSHYTHLLIKCRGDGRTYKVMLHIPQFMDITWGNSYTYLLHTHGGPHWQFEMIPFSRFVFTVEGRAIDVQYPLDPRAASSIGITLMDRIEGPFRLEIDFIGATHDISHLEKHAYE

SEQ ID NO: 159902 - protein, 221 aa, Heterodera glycines
  Homolog annotation: Hit_ID=AAS38911.1; Match level="QueryCoverage =96%, HitCoverage=93%, E-value=9e-16, Identity=40%"; Hit description =similar to Leishmania major. Ppg3 [Dictyostelium discoideum]
  Gene Ontology: Mol. function=transmembrane receptor activity; Cellular component=integral to plasma membrane; Biological process =nucleocytoplasmic transport
  Coding regions on vcDNA: vcDNA=SeqID_86325; Strand=-; Position=17-682
SSRKSCSLSLGNGIKSLLRLSGLATTLAVDFVALWPLSNWLFVSLSPSSSSSSSSISIWSSASLASVSSKLTSLSSIATQSCRNWSRSSTDSSFSASSNCRCPSSIPSSSNSICSCNSSPSPSSSPSSSSSSSSSAASSSSVINCKRFFFGGRSTIAPDSLDNALASHFVRKHLSDANFVSPAFNFAPNTANSLPIPFNSRFSSSTFFCSVISSSFRPRSL

SEQ ID NO: 159903 - protein, 184 aa, Heterodera glycines
  misc_feature (167)..(167): Xaa can be any naturally occurring amino acid
  Homolog annotation: Hit_ID=AAO85454.1; Match level="QueryCoverage =100%, HitCoverage=99%, E-value=1e-102, Identity=99%"; Hit description=putative gland protein G16B09 [Heterodera glycines]
  Coding regions on vcDNA: vcDNA=SeqID_86326; Strand=+; Position=32-584
MASSFCSSLISIVAIVCLLCKCCFSAPHPCCPGSQHVVSMMKDHTGTFSASMPKSSLCLSAERVAAAVENQLKTIWCPGNGGQTLINEINAAQSSSDECARSLGFVRAMFEIAASAASHVGANAELANLAVQFREQVGTIDTNCAALGIHVGQISLGTPKGDHPQVXDSESVLSNPGTSGSHKR

SEQ ID NO: 159904 - protein, 103 aa, Heterodera glycines
  Coding regions on vcDNA: vcDNA=SeqID_86327; Strand=-; Position=21-332
KSKAMEYFQLDRRHGDELYGCLLLLLLGMAFTICATTFSTNAAHKRNSQNARSECVCPYKKNWANARVLALSAVVCTTQRCSAACSATSGQHCPLTLRAQFRP

SEQ ID NO: 159905 - protein, 84 aa, Heterodera glycines
  misc_feature (37)..(37): Xaa can be any naturally occurring amino acid
  Homolog annotation: Hit_ID=AAN14978.1; Match level="QueryCoverage =100%, HitCoverage=24%, E-value=8e-40, Identity=98%"; Hit description= chitinase [Heterodera glycines]
  Coding regions on vcDNA: vcDNA=SeqID_86328; Strand=+; Position=2-253
LFFVLFFNAAINFVSSHRIVGYYQGIRPLTNDQAKKXTHLILAFSTPDSQGNLSPLSSVLKQALKAGKSANGALKVMIAIGGGG

SEQ ID NO: 159906 - protein, 173 aa, Heterodera glycines
  Homolog annotation: Hit_ID=NP_493624.1; Match level="QueryCoverage =100%, HitCoverage=84%, E-value=1e-67, Identity=72%"; Hit description= CYcloPhilin (21.9 kD) (cyp-5) [Caenorhabditis elegans] emb|CAB07192.1| Hypothetical protein F31C3.1 [Cae
  Gene Ontology: Mol. function=cyclosporin A binding; Cellular component=cytoplasm; Biological process=signal transduction
  Coding regions on vcDNA: vcDNA=SeqID_86329; Strand=+; Position=3-524
FDISIGGVKKGRIVIGLFGEVVPKTAKNFLELAKGTHGYGYKDSKFHRVIRNFMIQGGDFTRGDGTGGKSIFEGKSFEDENFKLHHYGAGWLSMANAGPDTNGSQFFITTVHTPWLDGRHVVFGKVLEGMNIVREIEDGETAGGDRPKKDVVIVDSGELTVSEPFKVAREPVV

SEQ ID NO: 159907 - protein, 234 aa, Heterodera glycines
  Coding regions on vcDNA: vcDNA=SeqID_86330; Strand=+; Position=12-713
TLGTKQLKRDNVYELIGDFAKALLPSSFLYGYCKEANCAPSSILLNYAVELCKLSSSLTADANRFELCIETAKAAILKAEMDERTVMVLLSTVKDICPYNYEAIELLFHTMHEIATNGKIEPENPDLVLIRGGYMLLKFLRCTNRGKNISSGEIRWYKQFTSQKNWNSSLSYVTNTELVLADETAGAPSLDESAMGPVRQQSNLLPSNESNSILPSWAMKRLPFHLLFNEENES

SEQ ID NO: 159908 - protein, 32 aa, Heterodera glycines
  Coding regions on vcDNA: vcDNA=SeqID_86331; Strand=-; Position=220-318
FLFFFFFFLAQKRRKIKRDKYVFNWRKLVQIQ

SEQ ID NO: 159909 - protein, 111 aa, Heterodera glycines
  Homolog annotation: Hit_ID=AAL78214.1; Match level="QueryCoverage =86%, HitCoverage=48%, E-value=8e-16, Identity=45%"; Hit description =putative esophageal gland cell protein Hgg-20 [Heterodera glycines]
  Coding regions on vcDNA: vcDNA=SeqID_86332; Strand=+; Position=161-496
MSDHPNVALADLSCVANDVWLDTLFWIDRVEVGTKFALIDARFGKLVATHFNLRKWRLGELGVHRAPSGWDRGGTAAVTVMDDNALINRLPLATCPAPGGVIGFSAIYIWS

SEQ ID NO: 159910 - protein, 186 aa, Heterodera glycines
  Homolog annotation: Hit_ID=NP_494398.1; Match level="QueryCoverage =95%, HitCoverage=72%, E-value=2e-45, Identity=51%"; Hit description =putative protein of eukaryotic origin (2D204) [Caenorhabditis elegans] gb|AAF60412.1| Hypothetical protei
  Coding regions on vcDNA: vcDNA=SeqID_86333; Strand=+; Position=1-561
LFTNSSLTGNKGYKAADWKLDSPDWVGRLRLISIGDKLEIRLEDKTSGELFAKAPIGQLNSVDYGSVSDSSRYFVVRLRNDNAQTAFVGIGFADRADSFDLNVAIQDHFKAVKKCDDSAEDNAETVPKLDLSFKEGQTITVNIGKKTITSNNNSSSAVPNLRTSLGGSSAVPLLPPPPASGNKIRK

SEQ ID NO: 159911 - protein, 178 aa, Heterodera glycines
  Homolog annotation: Hit_ID=NP_503408.1; Match level="QueryCoverage =85%, HitCoverage=94%, E-value=9e-19, Identity=35%"; Hit description =putative secreted or extracellular protein precursor (5B870) [Caenorhabditis elegans] gb|AAF60880.2| Hypo
  Coding regions on vcDNA: vcDNA=SeqID_86334; Strand=+; Position=34-570
MYMNSMGSRGASSAAVVASAAALCLFSAMAVVVYGAESAGPKADQAMAAKQFNPSAFPAMPPELEKILPADVVQKLKAVHADMSLNIMQKQDKIDRIMSSLPGEVLDQIPAPPGFERLPDDVKNRLKQINRQTNKAWADKQKELQEYVKTLPQEQRAILMMGPMGGPHPPPPSFGRRR

SEQ ID NO: 159912 - protein, 143 aa, Heterodera glycines
  misc_feature (113)..(113): Xaa can be any naturally occurring amino acid
  Homolog annotation: Hit_ID=CAE69178.1; Match level="QueryCoverage =80%, HitCoverage=24%, E-value=4e-33, Identity=51%"; Hit description =Hypothetical protein CBG15211 [Caenorhabditis briggsae]
  Coding regions on vcDNA: vcDNA=SeqID_86335; Strand=+; Position=254-681
FGKHFFAKWHFQETLELNSPFEAVSTVNGHQFMLQSSKGRNPYCETCLGTIWRLAQHWRRCKSCGYRTHEKYIDKVRRVCPSLALARTEFSLQFDLCPEKSLLEQNYQCAECXLPIGFDDDSEKLPRICDFTGLFCCRRCHWN

SEQ ID NO: 159913 - protein, 181 aa, Heterodera glycines
  Coding regions on vcDNA: vcDNA=SeqID_86336; Strand=+; Position=1-543
IPMHRPRHCSEFRPFILNRRAVPCRPSLHLPYRMPNNNNDSTPKTAFSLRPTRTHCQQPMHIHNPFSCPPPPRHRSNLSKFDPSKMPPQFPAFGNPPSPEGMTLTGRMPRQKTKFHRQCAQFSPFWKCFLASSHCSWVRPCPNALSLSKFARPIRRCAQCESVQLPHPTQRAHLFDPFRHP

SEQ ID NO: 159914 - protein, 42 aa, Heterodera glycines
  Coding regions on vcDNA: vcDNA=SeqID_86337; Strand=-; Position=81-209
FFFFFFFFFDHSSSHCFHSVQLSFHLYPLHLVSRCSSSLPPS

SEQ ID NO: 159915 - protein, 36 aa, Heterodera glycines
  Coding regions on vcDNA: vcDNA=SeqID_86338; Strand=+; Position=3-110
NRLLAVVPFLVRTNFNGARVVHRALDQSRALLHCPS

SEQ ID NO: 159916 - protein, 166 aa, Heterodera glycines
  Homolog annotation: Hit_ID=CAE65688.1; Match level="QueryCoverage =80%, HitCoverage=31%, E-value=6e-10, Identity=28%"; Hit description =Hypothetical protein CBG10763 [Caenorhabditis briggsae]
  Coding regions on vcDNA: vcDNA=SeqID_86339; Strand=+; Position=3-503
SVVELRNKIETEATRTRKNPGEVLLKIIRFYSSKLNVQMSKLRDRSSELLSSSMQKQILTLTAYVQQLDDSFVKAKDIDEVKQEVLEEAKQKLFDIARWSASLSLRGPPKTSTADDVEHENLSSNIETEPKQEETKGEEEETLQQSMKEDEEEKGEEEEDEEEEED

SEQ ID NO: 159917 - protein, 212 aa, Heterodera glycines
  Homolog annotation: Hit_ID=NP_493723.3; Match level="QueryCoverage =96%, HitCoverage=59%, E-value=3e-54, Identity=58%"; Hit description =nucleotide-sugar transporter (2A681) [Caenorhabditis elegans] gb|AAB66127.3| Hypothetical protein C03H5.2
  Gene Ontology: Mol. function=UDP-N-acetylglucosamine transporter activity; Cellular component=Golgi apparatus; Biological process=UDP- N-acetylglucosamine transport
  Coding regions on vcDNA: vcDNA=SeqID_86340; Strand=+; Position=13-648
MAAVSSAKSSSALKWVSLIVLIGQTTALVLTLRYSQTQKSHPSDGPKYLSSTAVLMAEIVKFFTCVSVLGYQNKWNFGRLLHDFDGRDSLKVGVPALLYVVQNNLLFLALSKLDAATYQVTYQLKILTTAFFSVTMLNKKLDLIKWMSLILLTFGVALVQLPKSAESPSLAVDEKAFGADNPPQKSTGDGFVGLFAILAACCSSGFAGVYLE

SEQ ID NO: 159918 - protein, 183 aa, Heterodera glycines
  Coding regions on vcDNA: vcDNA=SeqID_86341; Strand=+; Position=34-585
FLYKKQNKIFVLNGLRQSYTCCWGPFRTRIETGTTVMALFGFGLGILSAISSYVGFHNIYAGMVYLASSLFYLSVIIAMKKKEPSLFLPYLIFEGIGLLCAAVISLTMFIFGIWSPQQAFSTKEQEMNFRSLMLFFAATVGIDVALNAWFYSIIYRTYNLLKKTTKLVASASTVASARVPPPV

SEQ ID NO: 159919 - protein, 112 aa, Heterodera glycines
  Coding regions on vcDNA: vcDNA=SeqID_86342; Strand=+; Position=237-572
LQFDDEAFLAFVKGPANFDKFCAGKGVTNDQSKELLTQIYGTHLGILFYMRKNWHCANVRKEFEEFIDPEECQLFQNYLCIVYEFLFNVYAEQEDIMKPILKPPIGFRISIL

SEQ ID NO: 159920 - protein, 187 aa, Heterodera glycines
  Homolog annotation: Hit_ID=CAE70160.1; Match level="QueryCoverage =66%, HitCoverage=70%, E-value=8e-37, Identity=58%"; Hit description =Hypothetical protein CBG16627 [Caenorhabditis briggsae]
  Gene Ontology: Mol. function=structural constituent of ribosome; Cellular component=mitochondrial small ribosomal subunit; Biological process=protein biosynthesis
  Coding regions on vcDNA: vcDNA=SeqID_86343; Strand=+; Position=8-571
DGSFLARINYFRAFSSTVSRSFKQVKHTVQDNVTTIELVDVPIASTHRELKESAATQSKTPDDCSCVLCKIPTSISYKDVLILEQFMRLDGTVFPRQLTGLCHDQQQRLERCVMQAHWSGLFPDRTIPEFDRAGYKRFNRHWDDDLAMFRLKYKLHPGSWFYIKRYNPRIREYRPFKADEIPDIERE

SEQ ID NO: 159921 - protein, 202 aa, Heterodera glycines
  Coding regions on vcDNA: vcDNA=SeqID_86344; Strand=+; Position=31-636
NRIGCVNSRTTGRTENGTVKPSLICGKEEEETEQMAESKSELGDELWTGMEGPPVKEMKLETRAEEEEDEFDEQFLNEPKTIPMDTETLTAADSLRSHFGSLTKGIPNRMHRSSLLSAWEPPTSSASILKNPEQQRPSLLSDITEVFSAQQNVLGPSTSIGKITEMTHNVPFQFNAKVTVKELISQSFGETKGEELAKIVQA

SEQ ID NO: 159922 - protein, 141 aa, Heterodera glycines
  Coding regions on vcDNA: vcDNA=SeqID_86345; Strand=+; Position=1-426
QSSACERIDELHLELNFTILDITSIESKALTKWLTGKKAKKSSKKLLIRPRSREFATSWIRILQSDRLDNIYQVRVQCEFSLEQFSISCGANGTMTMEMRQDGQKDYLLNKYPTGEKMPPNYAFQLNGPLIKVSFVAQQKS

SEQ ID NO: 159923 - protein, 186 aa, Heterodera glycines
  Coding regions on vcDNA: vcDNA=SeqID_86346; Strand=+; Position=1-558
SALSTLWRLFSFYKASLSRSQSESKPTNSFGSLAIKPPTLANTHCQFNYNNILATLGNGIDYHRQNSGTGEGTQLPVGPFGVFAGFSPFSKPSLSRSQSESKPTNSTNSFANIAAKPPTAANTQYNYNQQLRMIMPQPSVVSKKNSPTSQNDKRMDKLENGETNTPSLCGDEEEKPAKNYLHKTQI

SEQ ID NO: 159924 - protein, 198 aa, Heterodera glycines
  misc_feature (14)..(14): Xaa can be any naturally occurring amino acid
  Coding regions on vcDNA: vcDNA=SeqID_86347; Strand=+; Position=1-594
SMNRQKRQNLNSIXKKKAIDLALNQSPLSVRLSLSCFHLFLTAEKINERNKVKVTLLSKPQCDANGYEIIVDYKLIVGNWTKLVQKDKWDVEETLLSMEHDSCYIDTLEVLANVRETLAPQDIKTSTGFRSFNILCSDRSFYVNTTHLNLLGGRMFKEWYERECQGEKNAVIQSIDANELEKLLQTCCAYGSTPTIPQ

SEQ ID NO: 159925 - protein, 126 aa, Heterodera glycines
  Homolog annotation: Hit_ID=XP_319666.1; Match level="QueryCoverage =90%, HitCoverage=34%, E-value=1e-42, Identity=71%"; Hit description =ENSANGP00000021376 [Anopheles gambiae]
  Coding regions on vcDNA: vcDNA=SeqID_86348; Strand=+; Position=1-381
IAKKVNQLEDKKENDVEEKAEELKTQGDTFKKQLNNLFAQVDDRRRKRDLPDYLCGKISFELLKDPVITPSGITYDRQDILTHLHRVGHFDPVTRVPLTADQLIPNFSMKEVVDHFVQENEWAIDF

SEQ ID NO: 159926 - protein, 186 aa, Heterodera glycines
  misc_feature (2)..(2): Xaa can be any naturally occurring amino acid
  Coding regions on vcDNA: vcDNA=SeqID_86349; Strand=+; Position=2-559
CXRRTFSRTHGIAKSGRLDLENRANPHFFRRLSASSVTLVLFYHSLGTRSVSQKLCCKIFFTLNNGTWPSALSYDEDPNSNCPYQCIYTTERTAEASASVLLFHVFWSNPIGFWPFWSWPQHRSEEQLYAFFTQESPYYAGSAFNKLSNDWFNLSMTYHADSTIATKYDELLEHRSGEMLAGEDEF

SEQ ID NO: 159927 - protein, 142 aa, Heterodera glycines
  Homolog annotation: Hit_ID=CAE71249.1; Match level="QueryCoverage =75%, HitCoverage=62%, E-value=5e-14, Identity=36%"; Hit description =Hypothetical protein CBG18125 [Caenorhabditis briggsae]
  Coding regions on vcDNA: vcDNA=SeqID_86350; Strand=+; Position=3-428
SAFGRPSTIFARLTVADEHTNDAGIMHTGFAAAMADVLTAATVRITAAQQTPVVSVDLTTAIVQPARIGDILLMEANCLQADRSIAFTEAIFRRKSDGQLIVKASQQLAILHYLPLKTKGKGGDGNDAKKGPTDCEQQQQQN

SEQ ID NO: 159928 - protein, 180 aa, Heterodera glycines
  Homolog annotation: Hit_ID=CAE56797.1; Match level="QueryCoverage =98%, HitCoverage=60%, E-value=6e-63, Identity=48%"; Hit description =Hypothetical protein CBG24609 [Caenorhabditis briggsae]
  Gene Ontology: Mol. function=protein binding; Cellular component =nucleoplasm
  Coding regions on vcDNA: vcDNA=SeqID_86351; Strand=+; Position=2-544
IGETSGYFQRLLISLCSGARDEQMHTDPIKANQDAQRLWRAGEARLGSDEIAFNSILAVQNFVLFRMVFDEYQRQHGHSIEQAISNEFSGDIRDANLALVKSIRNRASYFAELLHNSMKGIGTRDTDLIRLVVTRSEVDLVDIRQAYQNMYGTSLENAIASDCSGAYKDGLVAIVKGYYH

SEQ ID NO: 159929 - protein, 203 aa, Heterodera glycines
  Homolog annotation: Hit_ID=CAE62116.1; Match level="QueryCoverage =96%, HitCoverage=12%, E-value=4e-53, Identity=56%"; Hit description =Hypothetical protein CBG06155 [Caenorhabditis briggsae]
  Gene Ontology: Mol. function=microtubule binding; Cellular component =microtubule cytoskeleton; Biological process=gametogenesis
  Coding regions on vcDNA: vcDNA=SeqID_86352; Strand=+; Position=3-611
GAPSAHPSSPCSSSLLPPPVSSLSVPLHHRSSISGGGSRPIVIRKGPQGFGFSIRSVRVYLSEMSEYYSIEHIVAAVREGSPAREAGLRTNDLITRVHTQSVHNMTHPEMMRRLLSCGNELTIHVVPLSSTSIKEGEPRRNIGKPLRKKPRRPPTAQQKNKQQSRKGSALLRRLSGKRTVGDTVPGTSSQKQMFIPRSVSSQE

SEQ ID NO: 159930 - protein, 126 aa, Heterodera glycines; identical to SEQ ID NO: 141921
  Homolog annotation: Hit_ID=AAH47137.1; Match level="QueryCoverage =78%, HitCoverage=78%, E-value=1e-21, Identity=51%"; Hit description =Histone 2, H2bb [Mus musculus] ref|NP_783597.1| histone 2, H2bb [Mus musculus] gb|AAO06250.1| histone prot
  Gene Ontology: Mol. function=DNA binding; Cellular component =nucleosome; Biological process=nucleosome assembly
  Coding regions on vcDNA: vcDNA=SeqID_86353; Strand=+; Position=76-456

SEQ ID NO: 159931 - protein, 94 aa, Heterodera glycines
  Coding regions on vcDNA: vcDNA=SeqID_86354; Strand=+; Position=2-286
MKMAVNNTERLHFSSFASQKFSLQNFQNCNIVEKLNIRNTKQFNIDIRVEEGNGLFTVTFDTGGKATKCQYRSPDMPTWAVQYITVRTELAQLF

SEQ ID NO: 159932 - protein, 234 aa, Heterodera glycines
  Homolog annotation: Hit_ID=CAE68838.1; Match level="QueryCoverage =95%, HitCoverage=46%, E-value=1e-55, Identity=45%"; Hit description =Hypothetical protein CBG14799 [Caenorhabditis briggsae]
  Gene Ontology: Cellular component=membrane
  Coding regions on vcDNA: vcDNA=SeqID_86355; Strand=+; Position=4-705
IPLRRFLRLLLLIFGNSSDPAQIVSPWAWRMPWLQWLLLFWFLIFMQRVQYYYAWTMTDAICNISGFGFDGFTSDGKPKWDLTTTVDVWKVETAQSFKETLDGWNLKTMFWLRYIAYERMPKNYRTLSTYALSAVWHGLFMGYYLCFATGALITVAGRMSRRCIRHHFQRNAFLHHLYNLLTFLATKFALAYTTFPFVTMHLNPGLLLYRRLFFFLHFLALFAILALPRLLPPE

SEQ ID NO: 159933 - protein, 227 aa, Heterodera glycines
  Coding regions on vcDNA: vcDNA=SeqID_86356; Strand=+; Position=2-682
DGSCRNGRKLGHFIFGKKNKWNCPEKANDKQRKRPSLQRNDATAGQMLENCNLLRFANNALRKYFLYLKANKKFLEEDRDNRGAEQIIKAKDDLLKKLSLKPSFLQLSENNLSTVKIVLLKAYKHFNLQTENLEENEFKLITEKFVNFENCAKLMKLSKAFQKKKSLEFPIDDTMNRYRKALGKIKAKMEDDDDYCIKCKIPTVDEIINGKEAKLKDRFEDAFQKAT

SEQ ID NO: 159934 - protein, 185 aa, Heterodera glycines
  Homolog annotation: Hit_ID=NP_497740.1; Match level="QueryCoverage =96%, HitCoverage=37%, E-value=5e-58, Identity=63%"; Hit description =glutathione reductase (51.5 kD) (3E741) [Caenorhabditis elegans] emb|CAB03763.1| Hypothetical protein C46
  Gene Ontology: Mol. function=thioredoxin reductase (NADPH) activity; Cellular component=cytosol; Biological process=response to oxidative stress
  Coding regions on vcDNA: vcDNA=SeqID_86357; Strand=+; Position=19-573
MTDESRLEDVYKLIWAIGRDPLTAELNLADVGVKLIFGDYIKVDDYQNTTKEGFYAVGDVCTPKFELTPVAIAAGRRLAHRLFNKEAENRLTYENIPTVVFSHPPLATTGLSEKEAVERFGRDQVKTYNAGFTNMYFAMTQHKEKTHMKIVCHGKDEKVIGLHILGMGADEMLQGFAVCVKAGLT

SEQ ID NO: 159935 - protein, 50 aa, Heterodera glycines; identical to SEQ ID NO: 158994
  Coding regions on vcDNA: vcDNA=SeqID_86358; Strand=+; Position=32-184

SEQ ID NO: 159936 - protein, 197 aa, Heterodera glycines
  misc_feature (139)..(139): Xaa can be any naturally occurring amino acid
  Homolog annotation: Hit_ID=AAP30769.1; Match level="QueryCoverage =98%, HitCoverage=100%, E-value=1e-104, Identity=99%"; Hit description=putative gland protein G16H02 [Heterodera glycines]
  Coding regions on vcDNA: vcDNA=SeqID_86359; Strand=+; Position=2-593
MSMLRPSVLPLGTSARPLVLSCVAIVASVGIVCAHSQSKGISGAPLNPSPSLLFVCGLSFATLFSVILAMFGLSWLRPIFLLPIICASGVVCVFHTLSVANWLSDWWISADQSLDLDWLIIFTSAITFQAISMLVFSLXKHLMIFKLLRPFTFKFAAIAFFDSQIQNIPLIVALIIASTAAESELFLKGGGKSFLFP

SEQ ID NO: 159937 - protein, 94 aa, Heterodera glycines
  Coding regions on vcDNA: vcDNA=SeqID_86360; Strand=+; Position=1-285
IENGSEPTERLHFSSFASQKFSLQNFQNCNIVEKLNIRNTKQFNIDIRVEEGNGLFTVTFDTGGKATKCQYRSPDMPTWAVQYITVRTELAQLS

SEQ ID NO: 159938 - protein, 50 aa, Heterodera glycines
  Coding regions on vcDNA: vcDNA=SeqID_86361; Strand=-; Position=2-151
QNINSNNSRRKRKKSENRPNNYLICLSLIRANLSEKSSPFPCTPLNGQLL

SEQ ID NO: 159939 - protein, 190 aa, Heterodera glycines
  Homolog annotation: Hit_ID=CAE57429.1; Match level="QueryCoverage =95%, HitCoverage=54%, E-value=7e-15, Identity=37%"; Hit description =Hypothetical protein CBG00388 [Caenorhabditis briggsae]
  Coding regions on vcDNA: vcDNA=SeqID_86362; Strand=+; Position=95-664
MTTTVEMSSGAATTASAAAVAGTAPSAGPMPSCICSSTSQLLTAAGMDGIPPAKTPANSGPDANFLADSLGVSPLYRQEDTKRWQTAAKVYQSSRSQMHSPTSGTCAPQHFHFGESLTAEGHLTQKIRQCRSSGSPISLEDIAAVNRQFHRQMDSGQRRRVNGPALNGSLELEAIAAVHELASQVKQISV

SEQ ID NO: 159940 - protein, 176 aa, Heterodera glycines
  Homolog annotation: Hit_ID=AAP30771.1; Match level="QueryCoverage =100%, HitCoverage=48%, E-value=9e-98, Identity=98%"; Hit description= putative gland protein G23G11 [Heterodera glycines]
  Coding regions on vcDNA: vcDNA=SeqID_86363; Strand=+; Position=201-728
MSDSEKVTTRNARPKVLDTRDDGKFTAKFIAPRSREPDSVFLHIFGSKKDPHLYLDVSEVQWGNVYIFDLNKTEVIAVRPRRVADELRKLEERDRPPVKREQPKPQPQPQAQPQPVTFQKILSGLVWPTTEKYTLLVSSRDFDLDGRGSPIKQRATNPDPTRAETNYKGTFDVKMA

SEQ ID NO: 159941 - protein, 211 aa, Heterodera glycines
  Homolog annotation: Hit_ID=NP_494846.1; Match level="QueryCoverage =99%, HitCoverage=46%, E-value=7e-41, Identity=42%"; Hit description =protective protein for beta-galactosidase precursor (53.6 kD) (2F29) [Caenorhabditis elegans] gb|AAC46812
  Coding regions on vcDNA: vcDNA=SeqID_86364; Strand=+; Position=2-637
HFCWRGGLNVYDIYENCTPHPNNLDIMRRGIFNAKSMHSNDSVLWRTDDAFENANQPKEEKVNYLLRCLNGQPLVDYLNKDQVRKALHIPPTVPSWTQCSRWVAMHYRNQYADMSHFVWKALWANVRVLLFYGDTDMACNFLLGQRFSEMLGLKRLGTNLWHFGGQIAGIKTEYGSGLTYITVRGAGHMVPQKRGSEIEYAIGQFPTNRTI

SEQ ID NO: 159942 - protein, 228 aa, Heterodera glycines
  misc_feature (78)..(78): Xaa can be any naturally occurring amino acid
  Homolog annotation: Hit_ID=CAE75396.1; Match level="QueryCoverage =99%, HitCoverage=42%, E-value=1e-47, Identity=42%"; Hit description =Hypothetical protein CBG23385 [Caenorhabditis briggsae]
  Gene Ontology: Biological process=reproduction
  Coding regions on vcDNA: vcDNA=SeqID_86365; Strand=+; Position=2-684
KSYCADIGHLIANRTFVWSTLAYTAVVFVTGTLSWGPTAMEHAKAMDEHLNDTSKLRPAEKNQIALIFGVITCVAGIXGVSLGSLIAQHWKTGKFCFAHHRSGRADPIVSAVGSFVAAPLMFVAFSLITTDQLLSWFVVFLTILCLCLNWAINVDMLMSIIVPERRSIASAIQILFSHLFGDASGPYLVGAISDFVRGSSDLPTDRFHSLIFAFYLPNALLFLSGAAF

SEQ ID NO: 159943 - protein, 162 aa, Heterodera glycines
  Homolog annotation: Hit_ID=NP_509283.1; Match level="QueryCoverage =98%, HitCoverage=44%, E-value=1e-43, Identity=52%"; Hit description =apyrase (40.3 kD) (XI186) [Caenorhabditis elegans] gb|AAA68725.2| Hypothetical protein F08C6.6 [Caenorhab
  Gene Ontology: Biological process=ribonucleoside diphosphate catabolism
  Coding regions on vcDNA: vcDNA=SeqID_86366; Strand=+; Position=2-490
NPMYVKVIHPYGEVLHVDWTKQYKALRGKIGIAFPGYMIHESGQWSDIHKKWFFLPRRASNDTYSETEDEHMGTNLLLIADEDFEHIQVRHIGPPGDGFRGFSAFRFLPNTEDDIIVAIKSEERGGKPIASYLFVFRLSDGHVLLDDQKFDGPYKFEGVVVY

SEQ ID NO: 159944 - protein, 201 aa, Heterodera glycines
  Homolog annotation: Hit_ID=CAE70680.1; Match level="QueryCoverage =99%, HitCoverage=45%, E-value=5e-84, Identity=72%"; Hit description =Hypothetical protein CBG17397 [Caenorhabditis briggsae]
  Gene Ontology: Mol. function=isocitrate dehydrogenase (NADP+) activity; Cellular component=mitochondrion; Biological process =carbohydrate metabolism
  Coding regions on vcDNA: vcDNA=SeqID_86367; Strand=+; Position=112-714
MKKIRVANPVVDLDGDEMTRIIWAGIKEKLILPYLDIDIKYYDLSIENRDATDDEVTVDAAEAIKKYNVGIKCATITADEARVKEFGLKKMWLSPNGTIRNILGGTVFREPIICKNIPRVVPGWKKEIVIGRHAFGDQYKATDIVVPKGSKFEINIIKSDGQVERHSVFNFADTGGIIMGMYNTDDSIRGFAHSCFQYALK

SEQ ID NO: 159945 - protein, 145 aa, Heterodera glycines
  Homolog annotation: Hit_ID=AAP30767.1; Match level="QueryCoverage =100%, HitCoverage=100%, E-value=5e-73, Identity=93%"; Hit description=putative gland protein G21E12 [Heterodera glycines]
  Gene Ontology: Mol. function=structural constituent of cytoskeleton
  Coding regions on vcDNA: vcDNA=SeqID_86368; Strand=+; Position=33-470
MATYLFIAAAAFGAGIYCWKAYLGPMLDQPISDDEEKPKPEGGEESTTAGDKEDIKAGSKGDKHKKKDKKGEGAAAAPAADKKEEKRKDKHRSKEAGKSDDSKAGKKDKHGKKDKKGKKKDTADASTVDEALGEQSTAETSQAEE

SEQ ID NO: 159946 - protein, 133 aa, Heterodera glycines
  Coding regions on vcDNA: vcDNA=SeqID_86369; Strand=-; Position=127-528
DHKERKGQAKNEEHSLDHSVPASFVLLLPIFFQCFVLLIRHLLLPIGRSLPLFYVFLLYLCHSFNVFAYNFPELGEIIRRTQKTFFNFTVIIRSIPWLPESICSITFSAGSFRMLLSHITSNDNSGKFDGQVQ

SEQ ID NO: 159947 - protein, 80 aa, Heterodera glycines; identical to SEQ ID NO: 159706
  Coding regions on vcDNA: vcDNA=SeqID_86370; Strand=+; Position=58-300

SEQ ID NO: 159948 - protein, 87 aa, Heterodera glycines
  Coding regions on vcDNA: vcDNA=SeqID_86371; Strand=-; Position=1-261
KIQWKMFLAADFVPSGKVSTYFMISSNLVLNDFPCWRSICLTRWRTSAGSCATSGGSGIWSMTFSGRVQMIESIRSIFCSALNDPSS

SEQ ID NO: 159949 - protein, 52 aa, Heterodera glycines; identical to SEQ ID NO: 159767
  Homolog annotation: Hit_ID=NP_501725.2; Match level="QueryCoverage =78%, HitCoverage=2%, E-value=5e-10, Identity=63%"; Hit description =putative protein, with 2 coiled coil-4 domains, of eukaryotic origin (4K462) [Caenorhabditis elegans] emb|
  Coding regions on vcDNA: vcDNA=SeqID_86372; Strand=+; Position=165-320

SEQ ID NO: 159950 - protein, 118 aa, Heterodera glycines; identical to SEQ ID NO: 159796
  Coding regions on vcDNA: vcDNA=SeqID_86373; Strand=+; Position=378-731

SEQ ID NO: 159951 - protein, 203 aa, Heterodera glycines
  Coding regions on vcDNA: vcDNA=SeqID_86374; Strand=+; Position=47-655
NALAEKVSETEAKLENGMRENQNALAKKVSETEAKLENGMRENQNALAEKVSETEAKLENGMRENQNALAKKVSETEAKLENGIQNNQKALSLMKNMATLAFFHFPLPIYHRWNASDCDPEIVINESTNAIQHNGTEDIDWRSCRAWPIQMSSAVGRIGIIYAEYRILAIIGGLRIGLSTKEMPLDRWVGNGHVSYGYAYYGE

SEQ ID NO: 159952 - protein, 219 aa, Heterodera glycines
  Homolog annotation: Hit_ID=NP_504592.2; Match level="QueryCoverage =94%, HitCoverage=36%, E-value=1e-105, Identity=88%"; Hit description= receptor Mediated Endocytosis RME-1, required for endocytic recycling (65.2 kD) (rme-1) [Caenorhabditis
  Gene Ontology: Mol. function=protein binding; Cellular component =endomembrane system; Biological process=receptor mediated endocytosis
  Coding regions on vcDNA: vcDNA=SeqID_86375; Strand=+; Position=1-657
RSCITWRILSVYEFHSPALDDPDFNAKPMILLVGQYSTGKTTFIRYLLEQNFPGIRIGPEPTTDRFIVVMYGEEEAVIPGNALVVDSTKQFRALTKFGNAFLNRFQCSMLKNEVLNGVTIIDTPGILSGEKQRIDRGYDFSGVLEWFAERVDRIILLFDAHKLDISDEFKRCIEALSGNEDKIRIVLNKSDMVDHQQLMRVYGALMWSLGKVFKTPEVA

SEQ ID NO: 159953 - protein, 141 aa, Heterodera glycines
  Homolog annotation: Hit_ID=CAE69876.1; Match level="QueryCoverage =89%, HitCoverage=27%, E-value=7e-25, Identity=51%"; Hit description =Hypothetical protein CBG16213 [Caenorhabditis briggsae]
  Coding regions on vcDNA: vcDNA=SeqID_86376; Strand=+; Position=3-428
LAVCCFGIVAGAVGGVYYYNHVRSSRIDDPFNEFTRYSPAGPTKDKLKKSGSPIFGQSGDDTLAYKAQLHHYQQQKQKILGTASGPVVDNVSDNEEDTDEMDHNYSVFECPGLAPTGDLEIQNPNFVGAEKSAAGETRRTE

SEQ ID NO: 159954 - protein, 105 aa, Heterodera glycines
  misc_feature (24)..(24): Xaa can be any naturally occurring amino acid
  Homolog annotation: Hit_ID=BAD11764.1; Match level="QueryCoverage =89%, HitCoverage=19%, E-value=3e-25, Identity=52%"; Hit description =mitochondria processing peptidase subunit beta [Brugia malayi]
  Gene Ontology: Mol. function=mitochondrial processing peptidase activity; Cellular component=mitochondrial processing peptidase complex; Biological process=mitochondrial processing
  Coding regions on vcDNA: vcDNA=SeqID_86377; Strand=+; Position=37-353
MKEWRQLCEEVDVDELERAKRSLXTNSLLMLDGSTPICDDVGRQLLCFDRRISTEELEEKINAITPYTIRIIGRRYFVNKPFAYVIIGKTSNWPNPMKIHKWLSW

SEQ ID NO: 159955 - protein, 127 aa, Heterodera glycines
  Homolog annotation: Hit_ID=CAE69178.1; Match level="QueryCoverage =68%, HitCoverage=18%, E-value=4e-23, Identity=52%"; Hit description =Hypothetical protein CBG15211 [Caenorhabditis briggsae]
  Coding regions on vcDNA: vcDNA=SeqID_86378; Strand=+; Position=277-657
FGKHFFAKWHFQETLELNSPFEAVSTVNGHQFMLQSSKGRNPYCETCLGTIWRLAQHWRRCKSCGYRTHEKYIDKVRRVCPSLALARTEFSLQFDLCPEKSLLEQNYQCAECFCPSDSTTTLKNCLG

SEQ ID NO: 159956 - protein, 225 aa, Heterodera glycines
  misc_feature (214)..(214): Xaa can be any naturally occurring amino acid
  Homolog annotation: Hit_ID=CAE68478.1; Match level="QueryCoverage =88%, HitCoverage=98%, E-value=3e-57, Identity=53%"; Hit description =Hypothetical protein CBG14278 [Caenorhabditis briggsae]
  Coding regions on vcDNA: vcDNA=SeqID_86379; Strand=+; Position=1-678
MLLSSSLFLCFPSPFAIPLAMSSLPIVRSQSTSYIGFPRARDFAIGDGHVPSLIIVTSVPNLNHLHVSDAYRSSTLYKYRRDWDLLDSAISDHSHRGPGFHWVDRRFRARRFMNTDPIPDSLGLDYPNFWSRYKWYSDYLEPRHWRRHRDPNYDRPLWNSWKPYILDGKNQKQAIDMYRQGLVSFAYLDKDWITPWALGRKEKDWADIYPPAGXYGSRRYMYSWA

SEQ ID NO: 159957 - protein, 183 aa, Heterodera glycines
  Homolog annotation: Hit_ID=CAE70160.1; Match level="QueryCoverage =68%, HitCoverage=70%, E-value=8e-37, Identity=58%"; Hit description =Hypothetical protein CBG16627 [Caenorhabditis briggsae]
  Gene Ontology: Mol. function=structural constituent of ribosome; Cellular component=mitochondrial small ribosomal subunit; Biological process=protein biosynthesis
  Coding regions on vcDNA: vcDNA=SeqID_86380; Strand=+; Position=2-553
LARINYFRAFSSTVSRSFKQVKHTVQDNVTTIELVDVPIASTHRELKESAATQSKTPDDCSCVLCKIPTSISYKDVLILEQFMRLDGTVFPRQLTGLCHDQQQRLERCVMQAHWSGLFPDRTIPEFDRAGYKRFNRHWDDDLAMFRLKYKLHPGSWFYIKRYNPRIREYRPFKADEIPDIERE

SEQ ID NO: 159958 - protein, 99 aa, Heterodera glycines
  Coding regions on vcDNA: vcDNA=SeqID_86381; Strand=+; Position=1-300
EKMRVLPLLFSALLLLSVGLCFAQFDQSPSAALNHVRAKRGYKPWKKQSFSSSSSEMYRRRRPSGNGHYRDYNGYGSNGYYRRKPGILERALGKITRSY

SEQ ID NO: 159959 - protein, 205 aa, Heterodera glycines
  Homolog annotation: Hit_ID=CAF96315.1; Match level="QueryCoverage =73%, HitCoverage=26%, E-value=2e-32, Identity=45%"; Hit description =unnamed protein product [Tetraodon nigroviridis]
  Gene Ontology: Mol. function=sodium dependent multivitamin transporter activity; Cellular component=integral to plasma membrane; Biological process=transport
  Coding regions on vcDNA: vcDNA=SeqID_86382; Strand=+; Position=2-616
CFLRWTLFCSACFCSFLCWSVFGQFAAFRPAVPRRFFVHKSGPTGDPSTLKHSSANDFLDGGRRLPVLPVCLSLLTTFVSGIGLLSTPAEIYSRGSAFALFNLCGSFAFALIGIFFLPIFFKLKCLNAYEYFELRFQSQSLRRLATLVFMANTLFYMAVVIYAPAISLSGVTSLRLWPFVLLVGVVSTIYTAAGGIRAVIWTDTL

SEQ ID NO: 159960 - protein, 190 aa, Heterodera glycines
  Homolog annotation: Hit_ID=CAE66658.1; Match level="QueryCoverage =95%, HitCoverage=49%, E-value=1e-19, Identity=30%"; Hit description =Hypothetical protein CBG11995 [Caenorhabditis briggsae]
  Coding regions on vcDNA: vcDNA=SeqID_86383; Strand=+; Position=3-572
IIGPNNIKLDDFTDRLCYRYTPVLLGLFMFITGTVDNFGSPIRCMVPQEFSASWSNFVHQYCYVTGTYVKIVDPSDQTVERIYVNYYQWVPYLLILQALIMRLPLSFWRFGRRISDADFDYVNELGLKARTSTAEKRTEFLTEAANYICQIVGSRKTHNGLGSLVGYMYLLYKMINVIVVFAQIYMLKIF

SEQ ID NO: 159961 - protein, 222 aa, Heterodera glycines
  misc_feature (208)..(208): Xaa can be any naturally occurring amino acid
  Homolog annotation: Hit_ID=AAM74954.1; Match level="QueryCoverage =99%, HitCoverage=84%, E-value=1e-124, Identity=97%"; Hit description= pectate lyase 2 [Heterodera glycines]
  Coding regions on vcDNA: vcDNA=SeqID_86384; Strand=+; Position=49-714
FFYSIGLTFVQIGQLSAGICKFPNPSKSVTVQSMMTVSSNTDYKNTLFVGGSGILNGACDVNNGKLKYLMTLKNGVTIKNAILDTPGLGIYCEGNCVLENIYYKRLCYHATGFGYKSTSTSYTYQVIGGAGQGSPDKYFTQSGKGTTIIKNFCAEGKYGKLWCSCGNCAFQTARTVQISNTVLKGPGLSVVSLNSNYGDKMSLSGLTXHGQKSSSTKTNYIC

SEQ ID NO: 159962 - protein, 72 aa, Heterodera glycines
  Homolog annotation: Hit_ID=NP_495750.1; Match level="QueryCoverage =100%, HitCoverage=13%, E-value=2e-17, Identity=61%"; Hit description= chaperonin Containing TCP-1 (58.4 kD) (cct-4) [Caenorhabditis elegans] emb|CAA88861.1| Hypothetical prot
  Gene Ontology: Mol. function=chaperone activity; Cellular component =cytoskeleton; Biological process=cell organization and biogenesis
  Coding regions on vcDNA: vcDNA=SeqID_86385; Strand=+; Position=3-221
AGLSPIETVTEMRSQLSMGNKEHGVNVRMGAITDIREENVVQPFLVSSFAVKQAAECVLRPLKIDDFVLSVR

SEQ ID NO: 159963 - protein, 217 aa, Heterodera glycines
  misc_feature (10)..(10): Xaa can be any naturally occurring amino acid
  misc_feature (41)..(41): Xaa can be any naturally occurring amino acid
  misc_feature (58)..(58): Xaa can be any naturally occurring amino acid
  Homolog annotation: Hit_ID=CAE62700.1; Match level="QueryCoverage =99%, HitCoverage=46%, E-value=2e-76, Identity=64%"; Hit description =Hypothetical protein CBG06849 [Caenorhabditis briggsae]
  Gene Ontology: Mol. function=glycine transporter activity; Cellular component=plasma membrane; Biological process=alanine transport
  Coding regions on vcDNA: vcDNA=SeqID_86386; Strand=+; Position=2-649
TDTVIFIGMXMYAFEGQTMILPIENKLATPEDFLDNFGVLXSTMCLCTFFMIAIGFFXVNGFGTIVRETITVNVPHTGLYSAVNGFLCIQSMLGHSIAMYVVFDMFYKGFRRKFTARFPNVPSLVVDKGFRVGWVFLTYLMAILIPRLAVMIPLVGVTSGTLCALVYPPFFQIVTFWSDWKLNMSPVRRAFLIGRNCFVIVLGFFAIGAGVAANVLQ

SEQ ID NO: 159964 - protein, 114 aa, Heterodera glycines
  Coding regions on vcDNA: vcDNA=SeqID_86387; Strand=-; Position=350-694
VADFEGELLLAIVVQCPTVLLVEGRLKPNIIKLKQSRIKIRVRRHFVLLVEGRMKHNIIQIKIRIRRHFVLLVEGRMKHNIIQIKIRIRRHFREMFKLFRQLLIHISQLGNFYS

SEQ ID NO: 159965 - protein, 119 aa, Heterodera glycines
  Coding regions on vcDNA: vcDNA=SeqID_86388; Strand=+; Position=226-582
MGASLKTNQDLSQLSSTRLPISKIAEKPPSADASDRYEDINTDVLNERFTDAETNKFVQRTIERAQIEAERTFLNQQILERRFAPGESLFGPVNKRAMGSAQPDRTVSGGIKRFINLPN

SEQ ID NO: 159966 - protein, 215 aa, Heterodera glycines
  misc_feature (21)..(21): Xaa can be any naturally occurring amino acid
  Homolog annotation: Hit_ID=NP_498989.1; Match level="QueryCoverage =100%, HitCoverage=47%, E-value=4e-85, Identity=68%"; Hit description= amino acid transporter family member (51.3 kD) (3K84) [Caenorhabditis elegans] emb|CAA77582.1| Hypotheti
  Gene Ontology: Mol. function=glycine transporter activity; Cellular component=plasma membrane; Biological process=alanine transport
  Coding regions on vcDNA: vcDNA=SeqID_86389; Strand=+; Position=1-644
PARRQGDVISPHRAVLTLSKXMFNAGCFSLPYAWMLGGKWVSLALTFVIAGFNWYGNHILVRSSQHLAKKSGVASLDYGHFAKRVCDYSELPFLRRHSKRIMYVVNITILFYQLGMCAVAILFIADNMVHMLGSWLGNSTTLMATIAIVFIIFTNMFTEMRVIGVFAAVSSVFLLLGAGVIMQFTLTQPSKWDELPAYTNFTDTVIFIGMSMYAF

SEQ ID NO: 159967 - protein, 159 aa, Heterodera glycines
  Coding regions on vcDNA: vcDNA=SeqID_86390; Strand=+; Position=3-482
VLLTLDRTHCWASTHQMVATPTVDGQPKELYCSDHVWGFKFDWIKTFKEEFLRSTTPASYYILLHLCSMPEKPFELVNDQTQEKLSLAKIEGNVLISYWLLKRWPIAGGETAQRKDENGNKLNNVRLLIRGINCIGPLSPSTADQSNGNAVPSGAGSSE

SEQ ID NO: 159968 - protein, 97 aa, Heterodera glycines
  Coding regions on vcDNA: vcDNA=SeqID_86391; Strand=-; Position=9-302
YSYTIKCCHLACLFIQDALSKCRSNHRLSCNNCPEQCSSHRICAPPPQNCSWSSAPAVPFLRHLPCTVPTHCTFEYGSESGCEYRNHGPSSVTTAAV

SEQ ID NO: 159969 - protein, 92 aa, Heterodera glycines
  misc_feature (18)..(18): Xaa can be any naturally occurring amino acid
  Homolog annotation: Hit_ID=CAE57411.1; Match level="QueryCoverage =100%, HitCoverage=11%, E-value=6e-18, Identity=46%"; Hit description= Hypothetical protein CBG00366 [Caenorhabditis briggsae]
  Coding regions on vcDNA: vcDNA=SeqID_86392; Strand=+; Position=3-277
LCQALGFSSTAHHRISSXMAGSPQTVRVFVDELSRRFRPVFFSRLEGAWKTYAEEQEERVISDLEAFDLFYICRKEAEHNQNVDSLELMKHF

SEQ ID NO: 159970 - protein, 90 aa, Heterodera glycines
  Coding regions on vcDNA: vcDNA=SeqID_86393; Strand=-; Position=3-275
SLSMLSGGGGFFRMTVYSFCLWIHNKRVCRSITLSIDHLSYCGIITSSRLSQIVHNLQFFNLAVSNVQGLVGIVFPIVDIRVILEVIVSV

SEQ ID NO: 159971 - protein, 199 aa, Heterodera glycines
  Coding regions on vcDNA: vcDNA=SeqID_86394; Strand=-; Position=3-599
PFLRELVNAVEKPAKNDQTEQYQQRSEHAVKKEKGEKTQVIGGKCRQIAFDARSNRCHAGRKTELGALEEHGPRLISLTEFGQQSLGTGRGGRHRLIGAIGGGGRRIGGRAEKGSRREPRGLLLLLLLSLRMTILRRRVHLGSGRIGRKRWIKRLMRDGRGTIAGGGESISFSPSLPFANYDHIVVFLVIFLACLRLFH

SEQ ID NO: 159972 - protein, 207 aa, Heterodera glycines
  misc_feature (9)..(9): Xaa can be any naturally occurring amino acid
  Homolog annotation: Hit_ID=NP_647640.1; Match level="QueryCoverage =98%, HitCoverage=58%, E-value=3e-32, Identity=40%"; Hit description =CG7967-PA [Drosophila melanogaster] gb|AAF47540.1| CG7967-PA [Drosophila melanogaster] gb|AAM11307.1| RH7
  Coding regions on vcDNA: vcDNA=SeqID_86395; Strand=+; Position=35-654
IRTRDVVIXYWCLLKALEDGMKLSGNEPNTNKFLLDLMTVLENVKQSHKENDAIMQEIVGQSHIEDQAQRLFQFAYGLDQQSQFGQKLIKAFYTAGYWCDVLTCFGQLDDNIQSARKYAKWRAIDVHNCLKNGEQPKPATNPTVQHQKELSDQDDIAAQINDKLSGELNDLNAYLTKSPQAAAVPQQQCFNPMLTHPSQQRQIPSNY

SEQ ID NO: 159973 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_86396; Strand=+; Position=18-434
MPNIFKILLIVLLAVVSFRLSASTGDKKTANDGSGNNSSAGIGTKIKRIVTAGLLLTSLATGGAEAIGRSNAQGGNAAGLVPSHVTNRSMAPPPPPVQFEMGANRLEKMRAHLRELAEKMPVNESKRLSPSGPDPHHH

SEQ ID NO: 159974 - protein, 55 aa, Heterodera glycines
  Coding regions on vcDNA: vcDNA=SeqID_86397; Strand=-; Position=119-286
GPLFSQVPAPALCSVPRVLYQQYSSVAEIPQSLIHRVMSKVQHSCRMVQWTIIKK

SEQ ID NO: 159975 - protein, 197 aa, Heterodera glycines
  Homolog annotation: Hit_ID=NP_510233.1; Match level="QueryCoverage =97%, HitCoverage=37%, E-value=5e-48, Identity=49%"; Hit description =cytochrome P450 family member (58.3 kD) (XO26) [Caenorhabditis elegans] emb|CAB54200.1| Hypothetical prot
  Gene Ontology: Mol. function=oxidoreductase activity; Biological process=epoxygenase P450 pathway
  Coding regions on vcDNA: vcDNA=SeqID_86398; Strand=+; Position=120-710
MQLLLFLLAGFDTTANSLGFVSYYLACHPDVQLRAQEEIDTVCSSENPTYEELSQLKYMEAVIKETLRLVPVAATVVTRVCSQTTTLGQILVEKGTGVTIDLYTFHRNKELWGDDADEFRPERWLDIDPPPASAYYYAFGGGPRICIGMRFALLEEKMALARLLRRYPLAKNEQTEKFLKVNSQVVLNPGAVMVQLN

SEQ ID NO: 159976 - protein, 211 aa, Heterodera glycines
  Coding regions on vcDNA: vcDNA=SeqID_86399; Strand=-; Position=11-646
VRRTMCSTGCSMLRQCSTASAAEMPSPTTTTGQSPDTYSVSAVAAIVARAIVVAVASVAGAIVVAVSVAPESPPSVSSNRCFNELRLYTTRPSAAAADSPGTPNSLGCCRPHANTTCLQRSVKVRCSAVFGTVSVPCSSQWHVPTKEGWQIFFPLLLCDEKMTFISQKTMNECEKNGRQMNDWGRERDRRESKKREKRERERTKERRRNAR

SEQ ID NO: 159977 - protein, 205 aa, Heterodera glycines
  Homolog annotation: Hit_ID=CAE65688.1; Match level="QueryCoverage =79%, HitCoverage=38%, E-value=2e-16, Identity=29%"; Hit description =Hypothetical protein CBG10763 [Caenorhabditis briggsae]
  Coding regions on vcDNA: vcDNA=SeqID_86400; Strand=+; Position=1-618
TTHRGTAAAADVCPTEQLSKCIVLVDYAKQRQEWTFNKVSQLSTSVVELRNKIETEATRTRKNPGEVLLKIIRFYSSKLNVQMSKLRDRSSELLSSSMQKQILTLTAYVQQLDDSFVKAKDIDEVKQEVLEEAKQKLFDIARWSASLSLRGPPKTSTADDVENENLSSNIETEPKQEETKGEEEETLQQSMKEDEEEKGEEDDDE

SEQ ID NO: 159978 - protein, 92 aa, Heterodera glycines
  Coding regions on vcDNA: vcDNA=SeqID_86401; Strand=+; Position=2-280
RRPRRKARRRRRLMCPRLKQKGKSRTHRWKGRKRRKAAERRQMLYLFLAQLCTNPSPFPHFAIPRLSNFFWLLAFAFRVILPMNSPCLFFRQ

SEQ ID NO: 159979 - protein, 66 aa, Heterodera glycines
  Coding regions on vcDNA: vcDNA=SeqID_86402; Strand=+; Position=325-525
FLMTNSMPKILFTIIAFVNISQILFATAMYKGKEICGKTVEECQAALIAFMKDSGSNQNYHASGNT

SEQ ID NO: 159980 - protein, 83 aa, Heterodera glycines
  Homolog annotation: Hit_ID=NP_496970.1; Match level="QueryCoverage =96%, HitCoverage=82%, E-value=4e-24, Identity=65%"; Hit description =high Mobility Group protein (10.6 kD) (hmg-1.1) [Caenorhabditis elegans] emb|CAB54448.2| Hypothetical pro
  Gene Ontology: Mol. function=DNA binding; Cellular component=nucleus; Biological process=regulation of transcription, DNA-dependent
  Coding regions on vcDNA: vcDNA=SeqID_86403; Strand=+; Position=37-288
MPKASKNKDPNMPKRAQSAYFIWMLANREKIKKPGMSVAEVAKAAGVEWGRMSAADKTLWEQKAADDKKRYEQEMTQYRARQK

SEQ ID NO: 159981 - protein, 180 aa, Heterodera glycines
  misc_feature (132)..(132): Xaa can be any naturally occurring amino acid
  Homolog annotation: Hit_ID=AAC95573.1; Match level="QueryCoverage =95%, HitCoverage=46%, E-value=6e-29, Identity=33%"; Hit description =orf 48 [Ateline herpesvirus 3] pir||T42963 hypothetical protein 48 - ateline herpesvirus 3 (strain 73) ref
  Gene Ontology: Biological process=N-linked glycosylation
  Coding regions on vcDNA: vcDNA=SeqID_86404; Strand=+; Position=1-544
SGKENEKQLEEEEKEKQREEEEKKQEEKETQQKEEEKKQNEEEKMHEEKEVEEIIMLDSNDDEAMEKEGEEKEKQLEDKEKPEEAQGEQEEEKEKQLGEKEMQIDELIVLDSDDEEKEKQGEEKEETQRKKXEDKERQEEEKETQGEENEKQAEDKETQGEEKEKREEEKEKLLQKKYKK

SEQ ID NO: 159982 - protein, 211 aa, Heterodera glycines
  misc_feature (67)..(67): Xaa can be any naturally occurring amino acid
  misc_feature (176)..(176): Xaa can be any naturally occurring amino acid
  Homolog annotation: Hit_ID=EAL32167.1; Match level="QueryCoverage =98%, HitCoverage=50%, E-value=6e-53, Identity=50%"; Hit description =GA22116-PA [Drosophila pseudoobscura]
  Coding regions on vcDNA: vcDNA=SeqID_86405; Strand=+; Position=37-670
MHSSRNVFAYFVSSDTSQPAIQHFHRVASTLRDNCTFWLGSGEWVRSVVGNESAIFFRDPHVDDDPXYNGPLDNLDSVKKWLTDKCVPLVREITFDNAEELTEEGIPFLILFRIPGDLQAERTFTDIVTTELEGQKNAANFLMADGKKFAHPLHHLGKSERDLPLIAIDCFRHMYXFPDMKQFGVKRHLPQFVLDMHSGKLHREFHQWPDP

SEQ ID NO: 159983 - protein, 235 aa, Heterodera glycines
  Homolog annotation: Hit_ID=CAE67560.1; Match level="QueryCoverage =98%, HitCoverage=43%, E-value=5e-74, Identity=59%"; Hit description =Hypothetical protein CBG13087 [Caenorhabditis briggsae]
  Gene Ontology: Mol. function=extracellular ligand-gated ion channel activity; Cellular component=integral to membrane; Biological process=synaptic transmission
  Coding regions on vcDNA: vcDNA=SeqID_86406; Strand=+; Position=40-744
QIPPIFVTLSFVLFVFLLFEFSSEAVTRKRKIPCKKTAFNRRTTNYQAWKEQITVCELLENYDPAVRPLGQEPTLEKRGPVVVTTSLFVNSISAVSERNMEYVVQFRFQQEWLDDRLAYSRLGDERSFAHLFVARDQTIWIPDSFFQNERSGHYHMLDQENRFVKIRADGRVTYNRRLTLTLACNMNLLRYPMDVQSCLIDFASYAYTTNDIIYKWDQVGVEIAPTANGALPNFE

SEQ ID NO: 159984 - protein, 106 aa, Heterodera glycines
  Coding regions on vcDNA: vcDNA=SeqID_86407; Strand=+; Position=2-322
WHSVFTSLSLGLCSALVWMTKFAYGLFLPLAMDFLGISATFLLLLLFTPLSTIFVWLFLPETRDKTLEEMEKQFREEDWAALKRKGRKRSKETRERIEDGESGERS

SEQ ID NO: 159985 - protein, 142 aa, Heterodera glycines
  Homolog annotation: Hit_ID=AAP30770.1; Match level="QueryCoverage =100%, HitCoverage=53%, E-value=2e-78, Identity=100%"; Hit description=putative gland protein G17G01 [Heterodera glycines]
  Coding regions on vcDNA: vcDNA=SeqID_86408; Strand=+; Position=224-649
MEKIVYLKLLQFVLTLTIIWQLRSLHQFCGTFADPKAFLHDISIGHCKNFTLIGKDSKSGEFSALFDQDKWHNQLIMMSSTNGQLIEEQQHQFMDELATKLPSAGRICIPITISPFDWIFYRIANDRILIDNDILYFSSVQL

SEQ ID NO: 159986 - protein, 86 aa, Heterodera glycines
  Homolog annotation: Hit_ID=CAE73548.1; Match level="QueryCoverage =100%, HitCoverage=35%, E-value=7e-27, Identity=71%"; Hit description= Hypothetical protein CBG21017 [Caenorhabditis briggsae]
  Gene Ontology: Mol. function=triose-phosphate isomerase activity; Cellular component=cytosol; Biological process=glycolysis
  Coding regions on vcDNA: vcDNA=SeqID_86409; Strand=+; Position=2-262
IAYEHVWAIGPEKPPPRKAQEVHGWIRKFLSEKVSQEIAEKTRIIYGGSVTAENCKDLAAKQDIDGFLVGGASLKPDFVNIINAKS

SEQ ID NO: 159987 - protein, 77 aa, Heterodera glycines
  Coding regions on vcDNA: vcDNA=SeqID_86410; Strand=+; Position=81-311
HNCRVGLAFGNGRKGINKHLNTGQKCHEENRENGKPKAYKCTGADNLDEEETEEQNTPKERRVAKTSVGKRMVLKQR

SEQ ID NO: 159988 - protein, 100 aa, Heterodera glycines; identical to SEQ ID NO: 158768
  Homolog annotation: Hit_ID=AAO85455.1; Match level="QueryCoverage =100%, HitCoverage=100%, E-value=7e-57, Identity=100%"; Hit description=putative gland protein G17G06 [Heterodera glycines]
  Coding regions on vcDNA: vcDNA=SeqID_86411; Strand=+; Position=18-320

SEQ ID NO: 159989 - protein, 159 aa, Heterodera glycines
  Homolog annotation: Hit_ID=AAH72279.1; Match level="QueryCoverage =76%, HitCoverage=22%, E-value=2e-12, Identity=37%"; Hit description =MGC82415 protein [Xenopus laevis]
  Gene Ontology: Mol. function=calcium-dependent phospholipid binding; Biological process=vesicle-mediated transport
  Coding regions on vcDNA: vcDNA=SeqID_86412; Strand=+; Position=3-482
YVRGVSDALNSYRKMAMSVLPYAPTEYAQVIHHVVKFAKASEKAQTGHFFLLVILTNGVIKDHRDTVDTIVEASSLPIAIAFIAVSNAHHPSQLAALRQQFAVHTLKSSRNVPLARETVTAVSCADPSMAYHFLMAVQRQLILHLLRAATDADAITASG

SEQ ID NO: 159990 - protein, 166 aa, Heterodera glycines
  Homolog annotation: Hit_ID=NP_503408.1; Match level="QueryCoverage =71%, HitCoverage=83%, E-value=7e-17, Identity=38%"; Hit description =putative secreted or extracellular protein precursor (5B870) [Caenorhabditis elegans] gb|AAF60880.2| Hypo
  Coding regions on vcDNA: vcDNA=SeqID_86413; Strand=+; Position=33-530
MYMNSMGSRGASSAAVVASAAALCLFSAMAVVVYGAESAGPKADQTLAAKQFNPSAFPAMPPELEKILPADVVQKLKAVHADMSLNIMQKQDKIDRIMSSLPGEVLDQIPAPPGFERLPDDVKNRLKQINRQTNKSWADKQKELQEYVKTLPHEQRAILMMGPMGG

SEQ ID NO: 159991 - protein, 150 aa, Heterodera glycines
  misc_feature (58)..(58): Xaa can be any naturally occurring amino acid
  misc_feature (72)..(72): Xaa can be any naturally occurring amino acid
  Homolog annotation: Hit_ID=AAN32890.1; Match level="QueryCoverage =100%, HitCoverage=90%, E-value=4e-72, Identity=91%"; Hit description= secretory protein 4D09 [Heterodera glycines]
  Coding regions on vcDNA: vcDNA=SeqID_86414; Strand=+; Position=14-465
MAKFVAIALLSLTVVPMALAKTGKSQTADEVEGFRNMNIGDNNKVDAGKDPAGDKATXKGKAQKAGTKSDGXTNEPAAAKGTKNGKSPKTKAKQEVATNDPAAANEWNDQLMGMIVEKFSEELAVLLPKANTFMENALSFINEQMEKNGI

SEQ ID NO: 159992 - protein, 219 aa, Heterodera glycines
  misc_feature (58)..(58): Xaa can be any naturally occurring amino acid
  Homolog annotation: Hit_ID=AAP30764.1; Match level="QueryCoverage =100%, HitCoverage=50%, E-value=1e-113, Identity=93%"; Hit description=putative gland protein G28B03 [Heterodera glycines]
  Coding regions on vcDNA: vcDNA=SeqID_86415; Strand=+; Position=2-658
NILLKSVLFLSLLSLFGDCMKNSDQIGVKRKSAGIRIEEPFVVKGKGKVVETSRKGSXIVGEKIFVMNTAERIKKMDIAQDKAKMDIDANGKPKQNEENAPPKYVFIWSSNNEKKNLEVDLRVIRHSKKLSELFHAKSDQSVNAKHGKQEALPVPKQEAEKILKEVEEWYAHHKNDKHKNAPVFVFKCKDNVSLVINVHLDAVRLSKELSNMLEDTADE

SEQ ID NO: 159993 - protein, 216 aa, Heterodera glycines
  Homolog annotation: Hit_ID=CAE71877.1; Match level="QueryCoverage =99%, HitCoverage=43%, E-value=8e-72, Identity=58%"; Hit description =Hypothetical protein CBG18932 [Caenorhabditis briggsae]
  Gene Ontology: Mol. function=aldehyde dehydrogenase activity; Cellular component=cytoplasm; Biological process=acetaldehyde metabolism
  Coding regions on vcDNA: vcDNA=SeqID_86416; Strand=+; Position=2-649
PARRLAWGKWLNCGQTCLAPDYVMVTNEMKPRLVEELKAVLVEYYGTNPETSKDYSRVINEAHFDRICALLKNSVGIEICKMGQPNREDLFIPPTILEVQTDDALMQSEIFGPILPFLIVRSFDEAIDIIKRGEKPLAAYLFTRDERKVNRWVAETHSGSVCVNDVMLQITVDTLPFGGVGESGMGSYRGKFGFDEFIHQKAVLKRCFFGDGIAAG

SEQ ID NO: 159994 - protein, 136 aa, Heterodera glycines
  Homolog annotation: Hit_ID=CAE71449.1; Match level="QueryCoverage =67%, HitCoverage=23%, E-value=2e-30, Identity=66%"; Hit description =Hypothetical protein CBG18361 [Caenorhabditis briggsae]
  Gene Ontology: Biological process=tyrosine catabolism
  Coding regions on vcDNA: vcDNA=SeqID_86417; Strand=+; Position=2-409
RRIPRHSPFGSLFALPHFFRLAKWTSPSTNGTVSAAPSSSARILCFDHIRFWVGNAKHAAHWYCVNFSFIPFAYTGLETGSRKTAAYAVKQDKVVFVFESALLPNNGEMIAHLAKHGDGVKDVAPEVDNSDWVLDT

SEQ ID NO: 159995 - protein, 205 aa, Heterodera glycines
  misc_feature (192)..(192): Xaa can be any naturally occurring amino acid
  Homolog annotation: Hit_ID=CAE59703.1; Match level="QueryCoverage =85%, HitCoverage=33%, E-value=2e-67, Identity=70%"; Hit description =Hypothetical protein CBG03134 [Caenorhabditis briggsae]
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_86418; Strand=+; Position=11-681
YAFTHFSVHKLNIVGKTVVPFFGSVVHCPSWSVRFVSTVPNWIHGQRVESKTKEWIELTNPATNEVVGLVPESTLDEMQLAVDSCKKAFRSWRNSSVVTRQQCMFKLQELIKRDMKKLAENVTKEQGKTLSDAEGDVFRGLQVVEFACNAASLLLGEHLPNIAKDMETYSLRLPLGVTAGICPFNFPAMIPXWMFPLALVSGNTM

SEQ ID NO: 159996 - protein, 188 aa, Heterodera glycines
  Coding regions on vcDNA: vcDNA=SeqID_86419; Strand=+; Position=27-593
IRKTQDKKCTKSGERKWKFGVNKSGSERLMKKTKRRSGKISEMATIETDKMSEMGTNRNGQNERNGDNQNGQSGRRNDGIDQRQTDDHAGEDPPLDALVHSAQMLQKAIFPFLEMKYLAQKRRRGDTPADGGLLNRVQTERKPQQSYRRRSLPHRSTSNHLQTVANKTLSPHAFELPKSDRGNLQHLD

SEQ ID NO: 159997 - protein, 245 aa, Heterodera glycines
  Coding regions on vcDNA: vcDNA=SeqID_86420; Strand=+; Position=3-737
TLSSSDVGGGNRSSNSKHSSADNTNRGKKAAKVVVNKRREVKEFVLVGGGGDVKEAAVAAGTVTLPEGAAGVGRVDDPRRENSNRMVAACVATPSVTVTATAATYFNNQTGFAGTLGGGGGSKKGMEANSNPSKASKGVTMTTAEVDQLMQQLQSVVENGDLPTWTLAFRTGECTTFPNRTDSCFLSQVNGTKSLPEETRKFIPDPSFINLFAFLLGCFMTHRTPIIIPLLFASSNQSVGLLITN

SEQ ID NO: 159998 - protein, 197 aa, Heterodera glycines
  Coding regions on vcDNA: vcDNA=SeqID_86421; Strand=+; Position=3-593
CLDCSKPACLVAHNGLNFDFRILCHELRKSDLFRTHPIPEQVYFLDTLSCFYELEKEYNREIELTMENVDWTLVLSQFQPNSETVVATAEIEETVQQNGTASEGTQNSNGHKSTTVLHRLTVLQETPTKKPELISVAKTTAKRSLFDEDVHPIQFMRKTHWSPAKRRCIDAKFFESNNRGEWNFNGNHARRLLCGRG

SEQ ID NO: 159999 - protein, 90 aa, Heterodera glycines
  Homolog annotation: Hit_ID=CAE60765.1; Match level="QueryCoverage =86%, HitCoverage=17%, E-value=2e-18, Identity=62%"; Hit description =Hypothetical protein CBG04453 [Caenorhabditis briggsae]
  Coding regions on vcDNA: vcDNA=SeqID_86422; Strand=+; Position=1-273
SPPSYFKGDMNYRKLVGDRAWPHQTPFSEALCGFCPTTLLALRTLKAETVAGVPLESLRKIKEKFGEKDLSWMSSSEYAVAQLCERRNGP

SEQ ID NO: 160000 - protein, 142 aa, Heterodera glycines
  Homolog annotation: Hit_ID=NP_496147.1; Match level="QueryCoverage =92%, HitCoverage=14%, E-value=4e-11, Identity=36%"; Hit description =phospholipase protein (93.6 kD) (2K235C) [Caenorhabditis elegans] emb|CAA88206.1| Hypothetical protein C0
  Coding regions on vcDNA: vcDNA=SeqID_86423; Strand=+; Position=113-538
MPGCNNGVTTAQQNTKRSPIVPLPDNFCTFGLDGVSKKVIERLREMNLLQPKALQLNDDEFASAEVILSQADFAINECQIVALEKGILWSPETIVPALDLFRIALLHPKLNEIFCSLESVLGNPPKGVPTVRRLVELLNLAH

SEQ ID NO: 160001 - protein, 199 aa, Heterodera glycines
  misc_feature (91)..(91): Xaa can be any naturally occurring amino acid
  Homolog annotation: Hit_ID=AAC98796.1; Match level="QueryCoverage =94%, HitCoverage=79%, E-value=1e-76, Identity=72%"; Hit description =dolichol monophosphate mannose synthase [Caenorhabditis briggsae]
  Gene Ontology: Mol. function=dolichyl-phosphate beta-D -mannosyltransferase activity; Cellular component=nuclear envelope -endoplasmic reticulum network; Biological process=protein amino acid glycosylation
  Coding regions on vcDNA: vcDNA=SeqID_86424; Strand=+; Position=19-614
DNGRKQQNTFLTPKFSILLPTYNEAENLPICLWLIIKYLKGLSYEVIIIDDNSPDGTQEVAKSLQKEFGAGRIKLLTRECKLGLGSAYVFXGEFVILMDADLSHHPRHIPEMVTLQEKHGYDIVTGTRYAMGGGVSGWDFRRKMISRGANFLAQFLLQPGVSDLTGSFRLYRKSVLSKLVVESVSKGYVFQMEMMFRAK

SEQ ID NO: 160002 - protein, 214 aa, Heterodera glycines
  misc_feature (147)..(147): Xaa can be any naturally occurring amino acid
  Homolog annotation: Hit_ID=NP_504988.1; Match level="QueryCoverage =100%, HitCoverage=35%, E-value=1e-23, Identity=31%"; Hit description= cytochrome p450 2C33v4 family member (5I160) [Caenorhabditis elegans] gb|AAA98571.1| Hypothetical protei
  Gene Ontology: Mol. function=cytochrome P450 activity; Cellular component=extracellular space; Biological process=electron transport
  Coding regions on vcDNA: vcDNA=SeqID_86425; Strand=+; Position=2-643
QFFDNEIERRVELRKSADGYSGDGTFLDILDQFIDQMEEKRRKSKAKAFLKLKYLSTLCYDIFLAGQETTSNTLNFLILFMLLDQKSQQKLHAELDSLANDKNEQTAPEGRGTVFRMEDRLRLPYTHAVVNVKGAREQRQINETINXLTIGKESLRLSNLLPLNLHKVLQTDVEIGGHKLKKGTAVVNQIATVLFDDKIFPDHEKFMPSRFLEE

SEQ ID NO: 160003 - protein, 169 aa, Heterodera glycines
  misc_feature (21)..(21): Xaa can be any naturally occurring amino acid
  misc_feature (37)..(37): Xaa can be any naturally occurring amino acid
  Homolog annotation: Hit_ID=NP_871817.1; Match level="QueryCoverage =83%, HitCoverage=35%, E-value=4e-38, Identity=54%"; Hit description =oxysterol-binding protein (1G409) [Caenorhabditis elegans] gb|AAN84853.1| Oxysterol binding protein (osbp
  Gene Ontology: Mol. function=oxysterol binding; Cellular component =cytosol; Biological process=Golgi to plasma membrane transport
  Coding regions on vcDNA: vcDNA=SeqID_86426; Strand=+; Position=2-509
AGKVELRCEKTGYRAEIDFLXQPFFRGKAHQIHGQIXYTSRKTALMQLKGEWNGEIYLKRDGATDYQLFTDVRQKPDVRKECVPVREQEDRESRKLWRHVTAALFINNIEIASQSKRCIEQRQRDEKVGRERLGHHWQPRFFVRIGDGSPSDSWRYCDALEQRTTTDGP

SEQ ID NO: 160004 - protein, 129 aa, Heterodera glycines
  Coding regions on vcDNA: vcDNA=SeqID_86427; Strand=+; Position=49-438
MNQTVPISGSFGVDDHQKTAKNIYPSLELLEKEPRGGTLMGCVDGEEVCTAGLPYPGYQKPKGQKHSRHCEWKHKNLVIQSLVEQLVGMGFDNCNGWLFRVAEKEGAELDRIFVAIDEDTMYRARISLQ

SEQ ID NO: 160005 - protein, 137 aa, Heterodera glycines
  Coding regions on vcDNA: vcDNA=SeqID_86428; Strand=-; Position=3-413
FTVNSKFQEANFTFYQKSDLTFASCCADLDRYDFHLFNVHDAATNRASKNDEDLDTTMVFDDQNPKGPSPSGTKRENEAHFEVDDEENVVIDPHEYNIRFFDDDDDGAAQIPSDEGEGLEMSDQPKGNEAPINRYAR

SEQ ID NO: 160006 - protein, 166 aa, Heterodera glycines
  Homolog annotation: Hit_ID=AAL78214.1; Match level="QueryCoverage =95%, HitCoverage=81%, E-value=3e-80, Identity=88%"; Hit description =putative esophageal gland cell protein Hgg-20 [Heterodera glycines]
  Coding regions on vcDNA: vcDNA=SeqID_86429; Strand=+; Position=136-633
MGQINLCDDVWLDTLAWINRGEVGMKFALVNARFNTLVDRHFEQRKWCFGEFHICERMTEESGAEIMTSIDGSDFSTLPLPTTPLPDSVVGFQSISIWYINEEVINFLCTIRRLLAEDIALEFSTYFTEYRSWKVMARHIWPLLRDGISTLFLKKCDLAMLRKHVS

SEQ ID NO: 160007 - protein, 153 aa, Heterodera glycines
  Coding regions on vcDNA: vcDNA=SeqID_86430; Strand=+; Position=70-531
PCGAGGGGGGQFLVGERGRSRVGPMNQQKRYLREDIGMSEEMPDFVLVMSFLFCLFVLPFQMFCFYTIVVFVAIFGFSQLFKVAFSPSIVFLELFVGLFKFFHGFFLRFVCPLFFPLLLWLFLSHCFVSGGFVWTPFHSLYECPPPPIKVRFL

SEQ ID NO: 160008 - protein, 241 aa, Heterodera glycines
  Homolog annotation: Hit_ID=CAE64089.1; Match level="QueryCoverage =95%, HitCoverage=44%, E-value=5e-35, Identity=36%"; Hit description =Hypothetical protein CBG08694 [Caenorhabditis briggsae]
  Gene Ontology: Cellular component=membrane fraction; Biological process=metabolism
  Coding regions on vcDNA: vcDNA=SeqID_86431; Strand=+; Position=2-724
GVSLILDISRSGTVLFSFGTVANTRTLGESLRRTLLHTFSQFPDYEFIWKLDAESAANESELIKATPNVHTFEWVPQNAILRHPKLRAFVTHCGQNSLAEAAKIGVPIVGIPLFGDQLYNAVLAKHRGMAVHVGIRQLIADKTGKVLRTALSRVLHDASFRANAKLIQKKIALSPFGAKEQLVRWVEFAAEFPHLNELNMPTDAELGWVAYYSIDAILFTISAVFLAILALFFDAADGISS

SEQ ID NO: 160009 - protein, 112 aa, Heterodera glycines
  misc_feature (42)..(42): Xaa can be any naturally occurring amino acid
  Coding regions on vcDNA: vcDNA=SeqID_86432; Strand=+; Position=209-546
KRKRKAQAPAQKQHHQRRKAPLHKKKDRLKQRQGKRPMKRQXTTKKKEKSSKSAKGKPTSNPKPERTEPSVKEDSKPVAAEKGVEVPHSMMSKGDSVVDEEDEVGYTTTTDV

SEQ ID NO: 160010 - protein, 187 aa, Heterodera glycines
  Homolog annotation: Hit_ID=AAS58484.1; Match level="QueryCoverage =92%, HitCoverage=17%, E-value=4e-12, Identity=30%"; Hit description =SNF2P [Triticum monococcum]
  Coding regions on vcDNA: vcDNA=SeqID_86433; Strand=+; Position=1-564
QALILHAVGDRGNFGTGGIFSALRRLSSAIPNCYEYAHRMRDLNRGDVHLVENIAVQSVPEPFKQLDNINNIKNENEPELKAKKGSNNASRTLSVALMVVQTHRTKKTNVGTQLEALEQCLLRIRLFARRFACSVHLLRIWFDLDEIEERQVRELLDQHLCAHGINVYIYKLRRSEGKSAAAEKMEN

SEQ ID NO: 160011 - protein, 211 aa, Heterodera glycines
  misc_feature (1)..(1): Xaa can be any naturally occurring amino acid
  Homolog annotation: Hit_ID=AAM18623.1; Match level="QueryCoverage =99%, HitCoverage=81%, E-value=1e-123, Identity=80%"; Hit description= C-type lectin domain protein [Heterodera glycines]
  Coding regions on vcDNA: vcDNA=SeqID_86434; Strand=+; Position=1-633
XLEWDEKKLKNASWADMTPMDYLSPMEWGTKKRPVYVDNSNGGEYNKENENCVFIGQWPREGKQYLKLDSAVDKYGLDVLWRDEVCEKPGEDCPRGAVCKKRATVGECYGTGAYLLDAADEEEMKKLLKFITVGSGTFVYAEKNTYMVLLLKDLYGKQMKEEDRKKVCAYYKAEYVTVKAEPNKVQEYVDKVLSKQKQMYADASDHMLCKF

SEQ ID NO: 160012 - protein, 231 aa, Heterodera glycines
  Coding regions on vcDNA: vcDNA=SeqID_86435; Strand=+; Position=2-694
TCLLGILLLDICCVAEEYSIELRVKPSLGRKQPHFYYAEVKCSSEEAFVPINAFFEHSPDDGYDLANFNVGNKKCPGGFQIGIAMFNGSYPEDFGWYTWGAKKPLLLKGIKFKENSFAMVQNVEFANHFKLDISPKLADTSNLVYRVNVLCMDNDQQLVFETFTQSETIVVFNSIDGPKCGTYDVKVWPTFLNWLDKSEKEINSFLETEFSLHGIGVKNGEMHHINFPTLA

SEQ ID NO: 160013 - protein, 180 aa, Heterodera glycines
  Coding regions on vcDNA: vcDNA=SeqID_86436; Strand=+; Position=71-610
ITSADIELDRLVSLVASQNTTESSDSQPFTSKTPEGPNNKSNTLSNEPVFELPKFTPPDSPSERPSTLNNLAAGDVNETKHFDLAITEHKGPLNSLEETFERYPSTADENLVLIPKDIKPEILMTRRKANKLPIYKQNSNSLQNKTSQSRSDNGHQSRKRNNDAYSFEDDELLAVSSYSV

SEQ ID NO: 160014 - protein, 137 aa, Heterodera glycines
  Homolog annotation: Hit_ID=AAO33474.1; Match level="QueryCoverage =100%, HitCoverage=100%, E-value=1e-64, Identity=92%"; Hit description=gland-specific protein g4g12 [Heterodera glycines]
  Coding regions on vcDNA: vcDNA=SeqID_86437; Strand=+; Position=21-434
MPNIFKILLIVLLAVVSFRLSASTGDKKTAMMGVETLIAGIGTKIKRIVTAGLLFTSLATGGAEAIGRSNAQGGNAAGLVPSHVTNRSMAPPPPPVQFEMGANRLEKMRAHLRELAEKMPVNESNRLSPTGPDPHHH

SEQ ID NO: 160015 - protein, 104 aa, Heterodera glycines
  Coding regions on vcDNA: vcDNA=SeqID_86438; Strand=+; Position=1-315
LIVIGQALTRQLRKCSKRFVRSFFPWQHLFLSTRIALINGFCGKIRIWRIMRVPTDPDSPQCLCAVRCLVKCRSQLSRNCKSDWQNCEGVSAGAFVNYSLPYGN

SEQ ID NO: 160016 - protein, 66 aa, Heterodera glycines
  Coding regions on vcDNA: vcDNA=SeqID_86439; Strand=+; Position=324-524
FLMTNSMPKILFTIIAFVNISQILFATATYKGKEICGKTVEECQAALIAFMKDSGSNQNYHASGNT

SEQ ID NO: 160017 - protein, 213 aa, Heterodera glycines
  Homolog annotation: Hit_ID=CAE61291.1; Match level="QueryCoverage =97%, HitCoverage=26%, E-value=6e-89, Identity=71%"; Hit description =Hypothetical protein CBG05115 [Caenorhabditis briggsae]
  Gene Ontology: Mol. function=protein binding; Cellular component =ubiquitin ligase complex; Biological process=signal transduction
  Coding regions on vcDNA: vcDNA=SeqID_86440; Strand=+; Position=7-645
MLSIDRPAASCGSASYPKNRDTIMPQPPVTPSNQNEEPLPEGWETRMDQYGRRYYVDHTTKSTTWVRPSSMPLPPGWESRRDPRGRVYYVDHNTRTTTWQRPTADMLAAHEQWESNRSQAMHQWEQRFLYTHHDDPLGPLPEGWERREDPNTGRHYFVNHQNKTTQWEDPRTQGLTDAPLPEGWEMRITEQGVPFFIDHNNKTTTYNHPRTGR

SEQ ID NO: 160018 - protein, 150 aa, Heterodera glycines
  Coding regions on vcDNA: vcDNA=SeqID_86441; Strand=+; Position=3-455
MLLLRSVPLLSACLSFFGFLLPPPIVGLQCKQYPELEPGTKFSTEPKEVDCEGKNDICTVTNCKDGSNVAIPWYTHGDCDIESRFSCDKLGAQCTAKGGTFCCHTCKEDLCNTEDICPNTAAMRAGQQVIALVVPLLVAVFAIRAAKIGF

SEQ ID NO: 160019 - protein, 215 aa, Heterodera glycines
  Homolog annotation: Hit_ID=NP_506424.2; Match level="QueryCoverage =99%, HitCoverage=39%, E-value=2e-48, Identity=40%"; Hit description =putative protein (60.9 kD) (5O309) [Caenorhabditis elegans] emb|CAB02126.2| Hypothetical protein F55B12.5
  Coding regions on vcDNA: vcDNA=SeqID_86442; Strand=+; Position=1-645
QMLGLILSEYVPNTFFWHIFNAQLGHVTVSYSHRHMPHFLRSIAKMACADCRLVIGANLTASPRALVDVNGVVLALEGDVSAVFRRKNKVHNLLSARGQLRVAIKPHFRHSRLYSDVLLTGVDFKVYKGGMDGIMAGAIRKMVSFLIPRAIWPKIQQRLRLVVNYKGVQIPRLCSVEFNHLHLDYIAHAAIISGDFDVDLPLFIRSFKEFMDEKQ

SEQ ID NO: 160020 - protein, 67 aa, Heterodera glycines
  Homolog annotation: Hit_ID=ZP_00357698.1; Match level="QueryCoverage =58%, HitCoverage=23%, E-value=3e-13, Identity=81%"; Hit description =hypothetical protein Chlo02002738 [Chloroflexus aurantiacus]
  Coding regions on vcDNA: vcDNA=SeqID_86443; Strand=-; Position=195-398
IFFFFFFFFFPFFFFFFFFFFFFFFFFFFFFFKFNGFYKRKKKQTELSSIISNANTFLEMQRKLNEQ

SEQ ID NO: 160021 - protein, 174 aa, Heterodera glycines
  misc_feature (57)..(57): Xaa can be any naturally occurring amino acid
  Homolog annotation: Hit_ID=CAE66170.1; Match level="QueryCoverage =99%, HitCoverage=30%, E-value=3e-54, Identity=61%"; Hit description =Hypothetical protein CBG11408 [Caenorhabditis briggsae]
  Gene Ontology: Mol. function=RNA helicase activity; Cellular component=nucleus; Biological process=cell growth
  Coding regions on vcDNA: vcDNA=SeqID_86444; Strand=+; Position=5-525
MPQENALLAGVDICVASPGRLMDCINDRVTNLHNCTYLVLDDFYRMLDMGFEPQIRXILLQIRPDLLTLMFSATWPAEVRSLAADFLSSPVGLNVGSLDLSANHNIKQTVEVVEDFAKKDRLWVVLNDILKQTEYKTLMFAETNRKVDELTRQMRYKGMPALCIHGDKSQKERE

SEQ ID NO: 160022 - protein, 143 aa, Heterodera glycines
  Homolog annotation: Hit_ID=CAE71449.1; Match level="QueryCoverage =67%, HitCoverage=24%, E-value=2e-33, Identity=67%"; Hit description =Hypothetical protein CBG18361 [Caenorhabditis briggsae]
  Gene Ontology: Biological process=tyrosine catabolism
  Coding regions on vcDNA: vcDNA=SeqID_86445; Strand=+; Position=2-430
FLLFPLLPLAKGLFSLIIPSLLVNLSKSQDNPSTNGTVSAATSSSARILCFDHIRFWVGNAKQAAHWYCVNFGFIPFAYRGLDTGSRKTVAYAAKQDKIVFVFESALLPNNGEMSAHLAKHGDGVKDVAFEVDNLDWVLDTAR

SEQ ID NO: 160023 - protein, 201 aa, Heterodera glycines
  Homolog annotation: Hit_ID=NP_492824.1; Match level="QueryCoverage =81%, HitCoverage=66%, E-value=1e-23, Identity=36%"; Hit description =vamp-associated protein like family member (34.3 kD) (1L383) [Caenorhabditis elegans] gb|AAC17524.1| Hypo
  Gene Ontology: Mol. function=structural molecule activity; Cellular component=microtubule associated complex; Biological process=N -linked glycosylation
  Coding regions on vcDNA: vcDNA=SeqID_86446; Strand=+; Position=20-622
KSIPPSFLKAENKYFILKNEFPLILLLSLAFCALIIEAYPKNDGPIVRREADNEKAAKAQPGKEDKQAVKAEEKEEEKPKDKKEKRGAEAEEQKEGGEKKGEEKPKGKKEKRAAEKEEKKTENKEAEKKENEEQKPTGKKEKRAAEKEEKKSESKEAEKKENEEQKPAGKKEKRAAEKDEKKSESNEAEKKENEEQKPAGK

SEQ ID NO: 160024 - protein, 190 aa, Heterodera glycines
  Homolog annotation: Hit_ID=NP_504661.1; Match level="QueryCoverage =100%, HitCoverage=48%, E-value=1e-103, Identity=49%"; Hit description=f-box only protein 11 (5H14) [Caenorhabditis elegans] gb|AAC48052.3| Hypothetical protein K04A8.6 [Caen
  Coding regions on vcDNA: vcDNA=SeqID_86447; Strand=+; Position=3-572
SSDPIVRLNKIHDGLHGGIYVHEKGKGLIEENEIYGNTLAGIWVTTGSSPILRKNRIHSGKQVGVYFYDNGHGLLEENDIFNHLYSGVQIRTGSNPKITRNKIWGGQNGGVLVYNSGNGVLEDNEIFDNAMAGVWIKTDSNPTLRRNKIYDGRDGGVCIFNRGRGLLEDNDIYRNAQAGVLISTESSPIL

SEQ ID NO: 160025 - protein, 231 aa, Heterodera glycines
  misc_feature (51)..(51): Xaa can be any naturally occurring amino acid
  misc_feature (116)..(116): Xaa can be any naturally occurring amino acid
  misc_feature (209)..(209): Xaa can be any naturally occurring amino acid
  Homolog annotation: Hit_ID=AAP30764.1; Match level="QueryCoverage =100%, HitCoverage=52%, E-value=1e-122, Identity=96%"; Hit description=putative gland protein G28B03 [Heterodera glycines]
  Coding regions on vcDNA: vcDNA=SeqID_86448; Strand=+; Position=1-689
ALFGDCMKNSDQIGVKRKSAGIRIEEPNDVKGKGKVVETSRKGKEKVGEKXISVMNTAERIEKMDLAQDKAKMDIDTNGKPKQNEENAPPKYVFIWSGNNEKKNLEVDLRVIRHSXKKLSELFHAKSDQSVNAKHGKQEALPVPKQEAEKILKEVEEWYAHHKNDKHKNAPVFVFKCKDNVSLVINVHLDAVRLSKELSNMLEDTADEXYPKPIPSPVPNLKSDIMLKLIK

SEQ ID NO: 160026 - protein, 91 aa, Heterodera glycines
  Coding regions on vcDNA: vcDNA=SeqID_86449; Strand=-; Position=45-320
NFFFDRAQIYRKALVACPGRAAPATCHTQATGQCWQWQMASSYLIGKQMEDGSLKLAFFGEYFWVLPRIFELCINARPCRGVRPLSIHFFT

SEQ ID NO: 160027 - protein, 157 aa, Heterodera glycines
  Coding regions on vcDNA: vcDNA=SeqID_86450; Strand=+; Position=257-727
AVPRSLKSTNWPKTISLGPILSRWQKKDSVCTDFLNTFTELFKEEDFYNSIDGSMLNLLLSNLRELYPRVKQTCAWLDLLIQAKLFPATMLLIEELCKFIESPGLYFGAVPESTSEEDPYQTVACVGPTKNAAGLQSTSSSLAPIPPPKQKPIVPSR

SEQ ID NO: 160028 - protein, 100 aa, Heterodera glycines
  Coding regions on vcDNA: vcDNA=SeqID_86451; Strand=+; Position=272-574
LKLCPPFTHITGWSAPTWRANDYRSAVYYHAYLSRPKPLSCTHYSCNRGGTHVLKMDNDSSSIRSQHLTTYSACTTDTRRSGCTRAIRRGNERTERSVGH

SEQ ID NO: 160029 - protein, 80 aa, Heterodera glycines
  Homolog annotation: Hit_ID=CAE65084.1; Match level="QueryCoverage =96%, HitCoverage=83%, E-value=1e-10, Identity=42%"; Hit description =Hypothetical protein CBG09942 [Caenorhabditis briggsae]
  Gene Ontology: Mol. function=protein binding; Cellular component =axoneme; Biological process=eye photoreceptor cell development
  Coding regions on vcDNA: vcDNA=SeqID_86452; Strand=+; Position=64-303
STGEEKTKSGREEAFQKTQAMQGEKEEKQIDEKEEEQMEDEEKEAEQIGEEMEEGQMEDEEKEAEQIEEEMEEGQMEDEE

SEQ ID NO: 160030 - protein, 205 aa, Heterodera glycines
  Homolog annotation: Hit_ID=CAE66858.1; Match level="QueryCoverage =42%, HitCoverage=18%, E-value=6e-13, Identity=49%"; Hit description =Hypothetical protein CBG12231 [Caenorhabditis briggsae]
  Coding regions on vcDNA: vcDNA=SeqID_86453; Strand=+; Position=3-617
SFDAHNTRLFDRTISVRMDRYPKEVERREGGLPFGLRAVGMGLGANGAPLTDVASVISSISPSQTQPGMNGTAGAPITPFQSPPNVAQFGPVAAQPVAAGPPSGFQQGLPDHGISGHFQSPQPTYQPQATSGFFNPPQPSPQNRPSGGMAFGGGGATPQYAPTKQMGVVGGGTASAAVYGHPPQQQTQKYEHKVEPKFEMGAYPG

SEQ ID NO: 160031 - protein, 221 aa, Heterodera glycines
  Homolog annotation: Hit_ID=NP_497705.1; Match level="QueryCoverage =66%, HitCoverage=29%, E-value=1e-15, Identity=32%"; Hit description =myosin heavy like (3E497) [Caenorhabditis elegans] emb|CAA84327.1| Hypothetical protein F59A2.2 [Caenorha
  Coding regions on vcDNA: vcDNA=SeqID_86454; Strand=+; Position=1-663
TEIEGWIEKCHSMEKRDTDSNTLWQEKVDTLQKAIVALEHEKADMVEKLSQAKQEGVKLVKESEEKRHGEILTEQLKKKDEEWSRRVKELEEQMQLAVEESDLQRKTSVTGHERELSNLRGRVAELEKENTQILQQFCGQKGELEQMKRKELTETEETPKERGETQGKEIEEREKMETKLAETERESNELKRTIETMEKEISRLVHLSDSQKVQLSEQSEK

SEQ ID NO: 160032 - protein, 163 aa, Heterodera glycines
  Coding regions on vcDNA: vcDNA=SeqID_86455; Strand=+; Position=4-492
IVPSPKPGKFPKTPTTNNTKYLPPELLDEMTFYIYPNQNCSRILTSSWLLMEFLRPHIERWKKIFKILLNELIDLHKLCKEGIPWRTFTALAEKDKNCNAFVAALLELVKEDAYASIDGSGSNALLIRLRELYPSVIETLAWTGLQTLNAELFPSTQRMVQAL

SEQ ID NO: 160033 - protein, 162 aa, Heterodera glycines
  Coding regions on vcDNA: vcDNA=SeqID_86456; Strand=+; Position=43-531
MRLKERQTMEKMQSAARYIQILKVELRKSSDNERIALKERNQMKAEMERYKEQAQNLKTKLADREKQLHLHACKLQLQPRNPNRAFASLNGNTPLLGLSFDCVKSTPNLNDTTMFQANRKDVGNNVLETPVFNESEIAGPLRMPDTPAMLRNRNSFEPPRFF

SEQ ID NO: 160034 - protein, 132 aa, Heterodera glycines
  Coding regions on vcDNA: vcDNA=SeqID_86457; Strand=+; Position=251-646
RGFLLDNNRCEARLCFNHCIDLTSTVGTSQSANLLDLVAESTSPLEVPMCKKCANAVTAELNKQLGHLEKECIQYKKSLDHLLQRRADCPFDMEASRIKLDALKSEERDLLEQLTLLEDEERTLLHELDTKQ

SEQ ID NO: 160035 - protein, 142 aa, Heterodera glycines
  Coding regions on vcDNA: vcDNA=SeqID_86458; Strand=+; Position=163-588
NFPIFCPFENRRIVTRFQARKFISLLLRHISPTFSFYNLIPPDSALIQLAKDSGGIIVGPFLREMHSIKGQIGEALIAFLTKMSARSTKLFAENEGTKEERNSARNLIKVGIIFSMAKIIGEKLHDYEINWAKEILETQQKR

SEQ ID NO: 160036 - protein, 171 aa, Heterodera glycines
  Homolog annotation: Hit_ID=XP_215553.2; Match level="QueryCoverage =100%, HitCoverage=42%, E-value=6e-19, Identity=33%"; Hit description= similar to Hypothetical protein KIAA1223 [Rattus norvegicus]
  Gene Ontology: Mol. function=structural constituent of cytoskeleton; Cellular component=actin cytoskeleton; Biological process=signal transduction
  Coding regions on vcDNA: vcDNA=SeqID_86459; Strand=+; Position=1-513
LDCCSLTHLEMCRALIAHGANIHLGTDSGESTLLCACFEGNFEIVTLLVENGANVNLADSDGMTPLIATCYFTGKIDIVHLLLLHGAIVGQTDFTGMKFALLGAARAGYLEVCQLLVNGWAADVNQQTIHGTTALIRASGRGHVDVVTFLVEYGADLDHTDIDGYNALMCA

SEQ ID NO: 160037 - protein, 208 aa, Heterodera glycines
  misc_feature (196)..(196): Xaa can be any naturally occurring amino acid
  Homolog annotation: Hit_ID=CAE72913.1; Match level="QueryCoverage =97%, HitCoverage=45%, E-value=1e-36, Identity=39%"; Hit description =Hypothetical protein CBG20231 [Caenorhabditis briggsae]
  Coding regions on vcDNA: vcDNA=SeqID_86460; Strand=+; Position=35-657
MAAVINQNPSVTMTSSLGENARMDCCYFLPTELAQKIEGQLTGRIAGIHLLEREDGLLVVNEDRTLRVLLRRESGMFWPSIIHDLPHIPTKLSCSEQKNTIFVGFANGQIHEYSIENDFNSISFKRQWNSHTNSISGLGFSERLEQMVSCSKDKTVVWHCTSTTRKIASYCTGSPCTTLQFDGDASFVFVGDYSGXISVLRLVVGTQQ

SEQ ID NO: 160038 - protein, 201 aa, Heterodera glycines
  Homolog annotation: Hit_ID=NP_495890.1; Match level="QueryCoverage =93%, HitCoverage=13%, E-value=1e-52, Identity=55%"; Hit description =RNA helicase (rha-1) [Caenorhabditis elegans] emb|CAA90409.1| Hypothetical protein T07D4.3 [Caenorhabditi
  Gene Ontology: Mol. function=chromatin binding; Cellular component =dosage compensation complex (sensu Drosophila); Biological process =dosage compensation, by hyperactivation of X chromosome
  Coding regions on vcDNA: vcDNA=SeqID_86461; Strand=+; Position=1-603
AFDSKPKRFYWRRKLKSFHFRTTNALPSQNIVWAPPQENWNAWNASNIDNQTLAFRSLEWISNDLLTREKIKKIPARLTASRQTLPVFQHRDEIMHNVQQNSVVLVKGATGCGKPTQICQYLLESHLTQGKGAHFNCVVTQPMRISAITLAERVAEERCESVGESVGYSVRFEWMGPRPYGAIMFMTVGVLMRKMEHGLRG

SEQ ID NO: 160039 - protein, 133 aa, Heterodera glycines; identical to SEQ ID NO: 158769
  Homolog annotation: Hit_ID=AAO85456.1; Match level="QueryCoverage =100%, HitCoverage=100%, E-value=3e-72, Identity=100%"; Hit description=putative gland protein G18H08 [Heterodera glycines]
  Coding regions on vcDNA: vcDNA=SeqID_86462; Strand=+; Position=16-417

SEQ ID NO: 160040 - protein, 162 aa, Heterodera glycines
  Homolog annotation: Hit_ID=NP_501713.1; Match level="QueryCoverage =78%, HitCoverage=80%, E-value=6e-17, Identity=37%"; Hit description =predicted CDS, ctr copper transporter family member (4K417) [Caenorhabditis elegans] emb|CAA92470.2| Hypo
  Gene Ontology: Mol. function=copper ion transporter activity; Cellular component=integral to plasma membrane; Biological process =copper ion transport
  Coding regions on vcDNA: vcDNA=SeqID_86463; Strand=+; Position=42-530
CGCSSHSNKDTVLFKWWKVETIGSLLITCLVMYFGAICFEAIKWLRLMLEQKSRQPNSANSAGLNMTDQNKTVPMTNRRYAESLLSRVHLLQSVLFTVQLLLSYLLMLCFMTFSVWIGMAICAGAATGFWLFGRRVPMLAFASSGAAGSGQGYASTGRTELH

SEQ ID NO: 160041 - protein, 112 aa, Heterodera glycines
  Coding regions on vcDNA: vcDNA=SeqID_86464; Strand=+; Position=53-391
SSSFSRSVHILATVKEFQKFYPMKMPSNFKSVVGGHQLCNSNRFFSQEPSNLSPGEAFLQRSREANKEQLKKLVEEHERVKRECAEKRKRLIRLRRYYYLCVYGFAFFHFFL

SEQ ID NO: 160042 - protein, 154 aa, Heterodera glycines
  Coding regions on vcDNA: vcDNA=SeqID_86465; Strand=+; Position=1-462
PKVSTIGRVVKMSFSGHCLCYSTDSGAFYVQNLQAKSGGALKLFDGATDGHAICTFGMEEFALSGVHDLVVFVNMHGVSSRPPISVSGRSRIVGLSLKDPFLHVLIEDGTVSIFSTVDAHLVQSLAFPTDEVQDVRQNICGRSPAPITCQLENI

SEQ ID NO: 160043 - protein, 165 aa, Heterodera glycines
  misc_feature (144)..(144): Xaa can be any naturally occurring amino acid
  misc_feature (155)..(155): Xaa can be any naturally occurring amino acid
  Homolog annotation: Hit_ID=AAL78229.1; Match level="QueryCoverage =94%, HitCoverage=84%, E-value=2e-84, Identity=98%"; Hit description =SCN esophageal gland cell protein [Heterodera glycines]
  Coding regions on vcDNA: vcDNA=SeqID_86466; Strand=+; Position=10-506
SPFLIGNESNGFFFVLAVLFLVKVDFLQCKYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSELKQYCNNGAENEEENDEXSEREREEERVXEREEQQNSNH

SEQ ID NO: 160044 - protein, 175 aa, Heterodera glycines
  Coding regions on vcDNA: vcDNA=SeqID_86467; Strand=+; Position=19-546
PVFGCGDVHVIVFTVLPIFMQNLSFLLLCDVPKCDREGALKSEIEQTFPSLKCQHIHCYKKWPGHKFDTFMHVTVAGQQKQQHSPKLCAASEHGTNKSHCFCPPLTDLDSLHKMLRVKGARRVTVQPWLAVNGEQHEQQQQQSIRNNCSCCVSETCREKQCCEAVEDEEEKKYEI

SEQ ID NO: 160045 - protein, 223 aa, Heterodera glycines
  Coding regions on vcDNA: vcDNA=SeqID_86468; Strand=+; Position=2-670
RKSFHSKPHLEQLDGVKEGDQKEQELSEFMRSICNFLSTLTNEMTIMQRISTDTLRSFIDSLLSLVSDQRLKILNKQVFRSLNIIVIRLCEFTNPNVCFVALMKLVMKYQASDPGGQLSSLVRKCLTKFTDAIVEPTRIEKVDILTVLHPIHEYYSRFYVADGQTNQISDTVKDTSKLLCIFLQRLVINQKYAMLNYLYPFPESSQLVSYVRRCIRTVGRKAM

SEQ ID NO: 160046 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_86469; Strand=+; Position=17-433
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVDESKRLSPSGPDPHHH

SEQ ID NO: 160047 - protein, 97 aa, Heterodera glycines
  Coding regions on vcDNA: vcDNA=SeqID_86470; Strand=+; Position=3-296
MRVLPLLFSALLLLSVGLCFAQFDQSPSAALNHVRAKRGYKPWKKQSFSSSSSEMYRRRRPSGNGHYRDYNGYGSNGYYRRKPGILERALGKITRSY

SEQ ID NO: 160048 - protein, 187 aa, Heterodera glycines
  Coding regions on vcDNA: vcDNA=SeqID_86471; Strand=+; Position=64-624
LMASSFLGKSPNSFTNIAHHHQLLQSSHHQNGGTEIEKRSPSSSSTALNSGDLLSDNNEAAMALSSLIELGKNRQQTQRDEAENGIDNDDCRFDGSVAVSSPSVISSTFAATPANCSAETFQSHANGTHNVTTIKTEDNESGDELPPQDDSASDAPVHEIRCGLLNARLHMQRFTCPGIHRKCVEFE

SEQ ID NO: 160049 - protein, 189 aa, Heterodera glycines
  Homolog annotation: Hit_ID=NP_491361.1; Match level="QueryCoverage =94%, HitCoverage=40%, E-value=1e-39, Identity=45%"; Hit description =thioredoxin type domain containing protein (50.9 kD) (1E948) [Caenorhabditis elegans] gb|AAL11490.1| Hypo
  Coding regions on vcDNA: vcDNA=SeqID_86472; Strand=+; Position=3-569
AESTGKLLVLSSIEGMDRHNASTESGSFFALIKRTVVEARVDAEIEQHFQFGWMDGTQIASGVVMDSLPLPNLVVLNYSSYEFYLSKDHPAQMTAKSLLLFLHSVRLGEVTVHGGRAWITRLRRMAYEITSNVYDMFQHQPILTVCLFGVPLAFFSIITYSICSADFSVERDEFYPDDDEEESLPLEEL

SEQ ID NO: 160050 - protein, 211 aa, Heterodera glycines
  Coding regions on vcDNA: vcDNA=SeqID_86473; Strand=+; Position=44-676
MPRRASERTLDRFEDVRTIASSDIEVIRQMDDWSVTSSYPNSSHQQSNTQKIGQIRSIGELQQSQTPPELTTKLDTSEQSQREMDEKIAVLMAKLAHRDQKIEELGRANENLRTTNATLVAKSKQKNAAEAKLQSQFAEKEKQLTDLLDEGRKLSEYSGRQAKEVRKLKQQLEQLDIVTAARDSAVEELQEARQQLQEQENAMEQLRDELD

SEQ ID NO: 160051 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_86474; Strand=+; Position=17-433
MPNIFKILLIVLLAVVSFRLSASIGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160052 - protein, 64 aa, Heterodera glycines
  misc_feature (9)..(9): Xaa can be any naturally occurring amino acid
  misc_feature (50)..(50): Xaa can be any naturally occurring amino acid
  Homolog annotation: Hit_ID=JC1516; Match level="QueryCoverage=98%, HitCoverage=39%, E-value=1e-14, Identity=53%"; Hit description =globin - Caenorhabditis elegans
  Coding regions on vcDNA: vcDNA=SeqID_86475; Strand=+; Position=2-194
SETVNRHRXVKMEPSLWKAFWTVWTGFLETKVDLTEQAKSAWMSLGEDFXQEALAHLKRLGIPH

SEQ ID NO: 160053 - protein, 211 aa, Heterodera glycines
  Homolog annotation: Hit_ID=AAO85457.1; Match level="QueryCoverage =100%, HitCoverage=95%, E-value=1e-121, Identity=100%"; Hit description=putative gland protein G19B10 [Heterodera glycines]
  Coding regions on vcDNA: vcDNA=SeqID_86476; Strand=+; Position=22-654
MHLKIFLLILFVTICSVWSLSPKIHHNYHQQQQQHNIKNKLPPKNIGTKHLKTEINGHNKHKHNPASRHGHALLQKVKDQLNNDGWASEDANKTSVLLSSLLAIECHMKKLDKKRTNDSAEIKHLTEQICAAENKEQIGIHKLINEVAKTFEKDGKKMVEQMKRDEHTVKVHLDGHYGTLAEILPSAKKHAKATRLRTYHAVLHLLHLITP

SEQ ID NO: 160054 - protein, 182 aa, Heterodera glycines
  Homolog annotation: Hit_ID=NP_505977.1; Match level="QueryCoverage =98%, HitCoverage=15%, E-value=1e-63, Identity=67%"; Hit description =pyruvate carboxylase, Biotin-requiring, cadmium-responsive gene (129.3 kD) (pyc-1) [Caenorhabditis elegan
  Gene Ontology: Mol. function=pyruvate carboxylase activity; Cellular component=cytosol; Biological process=gluconeogenesis
  Coding regions on vcDNA: vcDNA=SeqID_86477; Strand=+; Position=1-549
SGRNLRDVDAMSSAMFPREFDEFEQFRQKYGPVDKLNSKVFFAGMDIVEEIQVEIERGKVLNIQMLAEGKLNSRGEREVFFELNGQGRSMFIPDNEASKSIVVRPKALPGMKGSIGAPMPGEILEVKVKVGDIVQPKQTLFILSAMKMEMNVGSPIAGTVKAIHLNKGEKVSPNDLVVEVEQ

SEQ ID NO: 160055 - protein, 122 aa, Heterodera glycines
  Homolog annotation: Hit_ID=NP_491993.1; Match level="QueryCoverage =95%, HitCoverage=30%, E-value=3e-40, Identity=63%"; Hit description =sec14 -like 2 (43.8 kD) (1H585) [Caenorhabditis elegans] emb|CAB07482.1| Hypothetical protein H06O01.3 [C
  Gene Ontology: Mol. function=transcriptional activator activity; Cellular component=cytoplasm; Biological process=regulation of cholesterol biosynthesis
  Coding regions on vcDNA: vcDNA=SeqID_86478; Strand=+; Position=2-370
VFRRPFQAMPDYDTLTTVYAGDKHLIELKVKANTRIGWQYLTEEEDIGFAVYFDPSGNANNLTEMDCVFPYIRLECSQVPISGSLLCEQSGRYIIEFDNYYSWFSAKQLRYNIEIDDRGIGQ

SEQ ID NO: 160056 - protein, 71 aa, Heterodera glycines
  Coding regions on vcDNA: vcDNA=SeqID_86479; Strand=+; Position=3-218
FSCCPASSSPLPIAPSTAVGMPPPPPPMANALRRPPPCPETQLILFFLNFTFFALLYLFIFVLFGAHSFLF

SEQ ID NO: 160057 - protein, 222 aa, Heterodera glycines
  Homolog annotation: Hit_ID=CAE62113.1; Match level="QueryCoverage =56%, HitCoverage=23%, E-value=2e-15, Identity=37%"; Hit description =Hypothetical protein CBG06151 [Caenorhabditis briggsae]
  Gene Ontology: Cellular component=mitochondrion
  Coding regions on vcDNA: vcDNA=SeqID_86480; Strand=+; Position=2-667
RALLGPVTTYVIGYVQQDDLFMGTPTVKEHLMAPAQLWMVGHTQRTMRRRVNELEEAISDGEARRLPFAFEPRHNPQIIFALQPTKDLASSVVDSAVSHILRTLNLFGRRIVVTIHRPSEGMCQKFERDRLLKLLERTQKDVQRLTTANQQLTTANQQLTTANQQLTTANQQLTTTNQQQQNTINHQQQNIQQLQNLLAGQQPLVPAFAPGVFGEQQQHHHA

SEQ ID NO: 160058 - protein, 73 aa, Heterodera glycines
  Coding regions on vcDNA: vcDNA=SeqID_86481; Strand=+; Position=1-219
NCRPSLPLRLLSCGWKCCASVEPQLCHEGRRNRWLKAVDDGLILDSSSVTADTSDLPLIGFQKNGKEDLIFKL

SEQ ID NO: 160059 - protein, 182 aa, Heterodera glycines
  Homolog annotation: Hit_ID=NP_507517.1; Match level="QueryCoverage =99%, HitCoverage=33%, E-value=3e-90, Identity=86%"; Hit description =fray / Ste20 kinase homologue (5S436) [Caenorhabditis elegans] emb|CAC14417.1| Hypothetical protein Y59A8
  Gene Ontology: Mol. function=protein binding; Cellular component =cytoplasm; Biological process=protein amino acid phosphorylation
  Coding regions on vcDNA: vcDNA=SeqID_86482; Strand=+; Position=21-566
NQAMSLCSHPNVVNYYTSFVVGEELWVVMRLLNCGSMLDILKRKIKAVGKDQAAYGVLDEVIIATVLKEVLRGLEYFHNSGQIHRDIKAGNILLANDGTVQIADFGVSGWLAASGGDLSRQKVRHTFVGTPCWMAPEVMEQVSGYDFKADIWSFGILCIELATGTVPYHRYPPMKVLMLTLQ

SEQ ID NO: 160060 - protein, 223 aa, Heterodera glycines
  misc_feature (210)..(210): Xaa can be any naturally occurring amino acid
  Homolog annotation: Hit_ID=NP_495990.1; Match level="QueryCoverage =95%, HitCoverage=32%, E-value=8e-28, Identity=32%"; Hit description =tubulin-tyrosine ligase (76.8 kD) (2J631) [Caenorhabditis elegans] emb|CAA87783.1| Hypothetical protein D
  Coding regions on vcDNA: vcDNA=SeqID_86483; Strand=+; Position=42-709
ILIISPVHEPQLLASGLPELFWKSLYKKISNQIFDAGKYFEVIIEESEPNETISSQVKAMSELKMDDPENVFLIDHAWTFRPNTARFALQQVDGLRKRLLDMFNIKAWYANKECLKDPFADDSADQQQKCADAVATHSADCEDSEVASPCGQNVEEIWEKHCEMDDLIIDEMWKYAMTYSIRMLNLEMDEHQIPVWYVMDEFGVRIGHSXSPNVKMVPFLDFS

SEQ ID NO: 160061 - protein, 98 aa, Heterodera glycines
  Homolog annotation: Hit_ID=AAO85458.1; Match level="QueryCoverage =100%, HitCoverage=88%, E-value=2e-50, Identity=100%"; Hit description=putative gland protein G19C07 [Heterodera glycines]
  Coding regions on vcDNA: vcDNA=SeqID_86484; Strand=+; Position=347-640
MLFGFFPFRAGCPGKNDIKAGSSSHVSSTIMIIEEKEDSESDEQMDGAGGDEEKRGGENGSEAQGGKGAARDNEMEDEELKVKAVVEETTTNEQGKTE

SEQ ID NO: 160062 - protein, 154 aa, Heterodera glycines
  Coding regions on vcDNA: vcDNA=SeqID_86485; Strand=+; Position=1-465
HCVGWYSNIQWLFLPRPDNLMKELTICIEDSAVEQQWLAAVEQIKAAFSNASSPVYFDITVYFPPPSSLSAVVPFKLTNEMTGEKLEMYKEDVEEDLSCFSLIRCPIAPDDKRERMKMIKELDKRWNRINIFLIGDGLLDGFPGASGDQKEQKK

SEQ ID NO: 160063 - protein, 174 aa, Heterodera glycines
  Homolog annotation: Hit_ID=AAC13679.1; Match level="QueryCoverage =75%, HitCoverage=22%, E-value=7e-37, Identity=57%"; Hit description =GLY9 [Caenorhabditis elegans]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_86486; Strand=+; Position=5-526
KKKKKIKKKRAAFLKAFFFPVDDHSLVGPDGDSPLFTHRIGKSAPEGQPGENGAAVTLTGEEAAEGRRQMSYWFMNVKASDKLSLDRALPDVRPNACRSLSYDLANLPSASVVIVFTDEPTSVLLRTVHSVFNRSPMSLLREVVLVDDFSHREELKAPLVAHLRRFGSRVRLFR

SEQ ID NO: 160064 - protein, 54 aa, Heterodera glycines
  Homolog annotation: Hit_ID=ZP_00357698.1; Match level="QueryCoverage =68%, HitCoverage=23%, E-value=3e-10, Identity=90%"; Hit description =hypothetical protein Chlo02002738 [Chloroflexus aurantiacus]
  Coding regions on vcDNA: vcDNA=SeqID_86487; Strand=-; Position=249-413
IFFFFFFFFFFFFFFFFFFFFFFFFFFVSKIYLQKVKKWTNIPSFKVTLFCYLI

SEQ ID NO: 160065 - protein, 111 aa, Heterodera glycines; identical to SEQ ID NO: 159909
  Homolog annotation: Hit_ID=AAL78214.1; Match level="QueryCoverage =86%, HitCoverage=48%, E-value=8e-16, Identity=45%"; Hit description =putative esophageal gland cell protein Hgg-20 [Heterodera glycines]
  Coding regions on vcDNA: vcDNA=SeqID_86488; Strand=+; Position=161-496

SEQ ID NO: 160066 - protein, 156 aa, Heterodera glycines
  Homolog annotation: Hit_ID=NP_477351.1; Match level="QueryCoverage =98%, HitCoverage=18%, E-value=5e-28, Identity=41%"; Hit description =CG5216-PA [Drosophila melanogaster] gb|AAF53248.1| CG5216-PA [Drosophila melanogaster]
  Gene Ontology: Mol. function=NAD-dependent histone deacetylase activity; Cellular component=cytoplasm; Biological process=chromatin silencing
  Coding regions on vcDNA: vcDNA=SeqID_86489; Strand=+; Position=59-526
MVEEQQPIISPAHCGSGAEEFSPDAQCAQQWKKPNESLFVVQQLARQGLGPRQILATLYPRYCSTISDDIPDEWIMQLLRELCEHRTRQKLSNYNTFEDAVELFMKSKRILVITGAGVSVSCGIPDFRSENGVYARLKKDFPELPTPTAMFDIDFF

SEQ ID NO: 160067 - protein, 141 aa, Heterodera glycines
  Homolog annotation: Hit_ID=AAO33474.1; Match level="QueryCoverage =95%, HitCoverage=97%, E-value=1e-70, Identity=100%"; Hit description= gland-specific protein g4g12 [Heterodera glycines]
  Coding regions on vcDNA: vcDNA=SeqID_86490; Strand=+; Position=2-427
RSKKCQHFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160068 - protein, 142 aa, Heterodera glycines
  Homolog annotation: Hit_ID=AAO33474.1; Match level="QueryCoverage =94%, HitCoverage=97%, E-value=1e-70, Identity=100%"; Hit description= gland-specific protein g4g12 [Heterodera glycines]
  Coding regions on vcDNA: vcDNA=SeqID_86491; Strand=+; Position=3-431
KDPKKCQHFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160069 - protein, 207 aa, Heterodera glycines
  Homolog annotation: Hit_ID=NP_503037.1; Match level="QueryCoverage =75%, HitCoverage=15%, E-value=2e-28, Identity=37%"; Hit description =intersectin 2 (4S71) [Caenorhabditis elegans] emb|CAB55138.1| Hypothetical protein Y116A8C.36 [Caenorhabd
  Gene Ontology: Mol. function=protein binding; Cellular component =lamellipodium; Biological process=small GTPase mediated signal transduction
  Coding regions on vcDNA: vcDNA=SeqID_86492; Strand=+; Position=42-662
MSASPSVSAALYDFPPADTETMVKLTNTTIPSPTATIEPSSVPLYELPPDNGKMPPSKASVADSVVLSVGVALYQWKARNEQEMTFGRGDVIEVLEQSEMRWRGRLQKNRQITGWFPKSYIKISAPSEQQKDESATTDLYQTGQSAAKNGGKARVGESGEWFIALYQFDAVESTDLSLKPGDRIWVTDQRDQWWRGTCDGKSGIFPA

SEQ ID NO: 160070 - protein, 57 aa, Heterodera glycines
  Homolog annotation: Hit_ID=ZP_00357698.1; Match level="QueryCoverage =68%, HitCoverage=21%, E-value=2e-13, Identity=79%"; Hit description =hypothetical protein Chlo02002738 [Chloroflexus aurantiacus]
  Coding regions on vcDNA: vcDNA=SeqID_86493; Strand=-; Position=251-424
LFFFFFFFWVFFFFFFFFFFFFFFFFFFFFVFFFCIWSVFMCQGNNNKKTKVLWLLA

SEQ ID NO: 160071 - protein, 210 aa, Heterodera glycines
  Homolog annotation: Hit_ID=CAE59495.1; Match level="QueryCoverage =88%, HitCoverage=51%, E-value=5e-40, Identity=44%"; Hit description =Hypothetical protein CBG02880 [Caenorhabditis briggsae]
  Gene Ontology: Mol. function=protein serine/threonine kinase activity; Cellular component=membrane; Biological process=protein amino acid phosphorylation
  Coding regions on vcDNA: vcDNA=SeqID_86494; Strand=+; Position=62-691
MLQAHQYQLRQGHRRVSARSILAHFGFEFSNDYRLGCGHYSKVYKGYFKEAQRTFAIKVTDLESVSEKFKQKFLPRELEVWRELDHPNLVYLYNDFQWSDYQFVVMELAVGGDLLSFLQKCGPVSETTCHNWMLQIVAALDYLHRKGIAHRDLKLENVLLCENGVIKVTDYGFSKQSSDLSSTFCGSRSYSSPEILLGIAYDMFKSDIWS

SEQ ID NO: 160072 - protein, 200 aa, Heterodera glycines
  misc_feature (134)..(134): Xaa can be any naturally occurring amino acid
  Homolog annotation: Hit_ID=AAH78007.1; Match level="QueryCoverage =100%, HitCoverage=18%, E-value=3e-33, Identity=37%"; Hit description= Hira-A protein [Xenopus laevis]
  Gene Ontology: Mol. function=histone-specific chaperone activity; Cellular component=nucleosome; Biological process=gastrulation
  Coding regions on vcDNA: vcDNA=SeqID_86495; Strand=+; Position=65-665
MQIFEAPWITHEGGSIFSLDFHPSGCKLATAGQDPSGAGLLIVWDLGFLNCPPDSKEFNCSQLPLTRIPHTSTINCVRWSKHSATISRLVCAGDDSMICVYECVGVYSSEGSFSNSLEMPTCQKRNIESYRCTXKLYGHSIDVLHIDWSSDGRFLASCSLDSTIIVWNALKLPEKVIVLKQTNDGHVRGVKGLAWDPIGR

SEQ ID NO: 160073 - protein, 155 aa, Heterodera glycines
  misc_feature (64)..(64): Xaa can be any naturally occurring amino acid
  misc_feature (74)..(74): Xaa can be any naturally occurring amino acid
  misc_feature (86)..(86): Xaa can be any naturally occurring amino acid
  misc_feature (113)..(113): Xaa can be any naturally occurring amino acid
  misc_feature (126)..(126): Xaa can be any naturally occurring amino acid
  Homolog annotation: Hit_ID=NP_950744.1; Match level="QueryCoverage =85%, HitCoverage=63%, E-value=9e-31, Identity=55%"; Hit description =hypothetical protein PAM492 [Onion yellows phytoplasma OY-M] ref|NP _950502.1| hypothetical protein PAM250
  Coding regions on vcDNA: vcDNA=SeqID_86496; Strand=-; Position=13-480
TPQSNYPPRHVPGPDNGPRLDVSNSKGGISRTTPPELAPRFHSLPPIVHIRSLTPRRSYSKGSXGSFRLTAGTXIFTGNSISLSMXWRQWGSRYAIRAGRNLPDKEFRYIRTXIVTAAVSWASVRXFTPPFNLQAPGRRQTLYVALLLRRDPVVC

SEQ ID NO: 160074 - protein, 101 aa, Heterodera glycines
  misc_feature (16)..(16): Xaa can be any naturally occurring amino acid
  misc_feature (41)..(41): Xaa can be any naturally occurring amino acid
  Homolog annotation: Hit_ID=XP_395077.1; Match level="QueryCoverage =83%, HitCoverage=90%, E-value=1e-18, Identity=56%"; Hit description =similar to DcoH-like protein DCoHm [Apis mellifera]
  Gene Ontology: Biological process=sporulation (sensu Saccharomyces)
  Coding regions on vcDNA: vcDNA=SeqID_86497; Strand=+; Position=5-309
MGKESLGEEQRKVLLXPLLKEGWETAQERDASKRAYLKFFXQAFGSMTRIALKAVPPYYHPFCLYVYNKVDITLSSHDVQGISERDVKLASFIENVFKTVK

SEQ ID NO: 160075 - protein, 142 aa, Heterodera glycines; identical to SEQ ID NO: 160068
  Homolog annotation: Hit_ID=AAO33474.1; Match level="QueryCoverage =94%, HitCoverage=97%, E-value=1e-70, Identity=100%"; Hit description= gland-specific protein g4g12 [Heterodera glycines]
  Coding regions on vcDNA: vcDNA=SeqID_86498; Strand=+; Position=3-431

SEQ ID NO: 160076 - protein, 59 aa, Heterodera glycines
  Homolog annotation: Hit_ID=NP_775539.1; Match level="QueryCoverage =93%, HitCoverage=12%, E-value=1e-19, Identity=76%"; Hit description =eukaryotic translation initiation factor 5 [Mus musculus] gb|AAH39275.1| Eukaryotic translation initiatio
  Gene Ontology: Mol. function=GTPase activity; Cellular component =eukaryotic translation initiation factor 2B complex; Biological process=regulation of translational initiation
  Coding regions on vcDNA: vcDNA=SeqID_86499; Strand=+; Position=148-324
MAKNNININRGVQDPFYRYKMPRILAKVEGKGNGIKTVIANMPEIAKALSRPPTYPTKY

SEQ ID NO: 160077 - protein, 60 aa, Heterodera glycines
  Coding regions on vcDNA: vcDNA=SeqID_86500; Strand=+; Position=2-181
TATKTGSTSTTTTAEKCQIANCHNRRMARLAHADDESADQLAAREDWAHFEMVDRQLDEL

SEQ ID NO: 160078 - protein, 91 aa, Heterodera glycines
  Coding regions on vcDNA: vcDNA=SeqID_86501; Strand=+; Position=9-281
GGLKGHEWQQKGHHSQSEALNRAKVSIGAKRPLTGASSSSEDDSGVLVTREHVPRKGRTLFRAVDAMRCDSVGSAVSAQQHRSRSHKPKPG

SEQ ID NO: 160079 - protein, 206 aa, Heterodera glycines
  misc_feature (19)..(19): Xaa can be any naturally occurring amino acid
  Homolog annotation: Hit_ID=NP_508927.1; Match level="QueryCoverage =99%, HitCoverage=18%, E-value=3e-56, Identity=52%"; Hit description =dihydropyrimidine dehydrogenase (XG89) [Caenorhabditis elegans] gb|AAK39195.1| Hypothetical protein C25F6
  Gene Ontology: Mol. function=dihydropyrimidine dehydrogenase activity; Cellular component=cytoplasm; Biological process=uracil catabolism
  Coding regions on vcDNA: vcDNA=SeqID_86502; Strand=+; Position=2-623
RALLYLSGIRALSDWAGQXPPVEKHQKGKSVLAQNAHLPPLGFFREQRYHLEKKMLNQNGVLNENNFFAIRPANEPEFVPKLKDVIGKALDKIGTYGDMDNSDQVVAVIDDDLCINCGKCYMTCNDSGYQAISFDKQTHLAKVNEENCTGCTLCHSVCPIPDCIKMVPKTIPHKINRGIAPRQQQNGDDAQQTAQNANRRIILEIN

SEQ ID NO: 160080 - protein, 184 aa, Heterodera glycines
  Coding regions on vcDNA: vcDNA=SeqID_86503; Strand=+; Position=3-557
SPRGDGRPKILLCQEIWSFADKIRELKTAFCDASAPVSFIIRLYLSSFAGEQFELRNDRTGEMLSMEMVATEDDEDGEGQQLQQMEEEDNDNADILTHYIKPERNLWLLKRRPTVGGGKWQKQWAQWEAEAIGWNWTNAWNVIEVANEEDVDVIEDGNEHLDMDEVTYEGEAMDEVDEMDDTDG

SEQ ID NO: 160081 - protein, 103 aa, Heterodera glycines
  Homolog annotation: Hit_ID=AAO85458.1; Match level="QueryCoverage =100%, HitCoverage=92%, E-value=4e-52, Identity=98%"; Hit description= putative gland protein G19C07 [Heterodera glycines]
  Coding regions on vcDNA: vcDNA=SeqID_86504; Strand=+; Position=345-653
MLFGFFPFRAGCPGKNDIKAGSSSHVSSTIMIIEEKEDSESDEQMDGAGGDEEKRGGEDGSEAHGGKGAARDNEMEDEELKVKAVVEETTTNEQGKTETNVEQ

SEQ ID NO: 160082 - protein, 213 aa, Heterodera glycines
  Coding regions on vcDNA: vcDNA=SeqID_86505; Strand=+; Position=23-661
MRNHSAQSQTDGGEVPKSGGEENGKTEQTGKAAREEGRESIDQVLEDKTGALADVPEEEMVISQCQISGENQSDSKKEGLISQGEPRNLSNAGPISQEGQIDSEKNDELINQQEQQQVTLISEEGLISEKKQQTVTEATTDEEALLISIQLNELTISPAKELDADDGKDAVVQLQKLVANGIASGEVGQIVADVVQNVVQTDAAATPAVQHGQ

SEQ ID NO: 160083 - protein, 49 aa, Heterodera glycines
  misc_feature (25)..(27): Xaa can be any naturally occurring amino acid
  Coding regions on vcDNA: vcDNA=SeqID_86506; Strand=+; Position=2-148
KRSEKCQHFKILLIVLLAVVYSRLXXXFYLVTKELLMMGVETTHQLGLV

SEQ ID NO: 160084 - protein, 259 aa, Heterodera glycines
  misc_feature (25)..(25): Xaa can be any naturally occurring amino acid
  Homolog annotation: Hit_ID=C88618; Match level="QueryCoverage=95%, HitCoverage=32%, E-value=2e-32, Identity=33%"; Hit description =protein ZK520.4 [imported] - Caenorhabditis elegans
  Gene Ontology: Mol. function=protein binding; Cellular component=SCF ubiquitin ligase complex; Biological process=induction of apoptosis by intracellular signals
  Coding regions on vcDNA: vcDNA=SeqID_86507; Strand=+; Position=1-776
YVKLSRRSFSQAIERITWDHNFSDXYFVCVSVPEAQSRRLYTAVKNSLELHTISIRESLLRLSGDQLLSAYNSEWEKFHKGAIYLHNLYGYLNKQLVKEKMDAESQHPFVVDNDSDGLYPHLGVGDLAFSIWRNELLMPLAAQLVAHIIGLLGRIRNGISASFGIRISDLRGAVLSFVDVNESIHREQKAQLLCMSIGIPTTEFYEEIFEKHFLEASENYYRTLTSETFVHLDCCPYMDAVIQKINDERSIVQRFLHYS

SEQ ID NO: 160085 - protein, 204 aa, Heterodera glycines
  misc_feature (192)..(192): Xaa can be any naturally occurring amino acid
  Homolog annotation: Hit_ID=CAE69126.1; Match level="QueryCoverage =87%, HitCoverage=36%, E-value=2e-47, Identity=52%"; Hit description =Hypothetical protein CBG15152 [Caenorhabditis briggsae]
  Gene Ontology: Mol. function=pre-mRNA splicing factor activity; Cellular component=nucleus; Biological process=mRNA processing
  Coding regions on vcDNA: vcDNA=SeqID_86508; Strand=+; Position=11-676
MDDENTHQANMERVREDEDEKIGLMDIKREIKAELNEAIGRQTEDGETEPKAERERERKSDRERERKKKSKRTSRDRSRSKSRERKRSRERRRSRSRSKERHRERERSREKERGEKRSKVKSNKYWDVPPAGYEHMSPKEYKELQHLATGAIPRATLQSSVPVVGPSVTCQARRLYVGNIPFGSNEDAMLDXFNQQMHLCGLAQ

SEQ ID NO: 160086 - protein, 144 aa, Heterodera glycines
  Coding regions on vcDNA: vcDNA=SeqID_86509; Strand=+; Position=5-439
AFDASLIRLFVSYFSVFEFWCAVNKNLFAASQKNAALTKHLHVSPFRYADSSDDGKEKKENTIKIDETIQKDKVDETLQKEEKAAQLTSLEPQRLRMKPDNRRVLVRMAIKAHKINAASEEGGGMSGAKSLLSMNTTEIDRLSA

SEQ ID NO: 160087 - protein, 164 aa, Heterodera glycines
  misc_feature (16)..(16): Xaa can be any naturally occurring amino acid
  misc_feature (24)..(24): Xaa can be any naturally occurring amino acid
  misc_feature (31)..(31): Xaa can be any naturally occurring amino acid
  misc_feature (37)..(37): Xaa can be any naturally occurring amino acid
  misc_feature (40)..(40): Xaa can be any naturally occurring amino acid
  misc_feature (48)..(48): Xaa can be any naturally occurring amino acid
  misc_feature (61)..(61): Xaa can be any naturally occurring amino acid
  misc_feature (110)..(110): Xaa can be any naturally occurring amino acid
  misc_feature (124)..(124): Xaa can be any naturally occurring amino acid
  Homolog annotation: Hit_ID=AAL78227.1; Match level="QueryCoverage =99%, HitCoverage=64%, E-value=4e-76, Identity=84%"; Hit description =hypothetical protein Hgg-18 [Heterodera glycines]
  Coding regions on vcDNA: vcDNA=SeqID_86510; Strand=+; Position=92-577
SQKGGAENGRGQKGRXQSPVPRPXLTEAADXCEQSGXMTXALNRQKHXKNAAEATAEKTPXRAGKSIERSGRKRRKRTAEDGCQQNFGGKSEKRRGIGKRSENENGNTFXGQQKGQRRVDFDNXRQKDDFGREGEADGGADSQNVGQHEEGAESEQQCRRRRLR

SEQ ID NO: 160088 - protein, 211 aa, Heterodera glycines
  Homolog annotation: Hit_ID=CAA52290.1; Match level="QueryCoverage =97%, HitCoverage=100%, E-value=1e-102, Identity=94%"; Hit description=polyubiquitin [Volvox carteri] pir||S40611 polyubiquitin 5 - Volvox carteri
  Coding regions on vcDNA: vcDNA=SeqID_86511; Strand=+; Position=3-638
IENVKAKIRTRRASTGPQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKNCIDE

SEQ ID NO: 160089 - protein, 100 aa, Heterodera glycines
  Homolog annotation: Hit_ID=NP_570940.1; Match level="QueryCoverage =93%, HitCoverage=58%, E-value=2e-12, Identity=44%"; Hit description =keratin associated protein 16-1 [Mus musculus] gb|AAK52889.1| keratin-associated protein 16.1 [Mus muscul
  Coding regions on vcDNA: vcDNA=SeqID_86512; Strand=+; Position=21-323
LHRLYPSYSGQYGNYGGYNYGNYYNPYGGNSRGYYGMYDSPSYGSGYSPSYYGGYYGRNGGLGYGGMYPGYGGYSTASYYGGWPYTAGYGAQNGYTSPWR

SEQ ID NO: 160090 - protein, 83 aa, Heterodera glycines
  misc_feature (29)..(29): Xaa can be any naturally occurring amino acid
  misc_feature (37)..(37): Xaa can be any naturally occurring amino acid
  Homolog annotation: Hit_ID=AAL78224.1; Match level="QueryCoverage =93%, HitCoverage=36%, E-value=1e-31, Identity=86%"; Hit description =hypothetical protein Hgg-30 [Heterodera glycines]
  Coding regions on vcDNA: vcDNA=SeqID_86513; Strand=+; Position=2-251
RLAAMLMQNPAGLMGTMYAPASGGFFLPXAIQNQRAXAVHANTESVRGTNAWRCPSLEQYGRFQPSNARLHDGSSCWRSVRRC

SEQ ID NO: 160091 - protein, 159 aa, Heterodera glycines
  Homolog annotation: Hit_ID=NP_085133.1; Match level="QueryCoverage =93%, HitCoverage=18%, E-value=7e-53, Identity=65%"; Hit description =chromosome 17 open reading frame 28 [Homo sapiens] gb|AAH35372.1| Chromosome 17 open reading frame 28 [Ho
  Coding regions on vcDNA: vcDNA=SeqID_86514; Strand=+; Position=4-483
MEESVESKRTSEQNQTQQEVEQLKQLENREEGAKNGQQTNETVAIEEEWTPTSEWVESWKKKLPLQTIMRVLQILVPQVEKICIDKGLTDESEILKFLQHGTLVGLLPVPHPILIRKYIANSATNNWFRTYLWGVVYCRNIDPPIWFDSNVTLFEIQRL

SEQ ID NO: 160092 - protein, 220 aa, Heterodera glycines
  misc_feature (216)..(216): Xaa can be any naturally occurring amino acid
  Homolog annotation: Hit_ID=NP_495985.1; Match level="QueryCoverage =97%, HitCoverage=87%, E-value=1e-69, Identity=56%"; Hit description =DNA segment Chr 7 ERATO Doi 743 expressed like (2J613) [Caenorhabditis elegans] emb|CAA87776.1| Hypotheti
  Coding regions on vcDNA: vcDNA=SeqID_86515; Strand=+; Position=5-664
RSFDLYLRFPELKPVERAHFRYPQTIDDAKRLGRVLIRYKDLLFYTVLSGVAAIYKIRSPFAIPVFIFLTILSGYLFSFPLALALVCLCSAAGATVCYFLSQMFGRSLVMYYFPEKLSKWQIEVQKQADNLFNYIVFLRVTPILPNWFINLASPIVDVPILPFFFGTLAGVAPPSFLFIQAGTTLQMMSNANVVWSWGSIALLAFFAALSLAPILXKYLK

SEQ ID NO: 160093 - protein, 114 aa, Heterodera glycines
  Homolog annotation: Hit_ID=CAD38524.1; Match level="QueryCoverage =99%, HitCoverage=63%, E-value=1e-35, Identity=67%"; Hit description =putative glutathione peroxidase [Globodera rostochiensis]
  Gene Ontology: Mol. function=glutathione peroxidase activity; Cellular component=cytosol; Biological process=establishment and/or maintenance of chromatin architecture
  Coding regions on vcDNA: vcDNA=SeqID_86516; Strand=+; Position=1-342
SSCSAVPSDPQQKSFYECSAKDMDGNETCFGKYRGEVLGVVNVALNCGFTDFNYSQLKHVLDKYKWNGLEIVALPRNQLNNQELGCAIDIKDFVTKKYNFEPDLYNKIDVNGPN

SEQ ID NO: 160094 - protein, 157 aa, Heterodera glycines
  Coding regions on vcDNA: vcDNA=SeqID_86517; Strand=-; Position=60-533
ANSVHPNAIPLRRINLAWPPGGRRTSRSTAKAPSSIAGTGRSMNSAKTFLARAIVSGLETTWLIVLSRRTSSTLNLLITGAMFNLSSKCAVCDCSDPNHGKFSPVYQPLSGKDKHADFASVARVQPRTSKGITDLLLLNFVRLNTENPSKKLCPQKQ

SEQ ID NO: 160095 - protein, 105 aa, Heterodera glycines
  misc_feature (6)..(6): Xaa can be any naturally occurring amino acid
  Homolog annotation: Hit_ID=CAE62725.1; Match level="QueryCoverage =95%, HitCoverage=22%, E-value=2e-38, Identity=71%"; Hit description =Hypothetical protein CBG06885 [Caenorhabditis briggsae]
  Gene Ontology: Mol. function=enoyl-CoA hydratase activity; Cellular component=mitochondrial membrane; Biological process=fatty acid beta- oxidation
  Coding regions on vcDNA: vcDNA=SeqID_86518; Strand=+; Position=2-318
IDVFEXHEAFAGQVLANLKALDSDWFCQNYMKRKAKFGLLPLEKVNMWGGSLSLGHPFGATGVRLLAHAANRLQSEGGRFAVIAACAARGHGMGMLVENYESKQK

SEQ ID NO: 160096 - protein, 138 aa, Heterodera glycines
  Homolog annotation: Hit_ID=AAO33474.1; Match level="QueryCoverage =100%, HitCoverage=100%, E-value=3e-72, Identity=98%"; Hit description=gland-specific protein g4g12 [Heterodera glycines]
  Coding regions on vcDNA: vcDNA=SeqID_86519; Strand=+; Position=12-428
MPNIFKILLIVLLAVVSFRLSASTGDKKTANDGSGNNSSSGIGTKIKRIVTAGLLFTSLATGGAEAIGRSNAQGGSAAGLVPSHVTNRSMAPPPPPVQFEMGANRLEKMRAHLRELAEKMPVNESKRLSPSGPDPHHH

SEQ ID NO: 160097 - protein, 176 aa, Heterodera glycines
  Homolog annotation: Hit_ID=NP_491131.1; Match level="QueryCoverage =81%, HitCoverage=35%, E-value=1e-31, Identity=48%"; Hit description =predicted CDS, tyrosinase family member (1D831) [Caenorhabditis elegans] gb|AAK21515.1| Hypothetical prot
  Coding regions on vcDNA: vcDNA=SeqID_86520; Strand=+; Position=1-531
GFIDSIWEHWRQNKQSRLQRETDFPRNDAACAPRWHFSEEFMPMLQPLWNIDVLSNNYTDNMYEFMPRPSCARTGKSEECGSSDYLWCDSRTNGGHAVCTSKIKPGGNCAGFEWSAEVCYGGSQCVEGRCTKAKTMDKENDEGKAKKMDDDGTAFMRGGAERGDGWHSTISFMKKR

SEQ ID NO: 160098 - protein, 170 aa, Heterodera glycines
  Homolog annotation: Hit_ID=AAL78214.1; Match level="QueryCoverage =85%, HitCoverage=74%, E-value=5e-39, Identity=50%"; Hit description =putative esophageal gland cell protein Hgg-20 [Heterodera glycines]
  Coding regions on vcDNA: vcDNA=SeqID_86521; Strand=+; Position=163-672
MDQIGCSFSDQIWLDTLAWIGRGEVGWHLALVNARFAALVNMQLQQRRWCLEEFHISERKPKRTGAEVLSLANNGSYFSLPLATSPLPDSVIGFNGTFNIWYLDAEVINFLQRFRRLFNTYISLKFTIPITEFRAWQAVAPHIWPLLKNGLGTLVNVKRKQLALMRKHIS

SEQ ID NO: 160099 - protein, 221 aa, Heterodera glycines
  misc_feature (16)..(16): Xaa can be any naturally occurring amino acid
  Homolog annotation: Hit_ID=AAH50420.1; Match level="QueryCoverage =98%, HitCoverage=22%, E-value=9e-72, Identity=63%"; Hit description =Methylenetetrahydrofolate dehydrogenase 1 [Homo sapiens]
  Gene Ontology: Mol. function=methylenetetrahydrofolate dehydrogenase (NADP+) activity; Cellular component=cytoplasm; Biological process =nucleobase, nucleoside, nucleotide and nucleic acid metabolism
  Coding regions on vcDNA: vcDNA=SeqID_86522; Strand=+; Position=9-670
KPSLVGDVNFEEAKRXAGFLTPVPGGVGPMTVAMLVRNTFLQAVCQKLNGRVEPDGTVKSRAVNAWKLYPLKLDLSSPVPTDIDISRAQQPKAIGRLAAEVGIAQSELELYGHSKAKVSLAVLNRLKERPNGMYVVVAGINPTPLGEGKSTTTVGLAQSLCAHLGRNTFACMRQPSHGPTFGIKGGAAGGGYSQVIPMEEFNLHLTGDIHAISAAHNLMAA

SEQ ID NO: 160100 - protein, 107 aa, Heterodera glycines
  Homolog annotation: Hit_ID=NP_495651.1; Match level="QueryCoverage =70%, HitCoverage=72%, E-value=1e-19, Identity=52%"; Hit description =putative protein (12.5 kD) (2I146) [Caenorhabditis elegans] emb|CAA85335.1| Hypothetical protein T09A5.7
  Coding regions on vcDNA: vcDNA=SeqID_86523; Strand=+; Position=6-329
MSLQHHQCIAIEKQQRSEHFMSSVFEECDALKQEYDKCFLNFFKTFVKEDERHERTVNPCQQLQNIYHKCLEKNLKTHKPYDIDLDELKKEVSISIEENIDWKQRGN

SEQ ID NO: 160101 - protein, 153 aa, Heterodera glycines
  Homolog annotation: Hit_ID=CAE68757.1; Match level="QueryCoverage =84%, HitCoverage=12%, E-value=3e-21, Identity=43%"; Hit description =Hypothetical protein CBG14691 [Caenorhabditis briggsae]
  Gene Ontology: Mol. function=protein binding; Cellular component =cytoplasm; Biological process=negative regulation of cell proliferation
  Coding regions on vcDNA: vcDNA=SeqID_86524; Strand=+; Position=2-460
AEPLSRGSPPEGFGPPPPVPTHQQSFGESEAVKELEQMPGVRRMDLIKVESDGIHKGLGFSIAGGTGNQHYPGDDGIFVTRIIKGTPAYYDGRLQKGDQILAVDNTIFKNVSHQFAVDTLTNTGDRVKILFLKNPHPDIESFGGMEGNTFDLT

SEQ ID NO: 160102 - protein, 139 aa, Heterodera glycines
  misc_feature (50)..(50): Xaa can be any naturally occurring amino acid
  Homolog annotation: Hit_ID=CAE75369.1; Match level="QueryCoverage =87%, HitCoverage=17%, E-value=3e-25, Identity=48%"; Hit description =Hypothetical protein CBG23353 [Caenorhabditis briggsae]
  Gene Ontology: Mol. function=structural constituent of cytoskeleton; Cellular component=spectrosome; Biological process=actin cytoskeleton organization and biogenesis
  Coding regions on vcDNA: vcDNA=SeqID_86525; Strand=+; Position=29-447
KNGDCKHLGDKKVIFLRNHGFAACGASVEEALHLAYHTLIACETQVSAMXGGRKNLIYPNEIAKKRAYDIAQHGANGMNRTASGQNGTMAHTYEKMGDIEWGVGELEWEAWVRQLDGAGYQTGHKYQMPSLLEAVMKGK

SEQ ID NO: 160103 - protein, 184 aa, Heterodera glycines
  Homolog annotation: Hit_ID=NP_504820.1; Match level="QueryCoverage =86%, HitCoverage=25%, E-value=3e-24, Identity=38%"; Hit description =predicted CDS, UDP-glucoronosyl/UDP-glucosyl transferase family member (5H645) [Caenorhabditis elegans] g
  Gene Ontology: Cellular component=membrane fraction; Biological process=lipid metabolism
  Coding regions on vcDNA: vcDNA=SeqID_86526; Strand=+; Position=12-563
PHAHFGRIVATYASPTSSQFPDYVFIWKLDAESAANESELIKATPNVHTFEWVPQNAILRHPKLRAFVTHCGQNSLAEAAKIGVPIVGIPLFGDQLYNAVLAKHRGMAVHVGIRQLIADKTGKVLRTALSRVLHDASFRANAKLIQKKIALSPFGAKEQLVRWVEFAAEFPHLNELNMPTDYYS

SEQ ID NO: 160104 - protein, 207 aa, Heterodera glycines
  Homolog annotation: Hit_ID=AAR82779.1; Match level="QueryCoverage =98%, HitCoverage=68%, E-value=5e-20, Identity=31%"; Hit description =LD31436p [Drosophila melanogaster]
  Gene Ontology: Cellular component=synaptic junction; Biological process=protein targeting
  Coding regions on vcDNA: vcDNA=SeqID_86527; Strand=+; Position=40-660
TTGCPHARPALVNAILNRHIETAIFLLEKGADPHQTMIGQLNGLNMNVTPLWAAVVFVNLELCRALIAHGANIEMGTDSGHSPLLCACFNGNLEIATFLVENGANANLADTDGMTPLIVTSFSGQIDIVRLLLSHGAIVEQTDFTGMKFALLGAAIGARLEVCRLLVDEWAADVNQETIDGTTPLLGASGEGHVDVGEEKMNFLIER

SEQ ID NO: 160105 - protein, 98 aa, Heterodera glycines
  Coding regions on vcDNA: vcDNA=SeqID_86528; Strand=+; Position=3-299
RFASEMSFVEHFNLVNGRTNERLTLEKEGNYCLLKRCPNGPNVGETAAAVQWENGGNSDANLNNVIIILDGVERIWPLSALEEEEAGQSSEKGTSSDK

SEQ ID NO: 160106 - protein, 91 aa, Heterodera glycines
  Coding regions on vcDNA: vcDNA=SeqID_86529; Strand=-; Position=2-274
SVGHSFVINQITTQNLSHCFASLPPLAHLRHQLKSPPPPGCKIVPLEKPSVKLNWRFSRGDKAAKDKNGRRRSRNRKRKKRRMGEGIGGLI

SEQ ID NO: 160107 - protein, 196 aa, Heterodera glycines
  Homolog annotation: Hit_ID=NP_504313.1; Match level="QueryCoverage =92%, HitCoverage=43%, E-value=1e-10, Identity=26%"; Hit description =predicted CDS, UDP-glucoronosyl/UDP-glucosyl transferase family member (5F376) [Caenorhabditis elegans] g
  Coding regions on vcDNA: vcDNA=SeqID_86530; Strand=+; Position=1-588
LIKDLSRTCISYSGKIVRRCKSFVRNTTPLLDYDIGSLPKRVKFIGGIDLMQPDHKDALPQVFGQPKPVIVFSMSSLLEPSKMPLDKFETVIRGLGVCEKEVIWKYAKQEDHGRMSLLQKHAPNVHLVEHYDQATVIGNKKTELVISECDIRIVMDALSSGKALLCLPMFAEQFYVSEKLRRMGAAVVLDPRSGSF

SEQ ID NO: 160108 - protein, 251 aa, Heterodera glycines
  Coding regions on vcDNA: vcDNA=SeqID_86531; Strand=+; Position=6-761
EGSVRTFQLLDSLCNPNAFKRRPDALFAPKRIGGMDVAAVSFLDSLNLTEENISKEAISRFSKEVYKMSAIQLSQLLKATSNRKIEHPVLINHICTALKDRPLPPSLRHICQIAFYLSKHSFLDKPLLNRIKEDFLVYVRNEIISKTSFSHIVIAFAFFRLTDRHFWQQIIQIIETLANRPEYSTALIECVNSLAVVNVHPKLVSSVVEKTKSLEKDGLFLGKWLQLVHSLAILNSLDSQMAESVLNRNFF

SEQ ID NO: 160109 - protein, 99 aa, Heterodera glycines
  Coding regions on vcDNA: vcDNA=SeqID_86532; Strand=-; Position=432-731
TNPIFLNDNSIELTPICFVRISLPNLPFSHYLPVDSALKGAPTAVHQKDEHLSNSDSLQFPQQVLNRCEDGPNKNDFQCRNISVQNEKTSVRQRKMRRE

SEQ ID NO: 160110 - protein, 120 aa, Heterodera glycines
  Coding regions on vcDNA: vcDNA=SeqID_86533; Strand=+; Position=78-440
FSLLNKSRPPELTHCVLTSNQLQFPPRPRKRTSFSRRIKMRTISRSLCLERRRKRPFSKGRRRKSKGTKSNGGKCQRNDGKGGETIATTETSDGGEEDVVIRTEKHFGGRFAAEREQFGG

SEQ ID NO: 160111 - protein, 51 aa, Heterodera glycines
  Coding regions on vcDNA: vcDNA=SeqID_86534; Strand=+; Position=36-191
FRTPDKFPLPHRVNSKRRNMTPLRHSVRELILCRERNDTTCLSDLLIKVLC

SEQ ID NO: 160112 - protein, 133 aa, Heterodera glycines
  misc_feature (103)..(103): Xaa can be any naturally occurring amino acid
  Homolog annotation: Hit_ID=AAO85456.1; Match level="QueryCoverage =100%, HitCoverage=100%, E-value=1e-71, Identity=99%"; Hit description=putative gland protein G18H08 [Heterodera glycines]
  Coding regions on vcDNA: vcDNA=SeqID_86535; Strand=+; Position=21-421
MAFLLLSLAPLFVALSGIDANKVPLQLCCAGGQSLAGLIYDYSDHFSEVLQQSGTEMCTSLKKDMTKLTTAIEKAEGCKCNLVEKIEKELDDVEDDCAYNLSXHSRTVPHCGHGLGTFGRKLELRSGRVQRAN

SEQ ID NO: 160113 - protein, 136 aa, Heterodera glycines
  Homolog annotation: Hit_ID=CAE64901.1; Match level="QueryCoverage =98%, HitCoverage=16%, E-value=2e-33, Identity=52%"; Hit description =Hypothetical protein CBG09716 [Caenorhabditis briggsae]
  Gene Ontology: Mol. function=DNA ligase activity; Cellular component =nucleus; Biological process=DNA replication
  Coding regions on vcDNA: vcDNA=SeqID_86536; Strand=+; Position=3-413
DEDLKSQFKEFQELRIDKPRSYFAFDPSLAPDHWFEPSVVWEVKAADMSISPRHLAARGLVDAEKGISLRFPRFIRNRADKKPENATSSEQIAEMYRNQDHIKNQKDGKVDFDEEEEGEEKKEEADDEKEEEEDEQ

SEQ ID NO: 160114 - protein, 200 aa, Heterodera glycines
  misc_feature (16)..(16): Xaa can be any naturally occurring amino acid
  Homolog annotation: Hit_ID=NP_495449.1; Match level="QueryCoverage =100%, HitCoverage=51%, E-value=4e-73, Identity=62%"; Hit description= cystathionine gamma-lyase (43.1 kD) (2H346) [Caenorhabditis elegans] gb|AAB93432.1| Hypothetical protein
  Gene Ontology: Biological process=sulfur amino acid metabolism
  Coding regions on vcDNA: vcDNA=SeqID_86537; Strand=+; Position=28-626
LTELANLEKEFKPNQXMVWFETPSNPLLKVIDIEAVCRAVRSRSKECIIVVDNTFMTPYFQRPLELGADVVMHSLTKYINGHTDVLMGAMVTNNDQLDQHLKSQQITAGAVPSPFDVYLVIRGIKTLHLRMRQHMENALAVARWLEKDPRVEKVLYPELESHPQHKIHKKQSSGMSGMVSFYMRADADGARKFLANLKLF

SEQ ID NO: 160115 - protein, 228 aa, Heterodera glycines
  misc_feature (195)..(195): Xaa can be any naturally occurring amino acid
  Homolog annotation: Hit_ID=AAP30755.1; Match level="QueryCoverage =96%, HitCoverage=96%, E-value=1e-115, Identity=94%"; Hit description= putative gland protein 29D09 [Heterodera glycines]
  Coding regions on vcDNA: vcDNA=SeqID_86538; Strand=+; Position=3-685
NKLFFACLLCCSHLPIVFLVCCNAMPNFPCCPGSQQVVAVMSKYIDTFSSAADESTVCSTAKSTVDGIKNELSYRVGCPSGGEAQIVNEIDRQLKNIAKMEINYEDECPYNLGFARAMFDLAAAAAGHAGNGTEWQYMKVQFEQESQAIKAIGQEKNFEVTDVHFGVPSKGVSAHQNVPSPSHVIANPGQHSSVXPRKERRTVVIGLRFLRTNKSGGNRIENHFVDMS

SEQ ID NO: 160116 - protein, 173 aa, Heterodera glycines
  Homolog annotation: Hit_ID=CAB38312.1; Match level="QueryCoverage =95%, HitCoverage=24%, E-value=4e-32, Identity=46%"; Hit description =molybdenum cofactor biosynthesis enzyme [Arabidopsis thaliana] gb|AAA97413.1| molybdenum cofactor biosynth
  Gene Ontology: Biological process=establishment of synaptic specificity at neuromuscular junction
  Coding regions on vcDNA: vcDNA=SeqID_86539; Strand=+; Position=24-545
MDFAVLVVSDSSDKDHKMDKSGPLLVELLQNSLLIRRGQKVTVANYTIVPDEKSKIVEYLREYSTKVDCILTSGGTGFSKRDVTPEATKEVIERECPGIAVALLKKGLDITPFAALTRLTAGIAANCLIINLPGSPKAVREGFEVIEPILSHAIAIVKGDESETSVLHKRTAL

SEQ ID NO: 160117 - protein, 232 aa, Heterodera glycines
  Coding regions on vcDNA: vcDNA=SeqID_86540; Strand=+; Position=2-697
HDPYKKKSREPPATNKKDVKKDTTKNLEQAQKTTNEMTITPNYKNGKAEEKAAVCTNLEEVQEKTNELSLKDKRETTQDIPKQTVPTVSAVGPSKMNFVGCLASVYPTNSSDIYQGKIMSVDVKGHSVRLEKPFLNGRPMSVPFIDMSGKMMKDIRVVRGPSPVRFHCVENSPINGRHSTGSVPSIRRPSPADSVRSEHTKRKRLSPLIVSSTYSPIAATPSTRCAPLNHQT

SEQ ID NO: 160118 - protein, 232 aa, Heterodera glycines
  misc_feature (29)..(29): Xaa can be any naturally occurring amino acid
  Homolog annotation: Hit_ID=NP_509684.1; Match level="QueryCoverage =96%, HitCoverage=35%, E-value=9e-49, Identity=41%"; Hit description =predicted CDS, sorl mouse sortilin-related receptor like (XK654) [Caenorhabditis elegans] emb|CAA96700.1|
  Coding regions on vcDNA: vcDNA=SeqID_86541; Strand=+; Position=2-696
DRFPPQQLRVDGTHFLLGNLVAGENFEFXIRTALDAERISSAAAIVEIAIPSDSDLVEVGKLIVTSRFRPDGNGVVNLTWEVPQHLLGKIQSYEMRYLEAARAQSVAMPFWERLFFPGTAPTAEIYNMKPDTEYVLRIRTTMESRVQVESAEFRFRTPKSAGANPIARLDVLYSSETPAVRLQWILAPHINAVLVGGFDVFFTDRYDLAESEWTHRRIHGNDPQLSLDSLSP

SEQ ID NO: 160119 - protein, 187 aa, Heterodera glycines
  Coding regions on vcDNA: vcDNA=SeqID_86542; Strand=+; Position=65-628
KNTPSCCSSSFSIDKLIFVPINPNGNEKLVKLIDFDRAQIIRICNNSEPCNEIEEEPAIMADTTTIIHSTLDIGKYSSPEIFVGNKQLSVKVDIWSFGISVYEAILVAKDKYGKKEEIPNVLNSIATLHRGFAIDQNGLKSEEINFNNNDWLQFSSGFKLAVKAILKIWKDQPKIALLIMVFSVFHF

SEQ ID NO: 160120 - protein, 235 aa, Heterodera glycines
  Coding regions on vcDNA: vcDNA=SeqID_86543; Strand=+; Position=2-709
VVCTSLKKDDEHAETVLFEMPELKRVIFVQIGGTSDDAPPMCLEVLNCCFGSESTSKLAAMSAAKINQIFWEFFVSFPVAFLSANSRWTVFSSFDAHFYVLSTQTGRLQFELCLDEPLSVLELEQNLCLSVGIAGSFALWDLLNGKVLARHSLKELLGDQNKHLLASAFSLRKNEKETNSTSIFLELLFSDFNSFAFSSKLGGWNKAQTVFDFVNEEKMSPNISSMLLQMPNSSD

SEQ ID NO: 160121 - protein, 192 aa, Heterodera glycines
  Homolog annotation: Hit_ID=AAC47118.1; Match level="QueryCoverage =76%, HitCoverage=24%, E-value=2e-09, Identity=30%"; Hit description =hemomucin
  Coding regions on vcDNA: vcDNA=SeqID_86544; Strand=+; Position=3-581
EEGSGDGHSAEGSGSAPTDEFGRQTPNESVAITDTRSPAQFGDSDRRPQYANTTTTVIHLHNLSPVSVLSTTRATPPIFATTTTTIMLATTLRPPSMKPAATTARTTTTLPSSVSSRASSPKTATTTVPRMIKPKDKDKWPQPLPKSTMPPFAPTRTTKRPFSFRTLPALWNNFGPAFSPSLSAELWLDCFC

SEQ ID NO: 160122 - protein, 190 aa, Heterodera glycines
  Homolog annotation: Hit_ID=AAV27340.1; Match level="QueryCoverage =79%, HitCoverage=58%, E-value=9e-18, Identity=36%"; Hit description =Hc38 [Haemonchus contortus]
  Coding regions on vcDNA: vcDNA=SeqID_86545; Strand=+; Position=41-610
KKAGKCLEDALLHFPFVLAQLLDRLQVQPDSAVDFNSYLGSTAIYRETVGSRLLAHIYVHHTAEELWRPNLAWLERATHLALPRLMKRQKEMDEWALNRKRCFVGLPPNLLRHCVLHGIRPSDVQLRQLLDEQSGPNTVVDPCPPKDNRRQRYEPANLDDLLQLHGLNVEDSPAMDGALHGVGTFLRTLL

SEQ ID NO: 160123 - protein, 213 aa, Heterodera glycines
  Homolog annotation: Hit_ID=NP_491034.1; Match level="QueryCoverage =91%, HitCoverage=51%, E-value=3e-33, Identity=41%"; Hit description =putative cytoplasmic protein of eukaryotic origin (37.0 kD) (1D303) [Caenorhabditis elegans] gb|AAF36018.
  Coding regions on vcDNA: vcDNA=SeqID_86546; Strand=+; Position=15-653
MPTVRCALTFGSPYGASLPLNTVSHAFAYGSGAIPQREEDPNTKMVDFLIVCNDSLLFHQQNLLQYVSIALLGLSSLHQFNLQRNPSHYSLPFRWFDANWVNQMQRLSGARLYYNTRISTQGRLIKYGIIQEDDLETDLLDWTWLYAAGRLQKPVLEVYNGRGETSDVQRTGRNIGRALFDNYRAAAHAALLQLDGWFTMDQFLNKVVSISYG

SEQ ID NO: 160124 - protein, 231 aa, Heterodera glycines
  misc_feature (216)..(217): Xaa can be any naturally occurring amino acid
  Homolog annotation: Hit_ID=NP_495557.1; Match level="QueryCoverage =94%, HitCoverage=15%, E-value=8e-13, Identity=26%"; Hit description =zn-finger, CCHC type and RNA-directed DNA polymerase  and Integrase, catalytic domain containing protein
  Coding regions on vcDNA: vcDNA=SeqID_86547; Strand=+; Position=26-718
YLELGLPFPREVICNKCGRKGHIAKICRNQNNTPQHSGFKYSRTGSNKQNANIIDCLHIMPSDWKTENEPYIERHVRLNGKVHKMVVDSGSKLTIVRKLIWVKLGQPFLTETKLKGRSFTGNIFTFMGKFKVQAALDDGMPLDLECFVIDSRDTLDLMGLPWIRAFERAYNQVVATTLSIENVADSRWCNRSNSTSTQFEMDLQNTFPKIFEETLXXCTKIRAHLKIKENS

SEQ ID NO: 160125 - protein, 208 aa, Heterodera glycines
  Homolog annotation: Hit_ID=NP_498540.1; Match level="QueryCoverage =90%, HitCoverage=58%, E-value=2e-79, Identity=73%"; Hit description =tissue specific transplantation antigen p35B like (3I150) [Caenorhabditis elegans] gb|AAA50647.1| Hypothe
  Gene Ontology: Mol. function=racemase and epimerase activity, acting on carbohydrates and derivatives; Biological process=L-fucose biosynthesis
  Coding regions on vcDNA: vcDNA=SeqID_86548; Strand=+; Position=35-658
VNGRKKHNESGGEAAAAIRVLVTGGTGLVGSAIRQVVTEEEQQRKPQRLQEQWFFVGSSECDLTDLEQTRVLFRRVRPTHVVNLAAMVGGLFHNLRHNLQFFVKNLAICQNVLQCCHETDVERCVSCLSTCIFPDKTPYPIDETMVHNGPPHDSNFGYSYAKRMTDVLNRGYAQDHNRKYTSAVPCNVFGPHDNFNLENAHVVPALIH

SEQ ID NO: 160126 - protein, 93 aa, Heterodera glycines
  Homolog annotation: Hit_ID=ZP_00357698.1; Match level="QueryCoverage =30%, HitCoverage=18%, E-value=8e-10, Identity=93%"; Hit description =hypothetical protein Chlo02002738 [Chloroflexus aurantiacus]
  Coding regions on vcDNA: vcDNA=SeqID_86549; Strand=-; Position=2-280
LFFFFFFFFTFFFFFFFFFFFFFFFFFFNTTTLINKSEIQVVSFLSLHKMSSRTLCRERSHIASLGIHTVRKRKFDLGVLKLLHPGTLQSATL

SEQ ID NO: 160127 - protein, 141 aa, Heterodera glycines
  Coding regions on vcDNA: vcDNA=SeqID_86550; Strand=+; Position=204-626
HSNSRKTAMAYATKYYDYQIAVVFAILLGGLLLLALVVTAIYYICVVNMRGKKGGITRVPSGRSTVRTRMNPQQYSPSAQPQIFHQQYPRYSPYGGMEGMSSQQTQQQQQQQHPFQAQNYEQAGVRVREMQPEYFQQQGPI

SEQ ID NO: 160128 - protein, 219 aa, Heterodera glycines
  misc_feature (26)..(26): Xaa can be any naturally occurring amino acid
  Homolog annotation: Hit_ID=NP_498984.1; Match level="QueryCoverage =100%, HitCoverage=38%, E-value=4e-64, Identity=55%"; Hit description= eukaryotic Initiation Factor (64.3 kD) (eif-3.D) [Caenorhabditis elegans] emb|CAA78049.1| Hypothetical p
  Gene Ontology: Cellular component=eukaryotic 48S initiation complex; Biological process=cell organization and biogenesis
  Coding regions on vcDNA: vcDNA=SeqID_86551; Strand=+; Position=1-656
YGTLHFYDKALMDKLSVKNPLHLEKXPASFYSLTTTEDPVFRKLSCNNVGNVFATDIILTTIMAANRSVNSWDIIAYRIGDKLFFDKRSTSGVSPIDAFWVSETAPDPPSGDAQGINNANDLASEALYVNQNFRRQVLKRDGKVFKFEEERIPFEDEQLGRTDCAYKYRTWNLGTMANGTAITLVARTEHDAVMLAGTSTKEVQKLTVKAFNEWDSSLS

SEQ ID NO: 160129 - protein, 152 aa, Heterodera glycines
  Coding regions on vcDNA: vcDNA=SeqID_86552; Strand=+; Position=9-467
QRKKTEEENGDEMTRSVCIGQINGNDQLLLISAAGHCSVAEYLNASSAAASLSPPALPPKPPRFRSFANFSDWPSPSAPSASPTDTLSQPKFGQHIQSPINLPDQTHPPEPIHHNSKPTEEERKRKKSKETEEDRGRKSDEEAEKRGKSPLH

SEQ ID NO: 160130 - protein, 208 aa, Heterodera glycines
  misc_feature (195)..(195): Xaa can be any naturally occurring amino acid
  Homolog annotation: Hit_ID=CAC70150.1; Match level="QueryCoverage =79%, HitCoverage=40%, E-value=4e-31, Identity=40%"; Hit description =hypothetical protein [Brugia malayi]
  Coding regions on vcDNA: vcDNA=SeqID_86553; Strand=+; Position=57-680
CPTNDHPVIGRQRCRLVRWPLQRHQIHSEDHSVVICDQIDVVVLDEKVLPQSLFPLNECCSFGRLKADQRFKLNAALSAHSEFSLKQCSTDKTVQMLVLWLLFWFKQRQIELILQQGLTPFSFWVAANIPMSLEMKLALLDEDSTDRRLRTAWRIVSQMDSIVCSNCAQSLCNVSDIVNLSTGSNSTLFTNSHGXVHDLFTIKKVSGI

SEQ ID NO: 160131 - protein, 222 aa, Heterodera glycines
  Homolog annotation: Hit_ID=XP_310525.1; Match level="QueryCoverage =98%, HitCoverage=29%, E-value=8e-75, Identity=59%"; Hit description =ENSANGP00000017297 [Anopheles gambiae]
  Gene Ontology: Mol. function=mannosyl-oligosaccharide 12-alpha -mannosidase activity; Cellular component=integral to membrane; Biological process=N-glycan processing
  Coding regions on vcDNA: vcDNA=SeqID_86554; Strand=+; Position=2-667
VRYAWGENELRPIAKIGHSGSVFGRAPVGATIIDALDTLYIMGMNKEFDQARDWVAQNFNLKESLSDLSVFETNIRFVGGLPSAYALTKDQMFLNKARDVADLLMPSFNAGPFGIPMSLINLRTGRTGNYGWASGGCSILSEFGSLELEFNYLSRLTGNLTYMSKCARVREYVIELQKPDGLYPNYLNPQTGKWCQKHVSVGALGDSFYEYLLKIWIFNGKR

SEQ ID NO: 160132 - protein, 175 aa, Heterodera glycines
  Coding regions on vcDNA: vcDNA=SeqID_86555; Strand=+; Position=1-528
KRWNNRLVHSHPATVQKNNILSDKLAAAQTIIGGLQPGQSDGAPQWANSLLGFCAEMVGICRELLSMVKEQQNDNMDTRETLEEERRLHSVVVENLPESEETVPSARVNSDFVDAQSMLDTCEIECRPCQKKTEAPPLSPPKSTQGKADEPPSDVFSSDNNMDYGTLKDFDPNRF

SEQ ID NO: 160133 - protein, 161 aa, Heterodera glycines
  Homolog annotation: Hit_ID=CAE56294.1; Match level="QueryCoverage =58%, HitCoverage=13%, E-value=8e-10, Identity=39%"; Hit description =Hypothetical protein CBG23946 [Caenorhabditis briggsae]
  Coding regions on vcDNA: vcDNA=SeqID_86556; Strand=+; Position=252-734
MANMFGAKLARCLLCGLTVYDKHLPTHRAIHRGDRPVDGHSVGGAFFCDLCGLAFRTRTNLIRHWRTGCSTIHANLPPNSDFALDDAGLKQMVVNLLKKLTAERKDSESFSESLDDEIGQPSTSHKHQIFHTEARDRTQIGVPAKAASKRCHDDQQQYQQT

SEQ ID NO: 160134 - protein, 84 aa, Heterodera glycines
  Coding regions on vcDNA: vcDNA=SeqID_86557; Strand=-; Position=1-255
RDRPPQLAPLMPPFCAALSSRIPSCHSYHKQHICTPLARMPLNSRRHVSLALQCQPAHRLVVMARHPLSDIGTRTLVHFVTAVL

SEQ ID NO: 160135 - protein, 206 aa, Heterodera glycines
  misc_feature (7)..(7): Xaa can be any naturally occurring amino acid
  misc_feature (84)..(84): Xaa can be any naturally occurring amino acid
  Homolog annotation: Hit_ID=CAE70203.1; Match level="QueryCoverage =100%, HitCoverage=21%, E-value=5e-46, Identity=47%"; Hit description= Hypothetical protein CBG16678 [Caenorhabditis briggsae]
  Coding regions on vcDNA: vcDNA=SeqID_86558; Strand=+; Position=1-618
TGRAGNXGWAYTFILPVGQEKIAGEVCRAFETADATPPEDLKKLWDDYKARMAAEGVEVYSGGGGYSGSGYRYDDMEDEIELNXRKMTKLVYGLESGMEDDVANIDSQLESVMKSSKRIVHCRAGATFRGGRADPSTEKKVEAARAMAERIAYEKLAQPTNQMEKDATHLTADAIMIRTEATTLTLSGISLAKQKATELNEKLNYL

SEQ ID NO: 160136 - protein, 192 aa, Heterodera glycines; identical to SEQ ID NO: 158772
  Homolog annotation: Hit_ID=AAO85459.1; Match level="QueryCoverage =100%, HitCoverage=100%, E-value=1e-113, Identity=100%"; Hit description=putative gland protein G20E03 [Heterodera glycines]
  Coding regions on vcDNA: vcDNA=SeqID_86559; Strand=+; Position=76-654

SEQ ID NO: 160137 - protein, 90 aa, Heterodera glycines
  Coding regions on vcDNA: vcDNA=SeqID_86560; Strand=+; Position=1-273
VRQSVTENGGRVPLVAGAKQRKAMPSEIGQQQKSQTNGKQKGHHFETAPLVRSNSQECVVMHKSESLEVMDSDQLAECFCFTTSHFFFCF

SEQ ID NO: 160138 - protein, 148 aa, Heterodera glycines
  misc_feature (122)..(122): Xaa can be any naturally occurring amino acid
  Homolog annotation: Hit_ID=NP_492694.1; Match level="QueryCoverage =100%, HitCoverage=36%, E-value=2e-72, Identity=88%"; Hit description= casein kinase gamma (46.4 kD) (1K804) [Caenorhabditis elegans] emb|CAB60309.2| Hypothetical protein Y106
  Gene Ontology: Mol. function=protein kinase activity; Cellular component=bud neck; Biological process=glia cell migration
  Coding regions on vcDNA: vcDNA=SeqID_86561; Strand=+; Position=274-717
MANARGPSSSTSTSTNASVGVLMVGPNFKVGKKIGCGNFGELRLGKNLYNNEHVAIKLEPMKSKAPQLHLEYRFYKLLGQTEGLPQVHYFGPCGKYNALVMELLGHSLEDLFDLCDRKFTLXTVCMTAMQLLRRIEYVHSKHLIYRDV

SEQ ID NO: 160139 - protein, 220 aa, Heterodera glycines
  Homolog annotation: Hit_ID=CAE73307.1; Match level="QueryCoverage =99%, HitCoverage=12%, E-value=4e-55, Identity=47%"; Hit description =Hypothetical protein CBG20734 [Caenorhabditis briggsae]
  Gene Ontology: Mol. function=electron transporter activity; Cellular component=DNA-directed RNA polymerase I complex; Biological process =electron transport
  Coding regions on vcDNA: vcDNA=SeqID_86562; Strand=+; Position=1-660
LDDAADYEGEEQDRNEAGIDEMERDEDNEEETTAPEGAEETTELDETEEAPTEGRGSEVNADRIKSVLESHAIIGGYEYDVHNEQWCTFKIHMPFLNKTRIDVLAIVEREIESFVLTQVRGIEKCNVREEQRNGRMVRVLQTQGINLGAFYAHADFLDINTIYSNDIDFMLRNFGIEGAARTISREMNNVFGVYGIEVNPRHLSLTADYMTFTGEVQPFS

SEQ ID NO: 160140 - protein, 179 aa, Heterodera glycines
  Homolog annotation: Hit_ID=NP_499756.1; Match level="QueryCoverage =75%, HitCoverage=67%, E-value=8e-18, Identity=35%"; Hit description =polyposis locus protein 1 family member (3O468) [Caenorhabditis elegans]
  Gene Ontology: Cellular component=membrane; Biological process =membrane organization and biogenesis
  Coding regions on vcDNA: vcDNA=SeqID_86563; Strand=+; Position=30-569
MSSDESTTSSASVVSVQLREVPIKDFKDVLPVLQKTLNELEHPFIKKAEEISGMEREKLFYITSSLVLLVLMLCPGNMLLSTLITVAYPMYASLLTLNTQNTSEYTQWLVYWCVFAEFCQFDYLFGSINGLLLLYVPLKTVFLLYLALPQTYGAHNLYVKHIRKVLAVTNVLDKMKKMF

SEQ ID NO: 160141 - protein, 112 aa, Heterodera glycines
  Coding regions on vcDNA: vcDNA=SeqID_86564; Strand=-; Position=65-403
MYKLNQAEKQTKTKERKEEKLIMETEKRRMWQIGERPSWQWSGHWKVGRSVESDPDGRLFVRTNGERMGRLLRNRRTAEGQRSSAGAAVFTHGKGRRVNESVANLIGSSVCQ

SEQ ID NO: 160142 - protein, 235 aa, Heterodera glycines
  Homolog annotation: Hit_ID=CAE71358.1; Match level="QueryCoverage =88%, HitCoverage=52%, E-value=1e-10, Identity=28%"; Hit description =Hypothetical protein CBG18261 [Caenorhabditis briggsae]
  Gene Ontology: Biological process=regulation of protein activity, epigenetic
  Coding regions on vcDNA: vcDNA=SeqID_86565; Strand=+; Position=33-737
MNYQQSVQQQLGGGMSAQQQQQQAVRHMQRPQNPASAAVPQNMSPNVAPSPQQQQQQMYQMPMYNHTNAGGTPFSPHNVYNQQMMTPQMASQQQFPPNAPATPATPQMSQSIGTPLSVHNIQQPGSVQPQQPGSVGMVATPAAPYSVGASTTGGPASNQPIAGPHSNPPAAQQATQTQPIGGASTQTEFDPIGTAKLLILKDLRRAIVNLNQFAEKALDSCSNPTHCLQSLQSVA

SEQ ID NO: 160143 - protein, 93 aa, Heterodera glycines
  Homolog annotation: Hit_ID=CAE60841.1; Match level="QueryCoverage =95%, HitCoverage=19%, E-value=6e-10, Identity=33%"; Hit description =Hypothetical protein CBG04550 [Caenorhabditis briggsae]
  Coding regions on vcDNA: vcDNA=SeqID_86566; Strand=+; Position=2-283
RRGPKMMEAFVTRRKELEDEFQKRKDQYSKEMQQRVSKKEAELKHHEEILNIRHTEIDNTYQNELKLVEAQINGLIEEKAKLEIKLKKQQRSK

SEQ ID NO: 160144 - protein, 146 aa, Heterodera glycines
  Coding regions on vcDNA: vcDNA=SeqID_86567; Strand=+; Position=203-640
WKKTTGGSLQIVLKSILCAMAPLLRIGLFAVDIFAIIGSHFYAHLSSDSSLSVITKSPDFNDAAEFVATFKSMTDASADVLDKISNIGNGAFTLLKFAGPIGQMVHIGLSIGLKQQDSPELRAIQALQRQITEQFEALSRKIDDSI

SEQ ID NO: 160145 - protein, 194 aa, Heterodera glycines
  Homolog annotation: Hit_ID=CAE59495.1; Match level="QueryCoverage =87%, HitCoverage=46%, E-value=9e-34, Identity=42%"; Hit description =Hypothetical protein CBG02880 [Caenorhabditis briggsae]
  Gene Ontology: Mol. function=protein tyrosine kinase activity; Cellular component=kinetochore microtubule; Biological process =protein amino acid phosphorylation
  Coding regions on vcDNA: vcDNA=SeqID_86568; Strand=+; Position=44-625
MLQAHQYQLRQGHRRVSARSILAHFGFEFSNDYRLGCGHYSKVYRGYFKEAQRTFAIKVTDLESVSEKFKQKFLPRELEVWRELDHPNLVYLYNDFQWSDYQFVVMELAVGGDLLSFLQKCGPVSETTCHNWMLQIVAALDYLHRKGIAHRDLKLENVLLCENGVIKVTDYGFSKQSSDLSSTFCGSRSYSSPE

SEQ ID NO: 160146 - protein, 231 aa, Heterodera glycines
  Homolog annotation: Hit_ID=AAH32919.1; Match level="QueryCoverage =73%, HitCoverage=33%, E-value=8e-21, Identity=36%"; Hit description =FLJ10826 protein [Homo sapiens]
  Coding regions on vcDNA: vcDNA=SeqID_86569; Strand=+; Position=3-695
VCSRADNSWHSVSEVLSEQKQRLSLNGWFHYAPGTANVAQTGPNCAVEEPICRVEPSMNITLAEVNEWLSPNYIRPGQHRQIKRIFAYKSELSLQQFLNNERYNKALDELEKAQFESVGPPHKRNVWRLVESSLEQNSVLQSLLRLFRSEAITLLLTQWTGLHLYDLKTKRGTAHSPNGAKRAAEPPKKRKRADEEEEGTTSGGLKQGGKADRCGESEDTNVRIASFIHRF

SEQ ID NO: 160147 - protein, 99 aa, Heterodera glycines
  Coding regions on vcDNA: vcDNA=SeqID_86570; Strand=+; Position=136-432
RTVQLRHIHSLLATFKFCDSSPKFGRVHRAEKSRGSEKEQCKAQTTINVLRWTRVFGFLNNNNSRSFSAFILVSIFICYFISFHLYKFLLGRKKKKKKK

SEQ ID NO: 160148 - protein, 85 aa, Heterodera glycines
  misc_feature (20)..(20): Xaa can be any naturally occurring amino acid
  Homolog annotation: Hit_ID=XP_227769.1; Match level="QueryCoverage =84%, HitCoverage=56%, E-value=5e-17, Identity=64%"; Hit description =similar to Ac1147 [Rattus norvegicus]
  Coding regions on vcDNA: vcDNA=SeqID_86571; Strand=+; Position=1-259
SVMPLDVRGCTRATLAKSAXCPSPKGVGKPVKICRDWDRTLQLLSANDEFLVGASHQLALNTSLPFAHTARRCPGLSHFEKFRDG

SEQ ID NO: 160149 - protein, 32 aa, Heterodera glycines
  Coding regions on vcDNA: vcDNA=SeqID_86572; Strand=-; Position=74-172
CFSPRPPPPRPLSILRFVSCDLSSIASSHYGD

SEQ ID NO: 160150 - protein, 200 aa, Heterodera glycines
  misc_feature (141)..(141): Xaa can be any naturally occurring amino acid
  misc_feature (174)..(174): Xaa can be any naturally occurring amino acid
  misc_feature (182)..(182): Xaa can be any naturally occurring amino acid
  Homolog annotation: Hit_ID=CAE75053.1; Match level="QueryCoverage =99%, HitCoverage=26%, E-value=4e-57, Identity=55%"; Hit description =Hypothetical protein CBG22967 [Caenorhabditis briggsae]
  Coding regions on vcDNA: vcDNA=SeqID_86573; Strand=+; Position=2-602
TTVLDDMQYLVNLRPSGTPVIESMSMDFETWLVSFISDDQPFEYFLYKRSKKRADYLFTTRPELAGRPLSKMIGFDYSARDGLRIQAYLSLPPQTPLLSPAQVRGDKLELARQGMLPRRPQKLIVLVHGGPKSRDFLASRXINAWLTSRGYAVLQINFRGSVGFGKNLTNAGTXGAAEQNTXNLLDGVDFLVSNNIADRR

SEQ ID NO: 160151 - protein, 126 aa, Heterodera glycines
  Homolog annotation: Hit_ID=EAK90720.1; Match level="QueryCoverage =76%, HitCoverage=94%, E-value=2e-19, Identity=31%"; Hit description =hypothetical protein CaO19.63 [Candida albicans SC5314]
  Coding regions on vcDNA: vcDNA=SeqID_86574; Strand=-; Position=147-527
FCYCYCFFSFYFCYCYCFFSFYFCYCYCFFSFYFFFYFCFFSFYFCYCYCFFSSFCFFYYFFFFFFSFYFFFSSFRCFCFCCFFSFLCCFTCFLYFYFIFLHISLLFFWSAAFFRSITCEHCCRKQ

SEQ ID NO: 160152 - protein, 60 aa, Heterodera glycines
  Coding regions on vcDNA: vcDNA=SeqID_86575; Strand=-; Position=2-181
QVSNEPVQIAKESTILFTRAQLSENVQKSDVFLRSTTVCAKQRNGAVESLGKMKRCVRES

SEQ ID NO: 160153 - protein, 185 aa, Heterodera glycines
  Homolog annotation: Hit_ID=AAP30761.1; Match level="QueryCoverage =100%, HitCoverage=68%, E-value=1e-98, Identity=98%"; Hit description= putative gland protein G20G04 [Heterodera glycines]
  Coding regions on vcDNA: vcDNA=SeqID_86576; Strand=+; Position=28-582
MVCLVMAVLMEMANSKAVKKYNKKGAVAASPAKGKASPKGGKSPAKGKAAKKLKPKKDAKGIKAKKAKPAKKSKAAKAVKGAPKTVKKLAFAKTAAQVKEIKSPAKPMVLKAVPPHQMHLMNEKVQTAVSPPAHARSLATVPYSTPVAADRNSLPSYTSDGTNLDMAHENDDYQNYYYGTEDSSR

SEQ ID NO: 160154 - protein, 200 aa, Heterodera glycines
  Homolog annotation: Hit_ID=NP_490989.1; Match level="QueryCoverage =94%, HitCoverage=25%, E-value=6e-47, Identity=47%"; Hit description =probable atp-dependent RNA helicase Ddx10 (82.6 kD) (1D65) [Caenorhabditis elegans] gb|AAF60456.1| Hypoth
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_86577; Strand=+; Position=1-600
VLVFALAVAGSFHTETFTHLRPGLYFTGLWGDLKQSKRIERFNKFNAVDGGAAMVCTDVASRGLDFRGMDWVLQMDCPSTVDDYIHRVGRTARMNRKGEAMLMLTPSQEPFVALLRQRNVPVTKVTVDSNKVFDVRNKITNLMVPFPSVKQFAQQSLIAYAKALYFSELKEVFDVQSIDFDALSRSYGLVVTPRIRFLRK

SEQ ID NO: 160155 - protein, 185 aa, Heterodera glycines
  Coding regions on vcDNA: vcDNA=SeqID_86578; Strand=+; Position=10-567
MYLKDRLTGLISTGWQRYSHTTPLCELLPAGIPSLARQAIFVSQWMNKREERTDQFMQEFLNCSVRHSTSATKFVRKGFTFPFVFEFKFCDCQFPGVELYSEIEELNLLRWKAAIERYISSNETEKETQNELEKMEEEFRKLRKTIASLLGHFFYEDTVDEWLAQHDHLNRFNDDDLGLPPPNRL

SEQ ID NO: 160156 - protein, 222 aa, Heterodera glycines
  Homolog annotation: Hit_ID=CAE74248.1; Match level="QueryCoverage =91%, HitCoverage=46%, E-value=3e-58, Identity=53%"; Hit description =Hypothetical protein CBG21934 [Caenorhabditis briggsae]
  Gene Ontology: Cellular component=extracellular space
  Coding regions on vcDNA: vcDNA=SeqID_86579; Strand=+; Position=24-689
MLFSSSTVLLLLLIVLPFSLSFILIPQNVRQISPALSSRPFRRFGHFSVIAKRNPIVLIPGDGGSRLKANLTGKPSVVHYFCQRQTNDFFALWLDLQQFGPFVIDCWADNMRLNFNRTSGRAQDLEGVKVRVPGFGHTRTVEWIDSSKRSPSRYFAPIVASLAKLGYQRGIDVIGAPYDWRRAPEELLHYFVKLRSLIEQLYHANGNRKVIVLAHSMGNPMA

SEQ ID NO: 160157 - protein, 76 aa, Heterodera glycines
  Coding regions on vcDNA: vcDNA=SeqID_86580; Strand=+; Position=86-316
HLLQEARKANDQMLFVMKDKKLNSEDKVRKLEEWANTLPENVRGELRVRDLRELKQLVHLYNGLTPVLHQGIQGGI

SEQ ID NO: 160158 - protein, 133 aa, Heterodera glycines
  Coding regions on vcDNA: vcDNA=SeqID_86581; Strand=+; Position=1-402
APPLPSSAAVVLFRPVRRALPQSSMASAGWLPPGATVGCGGPPQQQQQQTISMMMMHQQQQNGIMVNGNGTVVGIGHLQQQQQYHQFIAANPGMVGATSLPQDLENVNAMPFDQSLLDLNDYEIAPDGQFDFP

SEQ ID NO: 160159 - protein, 187 aa, Heterodera glycines
  misc_feature (10)..(10): Xaa can be any naturally occurring amino acid
  misc_feature (142)..(142): Xaa can be any naturally occurring amino acid
  misc_feature (164)..(164): Xaa can be any naturally occurring amino acid
  misc_feature (167)..(167): Xaa can be any naturally occurring amino acid
  Homolog annotation: Hit_ID=AAL78216.1; Match level="QueryCoverage =98%, HitCoverage=55%, E-value=1e-104, Identity=96%"; Hit description= aspartic protease precursor Hgg-33 [Heterodera glycines]
  Gene Ontology: Mol. function=aspartic-type endopeptidase activity; Cellular component=extracellular space; Biological process=induction of non-apoptotic programmed cell death
  Coding regions on vcDNA: vcDNA=SeqID_86582; Strand=+; Position=1-559
CPKLPTVFDXMVTQQKVPEPVFAFWLNRDPTSEFGGEITIGGTDQRRFVAPITYTPVTHKAHWQFKMDSISGGNGKLACQNGCQAIADTGTSLLAGPKNDIEKIQKYIGAIPLFHGEYMISCERIPTLPDVTINIGGKAYTXEGQGLCAENDQHGQKHMPFRFXGAXFAGTCRRTLDSWRCVYWSLL

SEQ ID NO: 160160 - protein, 153 aa, Heterodera glycines
  Homolog annotation: Hit_ID=AAP30770.1; Match level="QueryCoverage =74%, HitCoverage=43%, E-value=4e-28, Identity=53%"; Hit description =putative gland protein G17G01 [Heterodera glycines]
  Coding regions on vcDNA: vcDNA=SeqID_86583; Strand=+; Position=43-501
MRKFAYFKLCQAVLTSVFLWQILSTHQFCGEFDEPTAFFNSAVSSSHCEQFTLIGMDSTTGEYGAMPDKQKWHMQLMASSGSGQPIDEQQQNHMDEFSSKLPTVGRHCIPIAFSLVKPWVRDNKSHLHKVADLFAIQLLCGLLSLFVIAMHVL

SEQ ID NO: 160161 - protein, 176 aa, Heterodera glycines
  Coding regions on vcDNA: vcDNA=SeqID_86584; Strand=+; Position=2-529
KLRWFELTITNPSTQSSLSTSLPALPSAAVFAHSASLRRRAAAVPPPQNRHHFLPPPDPPPLLNGNASKVFSSSSSDTFLPAADVSGGDRRQVMFEEEPTTFISIRSVLINGQRFFQPLSVPAALCPSASAPPVDPMGPLLALSAADNDQSHPKQQKDAPLAPRVPFIYQQSLAAA

SEQ ID NO: 160162 - protein, 196 aa, Heterodera glycines
  Coding regions on vcDNA: vcDNA=SeqID_86585; Strand=-; Position=7-597
PSPTTTTGQSPDTSSVSAVAAIVARAIVVAVASVAGAIVVAVSVAPESPPSVSSNRCFNELRLYTTRPSAAAADSPGTPNSLGCCRPHANTTCLQRSVKVRCSAVFGTVSVPCSSQWHVPTKEGWQIFFPLLLCDEKMTFISQKTMNECEKNGRQLNDWGRERDRRESEKERKKGKGKDERTAEECAIKGVNYMCN

SEQ ID NO: 160163 - protein, 184 aa, Heterodera glycines
  Homolog annotation: Hit_ID=NP_510160.1; Match level="QueryCoverage =96%, HitCoverage=10%, E-value=1e-63, Identity=64%"; Hit description =putative cytoplasmic protein of ancient origin (XN617) [Caenorhabditis elegans] emb|CAA91030.1| Hypotheti
  Coding regions on vcDNA: vcDNA=SeqID_86586; Strand=+; Position=3-554
DETCSGEEEERVQIERDGSVFDLSKIDEPKFGKIDPNNVPHVGGNTWAGGTGGYNTAGLGGVGGPFRLDAGHAVHQLPDSAKEQVPEHIRKRAREIAREEYAKRLKEIDMGEYDAAAYEELATRVGRQVRVLRIVIDSLEHRKHGRQWAKHQTSGDLDDAKLIEWMAGERNIYRKRIEQPPDPS

SEQ ID NO: 160164 - protein, 143 aa, Heterodera glycines
  Coding regions on vcDNA: vcDNA=SeqID_86587; Strand=+; Position=289-717
MTGTLKAKNAIADANITCGLNSNFYFGWSSCMKIAFYGDDGYKKHAQKYGLDKTEGPEENFKNMTEFDKYGFMHDMVLLLFEGCVVCKNAKMTASLSLRQYMPQGLLNETCAAFVKRPTKALVGVTADSFAYGITLMERLCAE

SEQ ID NO: 160165 - protein, 136 aa, Heterodera glycines
  Homolog annotation: Hit_ID=NP_033762.1; Match level="QueryCoverage =93%, HitCoverage=21%, E-value=2e-18, Identity=44%"; Hit description =poly (ADP-ribose) polymerase family, member 2 [Mus musculus] gb|AAH62150.1| ADP-ribosyltransferase (NAD+,
  Gene Ontology: Mol. function=ATP binding; Cellular component=nucleus; Biological process=base-excision repair
  Coding regions on vcDNA: vcDNA=SeqID_86588; Strand=+; Position=2-409
MEQKTFKQNGERKRKTQKMEEQSREKPKDSEKENLDGRISKRNKMQSEEATVDAECAELRGNAKVFVDGKGRCYDVMLSQTNIQQNNNKFYLIQLLCNQTAANKFWVWFRWGRVGFKGQTNLVPFGTDFDGALELF

SEQ ID NO: 160166 - protein, 172 aa, Heterodera glycines
  Coding regions on vcDNA: vcDNA=SeqID_86589; Strand=+; Position=2-517
FPSFLFLIIIPVANGVITRSLTPRRGAAGEMAREFVELSTNSRESTSRRPSRVNILDDDYVEPSLGVRRYSAGSSSRTRTVKVMTEFKLLGQIWPEDVYIIYLDTSKFDKDDQKRIIGHDEPDVLKTASDGSFSWKFLVKHNESDEDIAVDVHMHIFGTVPNENLHRNIVIA

SEQ ID NO: 160167 - protein, 146 aa, Heterodera glycines
  Homolog annotation: Hit_ID=CAE56930.1; Match level="QueryCoverage =45%, HitCoverage=32%, E-value=1e-22, Identity=74%"; Hit description =Hypothetical protein CBG24775 [Caenorhabditis briggsae]
  Coding regions on vcDNA: vcDNA=SeqID_86590; Strand=+; Position=117-554
MSRLNAHDFCSTNSDFLLEYSDEKALSAVENGFFMRCSDLDEHWFDCQSVTESVNATDINQMELLCPYFGISKGPLLFANISCRVLPCIECYGTRNFAKEFPCKKYTGHYFLSALLYSIFLGPFAVDRFYLGYSAIAVGKLMTLED

SEQ ID NO: 160168 - protein, 140 aa, Heterodera glycines
  Coding regions on vcDNA: vcDNA=SeqID_86591; Strand=+; Position=1-423
VMHGDGGSPIAAQQRHSPTTLSRRSSSARPTPSLSPVYICPVREAITAEHADQQSASLPHGSAAGGGTLLYPLRKGERVRVLAIRGEYTRCSRLPAAEHRQQQLRQQRLALQNGLVPTRTLQFGANNGTTALNDERMTEL

SEQ ID NO: 160169 - protein, 168 aa, Heterodera glycines
  Homolog annotation: Hit_ID=CAA70694.1; Match level="QueryCoverage =99%, HitCoverage=47%, E-value=1e-97, Identity=99%"; Hit description =cathepsin S-like cysteine proteinase [Heterodera glycines]
  Gene Ontology: Mol. function=cathepsin S activity; Cellular component= extracellular space; Biological process=proteolysis and peptidolysis
  Coding regions on vcDNA: vcDNA=SeqID_86592; Strand=+; Position=1-507
TNLVDCSSKYGNEGCDGGLMDSAFEYVRDNNGLDTEESYPYEAVTGKCQFKNETVGGTVVSFKDLKEGDEEQLKIAVATIGPISVALDASNLSFQFYKTGVYYERWCSNRYLDHGVLLVGYGTDETHGDYWLVKNSWGPHWGENGYIRIARNKQNHCGIATMASYPVV

SEQ ID NO: 160170 - protein, 129 aa, Heterodera glycines
  Coding regions on vcDNA: vcDNA=SeqID_86593; Strand=-; Position=1-387
TLLKSPLIVGVFRRQWSRIVLDGWVLCFSIRGSVVLNAGSKRHRISTGCSHIISRNSYSSWQRIGVRNSFRRNANSDRHRICTAGCFRLVKWHFPLSHQLKPIRHFLVLFLESFNEFFRQLTISARSKT

SEQ ID NO: 160171 - protein, 138 aa, Heterodera glycines
  Coding regions on vcDNA: vcDNA=SeqID_86594; Strand=+; Position=70-486
KKYREANKLQSCQTTTSIMNSDNHLIQTMNRGDERSADIYLQEQTLMITSSHQPVQLLYDGANGQYFIPVQNGNDGSVCHIALTPTQSKVAGYYSIIIIFCNIGTFSFKFPNNKADYLSIGELQKDVHETFLNYVLKR

SEQ ID NO: 160172 - protein, 234 aa, Heterodera glycines
  misc_feature (11)..(11): Xaa can be any naturally occurring amino acid
  Homolog annotation: Hit_ID=NP_494897.3; Match level="QueryCoverage =99%, HitCoverage=23%, E-value=8e-71, Identity=52%"; Hit description =p-type trefoil domain and Glycoside hydrolase, family 31 precursor (106.8 kD) (2F206) [Caenorhabditis ele
  Gene Ontology: Mol. function=catalytic activity; Cellular component =brush border; Biological process=glycogen catabolism
  Coding regions on vcDNA: vcDNA=SeqID_86595; Strand=+; Position=3-702
FPDFLQKKGTXTDWWVDDFVRFLNEVQFDGIWIDMNEPSVFGTNEKHPWYFDTQPAFAGKPPIAPLMCPEPNNKLDYPPYRTWNAYKWDSIFSKRTLNEKTLCMIGKSGRRNWTMYDTHSLYGWSEMVATQKALRVSTGKRGPLTSRSTFPSSGHYGGHWLGDNQSRWPDLRLSIIGVMEFNMFGIPQVGADVCGLIGDSNEELCLRWQQLGAFHSYYRNHNDVNSKVSQDPAQ

SEQ ID NO: 160173 - protein, 209 aa, Heterodera glycines
  Coding regions on vcDNA: vcDNA=SeqID_86596; Strand=+; Position=1-627
IEHFVVNEKYREAVTMSLYAIEPSYKNITDPLKQRYQYKEEFIAMCRNASASPFDVLLRMEQSLKDDCQLPSQEQAENYAAILELFQKIEQRHHMLNLNDAIPMDKYKSIKSSILAKSAREALQEKLNTILNSANSAEEVLQALNKLNSDLHYYPCWLQAMADGNEWKREPLFHFAQIVRLDLMKASLIALHCAYISNEDDEFAIDINF

SEQ ID NO: 160174 - protein, 175 aa, Heterodera glycines
  Homolog annotation: Hit_ID=AAR85527.1; Match level="QueryCoverage =100%, HitCoverage=69%, E-value=2e-91, Identity=96%"; Hit description= 14-3-3b protein [Meloidogyne incognita]
  Gene Ontology: Mol. function=protein domain specific binding; Cellular component=cytoplasm; Biological process=protein targeting
  Coding regions on vcDNA: vcDNA=SeqID_86597; Strand=+; Position=3-527
GAELIPEERNLLSVAYKNVVGARRSSWRVISSIEQKTEGSEKKQQMAKEYREKVEQELREICHDVLDLLDKYLIPKAGNPESKVFYLKMKGDYYRYLAEVATGDDRNAVVEKSQQPYQEAFDIAKDKMQPTHPIRLGLALNFSVFYYEILNSPDKACQLAKQAFDDAIAELDTLN

SEQ ID NO: 160175 - protein, 214 aa, Heterodera glycines
  Coding regions on vcDNA: vcDNA=SeqID_86598; Strand=+; Position=1-645
DAVANAIVCPVCFAKFEPFPNLHAHVLRHLDKKCMAEFFSCKLCKDSNCVLFLSVTAIREHIRTAHGVATDSYLLTNIYPGNNIHKGTTRIMVQEVLKRFARIRFEQWRNVRQIKTKLGSMKRNCSFPPVDDHSWKRKKVGNEGGKVAEEDVIDRILFSPSQIPQNLSERLHRLKKMDRISRHQMIVPICGMSSFVGLSNVRIAKMAKSCSTHK

SEQ ID NO: 160176 - protein, 174 aa, Heterodera glycines
  Coding regions on vcDNA: vcDNA=SeqID_86599; Strand=+; Position=132-713
MDVCRPGRGGYCSRVVFLNADGTIREVITSCLKREQLVPRELPFVCQNSTTPQWNKLVNCCKSESFCNDIQFPIELGLRNGFLPESFDGLPSVFLTLLISLVLVLLFALSICVAISCCCFPRKRAVADCEMDSESLCGAPMGQLAEAATFSTGSGSGVPMLAPRTISYQISLQT

SEQ ID NO: 160177 - protein, 187 aa, Heterodera glycines
  misc_feature (21)..(21): Xaa can be any naturally occurring amino acid
  Homolog annotation: Hit_ID=CAE60650.1; Match level="QueryCoverage =93%, HitCoverage=71%, E-value=2e-42, Identity=42%"; Hit description =Hypothetical protein CBG04296 [Caenorhabditis briggsae]
  Gene Ontology: Mol. function=chromatin binding; Cellular component =nucleus; Biological process=loss of chromatin silencing
  Coding regions on vcDNA: vcDNA=SeqID_86600; Strand=+; Position=2-565
SDHIILEIVFEIFENIKEDVXWELVFVGTDGREEHDQVLDSVLIGPIQEGRHKFLFEAPPPQIHNLRPEDFMDVSLLLLKCKYREQLFMKIGWFVTHTYTDPELVENPPSQPVIEKLKRTIVSEDVRVTSYPIKWDEETEQPMDDDEEPNAGNEVSYGVAAIELTSNGNSQQMNMSQQEQTPMAAVN

SEQ ID NO: 160178 - protein, 79 aa, Heterodera glycines
  misc_feature (56)..(56): Xaa can be any naturally occurring amino acid
  Homolog annotation: Hit_ID=NP_495793.1; Match level="QueryCoverage =87%, HitCoverage=17%, E-value=2e-16, Identity=55%"; Hit description =gamma Butyrobetaine Hydroxylase (gbh-2) [Caenorhabditis elegans] pir||T23737 hypothetical protein M05D6.7
  Gene Ontology: Mol. function=oxidoreductase activity, acting on single donors with incorporation of molecular oxygen, incorporation of two atoms of oxygen; Cellular component=mitochondrion; Biological process=carnitine biosynthesis
  Coding regions on vcDNA: vcDNA=SeqID_86601; Strand=+; Position=2-239
NCAFFTAYQRFAQLANHSDNQATLTLRPGTVLFIDNFRVMHGRKAFQGERVMCGCXYLNRDVFLAKARPKLSPEFYRNV

SEQ ID NO: 160179 - protein, 86 aa, Heterodera glycines
  Coding regions on vcDNA: vcDNA=SeqID_86602; Strand=+; Position=93-353
EAKRGVPHFLTIKSFSIITFALRSYQMAIPEWNFFHLLSPPPLIFEFVIFSFSRLFPFHKFFFPIGFPSFQFVFSFSEVNTYYIVD

SEQ ID NO: 160180 - protein, 150 aa, Heterodera glycines
  Homolog annotation: Hit_ID=NP_503408.1; Match level="QueryCoverage =83%, HitCoverage=80%, E-value=9e-20, Identity=39%"; Hit description =putative secreted or extracellular protein precursor (5B870) [Caenorhabditis elegans] gb|AAF60880.2| Hypo
  Coding regions on vcDNA: vcDNA=SeqID_86603; Strand=+; Position=69-521
MAVVVYGAESAGPKADQAMAAKQFNPSAFPAMPPELEKILPADVVQKLKAVHADMSLNIMQKQDKIDRIMSSLPGEVLDQIPAPPGFERLPDDVKNRLKQINRQTNKAWADKQKELQEYVKTLPQEQRAILMMGPMGGPPPPPPSFGRRR

SEQ ID NO: 160181 - protein, 207 aa, Heterodera glycines
  misc_feature (172)..(172): Xaa can be any naturally occurring amino acid
  Homolog annotation: Hit_ID=EAA16908.1; Match level="QueryCoverage =92%, HitCoverage=8%, E-value=5e-10, Identity=21%"; Hit description =Drosophila melanogaster CG8797 gene product-related [Plasmodium yoelii yoelii]
  Coding regions on vcDNA: vcDNA=SeqID_86604; Strand=+; Position=3-625
RQKRKGNEGCDPGEKERKERESLIEEAYALSQEANISLEQIIKRYTKCRNQFLERVADQISDQLQQDHSDSTDDISTNKHERKKRPIVFISPQLRKRVKIQQQLAEADSANDGDDDSEQKQQKEKSPFTIPGGAEDDEMTDVHSQLEQKQQQQKQQQETEAKKSDGTTKTEXHSKRPICQQIQRGGSDQQHFERQCARRDQQMQQQQ

SEQ ID NO: 160182 - protein, 230 aa, Heterodera glycines
  misc_feature (55)..(55): Xaa can be any naturally occurring amino acid
  Homolog annotation: Hit_ID=CAE57411.1; Match level="QueryCoverage =96%, HitCoverage=25%, E-value=6e-32, Identity=35%"; Hit description =Hypothetical protein CBG00366 [Caenorhabditis briggsae]
  Coding regions on vcDNA: vcDNA=SeqID_86605; Strand=+; Position=1-689
NGLGPLSPEAVKQAHENDAGKLKPWQQRYLDWMILQARLCGYLTVKKNDKKAQLXTGSEFLVEFRYKPILLPISVICPFVPFYLFFRANHMQDNGVIVPIEHRYLLKSAPPRALALLSKGNDPENGPWEVTSKKHDALFAALNYCSAREIRQGLWQSYVTRSAFSSQMLNNSQNIEELRHNTEGFAKALGFSSTAHHRISSKMAGSPQTVRVFVDELSRRFRPVFFSRLE

SEQ ID NO: 160183 - protein, 119 aa, Heterodera glycines
  Homolog annotation: Hit_ID=XP_474218.1; Match level="QueryCoverage =96%, HitCoverage=17%, E-value=2e-25, Identity=51%"; Hit description =OSJNBa0015K02.22 [Oryza sativa (japonica cultivar-group)] emb|CAE04830.1| OSJNBa0084K01.2 [Oryza sativa (
  Gene Ontology: Biological process=establishment of synaptic specificity at neuromuscular junction
  Coding regions on vcDNA: vcDNA=SeqID_86606; Strand=+; Position=1-360
KKIVEYLREYSTKVDCILTSGGTGFSKRDVTPEATKEVIERECPGIAVALLKKGLDITPFAALTRLTAGIAANCLIINLPGSPKAVREGFEVIEPILSHAIAIVKGDESETSVLHKRTA

SEQ ID NO: 160184 - protein, 171 aa, Heterodera glycines
  Coding regions on vcDNA: vcDNA=SeqID_86607; Strand=+; Position=100-615
MATKCLPLELLYEIVPLIPAENATPNALSSCRLLHKLLLPRVIKWKEIMSENTGFQKQLLEMVKALHEKVAVIEKSVAIIEKNVAVIEKKATVIEKNVTVIEKEVTVIEKNVTVIEKEVTVIKKTIGIKGETTGVVEQQFHIRETVPTKTRKRETEETGARDRSAKAAAGL

SEQ ID NO: 160185 - protein, 209 aa, Heterodera glycines
  misc_feature (116)..(116): Xaa can be any naturally occurring amino acid
  Homolog annotation: Hit_ID=NP_509429.1; Match level="QueryCoverage =99%, HitCoverage=31%, E-value=1e-91, Identity=75%"; Hit description =transmembrane 9 superfamily member 2 (75.3 kD) (XJ38) [Caenorhabditis elegans] gb|AAB71307.1| Temporarily
  Gene Ontology: Mol. function=transporter activity; Cellular component= membrane fraction; Biological process=transport
  Coding regions on vcDNA: vcDNA=SeqID_86608; Strand=+; Position=2-626
ILDSMPHTNIQWFSIMNSLVIVIFLSGMVGMILLRTLHRDIARYNRLDEEEDAQEEFGWKLVHGDVFRPPRHALLLSVFVGTGSQVLLCAFITLAFACLGFLSPANRGSLMTFALXFFYVLFGVIAGYVSSRIYKTMEGLAWKSNILLTSFLIPGIIFGVFFVSNLMLWSKGSSAAVPFGTLCALLFLWLFISIPLTFVGAYFGFRAKR

SEQ ID NO: 160186 - protein, 132 aa, Heterodera glycines
  Homolog annotation: Hit_ID=AAO33474.1; Match level="QueryCoverage =100%, HitCoverage=95%, E-value=3e-69, Identity=100%"; Hit description=gland-specific protein g4g12 [Heterodera glycines]
  Coding regions on vcDNA: vcDNA=SeqID_86609; Strand=+; Position=1-399
ILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160187 - protein, 202 aa, Heterodera glycines
  Homolog annotation: Hit_ID=NP_001002869.1; Match level="QueryCoverage= 96%, HitCoverage=24%, E-value=6e-55, Identity=60%"; Hit description =DEAD (Asp-Glu-Ala-Asp) box polypeptide 27 [Danio rerio] gb|AAT68047.1| DEAD box polypeptide 27 [Danio
  Gene Ontology: Mol. function=ATP dependent RNA helicase activity; Cellular component=nucleolus; Biological process=ribosome biogenesis
  Coding regions on vcDNA: vcDNA=SeqID_86610; Strand=+; Position=1-606
DANCTDFLDDGENEIELLQEATDKTDQLDLKLKNKKSKSVGSDHFFDVRSNQVAASANCAHLSFTDLNLSRPLLKSISEAGFQNPTPIQTACIPVALAGRDICASSATGTGKTAAFMLPILERLLFRPSRRTSVTRVLVLVPTRELAIQVFQVSRQLAKYTQVEICLAAGGLDLKAQEAALRLGLDIVIATPGRLIDHLHNS

SEQ ID NO: 160188 - protein, 57 aa, Heterodera glycines
  Coding regions on vcDNA: vcDNA=SeqID_86611; Strand=-; Position=483-656
KLIKLYLKKFIFTAMKNGEQQPYQEEELRRTYSSSSSSSNSLSVHKRKCSGTDQLNK

SEQ ID NO: 160189 - protein, 211 aa, Heterodera glycines
  misc_feature (8)..(8): Xaa can be any naturally occurring amino acid
  Homolog annotation: Hit_ID=CAB69785.1; Match level="QueryCoverage =92%, HitCoverage=51%, E-value=2e-26, Identity=34%"; Hit description =putative serine protease inhibitor [Anopheles gambiae]
  Gene Ontology: Mol. function=protein binding; Cellular component =cytosol; Biological process=regulation of protein catabolism
  Coding regions on vcDNA: vcDNA=SeqID_86612; Strand=+; Position=5-637
ASPPPKAXLILEAQADFALKLLREVSTDDRSCIVSPFSAAVTLSMVYAGAKEKTGEEMGQLLANGAPESEVHKYFGALLKSITSGTNSSNTLETANKLYVGKGSKVKDAFKEQIEGNYGGQFETVDFLDGKGTAEKINKFVKEATHKKIRDLVTPDNFDGNTRLVLINALYFKGTWADKFDSKFTEKAKFHVDAKNFKELEMMHLTANFIY

SEQ ID NO: 160190 - protein, 187 aa, Heterodera glycines
  Homolog annotation: Hit_ID=CAE61649.1; Match level="QueryCoverage =64%, HitCoverage=32%, E-value=4e-28, Identity=57%"; Hit description =Hypothetical protein CBG05583 [Caenorhabditis briggsae]
  Coding regions on vcDNA: vcDNA=SeqID_86613; Strand=+; Position=25-585
MHAQPVPAESQLASGFEFGGSRLSAGSNQFGGISNMGNNSEAMHGKSFGGPSFKFNPLQGTGNNELLTFLDNLQSTLRSSGFNDQSVSEVMQAMQVLAKYNIMGLGLGLGVAAMAQMRNTESAMAQQNVLLGAAASNTPLQQQQQRYDIMSQSNITGSLLDSSQNIDQSIVGGSGGVLIDVMSQKKS

SEQ ID NO: 160191 - protein, 180 aa, Heterodera glycines
  Homolog annotation: Hit_ID=NP_501856.1; Match level="QueryCoverage =26%, HitCoverage=29%, E-value=3e-10, Identity=53%"; Hit description =transthyretin-like family member (4K923) [Caenorhabditis elegans] pir||T24917 hypothetical protein T14G10
  Coding regions on vcDNA: vcDNA=SeqID_86614; Strand=+; Position=3-545
TSSRVQNGPDPFVRLLHFCNSEEGETIELPEFRIFVPDTYDLGILVLDQKTLPNSTVNFPVPENPRRRLQQAKRPTEVGTLDESNGKKGAEDGFVTVDAPKSHNAKGLDDLLPPGKTVTKTNGDLLWETQSVEMEEVPAEYDTSIRQSQQHNWEEESNDGNERKNWTKKKQPTKEEKKRK

SEQ ID NO: 160192 - protein, 187 aa, Heterodera glycines
  Homolog annotation: Hit_ID=CAE67645.1; Match level="QueryCoverage =94%, HitCoverage=51%, E-value=1e-32, Identity=41%"; Hit description =Hypothetical protein CBG13204 [Caenorhabditis briggsae]
  Gene Ontology: Cellular component=cytoplasm; Biological process =antimicrobial humoral response (sensu Invertebrata)
  Coding regions on vcDNA: vcDNA=SeqID_86615; Strand=+; Position=2-562
EERNATERVKRSRTEAAEEEKRERLDDEEDGGPAETAEGMKTKRTKKHTLDSDEEDETEGYQRLDMDKVEGQEESTLEYEGHVKIMPFNMKDDLEEGHFDANGTFIFDKKQSVIKDAWLDNIEWDNVKNAAGKHWGKLDDEDDKKADDEKEVEPKEVYRRLIELLNEKETIGAALKRLNNEKKSNAA

SEQ ID NO: 160193 - protein, 224 aa, Heterodera glycines
  Homolog annotation: Hit_ID=CAE70241.1; Match level="QueryCoverage =99%, HitCoverage=30%, E-value=8e-63, Identity=55%"; Hit description =Hypothetical protein CBG16730 [Caenorhabditis briggsae]
  Gene Ontology: Biological process=nonselective vesicle transport
  Coding regions on vcDNA: vcDNA=SeqID_86616; Strand=+; Position=3-674
SLFRKSLTNYQITQNALLKNRFFYEFLLANDRQVAREVKDEYVDTTSKMFFSYFKAYVSRLFKFQMVDSATKSDLLGAEDVVKHPTTISALPSLFTSGKTHQTRSRATVFSLGHRQNLLLDDLLAPLIVPHVAQENNETFQFESLFRSVQYALVDHCSHEFLFICDFFMVNGQSAVDLFTSVMGRSISLLLKTLEEKIAANFDAISLFLCICFCAKFREMMGDR

SEQ ID NO: 160194 - protein, 250 aa, Heterodera glycines
  Homolog annotation: Hit_ID=XP_318657.1; Match level="QueryCoverage =84%, HitCoverage=45%, E-value=1e-35, Identity=43%"; Hit description =ENSANGP00000010224 [Anopheles gambiae]
  Gene Ontology: Mol. function=ATPase activity; Cellular component =mitochondrial outer membrane; Biological process=mitochondrial translocation
  Coding regions on vcDNA: vcDNA=SeqID_86617; Strand=+; Position=3-752
LFTGVNSHSSVVAVSAPKGILLYGPNGCGKTLIARAIAKEVDAYFINFGTSLVDFVNGSSVTMKSLFTLAEKIQPCVIFIDEIDLLFHRNRNDFQLLKTQFLAQWDEFLRCNSNCNVIIIGATNRVLDLVLCRFSLKVHIPLPDEEAREKLLRKILANENLEADFNYAEVVEATQKMSSSELKEVIRFAFLLRYQQVVQTQISVLQQSSSVANEGSENEAEKIQIKLSHNDIIRAFHDLKNVSMAPFSES

SEQ ID NO: 160195 - protein, 69 aa, Heterodera glycines
  Coding regions on vcDNA: vcDNA=SeqID_86618; Strand=+; Position=8-214
STAVPNDQHIWNRSSYACRNTGRASTHSKKTSTIKSNVSLLYSSTEVRLIYSGNDDDLIGASSTGKSGG

SEQ ID NO: 160196 - protein, 124 aa, Heterodera glycines
  Homolog annotation: Hit_ID=AAP30767.1; Match level="QueryCoverage =100%, HitCoverage=86%, E-value=3e-67, Identity=99%"; Hit description= putative gland protein G21E12 [Heterodera glycines]
  Coding regions on vcDNA: vcDNA=SeqID_86619; Strand=+; Position=29-400
MATYLFLAAAAFGAGIYCWKTYLGPMLDQPKSDDEEKPKPEGGEEATTAGEEEKKAGSKGDKHKKKDKKGEGAAAAPAADKKEEKRKDKHKSKESGKSDDSKAGKKDKHGKKDKKGKKKDTTDA

SEQ ID NO: 160197 - protein, 178 aa, Heterodera glycines
  Homolog annotation: Hit_ID=AAK94490.1; Match level="QueryCoverage =100%, HitCoverage=17%, E-value=2e-96, Identity=94%"; Hit description= PAZ/Piwi domain protein [Heterodera glycines]
  Coding regions on vcDNA: vcDNA=SeqID_86620; Strand=+; Position=43-576
EIREMIKETAIPPTVLRVHNERVKESLQLVNNEYLTKASVHFDTTPLHVDYRVLGPPATLYRNNHRVTPATSNCEWRPGDALVNAQIGTWVAYAFGNPVGDSVRRLGLTETMWRNFVDKYASEMRNKGIVCVPPVRVSICWYTSVNEVLNILHKEALNGGVEFCLIGHAKGSEGDDVH

SEQ ID NO: 160198 - protein, 86 aa, Heterodera glycines
  misc_feature (8)..(8): Xaa can be any naturally occurring amino acid
  Homolog annotation: Hit_ID=NP_496144.1; Match level="QueryCoverage =100%, HitCoverage=16%, E-value=5e-24, Identity=59%"; Hit description= CoA transferase (56.1 kD) (2K226) [Caenorhabditis elegans] emb|CAA88202.1| Hypothetical protein C05C10.3
  Gene Ontology: Mol. function=3-oxoacid CoA-transferase activity; Biological process=succinyl-CoA metabolism
  Coding regions on vcDNA: vcDNA=SeqID_86621; Strand=+; Position=1-260
PGSRVVLXMEHCAKGGKPKILDNCTLPLTGKNVVRRIITEMAVFDVHPTDGLSLVEVYETFSVEDVVRATGCQFKISENLKPMLQA

SEQ ID NO: 160199 - protein, 138 aa, Heterodera glycines
  Homolog annotation: Hit_ID=AAP30757.1; Match level="QueryCoverage =100%, HitCoverage=63%, E-value=2e-60, Identity=82%"; Hit description= putative gland protein 30G12 [Heterodera glycines]
  Coding regions on vcDNA: vcDNA=SeqID_86622; Strand=+; Position=45-458
MSNFIFVAFLTAAFFSSGLALPAPYDAESVVSSELNVPLLSADANVEAAITNESDSAAEIQAPSIPVPIEQQTAAASSSSTPKSEQTPKKVMNMKSAMEGAAANVYGGLPLDQQPKTIAEAAAKAKQTPAKLPADYDV

SEQ ID NO: 160200 - protein, 191 aa, Heterodera glycines
  Homolog annotation: Hit_ID=AAP30770.1; Match level="QueryCoverage =100%, HitCoverage=73%, E-value=2e-56, Identity=59%"; Hit description= putative gland protein G17G01 [Heterodera glycines]
  Coding regions on vcDNA: vcDNA=SeqID_86623; Strand=+; Position=1-573
QLLRIVLSLAFVWQLLSLHQFCGTFVCPKAFLHDISVGHCKRFTLIGKDSKTGEFGAVLDERKWHNQLFMSSTNGLPIKEQQQQFMDELAAKLPCPGRHCIPITTPSFFFWTEKNRNLLDTVVDSFSGQLLLALCSLLTIGIGFARMLRSAAEYECFDYCMALYSVFCWCCSAWASSYLLLYWTPYWSCMN

SEQ ID NO: 160201 - protein, 91 aa, Heterodera glycines
  misc_feature (29)..(29): Xaa can be any naturally occurring amino acid
  Coding regions on vcDNA: vcDNA=SeqID_86624; Strand=+; Position=2-274
IKMRGKACKWSKCSHKIRPPLLFASLRPXHSSAAALLRLVPNIPLHNALSQILIPPSDQMRGICWLICPTKLTFFCTSLIRQTNNIYLTAE

SEQ ID NO: 160202 - protein, 185 aa, Heterodera glycines
  Homolog annotation: Hit_ID=NP_496067.1; Match level="QueryCoverage =96%, HitCoverage=28%, E-value=1e-09, Identity=30%"; Hit description =poly polymerase   family member (2J898) [Caenorhabditis elegans] emb|CAA87419.1| Hypothetical protein T15
  Coding regions on vcDNA: vcDNA=SeqID_86625; Strand=+; Position=3-557
IPNSSMPFLVHKFFLIFSKWKWPMPVQLTPIDHKFFGTFLSWSPFGDWIGRRDLAWEKARRKHRTKKEQQNEIEKAMKSIRKELAMAVIMPTIGGRNLAEKVNISSAKVVENELKRACDKLRSKMETKDEAIAFTEKYEHFIVIECKGSSHNVDKFCDFVGKRLRYELLEFVENPLAIWVDFCHV

SEQ ID NO: 160203 - protein, 227 aa, Heterodera glycines
  Coding regions on vcDNA: vcDNA=SeqID_86626; Strand=+; Position=1-681
ILRTFQFCRAENPFFLEIHNKKARNSLNWTGKLIADELGQFVRAIRLAMGVFKDGTQMARFEDQLPPAKMISPDSTSLYMAHIRLERFCASEHFHVGKFGLATRQIANLLRAFTQRVSGIYSLERCSFLADSLFRLFTKFYECIKWHFRQSPNKSEIEKFGAAILKFGRFVCGTLREGDNAGSFCLPSSTTIGTELLLPSTLRKIKQKTKGRKEQKTITGRIKVSTE

SEQ ID NO: 160204 - protein, 49 aa, Heterodera glycines
  Coding regions on vcDNA: vcDNA=SeqID_86627; Strand=+; Position=75-224
MSTKRRLLAKKFPFFGCDANQLLLPPPTPGVNSHDIGLSFGVIHTFISP

SEQ ID NO: 160205 - protein, 215 aa, Heterodera glycines
  Homolog annotation: Hit_ID=NP_490770.1; Match level="QueryCoverage =99%, HitCoverage=94%, E-value=2e-24, Identity=34%"; Hit description =phosphoglycerate/bisphosphoglycerate mutase (24.9 kD) (1B166) [Caenorhabditis elegans] gb|AAK21514.2| Hyp
  Coding regions on vcDNA: vcDNA=SeqID_86628; Strand=+; Position=14-658
VTPPDIYAVRHAERLDDSEKRKVWHYNSRFAKDNPPLSPRGVQQAEELSVEFRNISIDYCFTSPYERCVQTASKILEGRSTLINVEPGLIESFNLICDRSGVQKISFQTGKELAQRYTNINRQYEPMYLAPPEIEKSKGVHGCFPRVEDTFRKIVAKCYGDILIVSHQGPVAALQRMLTGSMEFGGSATVSKYVEVPGMAGRFEAEYIYDSSHLS

SEQ ID NO: 160206 - protein, 192 aa, Heterodera glycines
  Homolog annotation: Hit_ID=XP_314537.1; Match level="QueryCoverage =91%, HitCoverage=66%, E-value=9e-34, Identity=39%"; Hit description =ENSANGP00000016990 [Anopheles gambiae]
  Coding regions on vcDNA: vcDNA=SeqID_86629; Strand=+; Position=2-577
ASSSELPKGNGRNGVRGEEEVKGGKEIASKTLNIQSKRFYLDVKQNDRGRFVKLAEVAMNGRKNRLFMSMRICKNIKELLGKFEGHVPASEEVNGKAENVTIQSESIVTERRRYYIDLRENRRGSFLRITQLETHSGIRNSVALPFEGIGQLHDALDSILEEYGEGFIEEEAELPHSQMIRTDGKSFFFDPG

SEQ ID NO: 160207 - protein, 184 aa, Heterodera glycines
  Homolog annotation: Hit_ID=NP_997065.1; Match level="QueryCoverage =63%, HitCoverage=7%, E-value=5e-17, Identity=37%"; Hit description =intersectin 1 [Danio rerio] emb|CAD43428.1| novel protein similar to human intersectin (SH3 domain protein
  Gene Ontology: Mol. function=protein binding; Cellular component =lamellipodium; Biological process=small GTPase mediated signal transduction
  Coding regions on vcDNA: vcDNA=SeqID_86630; Strand=+; Position=3-554
FDDDFKPNLSTAVDVNVQQKPVDKTSAVGDIEVKNNEIVQNGNQLSKESVSTVPYEQQHGQVIGQVKTVKYKALFEFNARSGDELSIQPGDLILVFEGHQSEPGWLAGQIRDKVGWFPASFAEPLSAAAAGPLLKRGGSLAGSPSGEPLAIIREECEPPPTGQIHPTEQRRGNAFDTDFTAAFT

SEQ ID NO: 160208 - protein, 109 aa, Heterodera glycines
  Coding regions on vcDNA: vcDNA=SeqID_86631; Strand=+; Position=119-448
FLYLIKCFRSIFWIFFCQNSFIFFINFFFALSIFSFPWVQSSLILVFLTFSVYSSTIKKNSFFEINSFTKKQKIQEKFAEFSRKKRTIKIFFFHFLEFHYYLIFIYFWN

SEQ ID NO: 160209 - protein, 218 aa, Heterodera glycines
  Coding regions on vcDNA: vcDNA=SeqID_86632; Strand=+; Position=55-711
MTRRVGPITDEDWQPLMWPVELRNRRKFRLLCAHVMDGKCGGGVFAMRRLWQSVIHQIAGDEVSNRVLNHCIRHIQRKLVEAHTVICPWRISPGLNTSATYDITARYHQLVDSGQPELPLADNVLDEALADKFGVQSRFFLALAIFGWLPISKQATNDVEMNKPQPNFHCPLCGRHLCASVFSSNNPLDPREQHQHYCPVVEDSVSPLWRECLQMCTN

SEQ ID NO: 160210 - protein, 143 aa, Heterodera glycines
  Coding regions on vcDNA: vcDNA=SeqID_86633; Strand=+; Position=19-450
LKKFEQRWREICGTNNNYVDFIVPNSEVHLANFGAIENAHLSILIQNLIDVIRSRNARQLVKEFGDKYLEEVMKFLDEAMAASNESLPLAKIVPVLCDAFAKIGTVSFGSIFHSLLSSTELHRFTLFVSECSKRDDLFDANLK

SEQ ID NO: 160211 - protein, 98 aa, Heterodera glycines
  misc_feature (12)..(12): Xaa can be any naturally occurring amino acid
  misc_feature (42)..(42): Xaa can be any naturally occurring amino acid
  Homolog annotation: Hit_ID=NP_499541.1; Match level="QueryCoverage =96%, HitCoverage=25%, E-value=5e-10, Identity=32%"; Hit description =predicted CDS, pol protein like family member (3M974) [Caenorhabditis elegans] emb|CAB60526.1| Hypothetic
  Coding regions on vcDNA: vcDNA=SeqID_86634; Strand=-; Position=7-300
RPYPFLRNPKLXGITFDPLLTFNAHSEKLRSKIQKRNNILRXLAGTTWGQSKEVLLTTYKAIARSLLNYAAPIWSPQLADSNWSILRRCQSALGTIGC

SEQ ID NO: 160212 - protein, 165 aa, Heterodera glycines
  Homolog annotation: Hit_ID=NP_501502.1; Match level="QueryCoverage =90%, HitCoverage=19%, E-value=3e-14, Identity=29%"; Hit description =laccase (4J499) [Caenorhabditis elegans] emb|CAA91039.1| Hypothetical protein F21D5.3 [Caenorhabditis ele
  Coding regions on vcDNA: vcDNA=SeqID_86635; Strand=+; Position=14-511
MRFRLIHAGFRHPLVVHIEQHQMEVIAMDGNEVKPFRTDALIIYPGERFDVRVTALGHPRWPIHRMVVGLAEQFLAETEEPIYGLANLDYHWHGETADPNWDGGEKVDFLLNRCTARQCVLLGCPFRTENGTFAAFDGRKFKCHSIDELRNNGKLNNYPSGHGYD

SEQ ID NO: 160213 - protein, 119 aa, Heterodera glycines
  Homolog annotation: Hit_ID=NP_491749.2; Match level="QueryCoverage =99%, HitCoverage=23%, E-value=6e-45, Identity=71%"; Hit description =ariadne family member (57.3 kD) (1G636) [Caenorhabditis elegans] gb|AAB93645.3| Hypothetical protein C27A
  Gene Ontology: Mol. function=zinc ion binding; Cellular component =ubiquitin ligase complex; Biological process=ubiquitin-dependent protein catabolism
  Coding regions on vcDNA: vcDNA=SeqID_86636; Strand=+; Position=2-358
CRFEFCCMCLGPWAPHVSGSGWYSCNRFDDDAAKRARDSQERSRAALKRYLHYYSRFTNHQNSLKLERKLFEKVSEKMEQMQVLGFSWIETQFLQKAVEILVECRRTLMYTYVFAFYLV

SEQ ID NO: 160214 - protein, 189 aa, Heterodera glycines
  misc_feature (125)..(125): Xaa can be any naturally occurring amino acid
  misc_feature (150)..(150): Xaa can be any naturally occurring amino acid
  misc_feature (174)..(174): Xaa can be any naturally occurring amino acid
  Homolog annotation: Hit_ID=AAL78216.1; Match level="QueryCoverage =100%, HitCoverage=56%, E-value=1e-112, Identity=98%"; Hit description=aspartic protease precursor Hgg-33 [Heterodera glycines]
  Gene Ontology: Mol. function=aspartic-type endopeptidase activity; Cellular component=lysosome; Biological process=induction of non -apoptotic programmed cell death
  Coding regions on vcDNA: vcDNA=SeqID_86637; Strand=+; Position=3-571
PEPVFAFWLNRDPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGKAYTXEGQGLCAENDQHGQKHMPFRFYGHXFAGTCRRTLDSWRCVYWSLLHGVXCGPKSCWFCAGQRRK

SEQ ID NO: 160215 - protein, 74 aa, Heterodera glycines
  Coding regions on vcDNA: vcDNA=SeqID_86638; Strand=+; Position=35-259
MERIDSIICTLPENVIDQIPDPPEVAQLPADVRQRVKQIERQQGKSFSTKFEEIMKYVDTLPEGTKSAAKNIFH

SEQ ID NO: 160216 - protein, 183 aa, Heterodera glycines
  Homolog annotation: Hit_ID=NP_491977.1; Match level="QueryCoverage =97%, HitCoverage=27%, E-value=1e-38, Identity=45%"; Hit description =ceramide kinase (62.4 kD) (1H511) [Caenorhabditis elegans] gb|AAC67466.1| Hypothetical protein T10B11.2 [
  Coding regions on vcDNA: vcDNA=SeqID_86639; Strand=+; Position=1-549
RPPSAPDYFGRVSFALSPSQPPLTVNSTVVGVPSSPVNIPPCVGHCDICSGRIPPDEHFPFHWQANFTHVICCVIPCVSPFTPYGLAPYTGLNDGTMDLALIPKVSRFTNLQIIRKVAMYGARFIPDEYPDVKVYRVSRWKFTPEALIVPSGEDTDKAAEQGQHSGAWNLDGEILLQPSDRPL

SEQ ID NO: 160217 - protein, 229 aa, Heterodera glycines
  misc_feature (19)..(19): Xaa can be any naturally occurring amino acid
  Homolog annotation: Hit_ID=CAA69216.1; Match level="QueryCoverage =99%, HitCoverage=32%, E-value=2e-36, Identity=34%"; Hit description =serine/threonine protein kinase [Drosophila melanogaster]
  Gene Ontology: Mol. function=3-phosphoinositide-dependent protein kinase activity; Cellular component=plasma membrane; Biological process=insulin receptor signaling pathway
  Coding regions on vcDNA: vcDNA=SeqID_86640; Strand=+; Position=2-687
FCFSLISKKAAYSTVYFAXERQTSRKFAVKMCLKKKIIKEKKVQQIFRERDILRLLSTPANACPFVVHLFCTFQDDESLFFVLSYAPKKDLMARLKKLQRFSVGQCQFAMAELFLALEHIHALDVIHRDVKPENILLREDGHILLSDFGCAKQIIAKRENVAEENGDKTDGQRADDGQKAEKSADSKSSKKREEEEATKLALRRRCSFVGSGAYVSPEVLNGKEVTGAC

SEQ ID NO: 160218 - protein, 256 aa, Heterodera glycines
  Homolog annotation: Hit_ID=NP_497570.1; Match level="QueryCoverage =100%, HitCoverage=43%, E-value=7e-72, Identity=49%"; Hit description= laminin A precursor family member (67.2 kD) (3D594) [Caenorhabditis elegans] gb|AAK29943.1| Hypothetical
  Coding regions on vcDNA: vcDNA=SeqID_86641; Strand=+; Position=3-770
ESYAAGLVQRWLTKLQISNHYSNTVKGICRDNKGYCRKLYRYLNANLEWISAQIDANPGDLYWRQVNLTFNQLTGIFDGYAMDSGKSFSPRVNFTITPIYMIQISGELIDLSILFKKVPRSKGEAVELAEAGHCSGLVKVAAGNSDLLMSHVAMSGFNTMNRIVKLYKFAYDPKDVPGFAVSFSGYPAALASADDFTLTSAGLLSIETTISVFDKSLYSQFVHPQGQLHCWLRSYISNQLTSTAHDWVKIFARFNS

SEQ ID NO: 160219 - protein, 114 aa, Heterodera glycines
  Homolog annotation: Hit_ID=NP_080523.1; Match level="QueryCoverage =98%, HitCoverage=62%, E-value=2e-16, Identity=40%"; Hit description =glycosyltransferase 28 domain containing 1 [Mus musculus] dbj|BAB29554.1| unnamed protein product [Mus mu
  Gene Ontology: Biological process=protein modification
  Coding regions on vcDNA: vcDNA=SeqID_86642; Strand=+; Position=415-756
MAKQCFVTVGSTRFDALVESLFRSDVLDALKKLKVECVTIQNGNGVIPKQIQSAILNQTQCIIDGITFHLFDYKASIREYLQSAELIVGHAGAGTCLEALECGKPFITVVNDSL

SEQ ID NO: 160220 - protein, 83 aa, Heterodera glycines
  Coding regions on vcDNA: vcDNA=SeqID_86643; Strand=-; Position=1-252
CFLFFGHLHPLWFVPWKTSIFLAFIFPADAQHFVRFANWPIASGLCQCHVRKAAQSEQSENENEEKTERKHLEKSPVLEERSS

SEQ ID NO: 160221 - protein, 177 aa, Heterodera glycines
  Homolog annotation: Hit_ID=CAE63218.1; Match level="QueryCoverage =89%, HitCoverage=39%, E-value=3e-74, Identity=84%"; Hit description =Hypothetical protein CBG07576 [Caenorhabditis briggsae]
  Gene Ontology: Cellular component=membrane
  Coding regions on vcDNA: vcDNA=SeqID_86644; Strand=+; Position=9-630
SEQVQNVTFVYNLSISLALYGLFLFYTATRDLLHPYNPVLKFLTVKSVIFLSFWQGFLLAVLGATSAIDPIYDLDGNEIIGRGTVAAGYQNFFICIEMFFAAIALRFAFSVSAYIDAHTVTAGSDVRPMTLQSISSSLKETMNPRDIMQDAIHNFHPQYQQYTQVIIKISCFISLIF

SEQ ID NO: 160222 - protein, 131 aa, Heterodera glycines
  Coding regions on vcDNA: vcDNA=SeqID_86645; Strand=+; Position=148-540
VPSEDKSCNILDDDYVEPSLGVRRYSAGSSSRTRTVKVMTEFKLLGQIWPEDVYIIYLDTSKFDKDDQKRIIGHDEPDVLKTASDGSFSWKFLVKHNESDEDIAVDVHMHIFGTVPNENLHRNIVIAEANS

SEQ ID NO: 160223 - protein, 116 aa, Heterodera glycines
  Homolog annotation: Hit_ID=CAE56930.1; Match level="QueryCoverage =62%, HitCoverage=34%, E-value=5e-25, Identity=73%"; Hit description =Hypothetical protein CBG24775 [Caenorhabditis briggsae]
  Coding regions on vcDNA: vcDNA=SeqID_86646; Strand=+; Position=211-558
MRCSDLDEHWFDCQSVTESVNATDINQMELLCPYFGISKGPLLFANISCRVLPCIECYGTRNFAKEFPCKKYTGHYFLSALLYSIFLGPFAVDRFYLGYSAIAVGKLMTLGGLGVL

SEQ ID NO: 160224 - protein, 152 aa, Heterodera glycines
  Coding regions on vcDNA: vcDNA=SeqID_86647; Strand=-; Position=119-577
SYEKCCCFVSLYLIVLFCTCFHRFVHFSLSVHGTQQTPITTLISKSIISHSSVIRSSFNAVVPLLAPNWSVLVGTRPFCNANRCCRSCCWRCSAAGKRLQRVYSPRMANTRTRSPLRNGYSSVPPPAALPCGSDADCWSACSAVIASRTGQM

SEQ ID NO: 160225 - protein, 178 aa, Heterodera glycines
  misc_feature (11)..(11): Xaa can be any naturally occurring amino acid
  Homolog annotation: Hit_ID=CAA70694.1; Match level="QueryCoverage =99%, HitCoverage=50%, E-value=1e-101, Identity=98%"; Hit description= cathepsin S-like cysteine proteinase [Heterodera glycines]
  Gene Ontology: Mol. function=cathepsin S activity; Cellular component= extracellular space; Biological process=proteolysis and peptidolysis
  Coding regions on vcDNA: vcDNA=SeqID_86648; Strand=+; Position=1-536
TASKIIYLSEXNLVDCSSKYGNEGCDGGLMDSAFEYVRDNNGLDTEESYPYEAVTGKCQFKNETVGGTVVSFKDLKEGDEEQLKIAVATIGPISVALDASNLSFQFYKTGVYYERWCSNRYLDHGVLLVGYGTDETHGDYWLVKNSWGPHWGENGYIRIARNKQNHCGIATMASYPVV

SEQ ID NO: 160226 - protein, 99 aa, Heterodera glycines
  Coding regions on vcDNA: vcDNA=SeqID_86649; Strand=-; Position=24-323
TRVPSGTELAPVAATLSVGTVTAVGKELVSGTVSDGTRTAIGTEFAPLAASDSSSGIFPSATSLSQSGTSWSCFWSPSTSSFASSTSSARSKNDVDAPS

SEQ ID NO: 160227 - protein, 138 aa, Heterodera glycines; identical to SEQ ID NO: 160171
  Coding regions on vcDNA: vcDNA=SeqID_86650; Strand=+; Position=77-493

SEQ ID NO: 160228 - protein, 232 aa, Heterodera glycines
  misc_feature (5)..(5): Xaa can be any naturally occurring amino acid
  Homolog annotation: Hit_ID=NP_494897.3; Match level="QueryCoverage =100%, HitCoverage=23%, E-value=5e-76, Identity=54%"; Hit description= p-type trefoil domain and Glycoside hydrolase, family 31 precursor (106.8 kD) (2F206) [Caenorhabditis el
  Gene Ontology: Mol. function=catalytic activity; Cellular component =brush border; Biological process=glycogen catabolism
  Coding regions on vcDNA: vcDNA=SeqID_86651; Strand=+; Position=21-715
MWPDXHCGFPDFLDPLPNTTDWWVDEFVRFHNEVQFDGIWIDMNEPSVFGTNEKHPWYFDTQPAFAGKPPIAPLMCPEPNNKLDYPPYRTWNAYKWDSKNTKRTLNEKTLCMIGKSGRRNWTMYDTHSLYGWSEMVATQKALRVSTGKRGPLTSRSTFPSSGHYGGHWLGDNQSRWPDLRLSIIGVMEFNMFGIPQVGADVCGLIGDSNEELCLRWQQLGAFHSYYRNHNDV

SEQ ID NO: 160229 - protein, 199 aa, Heterodera glycines
  Coding regions on vcDNA: vcDNA=SeqID_86652; Strand=+; Position=3-599
LKLSNDCTYEGQNIEHFVVNEKYREAVTMSLYAIEPSYKNITDPLKQRYQYKEEFIAMCRNASASPFDVLLRMEQSLKDDCQLPSQEQAENYAAILELFQKIEQRHHMLNLNDAIPMDKYKSIKSSILAKSAREALQEKLNTILNSANSAEEVLQALNKLNSDLHYYPCWLQAMADGNEWKREPLFHFAQIVRLDLMKA

SEQ ID NO: 160230 - protein, 152 aa, Heterodera glycines
  Homolog annotation: Hit_ID=CAA70694.1; Match level="QueryCoverage =100%, HitCoverage=43%, E-value=3e-80, Identity=100%"; Hit description=cathepsin S-like cysteine proteinase [Heterodera glycines]
  Coding regions on vcDNA: vcDNA=SeqID_86653; Strand=+; Position=28-483
MAFLSRLSILPNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWREKGAVTEVKD

SEQ ID NO: 160231 - protein, 134 aa, Heterodera glycines
  Homolog annotation: Hit_ID=AAO33474.1; Match level="QueryCoverage =100%, HitCoverage=97%, E-value=1e-67, Identity=97%"; Hit description= gland-specific protein g4g12 [Heterodera glycines]
  Coding regions on vcDNA: vcDNA=SeqID_86654; Strand=+; Position=1-405
FQIPLIVLLAVVSFRLSASTGDKKTANDGSGNNSSAGIGTKIKRIVTAGLLFTSLATGGAEAIGRSNAQGGNAAGLVPSHVTNRSMAPPPPPVQSEMGANRSEKMRAHLRELAEKMPVNESKRLSPSGPDPHHH

SEQ ID NO: 160232 - protein, 213 aa, Heterodera glycines
  misc_feature (3)..(3): Xaa can be any naturally occurring amino acid
  misc_feature (204)..(204): Xaa can be any naturally occurring amino acid
  Coding regions on vcDNA: vcDNA=SeqID_86655; Strand=+; Position=3-641
MWXSRIYFPENRPMKTAVANAIVCPVCFAKFEPFPNLHAHVLRHLDKKCMAEFFSCKLCKDSNCVLFLSVTAIREHIRTAHGVATDSYLLTNIYPGNNIHKGTTRIMVQEVLKRFARIRFEQWRNVRQIKTKLGSMKRNCSFPPVDDHSWKRKKVGNEGGKVAEEDVIDRILFSPSQIPQNLSERLHRLKKMDRISRHQMIVPXCGMSSFVGL

SEQ ID NO: 160233 - protein, 211 aa, Heterodera glycines
  misc_feature (206)..(206): Xaa can be any naturally occurring amino acid
  Coding regions on vcDNA: vcDNA=SeqID_86656; Strand=+; Position=3-635
GIGYRNPYALNETKIYSSRFSTHDDELLCKCNHFATCGKEGVASYVGEQYMDVCRPGRGGYCSRVVFLNADGTIREVITSCLKREQLVPRELPFVCQNSTTPQWNKLVNCCKSESFCNDIQFPIELGLRNGFLPESFDGLPSVFLTLLISLVLVLLFALSICVAISCCCFPRKRAVVDRCIGWLVQCRSPTLNSSKADCEMDSESXCGAPM

SEQ ID NO: 160234 - protein, 156 aa, Heterodera glycines
  misc_feature (22)..(22): Xaa can be any naturally occurring amino acid
  Homolog annotation: Hit_ID=CAE60650.1; Match level="QueryCoverage =98%, HitCoverage=54%, E-value=1e-46, Identity=54%"; Hit description =Hypothetical protein CBG04296 [Caenorhabditis briggsae]
  Gene Ontology: Mol. function=histone binding; Cellular component =chromatin assembly complex; Biological process=loss of chromatin silencing
  Coding regions on vcDNA: vcDNA=SeqID_86657; Strand=+; Position=1-467
NEFRINVVSVQLLENPATPSDXHKLEIVFEIFENIKEDVEWELVFVGTDGREEHDQVLDSVLIGPIQEGRHKFLFEAPPPQIHNLRPEDSMDVTLLLLKCKYREQLFMKIGWFVTHTYTDPELVENPPSQPVIEKLKRTIVSEDVRVTSYPIKWDE

SEQ ID NO: 160235 - protein, 207 aa, Heterodera glycines
  Homolog annotation: Hit_ID=AAB05072.1; Match level="QueryCoverage =91%, HitCoverage=34%, E-value=7e-76, Identity=74%"; Hit description =CCT-1 pir||JC4083 chaperonin - Caenorhabditis elegans sp|P41988|TCPA_ CAEEL T-complex protein 1, alpha subu
  Gene Ontology: Mol. function=chaperone activity; Cellular component =actin filament; Biological process=protein folding
  Coding regions on vcDNA: vcDNA=SeqID_86658; Strand=+; Position=9-629
LHLHCHVVKSSLGPVGLDKMLVDDVGDVTVTNDGATILKLLEVEHPAGKILVDLAQLQDEEVGDGTTTVVIIAAELLKAADELVRKKIHPTNIINGYRLACKEAVRYMTENLSFPVEELDRASLIRAAKTSMSSKLIGSESDFFAELCVDATVAVKRTDKAGRVSYPINSVNVLKAHGKSSKESQLISGYALNCSAVLTKSYRLAFQ

SEQ ID NO: 160236 - protein, 147 aa, Heterodera glycines
  Coding regions on vcDNA: vcDNA=SeqID_86659; Strand=-; Position=2-442
VVKTCHHRPPWSWPTAAVVVAVHWHPLRSARGCCNAESAHRRRPHFGAVCHWCRRCFASVFHCPRRWQPSPLRASADGSAAQRQLRRVSTPRHRWSHRHTSVSSNPWLSTRLLHVPSVLGTSARRRAHFSARDEESGLSASPSRFKG

SEQ ID NO: 160237 - protein, 55 aa, Heterodera glycines
  misc_feature (32)..(32): Xaa can be any naturally occurring amino acid
  Homolog annotation: Hit_ID=CAE57630.1; Match level="QueryCoverage =81%, HitCoverage=11%, E-value=7e-12, Identity=73%"; Hit description =Hypothetical protein CBG00615 [Caenorhabditis briggsae]
  Coding regions on vcDNA: vcDNA=SeqID_86660; Strand=+; Position=2-167
TLRPGTVLFIDNFRVMHGRKAFQGERVMCGCXYLNRDVFLAKARPKLSPEFYRNV

SEQ ID NO: 160238 - protein, 53 aa, Heterodera glycines
  Coding regions on vcDNA: vcDNA=SeqID_86661; Strand=-; Position=2-160
LDCKKVGDTSIGLSSTLYPSSADQRLYRRMITRGGLQPIHIGPFNQPAKPVNR

SEQ ID NO: 160239 - protein, 128 aa, Heterodera glycines
  Homolog annotation: Hit_ID=NP_741818.1; Match level="QueryCoverage =92%, HitCoverage=31%, E-value=2e-46, Identity=71%"; Hit description =cysteine PRotease related (42.4 kD) (cpr-6) [Caenorhabditis elegans] gb|AAK39189.1| Cysteine protease rel
  Gene Ontology: Mol. function=peroxidase activity; Cellular component =extracellular space; Biological process=protein targeting
  Coding regions on vcDNA: vcDNA=SeqID_86662; Strand=+; Position=1-384
SSNRTTTAIKWRMMGVNHVRHSTKAKKVLGKTRFLDLDLPESFDARQRWNFCPSISLIRDQSSCGSCWAFGAVEAMSDRTCIASGGNIRIALSADYLLSCRHKCGFGCDGGDPLQAWRYWVNEGIVTG

SEQ ID NO: 160240 - protein, 111 aa, Heterodera glycines
  Homolog annotation: Hit_ID=NP_503408.1; Match level="QueryCoverage =72%, HitCoverage=55%, E-value=2e-14, Identity=45%"; Hit description =putative secreted or extracellular protein precursor (5B870) [Caenorhabditis elegans] gb|AAF60880.2| Hypo
  Coding regions on vcDNA: vcDNA=SeqID_86663; Strand=+; Position=71-406
MAVVVYGAESAGPKADQAMAAKQFNPSAFPAMPPELEKILPADVVQKLKAVHADMSLNIMQKQDKIDRIMSSLPGEVLDQIPAPPGFERLPDDVKNRLKQINRQTNKAWAD

SEQ ID NO: 160241 - protein, 172 aa, Heterodera glycines
  Coding regions on vcDNA: vcDNA=SeqID_86664; Strand=+; Position=1-516
QQAEEQKANEGCDPGEKERKERESLIEEAYALSQEANISLEQIIKRYTKCRNQFLERVADQISDQLQQDHSDSTDDISTNKHERKKRPIVFISPQLRKRVKIQQQLAEADSVNDGDDDSEQKQQKEKSPFTIPGGAEDDEMTDVHSQLEQKQQQQKQQQETEAKKSDGTTKT

SEQ ID NO: 160242 - protein, 216 aa, Heterodera glycines
  misc_feature (54)..(54): Xaa can be any naturally occurring amino acid
  Homolog annotation: Hit_ID=CAE57411.1; Match level="QueryCoverage =96%, HitCoverage=24%, E-value=1e-27, Identity=34%"; Hit description =Hypothetical protein CBG00366 [Caenorhabditis briggsae]
  Coding regions on vcDNA: vcDNA=SeqID_86665; Strand=+; Position=17-663
MDWAPWVEAVKQAHENDAGKLKPWQQRYLDWMILQARLCGYLTVKKNDKKAQLXTGSEFLVEFRYKPILLPISVICPFVPFYLFFRANHMQDNGVIVPIEHRYLLKSAPPRALALLSKGNDPENGPWEVTSKKHDALFAALNYCSAREIRQGLWQSYVTRSAFSSQMLNNSQNIEELRHNTEGFAKALGFSSTAHHRISSKMAGSPQTVRVFVDEL

SEQ ID NO: 160243 - protein, 119 aa, Heterodera glycines
  Homolog annotation: Hit_ID=ZP_00329213.1; Match level="QueryCoverage =87%, HitCoverage=65%, E-value=8e-24, Identity=53%"; Hit description =COG0521: Molybdopterin biosynthesis enzymes [Moorella thermoacetica ATCC 39073]
  Gene Ontology: Biological process=establishment of synaptic specificity at neuromuscular junction
  Coding regions on vcDNA: vcDNA=SeqID_86666; Strand=+; Position=3-362
KQIVEYLREYSTKVDCILTSGGTGFSKRDVTPEATKEVIERECPRIAVALLKKGLDITPFAALTRLTAGIAANCLIINLPGSPKAAREGFEVIEPILSHAIAIVKGDESETSVLHKRTA

SEQ ID NO: 160244 - protein, 106 aa, Heterodera glycines
  Coding regions on vcDNA: vcDNA=SeqID_86667; Strand=-; Position=72-392
TFFSMTVAFFSITATFFSMMATLFSMTATFSWRAFTISRSCFGSRYFHSYLFPFDDTWQQKFVQQPTGRERIRWAFCRDRGTISTEVERKALVAMLEIRGQFVLGY

SEQ ID NO: 160245 - protein, 91 aa, Heterodera glycines
  Coding regions on vcDNA: vcDNA=SeqID_86668; Strand=-; Position=2-274
NCAMSSKTTLSLILSHASHFSFLLGTGKVSPLVSAQSFASRIRSIKTFSSLSMFSTQYFSSVSWVKAEFTNFCRSIPRKKRIRKVHFFIFF

SEQ ID NO: 160246 - protein, 134 aa, Heterodera glycines
  misc_feature (21)..(21): Xaa can be any naturally occurring amino acid
  Homolog annotation: Hit_ID=NP_509429.1; Match level="QueryCoverage =97%, HitCoverage=20%, E-value=1e-51, Identity=75%"; Hit description =transmembrane 9 superfamily member 2 (75.3 kD) (XJ38) [Caenorhabditis elegans] gb|AAB71307.1| Temporarily
  Gene Ontology: Mol. function=transporter activity; Cellular component= membrane; Biological process=transport
  Coding regions on vcDNA: vcDNA=SeqID_86669; Strand=+; Position=1-400
VWEHPDVKWSSRRDIILDSCXSTNIQWFSIMNSLVIVIFLSGMVGMILLRTLHRDIARYNRLDEEEDAQEEFGWKLVHGDVFRPPRHALLLSVFVGTGSQVLLCAFITLAFARLGFLSPANRGSLMTFALVFLC

SEQ ID NO: 160247 - protein, 138 aa, Heterodera glycines
  Homolog annotation: Hit_ID=AAO33474.1; Match level="QueryCoverage =100%, HitCoverage=100%, E-value=3e-72, Identity=99%"; Hit description=gland-specific protein g4g12 [Heterodera glycines]
  Coding regions on vcDNA: vcDNA=SeqID_86670; Strand=+; Position=15-431
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPSPVQFEMGANRLEKMRAHLRELAEKMPVNESKRLSPSGPDPHHH

SEQ ID NO: 160248 - protein, 204 aa, Heterodera glycines
  misc_feature (162)..(162): Xaa can be any naturally occurring amino acid
  misc_feature (192)..(192): Xaa can be any naturally occurring amino acid
  Homolog annotation: Hit_ID=NP_001002869.1; Match level="QueryCoverage= 93%, HitCoverage=23%, E-value=6e-50, Identity=58%"; Hit description =DEAD (Asp-Glu-Ala-Asp) box polypeptide 27 [Danio rerio] gb|AAT68047.1| DEAD box polypeptide 27 [Danio
  Gene Ontology: Mol. function=ATP dependent helicase activity; Cellular component=nucleolus; Biological process=ribosome biogenesis
  Coding regions on vcDNA: vcDNA=SeqID_86671; Strand=+; Position=2-611
KSRNSDANCTDLFDDGENEIELLQEATDKTDQLDLKLKNKKSKSVGSDHFFDVRSNQVAASANCAHLSFTDLNLSRPLLKSISEAGFQNPTPIQTACIPVALAGRDICASSATGTGKTAAFMLPILERLLFRPSRRTSVTRVLVLVPTRELAIQVFQVSRQXLAKYTQVEICLAAGGLDLNAQEAALRLGLXIVIATPGRLIDH

SEQ ID NO: 160249 - protein, 56 aa, Heterodera glycines
  Coding regions on vcDNA: vcDNA=SeqID_86672; Strand=-; Position=440-610
DVHIQAAQVAAIHFQSIKGNAAERISSINKHLHTIGALIFVSDHYAFSVVFISFIL

SEQ ID NO: 160250 - protein, 158 aa, Heterodera glycines
  Homolog annotation: Hit_ID=NP_503315.1; Match level="QueryCoverage =90%, HitCoverage=39%, E-value=3e-17, Identity=30%"; Hit description =serpin (srp-1) [Caenorhabditis elegans] gb|AAB71272.1| Serpin protein 1 [Caenorhabditis elegans] gb|AAS13
  Gene Ontology: Mol. function=protein binding; Cellular component =cytosol
  Coding regions on vcDNA: vcDNA=SeqID_86673; Strand=+; Position=91-564
MSSPPSPKASLILEAQADFALKLLREVSTDDRSCIVSPFSAAVTLSMVYAGAKEKTGEEMGQLLANGAPESEVHKYFGALLKSITSGTNSSNTLETANKLYVGKGSKVKDAFKEQIEGNYGGQFETVDFLDGKGTAEKINKFVKEATHKKIRDLVTPD

SEQ ID NO: 160251 - protein, 223 aa, Heterodera glycines
  Homolog annotation: Hit_ID=CAE61649.1; Match level="QueryCoverage =54%, HitCoverage=32%, E-value=6e-28, Identity=57%"; Hit description =Hypothetical protein CBG05583 [Caenorhabditis briggsae]
  Coding regions on vcDNA: vcDNA=SeqID_86674; Strand=+; Position=58-726
MHAQPVPAESQLASGFEFGGSRLSAGSNQFGGISNMGNNSEAMHGKSFGGPSFKFNPLQGTGNNELLTFLDNLQSTLRSSGFNDQSVSEVMQAMQVLAKYNIMGLGLGLGVAAMAQMRNTESAMAQQNVLLGAAASNTPLQQQQQRYDIMSQSNITGSLLDSSQNIDQSIVGGSGGVLIDVMSQKKSGTNGTNTFANSVIKERVVDDGHTELDVPDNIVGAVL

SEQ ID NO: 160252 - protein, 141 aa, Heterodera glycines
  Homolog annotation: Hit_ID=NP_501856.1; Match level="QueryCoverage =36%, HitCoverage=33%, E-value=6e-13, Identity=53%"; Hit description =transthyretin-like family member (4K923) [Caenorhabditis elegans] pir||T24917 hypothetical protein T14G10
  Coding regions on vcDNA: vcDNA=SeqID_86675; Strand=+; Position=2-424
LNFLPGVPNLPDPFVRILHFCNSEEGETIELPEFRIFVPDTYDLGILVLDQKTLPNSTVNFPVPENPRRRLQQAKRPTEVGTLDESNGKKGAEDGFVTVDAPKSHNAKGLHDLLLARLNGDQNERRFVVGDAIGGDGGSAG

SEQ ID NO: 160253 - protein, 140 aa, Heterodera glycines
  Homolog annotation: Hit_ID=CAE67645.1; Match level="QueryCoverage =90%, HitCoverage=36%, E-value=1e-24, Identity=46%"; Hit description =Hypothetical protein CBG13204 [Caenorhabditis briggsae]
  Gene Ontology: Cellular component=cytoplasm; Biological process =antimicrobial humoral response (sensu Invertebrata)
  Coding regions on vcDNA: vcDNA=SeqID_86676; Strand=+; Position=2-421
VLKRVRFTEERNATERVKRSRTEAAEEEKRERLDDEEDGGPAETAEGMKTKRTKKHTLDSDEEDETEGYQRLDMDKVEGQEESTLEYEGHVKIMPFNMKDDLEEGHFDANGTFIFDKKQSVIKDAWLDNIEWDNVKNAVG

SEQ ID NO: 160254 - protein, 175 aa, Heterodera glycines
  misc_feature (21)..(21): Xaa can be any naturally occurring amino acid
  Homolog annotation: Hit_ID=CAE70241.1; Match level="QueryCoverage =97%, HitCoverage=23%, E-value=1e-47, Identity=57%"; Hit description =Hypothetical protein CBG16730 [Caenorhabditis briggsae]
  Gene Ontology: Biological process=nonselective vesicle transport
  Coding regions on vcDNA: vcDNA=SeqID_86677; Strand=+; Position=3-526
ISLFRKPFTHYQITQNALLKXRFFYEFLLANDRQVAREVKDEYVDTTSKMFFSYFKAYVSRLFKFQMVDSATKSDLLGAEDVVKHPTTISALPSLFTSGKTHQTRSRATVFSLGHRQNLLLDDLLAPLIVPHVAQENNETFQFESLFRSVQYALVDHCSHEFLFICDFFMVNGQS

SEQ ID NO: 160255 - protein, 178 aa, Heterodera glycines
  Homolog annotation: Hit_ID=BAA92244.1; Match level="QueryCoverage =82%, HitCoverage=45%, E-value=3e-39, Identity=52%"; Hit description =type 1 protein phosphatase-1 [Vicia faba]
  Gene Ontology: Mol. function=protein serine/threonine phosphatase activity; Cellular component=plasma membrane; Biological process =sodium ion homeostasis
  Coding regions on vcDNA: vcDNA=SeqID_86678; Strand=+; Position=69-602
MAKEEYCFDAKAAAAAGQSRRPSTTASVLVQGDGQSSRFVDAIIRKVTQPPLQRFTDEITDEELKQLCKAATDVFRMQPTLVRIRPPVVVVGDIHGQFSDLQRIFTTHGPPPEQQYMFLGDYVDRGAHSMETIILLFCYKIKYPSNFMLLRGNHECSNINKAYGFYEEIDRRYPRPGA

SEQ ID NO: 160256 - protein, 167 aa, Heterodera glycines
  Homolog annotation: Hit_ID=XP_318657.1; Match level="QueryCoverage =98%, HitCoverage=35%, E-value=9e-33, Identity=49%"; Hit description =ENSANGP00000010224 [Anopheles gambiae]
  Gene Ontology: Mol. function=ATPase activity; Cellular component =mitochondrial outer membrane; Biological process=mitochondrial translocation
  Coding regions on vcDNA: vcDNA=SeqID_86679; Strand=+; Position=3-503
LPSLLYSAPKGILLYGPNGCGKTLIARAIAKEVDAYFINFGTSLVDFVNGSSVTMKSLFTLAEKIQPCVIFIDEIDLLFHRNRNDFQLLKTQFLAQWDEFLRCNSNCNVIIIGATNRVLDLVLCRFSLKVHIPLPDEEAREKLLRKILANENLEADFNYAEVVEATQ

SEQ ID NO: 160257 - protein, 144 aa, Heterodera glycines
  Homolog annotation: Hit_ID=AAP30767.1; Match level="QueryCoverage =100%, HitCoverage=100%, E-value=8e-77, Identity=97%"; Hit description=putative gland protein G21E12 [Heterodera glycines]
  Gene Ontology: Mol. function=structural constituent of cytoskeleton
  Coding regions on vcDNA: vcDNA=SeqID_86680; Strand=+; Position=33-467
MATYLFLAAAAFGAGIYCWKTYLGPMLDQPKSDDEEKPKPEGGEEATTAGEEEKKAGSKGDKHKKKDKKGEGAAAAPAADKKEEKRKDKHKSKESGKSDDSKAGKKDKHGKKDKKGKKKDTTDASTVDEALGEQGAAETSQAEQ

SEQ ID NO: 160258 - protein, 50 aa, Heterodera glycines
  Coding regions on vcDNA: vcDNA=SeqID_86681; Strand=-; Position=1-150
WPTEMSWRKALDRQMSAELGSREVPHESRTEHNSQQFEVDDLAQDLRIKM

SEQ ID NO: 160259 - protein, 109 aa, Heterodera glycines
  Coding regions on vcDNA: vcDNA=SeqID_86682; Strand=+; Position=94-423
NPSSPFVRIPSPVHSSAAALLRLVPNIPLHNALSQILIPPSDQMRGICWLICPTKLTFFCTSLIRQTNNIYLTAEKNIIKFGRLSFFLFLEYRKDYPLGLKELKIRKFS

SEQ ID NO: 160260 - protein, 172 aa, Heterodera glycines
  Coding regions on vcDNA: vcDNA=SeqID_86683; Strand=-; Position=1-516
LEPLHSMTIKCSYFSVNAIASSYVSILLLNLSHARFSSFSTTFALEMFTFSAKFRPPIVGIITAIANSFRMLFIAFSISFCCSFFVRCFLRAFSHAKYLRPIQSPNGDQLKKVPKNLDQWSQLDGHWPFPFGENEKEFGTRKGIDEFGNRRNTFVALQKSCSLKMPKGSQKI

SEQ ID NO: 160261 - protein, 183 aa, Heterodera glycines
  Coding regions on vcDNA: vcDNA=SeqID_86684; Strand=+; Position=48-596
NYNKKARNSLNWTGKLIADELGQFVRAIRLAMGVFKDGTQMARFEDQLFPAKMISPDSTSLYMAHIRLERFCASEHFHVGKFGLATRQIANLLRAFTHRVSGIYSLERCSFLADSLFRLFTKFYECIKWHFRQSPNKSEIEKFGAAILKFGRFVCGTLREGDNAGSFCLPSSTTIGTELLLPS

SEQ ID NO: 160262 - protein, 218 aa, Heterodera glycines
  misc_feature (14)..(14): Xaa can be any naturally occurring amino acid
  misc_feature (197)..(197): Xaa can be any naturally occurring amino acid
  Homolog annotation: Hit_ID=AAC72366.2; Match level="QueryCoverage =99%, HitCoverage=18%, E-value=1e-100, Identity=84%"; Hit description= guanylyl cyclase [Heterodera glycines]
  Gene Ontology: Mol. function=protein tyrosine kinase activity; Cellular component=integral to membrane; Biological process=transport
  Coding regions on vcDNA: vcDNA=SeqID_86685; Strand=+; Position=1-655
WWTAPELLRENNRXGTKEGDVFSFTIIYVEMVNRETVWNGTERDDDVDEILYRLKRTNNTIPHRPQLRPREDTNQSLVHLIRDYWAEVPAERPRMDMVRTMLKQMVQDGNQNLMDYVFGMLEQYASSLEQEVEERTKELVEERTKELVEEKRKSDILLNRMLPRQVADKLKLGEAVEPESFQMATIFFSDVVSFTTXAGKCTPLQVVNLLNGLYTAFD

SEQ ID NO: 160263 - protein, 60 aa, Heterodera glycines
  Coding regions on vcDNA: vcDNA=SeqID_86686; Strand=+; Position=44-226
PLHGCVKFLILNVTKRRLLAKKFPFFGCDANQLLLPPPPPAVNSHDIGLSFGVIHTFISP

SEQ ID NO: 160264 - protein, 173 aa, Heterodera glycines
  Homolog annotation: Hit_ID=CAE61315.1; Match level="QueryCoverage =90%, HitCoverage=85%, E-value=7e-20, Identity=34%"; Hit description =Hypothetical protein CBG05150 [Caenorhabditis briggsae]
  Coding regions on vcDNA: vcDNA=SeqID_86687; Strand=+; Position=69-587
KAQGVAFNSRFAKDNPPLSPRGVQQAEELSVEFRNISIDYCFTSPYERCVQTASKILEGRSTLINVEPGLIESFNLICDRSGVQKISFQTGKELAQRYTNINRQYEPMYLAPPEIEKSKGVHGCFPRVEDTFRKIVAKCYGDILIVSHQGPVAALQRMLTGSMEFGGSATVSK

SEQ ID NO: 160265 - protein, 55 aa, Heterodera glycines
  Coding regions on vcDNA: vcDNA=SeqID_86688; Strand=+; Position=35-199
REEKKLLARHLIFNRTVFIWTSSQNDRGRFVKLAEVAMNGRKNPLFMSMRICKNI

SEQ ID NO: 160266 - protein, 164 aa, Heterodera glycines
  Homolog annotation: Hit_ID=CAE57454.1; Match level="QueryCoverage =39%, HitCoverage=5%, E-value=1e-16, Identity=59%"; Hit description =Hypothetical protein CBG00418 [Caenorhabditis briggsae]
  Gene Ontology: Mol. function=protein binding; Cellular component =lamellipodium; Biological process=small GTPase mediated signal transduction
  Coding regions on vcDNA: vcDNA=SeqID_86689; Strand=+; Position=3-494
PKRTFGTSFDDDFKPNLSTAVDVNVQQKPVDKTSAVGDIEVKNNEIVQNGNQLSKESVSTVPYEQQHGQVIGQVKTVKYKALFEFNARSGDELSIQPGDLILVFEGHQSEPGWLAGQIRDKVGWFPASFAEPLSAAAAGPLLKRGGSLAGSPSGEPLAIIREEC

SEQ ID NO: 160267 - protein, 109 aa, Heterodera glycines
  Coding regions on vcDNA: vcDNA=SeqID_86690; Strand=+; Position=123-452
FLYLIKCFRSIFWIFFCQNSFIFFINFFFALSIFSFPWVQSSLILVFLTFSVYSSTINKNSFFEINSFTKKQKIHEKFAEFSRKKRTIKIFFFHFLEFHYYLIFIYLWN

SEQ ID NO: 160268 - protein, 97 aa, Heterodera glycines
  Coding regions on vcDNA: vcDNA=SeqID_86691; Strand=+; Position=2-295
ISDFLALNDAVNGNDGGVNVGSSSAELALNDEKSWANYRRRLATFDVASRIAKPKEISPVVCARHGWKNVGEEFLQCDDCGKVLYIKLPATKCPIAC

SEQ ID NO: 160269 - protein, 148 aa, Heterodera glycines
  Coding regions on vcDNA: vcDNA=SeqID_86692; Strand=+; Position=3-449
DFLFLIEKIRAKMEEICGTNNNYVDFIVPNSEVHLANFGAIENAHLSILIQNLIDVIRSINARQLVKEFGDKYLEEVMKFLDEAMAASNESLPLAKIVPVLCDAFAKIGTVSFGSIFHSLLSSTELHRFTLFVSECSKRDDLFDANLK

SEQ ID NO: 160270 - protein, 109 aa, Heterodera glycines
  Homolog annotation: Hit_ID=NP_496088.1; Match level="QueryCoverage =88%, HitCoverage=20%, E-value=3e-15, Identity=39%"; Hit description =reverse transcriptase family member (2J964) [Caenorhabditis elegans] pir||T27754 hypothetical protein ZK1
  Coding regions on vcDNA: vcDNA=SeqID_86693; Strand=-; Position=1-327
TFDAHSVGLRSKIQKRNNIIRALAGTTWGQSKEVLLTTYKAIDRSLLDYAAPIWSPQLADSNWSILRRCQNSALRTITGCVSITPTDHLHAETSILPVKDHNLVLSRQL

SEQ ID NO: 160271 - protein, 165 aa, Heterodera glycines; identical to SEQ ID NO: 160212
  Homolog annotation: Hit_ID=NP_501502.1; Match level="QueryCoverage =90%, HitCoverage=19%, E-value=3e-14, Identity=29%"; Hit description =laccase (4J499) [Caenorhabditis elegans] emb|CAA91039.1| Hypothetical protein F21D5.3 [Caenorhabditis ele
  Coding regions on vcDNA: vcDNA=SeqID_86694; Strand=+; Position=58-555

SEQ ID NO: 160272 - protein, 83 aa, Heterodera glycines
  misc_feature (47)..(47): Xaa can be any naturally occurring amino acid
  Homolog annotation: Hit_ID=NP_491749.2; Match level="QueryCoverage =98%, HitCoverage=16%, E-value=4e-28, Identity=68%"; Hit description =ariadne family member (57.3 kD) (1G636) [Caenorhabditis elegans] gb|AAB93645.3| Hypothetical protein C27A
  Gene Ontology: Mol. function=zinc ion binding; Cellular component =nucleus; Biological process=ubiquitin-dependent protein catabolism
  Coding regions on vcDNA: vcDNA=SeqID_86695; Strand=+; Position=1-248
HMTCKNLSCRFEFCWMCLGPWAPHVSRSGWYSCNRFDHDAAHRARDXQERSRAALKRYLHYYSRFTNHQNSLKLERKLFEKVS

SEQ ID NO: 160273 - protein, 186 aa, Heterodera glycines
  misc_feature (128)..(128): Xaa can be any naturally occurring amino acid
  misc_feature (153)..(153): Xaa can be any naturally occurring amino acid
  misc_feature (177)..(177): Xaa can be any naturally occurring amino acid
  Homolog annotation: Hit_ID=AAL78216.1; Match level="QueryCoverage =100%, HitCoverage=55%, E-value=1e-110, Identity=98%"; Hit description=aspartic protease precursor Hgg-33 [Heterodera glycines]
  Gene Ontology: Mol. function=aspartic-type endopeptidase activity; Cellular component=extracellular space; Biological process=induction of non-apoptotic programmed cell death
  Coding regions on vcDNA: vcDNA=SeqID_86696; Strand=+; Position=1-557
QKVPEPVFAFWLNRDPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGKAYTXEGQGLCAENDQHGQKHMPFRFYGHXFAGTCRRTLDSWRCVYWSLLHGVXCGPKSCWFC

SEQ ID NO: 160274 - protein, 85 aa, Heterodera glycines
  Coding regions on vcDNA: vcDNA=SeqID_86697; Strand=+; Position=2-259
PDDGSLSAEQKMERIDSIICTLPENVIDQIPDPPEVAQLPADVRQRVKQIERQQGKSFSTKFEEIMKYVDTLPEGTKSAAKNIFH

SEQ ID NO: 160275 - protein, 70 aa, Heterodera glycines
  Coding regions on vcDNA: vcDNA=SeqID_86698; Strand=-; Position=2-211
WEMLIRRDAPRANVAMADAWRNVDGGGGNADDGRIDSQRRLGGAESEENTTEVCRVADGGAQCGIYVAER

SEQ ID NO: 160276 - protein, 192 aa, Heterodera glycines
  Homolog annotation: Hit_ID=XP_394208.1; Match level="QueryCoverage =87%, HitCoverage=33%, E-value=2e-35, Identity=47%"; Hit description =similar to PDK1 [Apis mellifera]
  Gene Ontology: Mol. function=3-phosphoinositide-dependent protein kinase activity; Cellular component=plasma membrane; Biological process=insulin receptor signaling pathway
  Coding regions on vcDNA: vcDNA=SeqID_86699; Strand=+; Position=1-576
PFLFLAELGEGSYSTVYLASERQTSRKFAVKMCLKKKIIKEKKVQQIFRERDILRLLSTPANACPFVVHLFCTFQDDESLFFVLSYAPKKDLMARLKKLQRFSVGQCQFAMAELFLALEHIHALDVIHRDVKPENILLREDGHILLSDFGCAKQIIAKRENVAEENGDKTDGQRADDGQKAEKSADSKSSKK

SEQ ID NO: 160277 - protein, 213 aa, Heterodera glycines
  Homolog annotation: Hit_ID=CAE65016.1; Match level="QueryCoverage =98%, HitCoverage=34%, E-value=2e-58, Identity=50%"; Hit description =Hypothetical protein CBG09854 [Caenorhabditis briggsae]
  Coding regions on vcDNA: vcDNA=SeqID_86700; Strand=+; Position=2-640
SEWHSYAAGLAEGSLTKLQISNHYSNTVKGICRDNKGYCRKLYRYLNANLEWISAQIDANPGDLYWRQVNLTFNQLTGIFDGYAMDSGKSFSPRVNFTITPIYMIQISGELIDLSILFKKVPRSKGEAVELAEAGHCSGLVKVAAGNSDLLMSHVAMSGFNTMNRIVKLYKFAYDPKDVPGFAVSFSGYPAALASADDFTLTSAGLLSIETTI

SEQ ID NO: 160278 - protein, 91 aa, Heterodera glycines
  misc_feature (81)..(81): Xaa can be any naturally occurring amino acid
  Coding regions on vcDNA: vcDNA=SeqID_86701; Strand=+; Position=400-672
MAKQCFVTVGSTRFDALVESLFRSDVLDALKKLKVECVTIQNGNGVIPKQIQSAILNQTQCIIDGITFHLFDYKASIREYXQSAELIVGHA

SEQ ID NO: 160279 - protein, 169 aa, Heterodera glycines
  misc_feature (52)..(52): Xaa can be any naturally occurring amino acid
  Homolog annotation: Hit_ID=CAE63218.1; Match level="QueryCoverage =92%, HitCoverage=39%, E-value=8e-67, Identity=80%"; Hit description =Hypothetical protein CBG07576 [Caenorhabditis briggsae]
  Gene Ontology: Cellular component=membrane
  Coding regions on vcDNA: vcDNA=SeqID_86702; Strand=+; Position=2-602
TFVYNLSISLALYGLFLFYTATRDLLHPYNPVLKFLTVKSFIFLSFWQGILXIDRSNVSIDPIYDLDGNEIIGRGTVAAGYQNFFICIEMFFAAIALRFAFSVSAYIDAHTVTAGSDVRPMTLQSISSSLKETMNPRDIMQDAIHNFHPQYQQYTQVIIKISCFISLIF

SEQ ID NO: 160280 - protein, 189 aa, Heterodera glycines
  Coding regions on vcDNA: vcDNA=SeqID_86703; Strand=+; Position=3-569
NNWKLKFVECAEEIAEDQWHGLIIAKHQDGVISYESSHGFDDIFGTEQIKETEKYLEINLSKNAEPLGNELQEALSSAAFFDDFMPFVLAFEFGATFCAENGGTTKLCKEKCLSQSLVAPKTKAPFVGPTKFHRTTPRAVPKTTFGIVPKTEETFGFVPFARNVDHFGTNCTNIFFPAEVDKFLLNITA

SEQ ID NO: 160281 - protein, 178 aa, Heterodera glycines
  Homolog annotation: Hit_ID=NP_871916.1; Match level="QueryCoverage =98%, HitCoverage=51%, E-value=3e-79, Identity=79%"; Hit description =enolase and Enolase (36.4 kD) (2J223) [Caenorhabditis elegans] emb|CAD57704.1| Hypothetical protein T21B1
  Gene Ontology: Mol. function=phosphopyruvate hydratase activity; Cellular component=cytoplasm; Biological process=gluconeogenesis
  Coding regions on vcDNA: vcDNA=SeqID_86704; Strand=+; Position=6-542
MTLDFKYPNTDKAQWLTGEQLADMYKSFINDYPVVSIEDAFDQDDWENWSKLQAAIGIQLVGDDLTVTNPKRIQKAVQKKACNCLLLKVNQIGTVTESIEASKLARKSGWGVMVSHRSGETEDTFIADLVVGLATGQIKTGAPCRSERLAKYNRIMRIEEELGTDAVYAGKSFRSPQN

SEQ ID NO: 160282 - protein, 206 aa, Heterodera glycines
  misc_feature (187)..(187): Xaa can be any naturally occurring amino acid
  misc_feature (192)..(192): Xaa can be any naturally occurring amino acid
  Homolog annotation: Hit_ID=AAN32892.1; Match level="QueryCoverage =100%, HitCoverage=96%, E-value=1e-117, Identity=98%"; Hit description=secretory protein 4D06 [Heterodera glycines]
  Coding regions on vcDNA: vcDNA=SeqID_86705; Strand=+; Position=25-640
MSSLLLSIFPIVFLVCCNAMPNFPCCPGSQQVVAVMSKYIDTFSSAADESTVCSTAKSTVDGIKNELSYRVGCPSGGEAQIVNEIDQQLKNIAKMEINYEDECPYNLGFARAMFDLAAAAAGHAGNGTEWQYMKVQFEQESQAIKAIGQEKNFEVTDVHFGVPSKGVSAHQNVPSPSHVIANPGQHXFGWPXERKKNRCHRTSIFE

SEQ ID NO: 160283 - protein, 153 aa, Heterodera glycines
  Coding regions on vcDNA: vcDNA=SeqID_86706; Strand=+; Position=179-637
RLIRLPIFPLPHTISSSKEWCPSSPQNHSSSSTNATNQQHPSQQHQMHLQQQQVQNAVAQLLRQQFPTSAPGIMGMNALLNAAGISGGQAFPNIGTFPVHQHQFDLQSLAAAAQPHHHQQQQQLSSALNLQALVGAGAVHQPPTPITSAAAPN

SEQ ID NO: 160284 - protein, 184 aa, Heterodera glycines
  misc_feature (1)..(1): Xaa can be any naturally occurring amino acid
  misc_feature (5)..(6): Xaa can be any naturally occurring amino acid
  misc_feature (13)..(13): Xaa can be any naturally occurring amino acid
  misc_feature (15)..(15): Xaa can be any naturally occurring amino acid
  Homolog annotation: Hit_ID=NP_490931.1; Match level="QueryCoverage =98%, HitCoverage=48%, E-value=5e-66, Identity=68%"; Hit description =phosphate cytidylyltransferase 2 ethanolamine (42.0 kD) (1C653) [Caenorhabditis elegans] gb|AAK27869.1| H
  Gene Ontology: Mol. function=ethanolamine-phosphate cytidylyltransferase activity; Biological process=phospholipid biosynthesis
  Coding regions on vcDNA: vcDNA=SeqID_86707; Strand=+; Position=1-553
XAYLXXGVLNDEXIXKHKGPPVFNKKERYRMVRGIKWVDKIVEAAPYVTTLKTLDDNNCDFCVHGDDITLTADGKDTYAEVKVFWRYRECSRTPGVSTTDLVGRMLLLTKTHHKSNERELDDVERDHALKLSTDQEDRSPWTCISHFLPSTQTIMQFSEGRAPTPEYRIVYVCGSFDLFHIGHL

SEQ ID NO: 160285 - protein, 89 aa, Heterodera glycines
  Coding regions on vcDNA: vcDNA=SeqID_86708; Strand=+; Position=12-281
AKREKPNAPMEREKKKKSGGEETNALPFPCSIVYKSLPFSPFRYSPTLQFLLAVSFCFPSDPSDEFAVPFLPSMTHPQKAINSLIFLLP

SEQ ID NO: 160286 - protein, 231 aa, Heterodera glycines
  Homolog annotation: Hit_ID=NP_496722.1; Match level="QueryCoverage =92%, HitCoverage=56%, E-value=9e-22, Identity=32%"; Hit description =putative nuclear protein (43.0 kD) (2N92) [Caenorhabditis elegans] emb|CAB60360.1| Hypothetical protein Y
  Coding regions on vcDNA: vcDNA=SeqID_86709; Strand=+; Position=3-698
GLNHSTLGILRNRSINRIPIRIEECAENENGFADDYANYLFDSDQSDSDNAEEENEVSVQIQSQPIGGHRRKKTKSYRPIEIVDGFPLKRNMGAQKWRRVENTRLLTSFADTQDICFDGSDLIPETISAFSRLLRDEAKMKVWNDFLEKDESGQKKRLLQFEYEILMARDASKAQHSQQSVKNTDIKKSESQPHNKNGQPSSGGGKSSSDCFQRLDKKFRRLFAQTTERPI

SEQ ID NO: 160287 - protein, 106 aa, Heterodera glycines
  Homolog annotation: Hit_ID=NP_490685.1; Match level="QueryCoverage =85%, HitCoverage=91%, E-value=2e-11, Identity=37%"; Hit description =transposase (1A616) [Caenorhabditis elegans] gb|AAB54166.1| Hypothetical protein F53G12.11 [Caenorhabditi
  Coding regions on vcDNA: vcDNA=SeqID_86710; Strand=+; Position=199-519
ATSTSPSALETRQKAEVEVNEYLRDPKIKSRADPSLYWEVNSQKWPMIGDVVRKFLSPPATSSESERLFSTAGLISDDLRKSLLPENLAKLLFLHHNLLLTGFSIE

SEQ ID NO: 160288 - protein, 42 aa, Heterodera glycines
  Coding regions on vcDNA: vcDNA=SeqID_86711; Strand=+; Position=159-287
ELSSLCDFFLFDILTLTHFGLMLKYCASFCFSFLSNLWSGDE

SEQ ID NO: 160289 - protein, 195 aa, Heterodera glycines
  Homolog annotation: Hit_ID=A48449; Match level="QueryCoverage=100%, HitCoverage=51%, E-value=1e-109, Identity=98%"; Hit description =Actin-1A - nematode (Onchocerca volvulus)
  Gene Ontology: Biological process=reproduction
  Coding regions on vcDNA: vcDNA=SeqID_86712; Strand=+; Position=1-585
GSGMCKAGFAGDDVPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVTHTEPIYEGYALPHAILRLDLAGRDLTDYLMKILTERGYSFTTTAERE

SEQ ID NO: 160290 - protein, 83 aa, Heterodera glycines
  Homolog annotation: Hit_ID=NP_105252.1; Match level="QueryCoverage =57%, HitCoverage=6%, E-value=6e-11, Identity=54%"; Hit description =hypothetical protein mll4364 [Mesorhizobium loti MAFF303099] dbj|BAB51038.1| mll4364 [Mesorhizobium loti M
  Coding regions on vcDNA: vcDNA=SeqID_86713; Strand=+; Position=3-251
GSLVATRLFQKLRFAEKGGRLAWAFMGAIATGATIWCTHFVAMIAYQPGVDVTYEPGLTGVSLGIAICGSALALWFGSRQMRF

SEQ ID NO: 160291 - protein, 209 aa, Heterodera glycines
  Homolog annotation: Hit_ID=NP_741263.2; Match level="QueryCoverage =95%, HitCoverage=17%, E-value=1e-58, Identity=55%"; Hit description =UNCoordinated locomotion UNC-16, EGg Laying defective EGL-39, putative protein, with 3 coiled coil-4 doma
  Gene Ontology: Mol. function=protein kinase binding; Cellular component=cytoplasm; Biological process=regulation of JNK cascade
  Coding regions on vcDNA: vcDNA=SeqID_86714; Strand=+; Position=1-627
DFFVISLDPSVTNAMQSSVSSNEMIFGGNSTVCSEESHAMSEKVQTIASSIYREFETMIQKHGQESIKDLMSLVVNVLESLDTAYQEKDELIVDLEMLKDENGQLLNQYERERQMRKNQDQKSLEREEFMSETIRELESKVQSMASIVRMLELKAKNANDHAMRLEEREADQKIEYEKLHERYNELLRTHIEHVERTKFLMGSEMFDMA

SEQ ID NO: 160292 - protein, 196 aa, Heterodera glycines
  Homolog annotation: Hit_ID=NP_491361.1; Match level="QueryCoverage =94%, HitCoverage=42%, E-value=1e-34, Identity=40%"; Hit description =thioredoxin type domain containing protein (50.9 kD) (1E948) [Caenorhabditis elegans] gb|AAL11490.1| Hypo
  Coding regions on vcDNA: vcDNA=SeqID_86715; Strand=+; Position=5-592
WIICFSEAEKDDLEKWFGRNRWPFLTQISATNIRKIAESTGKLLVLSSIEGMDRHNASTESGSFFALIKRTVVEARVDAEIEQHFQFGWLDGTQIASGVVMDSLLLPNLVVLNYSSYEFYLSKDHPAQMTAKSLLLFLHSVRLGEVTVHGGRAWITRLRRMAYEITSNVYDMFQHQPILTVCLFGVPLAFFSIITY

SEQ ID NO: 160293 - protein, 97 aa, Heterodera glycines
  Coding regions on vcDNA: vcDNA=SeqID_86716; Strand=+; Position=3-293
LWDGHFDENDSDRMAGKALEWLSYHLKLAKNDETNYDETLTRVIRLLGLSIQRKWTEAKSLAEEMFITVAPSDNARQMIYSSMEQMQQFLNFDEHIE

SEQ ID NO: 160294 - protein, 87 aa, Heterodera glycines
  Coding regions on vcDNA: vcDNA=SeqID_86717; Strand=-; Position=77-340
RVKVRVSAISVVLLGVDLRRDIARNACWGYVGTMSEDEKLQERRRMVRPPTGGTAAGRSMGTKMKTPDTKSMSSQERIKRQLPSLVK

SEQ ID NO: 160295 - protein, 175 aa, Heterodera glycines
  Homolog annotation: Hit_ID=AAH65093.1; Match level="QueryCoverage =82%, HitCoverage=14%, E-value=2e-12, Identity=35%"; Hit description =Ankrd27 protein [Mus musculus]
  Gene Ontology: Mol. function=transcription factor activity; Cellular component=membrane; Biological process=regulation of transcription, DNA-dependent
  Coding regions on vcDNA: vcDNA=SeqID_86718; Strand=+; Position=56-580
MADDIPPPPAVAADGGDVVVDLEQHVRQLIMSIGQGSEDAVHELSILIESFNQEQLVDFLEIMARMYVESGVSVDMPGGQGINMLMVAASSGRVDFARYLLAHGATVGHLDATGSVFPLMLAAESGELEVCRLLVEEWAAEVNQQAIDGTTPLMSASSEGRLDVVIYLIDHGVEI

SEQ ID NO: 160296 - protein, 235 aa, Heterodera glycines
  Coding regions on vcDNA: vcDNA=SeqID_86719; Strand=+; Position=1-708
PTTGLTPAESVRRSQISALVEPKQPQQQQQDINNGAGDEHGGVLRRSISVLSDNWYDWVEGNQTDKAGLSNQQQNVIVHQSVNSTIDADEHGISDEASPVASLSTIDLGRVYTTVGTVMESLLVNFAHLWQYRFFRVAFVLLSIYFCLGFLERCAVAMTAACVRWAWPPVHFMLGSSRGTLFYLTDWFAWMDDFLSSWVCDMANRYCHQYDVMCDCQCSFVSRTQRAALLGGRRF

SEQ ID NO: 160297 - protein, 126 aa, Heterodera glycines
  Coding regions on vcDNA: vcDNA=SeqID_86720; Strand=-; Position=44-424
IHLADENPVHIRHIRRASQPNGHREWSSPIFLTFHLFRWSNPQFVPHKPRQPVLVQLPSRIRLPFSVHSPPSISHPRVHRCGCCCCCQPSLPREIRAPIVPRMGQRRRCHRRTPRDDAPRRSRTTS

SEQ ID NO: 160298 - protein, 87 aa, Heterodera glycines
  Coding regions on vcDNA: vcDNA=SeqID_86721; Strand=+; Position=1-261
FCLFCFFLPTFHGSPFLLPLTHLIVRRHKLIIRAPKKSLILATLPRRRRTANGRRSRAKKRRPKAAAAVHRRRRKKKNTKKKKNKKK

SEQ ID NO: 160299 - protein, 182 aa, Heterodera glycines; identical to SEQ ID NO: 158791
  Homolog annotation: Hit_ID=AAP30768.1; Match level="QueryCoverage =100%, HitCoverage=100%, E-value=1e-101, Identity=100%"; Hit description=putative gland protein G22C12 [Heterodera glycines]
  Coding regions on vcDNA: vcDNA=SeqID_86722; Strand=+; Position=6-554

SEQ ID NO: 160300 - protein, 188 aa, Heterodera glycines
  Homolog annotation: Hit_ID=NP_501912.1; Match level="QueryCoverage =89%, HitCoverage=28%, E-value=3e-44, Identity=52%"; Hit description =yeast SIR related (68.8 kD) (sir-2.1) [Caenorhabditis elegans] emb|CAA94364.1| Hypothetical protein R11A8
  Gene Ontology: Mol. function=NAD+ ADP-ribosyltransferase activity; Cellular component=cytoplasm; Biological process=chromatin silencing
  Coding regions on vcDNA: vcDNA=SeqID_86723; Strand=+; Position=1-564
SFAGTLLLEGGEEFSPDAQCAQQWKKPNESLFVVQQLARQGLGPRQILATLYPRYCSTISDDIPDEWIMQLLRELCEHRTRQKLSNYNTFEDAVELFRKSKRILVITGAGVSVSCGIPDFRSENGVYARLKKDFPELPTPTAMFDIDFFRQNPRPFYNFAREIFPGQFRPSLSHMFIKFLDDEKKLLR

SEQ ID NO: 160301 - protein, 172 aa, Heterodera glycines
  Coding regions on vcDNA: vcDNA=SeqID_86724; Strand=+; Position=1-516
ENRLSIRLYFAKIMAIFTKIFNFIKTSTEKENKQKYLLVFVEIWNKICPRIHAELQQNDISSTVGILYNIWRGIASRYNQIPLGIFQGYEPIRVLSSDNGLLLLDEKGTYSSNVIRAELFEDHVVNMLRLYEQQSEGNSFGLLLRRCKLDGIAYKHLDKFANGNEFEKLRAK

SEQ ID NO: 160302 - protein, 140 aa, Heterodera glycines
  misc_feature (10)..(10): Xaa can be any naturally occurring amino acid
  misc_feature (15)..(15): Xaa can be any naturally occurring amino acid
  misc_feature (20)..(20): Xaa can be any naturally occurring amino acid
  misc_feature (24)..(24): Xaa can be any naturally occurring amino acid
  Coding regions on vcDNA: vcDNA=SeqID_86725; Strand=+; Position=1-420
KKKRGTIRKXEEEEXDEIFXNGTXKRDNRPDTDHDYAGTRQLATAKGATGKHQRQKGGGGTAKEPKKKTALVNGTDSVVRSSARPHRPTKRFVFETNESFIRGTSKVRPTSPRKHGKKSTAEGGSEGEESEDDGKEDSVE

SEQ ID NO: 160303 - protein, 125 aa, Heterodera glycines
  Homolog annotation: Hit_ID=NP_495449.1; Match level="QueryCoverage =100%, HitCoverage=31%, E-value=4e-36, Identity=56%"; Hit description= cystathionine gamma-lyase (43.1 kD) (2H346) [Caenorhabditis elegans] gb|AAB93432.1| Hypothetical protein
  Gene Ontology: Biological process=sulfur amino acid metabolism
  Coding regions on vcDNA: vcDNA=SeqID_86726; Strand=+; Position=3-377
LKIVDFQAVCRMVRARSKHCVVVVDNTFMTPYLQRPLELGADVAVQSLTKYINGHADVLMGTVVTNKEQLDQHIYAQQIYAGAVPSAFDAFLVLHGIKTLPLRMRQHVENALAIGRWLEKDPRVE

SEQ ID NO: 160304 - protein, 210 aa, Heterodera glycines
  Homolog annotation: Hit_ID=XP_315369.1; Match level="QueryCoverage =99%, HitCoverage=30%, E-value=1e-34, Identity=39%"; Hit description =ENSANGP00000020955 [Anopheles gambiae]
  Gene Ontology: Mol. function=protein binding; Cellular component =Golgi apparatus; Biological process=N signaling pathway
  Coding regions on vcDNA: vcDNA=SeqID_86727; Strand=+; Position=2-631
AEIISYLSPSDLALSAAGVSRLWRSLSEDKLLWAGKCRQHSINEMFPPNICRKENWARSDTGGESSSELANIYNDSSRAKSVAFPPPNPSPMPLCLHRSRWKAVFLRSLRVSNNWKLRRPTAVCQLRGHDEHVITCLKLRGDLIVTGSDDCTLRVWSAATGTCVHVLNGHIGGVWALQLSQDGKIAVSGSTDRTVRVWDTEKGTLIHCLN

SEQ ID NO: 160305 - protein, 80 aa, Heterodera glycines
  Coding regions on vcDNA: vcDNA=SeqID_86728; Strand=-; Position=1-240
MDKMRVIVGGEMGKRNTQTENSRFDQAEKAKANASAKGIHSKGSRAIPICSASRNTPSIARFVAWLSLSHSKHGKVHCLH

SEQ ID NO: 160306 - protein, 109 aa, Heterodera glycines
  Homolog annotation: Hit_ID=CAF92101.1; Match level="QueryCoverage =99%, HitCoverage=5%, E-value=3e-20, Identity=48%"; Hit description =unnamed protein product [Tetraodon nigroviridis]
  Gene Ontology: Mol. function=ARF guanyl-nucleotide exchange factor activity; Cellular component=Golgi apparatus; Biological process =retrograde (Golgi to ER) transport
  Coding regions on vcDNA: vcDNA=SeqID_86729; Strand=+; Position=3-332
IAGAVQSIADSVTKAKFVGTTKLGIDECVLFQILQSLRSLVLSPGGRHLTNETLCEILQCCFRIGLESSLPELLRMAAENALAEMCRYLFASIQTFEQDIRPGLKELMK

SEQ ID NO: 160307 - protein, 176 aa, Heterodera glycines
  Homolog annotation: Hit_ID=CAE60358.1; Match level="QueryCoverage =94%, HitCoverage=96%, E-value=2e-70, Identity=76%"; Hit description =Hypothetical protein CBG03955 [Caenorhabditis briggsae]
  Gene Ontology: Mol. function=calcium ion binding; Cellular component =plasma membrane; Biological process=regulation of action potential
  Coding regions on vcDNA: vcDNA=SeqID_86730; Strand=+; Position=3-533
TSSPDIPLIFQSVDRDRSGQISADELQQALSNGTWKPFNPETCRMMISMFDSNNDGGINFQEFGALWEYINDWTRTFRTFDRDNSGNIDRDELVNALTQFGYRLSGTFYDMLMRKFDRTQSGRINFDDFIQLCVVLQTLTTAFREKDTDRDGWIRIYYEEFLAMVFSLKMSMMAKQ

SEQ ID NO: 160308 - protein, 134 aa, Heterodera glycines
  misc_feature (24)..(24): Xaa can be any naturally occurring amino acid
  Homolog annotation: Hit_ID=AAO33474.1; Match level="QueryCoverage =99%, HitCoverage=95%, E-value=7e-68, Identity=99%"; Hit description =gland-specific protein g4g12 [Heterodera glycines]
  Coding regions on vcDNA: vcDNA=SeqID_86731; Strand=+; Position=1-403
LILLIVLLAVVSFRLSASTGDKKXTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160309 - protein, 194 aa, Heterodera glycines
  misc_feature (112)..(112): Xaa can be any naturally occurring amino acid
  Homolog annotation: Hit_ID=NP_493334.1; Match level="QueryCoverage =90%, HitCoverage=55%, E-value=8e-49, Identity=53%"; Hit description =GTP-binding protein like (39.4 kD) (1N870) [Caenorhabditis elegans] emb|CAB07637.1| Hypothetical protein
  Coding regions on vcDNA: vcDNA=SeqID_86732; Strand=+; Position=1-583
TCANLVRKPLKAEEGGQGEEMSYDIEMRIMATAGLVGIPNVGKSTLLRAISRAKPKVAAYPFTTLSPSVGMVQYGDFFQLAVADIPGLVQGAHRNEGLGFSFLRHIVRCESXMTLYDDELSKKEAAIVINKTDLLDGEMVKSAIVSMFPEQSVFFVSGRHRLGIEPLLMFLREKHERFLKEREAKMEIEREQLM

SEQ ID NO: 160310 - protein, 90 aa, Heterodera glycines
  Coding regions on vcDNA: vcDNA=SeqID_86733; Strand=+; Position=3-275
KCPLLPLHFVFFVRPFSSELPFCGAQLADVQALQTHWLQQHVAQLARPHVCVDCDAGFTTAEALRAHREMQHAEKTARKEQRISSRNEVK

SEQ ID NO: 160311 - protein, 75 aa, Heterodera glycines
  Homolog annotation: Hit_ID=NP_498263.1; Match level="QueryCoverage =88%, HitCoverage=12%, E-value=7e-23, Identity=74%"; Hit description =ALDH7A2, ALdehyde deHydrogenase (alh-9) [Caenorhabditis elegans] gb|AAC46640.1| Aldehyde dehydrogenase pr
  Gene Ontology: Mol. function=aldehyde dehydrogenase (NAD+) activity; Biological process=aldehyde metabolism
  Coding regions on vcDNA: vcDNA=SeqID_86734; Strand=+; Position=209-433
MNFGPSFFQVGVISAFNFPAAVYGWNAALALVCGNSVLWKPSPSTPLTSIAITRLVGEVLSKNGLSPDICSLICG

SEQ ID NO: 160312 - protein, 34 aa, Heterodera glycines
  misc_feature (11)..(11): Xaa can be any naturally occurring amino acid
  misc_feature (20)..(21): Xaa can be any naturally occurring amino acid
  Coding regions on vcDNA: vcDNA=SeqID_86735; Strand=-; Position=0-101
CCLISSGCSSXAGTFHPSDXXLDRHSPIDRGQHL

SEQ ID NO: 160313 - protein, 156 aa, Heterodera glycines
  Coding regions on vcDNA: vcDNA=SeqID_86736; Strand=-; Position=117-587
RVQVPQLHFLLVIPHGAHIASPNCLALHPIDAPVVRDHCRVHPRTLCAALRLLLLLVVFAAAALRLVALSLGHFLCIFQCLFICVQIRQSKHQQFVVLCSVSQQQAKRSLENRSDCRPKSRTKHQNLNTDSSFRMCETTNTPSHRIPILRSPSKFG

SEQ ID NO: 160314 - protein, 228 aa, Heterodera glycines
  Homolog annotation: Hit_ID=XP_311177.1; Match level="QueryCoverage =98%, HitCoverage=55%, E-value=1e-128, Identity=99%"; Hit description= ENSANGP00000019055 [Anopheles gambiae]
  Gene Ontology: Biological process=reproduction
  Coding regions on vcDNA: vcDNA=SeqID_86737; Strand=+; Position=32-715
FVDKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVALDF

SEQ ID NO: 160315 - protein, 132 aa, Heterodera glycines
  Homolog annotation: Hit_ID=NP_783594.1; Match level="QueryCoverage =80%, HitCoverage=83%, E-value=7e-22, Identity=47%"; Hit description =histone 1, H2ba [Mus musculus] emb|CAI35973.1| OTTMUSP00000000673 [Mus musculus] gb|AAO06249.1| histone p
  Gene Ontology: Mol. function=DNA binding; Cellular component =nucleosome; Biological process=nucleosome assembly
  Coding regions on vcDNA: vcDNA=SeqID_86738; Strand=+; Position=1-399
QQHRTKMARRRRKKEPRKQSYKLYVRRVLKEVHPGKEISMRALNIMNSFVIDALDRIATEATRMAHNDRRKTITLRDMEFSVRLCLPDVMAKDANQKAQKTVTKFYAAKVRDRMRRTEMRRGEFAMMQMAAL

SEQ ID NO: 160316 - protein, 64 aa, Heterodera glycines
  Homolog annotation: Hit_ID=NP_001003835.1; Match level="QueryCoverage= 90%, HitCoverage=4%, E-value=7e-12, Identity=53%"; Hit description =TATA box binding protein (TBP)-associated factor 150kDa [Danio rerio] gb|AAT68099.1| TATA box binding p
  Coding regions on vcDNA: vcDNA=SeqID_86739; Strand=+; Position=3-194
LSAARATSAANIGFAIGDFQIHVQPEMPEIINFVVPELIPLLKHTMKSLNRIFVFFEELLSCRF

SEQ ID NO: 160317 - protein, 273 aa, Heterodera glycines
  misc_feature (16)..(16): Xaa can be any naturally occurring amino acid
  misc_feature (190)..(190): Xaa can be any naturally occurring amino acid
  Homolog annotation: Hit_ID=CAE69683.1; Match level="QueryCoverage =99%, HitCoverage=57%, E-value=3e-50, Identity=43%"; Hit description =Hypothetical protein CBG15936 [Caenorhabditis briggsae]
  Gene Ontology: Cellular component=mitochondrion
  Coding regions on vcDNA: vcDNA=SeqID_86740; Strand=+; Position=1-819
LLAFLIGPSIGAFFSXVPAESGEFDPSPALLAIALTLAELALLVFFLPETLAKAKNDDCHKQSGHSLRHLLSPRALFSFDFLSPASASSPPVSVPLLQKYSRVYFLFMLLFSAMEFTLGFLTHLRFNYSSMQQGRLYLFSGFCMLVIQGFVVRRIPSTLKAQSHGALVGLVSIVPAYFVIAFAHCQNGIXTALFMGLLLFSVASATVVPFLTTLFSNQCDQSAKGACLGTFRSVGALARACGPLVGALLFWLLGPTLSYCLGAIGLIAPGIIF

SEQ ID NO: 160318 - protein, 145 aa, Heterodera glycines
  misc_feature (114)..(114): Xaa can be any naturally occurring amino acid
  Homolog annotation: Hit_ID=AAO85452.1; Match level="QueryCoverage =100%, HitCoverage=27%, E-value=1e-74, Identity=99%"; Hit description= putative gland protein G12H04 [Heterodera glycines]
  Coding regions on vcDNA: vcDNA=SeqID_86741; Strand=+; Position=50-483
MALSALLLLLPLLLNVQNIPDESVQSDMKAVYSAISSPEQWKNSQNSLASLESQLTEPQRALAKMHWELETIQKEKPEAPPQFDLGLFSEALEVMVEMDEEAKEVKLRKDKLIXMGRRRGSKKKLKEKMTEEDTVPEVRVNENGK

SEQ ID NO: 160319 - protein, 142 aa, Heterodera glycines
  Coding regions on vcDNA: vcDNA=SeqID_86742; Strand=+; Position=2-430
MEGTTSPPYFLRSRTRKEGPAVLELIEKLQQANDKVDQQIAEEHQLRNEVLQMAPRAMKKYLGTRFERLMNAKLEFPQMADSERKSEAELAKAKEELRQLKLQAVKEAEEQKRELEEAQRMERELKERVNRKLAKLRALEEM

SEQ ID NO: 160320 - protein, 81 aa, Heterodera glycines
  misc_feature (5)..(5): Xaa can be any naturally occurring amino acid
  misc_feature (8)..(8): Xaa can be any naturally occurring amino acid
  misc_feature (15)..(16): Xaa can be any naturally occurring amino acid
  misc_feature (24)..(24): Xaa can be any naturally occurring amino acid
  misc_feature (30)..(30): Xaa can be any naturally occurring amino acid
  misc_feature (33)..(33): Xaa can be any naturally occurring amino acid
  misc_feature (48)..(48): Xaa can be any naturally occurring amino acid
  misc_feature (57)..(57): Xaa can be any naturally occurring amino acid
  misc_feature (60)..(60): Xaa can be any naturally occurring amino acid
  misc_feature (62)..(62): Xaa can be any naturally occurring amino acid
  misc_feature (68)..(68): Xaa can be any naturally occurring amino acid
  misc_feature (80)..(80): Xaa can be any naturally occurring amino acid
  Coding regions on vcDNA: vcDNA=SeqID_86743; Strand=+; Position=3-248
GHRHXFQXPRISSHXXEGYFAQHXTGGTSXDVXLPAPTIGTKGREGKXAQISRGNRXGTXFXRNKFCXELELARKAYHGXL

SEQ ID NO: 160321 - protein, 238 aa, Heterodera glycines
  Homolog annotation: Hit_ID=CAE61387.1; Match level="QueryCoverage =56%, HitCoverage=28%, E-value=1e-23, Identity=44%"; Hit description =Hypothetical protein CBG05236 [Caenorhabditis briggsae]
  Coding regions on vcDNA: vcDNA=SeqID_86744; Strand=+; Position=3-716
KCHNNWREKLRSLQEYGDFKQFLRLCHLEPGYGYELLAPVHSDFPAEGSICELQVGRRQLVLIYPDDEGCTVRFALPSKRIRVWRVSHSEHQLLAQMSFQLEYLRQPDEFGLITLRTDQSVLLSLFLQSIADEILQDQQYKTESPFKFVDDAISLKAASDGSSAVASSSIVAGVGDDQKSVKSCSNNSSSSNHANSSSCALDALVNGAGGDGTEYRIKLISYQMPFLDHENFEDVLDA

SEQ ID NO: 160322 - protein, 221 aa, Heterodera glycines
  Homolog annotation: Hit_ID=CAE70921.1; Match level="QueryCoverage =99%, HitCoverage=21%, E-value=7e-16, Identity=30%"; Hit description =Hypothetical protein CBG17720 [Caenorhabditis briggsae]
  Coding regions on vcDNA: vcDNA=SeqID_86745; Strand=+; Position=66-728
MGNEKGIPIAEPEIVAFNSPDNSDREWMTMFERCVNKHIQFIMLVDEKRKDTHGLLKLSEAMHKVTTQHVTLEKANDVVRKNQRQTLENILNKLNMKNFGLNYVPVMEPSACRRFSLENGNVLVIGYDVNHPAPMPQQTRRLLASQGESQLSSLDPSCVGICANMAPDFNAFVGDYFFQESRREAIDQMQLVDRMKWILQNVEKHRPGKSRPEYIFIFRDG

SEQ ID NO: 160323 - protein, 197 aa, Heterodera glycines
  Homolog annotation: Hit_ID=CAE72411.1; Match level="QueryCoverage =74%, HitCoverage=94%, E-value=1e-16, Identity=29%"; Hit description =Hypothetical protein CBG19572 [Caenorhabditis briggsae]
  Coding regions on vcDNA: vcDNA=SeqID_86746; Strand=+; Position=8-601
NSLVNTIRAVPPVPFRLAWSRFTSRVSSESSQFRPADDSRQLIEDNHFLLTIVISNATNHESISYKQDGGRFDSSQFTLKFHANTLYKIYVKTKPAQQFLSLNIAGNVLSLAPIEGGSGEYVAIWNTADKEPTKKGTRQDIEFVLSAKDKTLSKNLQVKFYPHNDTHAGWGQKLDQITWRCSTNDIGHVFVLEEQAL

SEQ ID NO: 160324 - protein, 157 aa, Heterodera glycines
  Homolog annotation: Hit_ID=NP_492033.1; Match level="QueryCoverage =58%, HitCoverage=21%, E-value=8e-27, Identity=59%"; Hit description =acyltransferase (46.9 kD) (1H765) [Caenorhabditis elegans] emb|CAA95833.1| Hypothetical protein M05B5.4 [
  Gene Ontology: Cellular component=extracellular space
  Coding regions on vcDNA: vcDNA=SeqID_86747; Strand=+; Position=15-485
MRGGGEGGGIFLSVIVRLSKKGGFQMLFSPNSVLLLLLIVLPFSLSFILIPQNVRQISPALSSRPFRRFGHFSVIAKRNPIVLIPGDGGSRLKANLTGKPSVVHYFCQRQTNDFFALWLDLQQFGPFVIDCWADNMRLNFNRTSGRAQDLEGVKVRV

SEQ ID NO: 160325 - protein, 190 aa, Heterodera glycines
  Coding regions on vcDNA: vcDNA=SeqID_86748; Strand=+; Position=1-570
SPSFICTNNNLFAVNSVNPNAHSQQMAMETLGGGEERNKMETEMDVSVGEESPHQQRFLEECLNLSQKFLKEMSKDEEQQQNVINGEANDGKSDVAKELLICHSSSPTASPQPSGCFLTSANVVAESDGILREQNRSGEADGQSTAATTPNASRRPSNSSAAAVSGSVEDELAKIKVVLRQHERRIRLLE

SEQ ID NO: 160326 - protein, 216 aa, Heterodera glycines
  Coding regions on vcDNA: vcDNA=SeqID_86749; Strand=+; Position=1-648
KIGKRFGVGKGTIGKLKFVECAEEIAEDQWHGLIIAKHQDGVISYESSHGFDDIFGTEQIKETEKYLEINLSKNAEPLGNELQEALSSAAFFDDFMPFVLAFEFGATFCAENGGTTKLCKEKCLSQSLVAPKTKAPFVGPTKFHRTTPRAVPKTTFGIVPKTEETFGFVPFARNVDHFGTNCTNIFFPAEVDKFLLNITARPYEIACNDYEKRAKI

SEQ ID NO: 160327 - protein, 213 aa, Heterodera glycines
  Coding regions on vcDNA: vcDNA=SeqID_86750; Strand=+; Position=1-639
LLEPAPSSVDYFFWQSDEASSSSVCAEERRQMYEQYGGQKQMRRTENDKNTEQCQRNAQRNIGERMPTMDDNNDQQPSMLRRMPLQSMENASLLKSSEFSSSEHFSACKKEPIEQSEVIAPKNRLGPPAHWRVEETEKRQKRSAKRAPLPRQTTYQIDEHGRQVVVVRNDDSYRSNDEDDERTENAERGVPPIARNGFVKPAYSYSCLIGLSL

SEQ ID NO: 160328 - protein, 181 aa, Heterodera glycines
  Homolog annotation: Hit_ID=NP_871916.1; Match level="QueryCoverage =98%, HitCoverage=53%, E-value=6e-82, Identity=79%"; Hit description =enolase and Enolase (36.4 kD) (2J223) [Caenorhabditis elegans] emb|CAD57704.1| Hypothetical protein T21B1
  Gene Ontology: Mol. function=phosphopyruvate hydratase activity; Cellular component=cytoplasm; Biological process=gluconeogenesis
  Coding regions on vcDNA: vcDNA=SeqID_86751; Strand=+; Position=35-580
RGKIDLDFKNPNTDKAQWLTGEQLADMYKSFINDYPVVSIEDAFDQDDWENWSKLQAAIGIQLVGDDLTVTNPKRIQKAVQKKACNCLLLKVNQIGTVTESIEASKLARKSGWGVMVSHRSGETEDTFIADLVVGLATGQIKTGAPCRSERLAKYNRIMRIEEELGTDAVYAGKSFRSPQN

SEQ ID NO: 160329 - protein, 120 aa, Heterodera glycines
  misc_feature (108)..(108): Xaa can be any naturally occurring amino acid
  Homolog annotation: Hit_ID=AAN32892.1; Match level="QueryCoverage =98%, HitCoverage=55%, E-value=4e-59, Identity=94%"; Hit description =secretory protein 4D06 [Heterodera glycines]
  Coding regions on vcDNA: vcDNA=SeqID_86752; Strand=+; Position=3-362
CLLCCSHLPIVFLVCCNAMPNFPCCPGSQQVVAVMSKYIDTFSSAADESTVCSTAKSTVDGIKNELSYRVGCPSGGEAQIVNEIDQQLKNIAKMEINYEDECPYNLGXARAMFDLAAAAA

SEQ ID NO: 160330 - protein, 170 aa, Heterodera glycines
  Coding regions on vcDNA: vcDNA=SeqID_86753; Strand=+; Position=149-658
MQNSLADVAGSAPQNVQVGSAVPSLPLTANSFANFPTTTHNQQQQRMVPAPPQNHSSSSTNATNQQHPSQQHQMHLQQQQVQNAVAQLLRQQFPTSAPGIMGMNALLNAAGISGGQAFPNIGTFPVHQHQFDLQSLAAAAQPHHHQQQQQLSSALNLQALVGAGAVHQPP

SEQ ID NO: 160331 - protein, 196 aa, Heterodera glycines
  misc_feature (10)..(10): Xaa can be any naturally occurring amino acid
  Homolog annotation: Hit_ID=NP_490931.1; Match level="QueryCoverage =99%, HitCoverage=52%, E-value=7e-77, Identity=71%"; Hit description =phosphate cytidylyltransferase 2 ethanolamine (42.0 kD) (1C653) [Caenorhabditis elegans] gb|AAK27869.1| H
  Gene Ontology: Mol. function=ethanolamine-phosphate cytidylyltransferase activity; Biological process=phospholipid biosynthesis
  Coding regions on vcDNA: vcDNA=SeqID_86754; Strand=+; Position=67-653
MGAYLVVGVXNDEEIGKHKGPPVFNEKERYRMVRGIKWVDEIVEAAPYVTTLKTLDENNCDFCVHGDDITLTADGKDTYAEVKEAGRYRECSRTPGVSTTDLVGRMLLLTKTHHKSNERELDDVERDHARKLSTDQEARSPWTCISRFLPSTQTIMQFSEGRAPTPEDRIVYVCGSFDLFHIGHLCFLEEARRLGD

SEQ ID NO: 160332 - protein, 54 aa, Heterodera glycines
  misc_feature (5)..(8): Xaa can be any naturally occurring amino acid
  Coding regions on vcDNA: vcDNA=SeqID_86755; Strand=+; Position=1-162
FFFFXXXXFFFPRLLFLKTAVLVLKRTPPLYLLATLYHSNETAGDKPEEGGDDV

SEQ ID NO: 160333 - protein, 182 aa, Heterodera glycines
  Coding regions on vcDNA: vcDNA=SeqID_86756; Strand=+; Position=2-547
YSLDTRGAGGLSPPWAGVGMDFGPYLKLTAMLIVLSTFGLGLSLAHMKKMLQIGKELAKQNETTKTASATFVGQDNLRTLRAFTGCQAGLSVLSIYVAASLAFMKFWYVRTHLVQEFSCSLMAITLAVVQFFVLRMANGGGLLLIKGIVLANACQIVQELNMSLSAFYTFFYAGRIYDAVEE

SEQ ID NO: 160334 - protein, 97 aa, Heterodera glycines
  Coding regions on vcDNA: vcDNA=SeqID_86757; Strand=+; Position=1-294
RPHLKRRPRRKARRRRRLMCPRLKQKGKSRTHRWKGRKRRKAAERRQMLYLFLAQLCTNPSPFPHFAIPRLSNFFWLLAFAFRVILPMNSPCLFFRQ

SEQ ID NO: 160335 - protein, 209 aa, Heterodera glycines
  Homolog annotation: Hit_ID=NP_496722.1; Match level="QueryCoverage =72%, HitCoverage=40%, E-value=5e-21, Identity=37%"; Hit description =putative nuclear protein (43.0 kD) (2N92) [Caenorhabditis elegans] emb|CAB60360.1| Hypothetical protein Y
  Coding regions on vcDNA: vcDNA=SeqID_86758; Strand=+; Position=44-670
MGILRNRSINRIPIRIEECAENENGFADDYANYLFDSDQSDSDNAEEENEVSVQIQSQPIGGHRRKKTKSYRPIEIVDGFPLKRNMGAQKWRRVENTRLLTSFADTQDICFDGSDLIPETISAFSRLLRDEAKMKVWNDFLEKDESGQKKRLLQFEYEILMARDASKAQHSQQSVKNTDIKKSESQPHNKNGQPSSGGGKSSSDCFQRL

SEQ ID NO: 160336 - protein, 106 aa, Heterodera glycines; identical to SEQ ID NO: 160287
  Homolog annotation: Hit_ID=NP_490685.1; Match level="QueryCoverage =85%, HitCoverage=91%, E-value=2e-11, Identity=37%"; Hit description =transposase (1A616) [Caenorhabditis elegans] gb|AAB54166.1| Hypothetical protein F53G12.11 [Caenorhabditi
  Coding regions on vcDNA: vcDNA=SeqID_86759; Strand=+; Position=214-534

SEQ ID NO: 160337 - protein, 57 aa, Heterodera glycines
  Coding regions on vcDNA: vcDNA=SeqID_86760; Strand=+; Position=2-175
YSKDHGAGSCQDSPRVRNILFGLKIVVLKKNAILRPRFLAIFNYSAFMCSHCTILNS

SEQ ID NO: 160338 - protein, 96 aa, Heterodera glycines
  misc_feature (18)..(18): Xaa can be any naturally occurring amino acid
  Homolog annotation: Hit_ID=NP_105252.1; Match level="QueryCoverage =86%, HitCoverage=11%, E-value=1e-14, Identity=43%"; Hit description =hypothetical protein mll4364 [Mesorhizobium loti MAFF303099] dbj|BAB51038.1| mll4364 [Mesorhizobium loti
  Coding regions on vcDNA: vcDNA=SeqID_86761; Strand=+; Position=2-288
LRLVFIAAILCLLGSLVXTRLFQKLRFAEKGGRLAWAFMGAIATGATIWCTHFVAMIAYQPGVDVTYEPGLTGVSLGIAICGSALALWFGSRQMRF

SEQ ID NO: 160339 - protein, 215 aa, Heterodera glycines
  misc_feature (58)..(58): Xaa can be any naturally occurring amino acid
  Homolog annotation: Hit_ID=NP_741263.2; Match level="QueryCoverage =94%, HitCoverage=17%, E-value=1e-59, Identity=55%"; Hit description =UNCoordinated locomotion UNC-16, EGg Laying defective EGL-39, putative protein, with 3 coiled coil-4 doma
  Gene Ontology: Mol. function=protein kinase binding; Cellular component=trans-Golgi network transport vesicle; Biological process =regulation of JNK cascade
  Coding regions on vcDNA: vcDNA=SeqID_86762; Strand=+; Position=3-647
FSDIFCFFLAPSVTNAMQSSVSSNEMIFGGNSTVCSEESHAMSEKVQTIASSIYREFXTMIQKHGQESIKDLMSLVVNVLESLDTAYQEKDELIVDLEMLKDENGQLLNQYERERQMRKNQDQKSLEREEFMSETIRELESKVQSMASIVRMLELKAKNANDHAMRLEEREADQKIEYEKLHERYNELLRTHIEHVERTKFLMGSEMFDMAQSLP

SEQ ID NO: 160340 - protein, 44 aa, Heterodera glycines
  Homolog annotation: Hit_ID=AAO85458.1; Match level="QueryCoverage =100%, HitCoverage=39%, E-value=1e-17, Identity=100%"; Hit description=putative gland protein G19C07 [Heterodera glycines]
  Coding regions on vcDNA: vcDNA=SeqID_86763; Strand=+; Position=1-135
GAARDNEMEDEELKVKAVVEETTTNEQGKTETNVEQSEKEGPMN

SEQ ID NO: 160341 - protein, 215 aa, Heterodera glycines
  Homolog annotation: Hit_ID=NP_491361.1; Match level="QueryCoverage =96%, HitCoverage=46%, E-value=4e-37, Identity=39%"; Hit description =thioredoxin type domain containing protein (50.9 kD) (1E948) [Caenorhabditis elegans] gb|AAL11490.1| Hypo
  Coding regions on vcDNA: vcDNA=SeqID_86764; Strand=+; Position=5-649
EELPGNETRILAVKDVDYLQIFEAEKDDLEKWFGRNRWPFLTQISATNIRKIAESTGKLLVLSSIEGMDRHNASTESGSFFALIKRTVVEARVDAEIEQHFQFGWLDGTQIASGVVMDSLLLPNLVVLNYSSYEFYLSKDHPAQMTAKSLLLFLHSVRLGEVTVHGGRAWITRLRRMAYEITSNVYDMFQHQPILTVCLFGVPLAFFSIITYSIC

SEQ ID NO: 160342 - protein, 148 aa, Heterodera glycines
  Coding regions on vcDNA: vcDNA=SeqID_86765; Strand=+; Position=3-449
LNEENVRLFRYPFLKNPFWDGHFDENDSDRMAGKALEWLSYHLKLAKNDETNYDETLTRVIRLLGLSIQRKWTEAKSLAEEMFITVAPSDNARQMIYSSMEQMQQFLNFDEQIEAAEKQTEREKDDQNSEESEKMALKKLFEQKKCRI

SEQ ID NO: 160343 - protein, 181 aa, Heterodera glycines
  Homolog annotation: Hit_ID=AAH65093.1; Match level="QueryCoverage =81%, HitCoverage=14%, E-value=8e-13, Identity=35%"; Hit description =Ankrd27 protein [Mus musculus]
  Gene Ontology: Mol. function=transcription factor activity; Cellular component=membrane; Biological process=regulation of transcription, DNA-dependent
  Coding regions on vcDNA: vcDNA=SeqID_86766; Strand=+; Position=75-617
MADDIPPPPAVAADGGDVVVDLEQHVRQLIMSIGQGSEDAVHELSILIESFNQEQLVDFLEIMARMYVESGVSVDMPGGQGINMLMVAASSGRVDFARYLLAHGATVGHLDATGSVFPLMLAAESGELEVCRLLVEEWAAEVNQQAIDGTTPLMSASSEGRLDVVIYLIDHGVEIQHANAE

SEQ ID NO: 160344 - protein, 229 aa, Heterodera glycines
  Coding regions on vcDNA: vcDNA=SeqID_86767; Strand=+; Position=1-687
NEQNEVQSTTGLTPAEAVRRSQISALVEPKQPQQQQQDINNGAGDEHGGVLRRSISVLSDNWYDWVEGNQTDKAGLSNQQQNVIVHQSVNSTIDADEHGISDEASPVASLSTIDLGRVYTTVGTVMESLLVNFAHLWQYRFFRVAFVLLSIYFCLGFLERCAVAMTAACVRWAWPPVHFMLGSSRGTLFYLTDWFAWMDDFLSSWVCDMANRYCHQYDVMCDCQCSFVS

SEQ ID NO: 160345 - protein, 126 aa, Heterodera glycines; identical to SEQ ID NO: 160297
  Coding regions on vcDNA: vcDNA=SeqID_86768; Strand=-; Position=81-461

SEQ ID NO: 160346 - protein, 101 aa, Heterodera glycines
  Coding regions on vcDNA: vcDNA=SeqID_86769; Strand=+; Position=3-305
RSFFAMNFPSIFSVLSLLLLFADFSWLAVSSPTDPSYRTKAQIDHSGTKKVVNSRHSPAPAPHSQRKEKQGKKEKAKSSSSSSSAEEEEKKHKKKKKKKKK

SEQ ID NO: 160347 - protein, 143 aa, Heterodera glycines
  Homolog annotation: Hit_ID=AAP30768.1; Match level="QueryCoverage =100%, HitCoverage=78%, E-value=1e-76, Identity=99%"; Hit description= putative gland protein G22C12 [Heterodera glycines]
  Coding regions on vcDNA: vcDNA=SeqID_86770; Strand=+; Position=31-459
MASSFCSSIISIVAIVCLLCKCCFSAPHPCCPGSQHVVSMMKDHTGTFSASMPKSSLCMSAERVAAAVENQLKTIWCPGNGSQTLINEINATQSSSDECARSLGFVRAMFEIAASAASHAGANADLAVQFREQVGTIDSNCAA

SEQ ID NO: 160348 - protein, 189 aa, Heterodera glycines
  Homolog annotation: Hit_ID=NP_477351.1; Match level="QueryCoverage =94%, HitCoverage=21%, E-value=7e-58, Identity=57%"; Hit description =CG5216-PA [Drosophila melanogaster] gb|AAF53248.1| CG5216-PA [Drosophila melanogaster]
  Gene Ontology: Mol. function=NAD-dependent histone deacetylase activity; Cellular component=cytoplasm; Biological process=chromatin silencing
  Coding regions on vcDNA: vcDNA=SeqID_86771; Strand=+; Position=86-652
VAVCGPQLARQGLGPRQILATLYPRYCSTISDDIPDEWIMQLLRELCEHRTRQKLSNYNTFEDAVELFRKSKRILVITGAGVSVSCGIPDFRSENGVYARLKKDFPELPTPTAMFDIDFFRQNPRPFYNFAREIFPGQFRPSLSHMFIKFLDDEKKLLRNYTQNIDTLERIAGISNLVECHGSFARATC

SEQ ID NO: 160349 - protein, 188 aa, Heterodera glycines
  Coding regions on vcDNA: vcDNA=SeqID_86772; Strand=+; Position=2-565
STVPSDAENRLSIRLYFAKIMAIFTKIFNFIKTSTEKENKQKYLLVFVEIWNKICPRIHAELQQNDISSTVGILYNIWRGIASRYNQIPLGIFQGYEPIRVLSSDNGLLLLDEKGTYSSNVIRAELFEDHVVNMLRLYEQQSEGNSFGLLLRRCKLDGIAYKHLDKFANGNEFEKLRAKYPKLKELFR

SEQ ID NO: 160350 - protein, 196 aa, Heterodera glycines
  Homolog annotation: Hit_ID=EAL33677.1; Match level="QueryCoverage =35%, HitCoverage=33%, E-value=2e-11, Identity=43%"; Hit description =GA21056-PA [Drosophila pseudoobscura]
  Gene Ontology: Mol. function=chromatin binding; Cellular component =nucleus
  Coding regions on vcDNA: vcDNA=SeqID_86773; Strand=+; Position=2-589
QLKKFPSLTDAFKKKRGNILNFEEEEFDEIISNGTSKRDNSPYTDHDYAGTRQLATAKGATGKHQRQKGGGGTAKEPKKKTALVNGTDSVVRSSARPHRPTKRFVEETNESFIRGTSKVRRTSPRKHGKKSTAEGGSEGEESEDDGKEYSVEKVFKKRVKGGKMEYFVKWAGYDDGWNTWEPRESLKHLEVLKQYE

SEQ ID NO: 160351 - protein, 169 aa, Heterodera glycines
  misc_feature (8)..(8): Xaa can be any naturally occurring amino acid
  Homolog annotation: Hit_ID=CAE56905.1; Match level="QueryCoverage =99%, HitCoverage=42%, E-value=3e-56, Identity=58%"; Hit description =Hypothetical protein CBG24746 [Caenorhabditis briggsae]
  Gene Ontology: Biological process=sulfur amino acid metabolism
  Coding regions on vcDNA: vcDNA=SeqID_86774; Strand=+; Position=4-509
MVLFETPXNPLLKIVDIEAVCRMVRARSKDCVVVVDNTFMTPYFQRPLELGADVTVQSLTKYINGHTDVLMGTVVTNKEHLDQHIYAQQIYAGAVPSAFDAFLVLHGIKTLPLRMRQHMENALAIGRWLEKDPRVEKVLYPDLESYPQHQIHKKQSIGMSGMLSFYIRT

SEQ ID NO: 160352 - protein, 211 aa, Heterodera glycines
  misc_feature (14)..(14): Xaa can be any naturally occurring amino acid
  Homolog annotation: Hit_ID=XP_314537.1; Match level="QueryCoverage =89%, HitCoverage=70%, E-value=8e-29, Identity=33%"; Hit description =ENSANGP00000016990 [Anopheles gambiae]
  Coding regions on vcDNA: vcDNA=SeqID_86775; Strand=+; Position=1-632
VFGRNANDRGRFVXLAEVAMNGRKNRLFMSMRICKNIKELLGKFEGHVPASEEVNGKAENVTIQSESIVTERRRYYIDLRENRRGSFLRITQLETHSGIRNSVALPFEGIGQLHDALDSILEEYGEGFIEEEAELPHSQMIRTDGKSFFFDPGHNSRGDFLKITELKSFMGVRNSVVLSIRAIPQFTQVLSKLYDDSQELRAVEEVNVNNV

SEQ ID NO: 160353 - protein, 208 aa, Heterodera glycines
  misc_feature (31)..(31): Xaa can be any naturally occurring amino acid
  Homolog annotation: Hit_ID=NP_625385.1; Match level="QueryCoverage =48%, HitCoverage=51%, E-value=7e-12, Identity=45%"; Hit description =putative acetyltransferase [Streptomyces coelicolor A3(2)] emb|CAB95978.1| putative acetyltransferase [St
  Coding regions on vcDNA: vcDNA=SeqID_86776; Strand=+; Position=3-625
DASGRSPALTVPTSRAAAYFGMFAVHPFFQXSGLGKRLLTVAERYARIVWGSDEMHLDVGWSLAELKLGMGRLQRYYKRRGFLSTGILRPFNGAVARFITVDRNDLWIELMVKDIRGALDDIGGDPEKRMKRVNSRGRLAREADKDDGGRDPQKRMERVRSFGRLTIEADRDDIGRDAQKRMERVRSLWRLAREADKSDESKGKDGEE

SEQ ID NO: 160354 - protein, 92 aa, Heterodera glycines
  Coding regions on vcDNA: vcDNA=SeqID_86777; Strand=+; Position=3-281
SFLVPAAAAAAAASLVAASDRVSVKGYTADAKGSLDCKFGSGDILKKCGTCAQSITECASSNPNKTEEICISEIASFAGDCGGCAVDILECL

SEQ ID NO: 160355 - protein, 211 aa, Heterodera glycines
  Homolog annotation: Hit_ID=XP_315369.1; Match level="QueryCoverage =95%, HitCoverage=29%, E-value=7e-33, Identity=40%"; Hit description =ENSANGP00000020955 [Anopheles gambiae]
  Gene Ontology: Mol. function=ubiquitin-protein ligase activity; Cellular component=nucleus; Biological process=N signaling pathway
  Coding regions on vcDNA: vcDNA=SeqID_86778; Strand=+; Position=3-635
RAFAENYRYLSPSDLALSAAGVSRLWRSLSEDKLLWAGKCRQHSINEMFPPNICRKENWARSDTGGESSSELANIYNDSSRAKSVAFPPPNPSPMPLCLHRSRWKAVFLRSLRVSNNWKLRRPTAVCQLRGHDEHVITCLKLRGDLIVTGSDDCTLRVWSAATGTCVHVLNGHIGGVWALQLSQDGKIAVSGSTDRTVRVWDTEKGTLIHC

SEQ ID NO: 160356 - protein, 191 aa, Heterodera glycines
  Coding regions on vcDNA: vcDNA=SeqID_86779; Strand=+; Position=16-588
HPPMTRKPRQNDDENHGKRMVQSEPRKPFQRQYQQHQTPASAIKSILKTPNGGDINSNSASAATGGRYQRKHFGPGQKRRVSFGSQSESNDSAIRKHKMPKVEVSTEQMTTPKVGQQKFQTKMNGSASSGKVINGPQKKLAEEQNSVSPVRSNMPKSGGNANIGGGAAPTPIPSPKNQKQNQQKQPSKAGQ

SEQ ID NO: 160357 - protein, 99 aa, Heterodera glycines
  Coding regions on vcDNA: vcDNA=SeqID_86780; Strand=-; Position=3-299
MFSRPVSSTSACTQWESSRGGIWAKGAIVQKTAGLIRQKRQKPMHQAKRNSLQRVKGNAHLLVPRATLRQSPVSSRGFPSPAANMAKCTVCTSLGPGSD

SEQ ID NO: 160358 - protein, 152 aa, Heterodera glycines
  Homolog annotation: Hit_ID=AAC38987.1; Match level="QueryCoverage =74%, HitCoverage=8%, E-value=9e-20, Identity=41%"; Hit description=P- glycoprotein [Haemonchus contortus] pir||T31073 multidrug resistance p-glycoprotein - nematode (Haemonchu
  Gene Ontology: Biological process=embryogenesis and morphogenesis
  Coding regions on vcDNA: vcDNA=SeqID_86781; Strand=+; Position=103-558
MAIPLLGEGSVGSAKSSPRKAKAAEGGGTLWRKHSPAMVLRRRKTSSASLRTSASTDVLQISQMQKELDESEVRPSSIGKIFRFNTGNWHLAFVGLIGCSISGLAVPFFALVYAQIFSVFSEPLDQLQSDALFWAAMFLLVGFLNAFGFFIS

SEQ ID NO: 160359 - protein, 110 aa, Heterodera glycines
  Homolog annotation: Hit_ID=CAF92101.1; Match level="QueryCoverage =96%, HitCoverage=5%, E-value=5e-20, Identity=48%"; Hit description =unnamed protein product [Tetraodon nigroviridis]
  Gene Ontology: Mol. function=ARF guanyl-nucleotide exchange factor activity; Cellular component=mitochondrion; Biological process =retrograde (Golgi to ER) transport
  Coding regions on vcDNA: vcDNA=SeqID_86782; Strand=+; Position=1-333
SNRGAVQSIADSVTKAKFVGTTKLGIDECVLFQILQSLRSLVLSPGGRHLTNETLCEILQCCFRIGLESSLPELLRMAAENALAEMCRYLFASIQTFEQDIRPGLKELMK

SEQ ID NO: 160360 - protein, 199 aa, Heterodera glycines
  misc_feature (165)..(165): Xaa can be any naturally occurring amino acid
  misc_feature (183)..(183): Xaa can be any naturally occurring amino acid
  Homolog annotation: Hit_ID=AAN32888.1; Match level="QueryCoverage =98%, HitCoverage=57%, E-value=1e-100, Identity=96%"; Hit description= annexin 4C10 [Heterodera glycines]
  Gene Ontology: Mol. function=phospholipid binding; Cellular component= cytoplasm; Biological process=skeletal development
  Coding regions on vcDNA: vcDNA=SeqID_86783; Strand=+; Position=34-630
NAPNGLTILLLISVVIGHSLANLGPTIKHNPHFKAVQTAHHLHDAIAKKHEAEVTQIICSISNEQRQALALEFKKQFGTDLIAMLKKEFKSDFEELIISLMQTPAVYDANQMRAALSGSNEAVLIEILATRTNRQITALKQAYERLDRRHQHNQLEEDIKAKTKXTLPKSVGVFAQLLSRRKXPASIVLAHDEAMKLFR

SEQ ID NO: 160361 - protein, 178 aa, Heterodera glycines
  misc_feature (31)..(31): Xaa can be any naturally occurring amino acid
  Homolog annotation: Hit_ID=CAE60358.1; Match level="QueryCoverage =93%, HitCoverage=96%, E-value=5e-70, Identity=75%"; Hit description =Hypothetical protein CBG03955 [Caenorhabditis briggsae]
  Gene Ontology: Mol. function=calcium channel regulator activity; Cellular component=cytoplasm; Biological process=regulation of action potential
  Coding regions on vcDNA: vcDNA=SeqID_86784; Strand=+; Position=39-574
MVTSSPDIQLIFQSVDRDRSGQISADELNRXLSNGTWKPFNPETCRMMISMFDSNNDGGINFQEFGALWEYINDWTRTFRTFDRDNSGNIDRDELVNAFTQFGYRLSGTFYDMLMRKFDRTQSGRINFDDFIQLCVVLQTLTTAFREKDTDRDGWIRIYYEEFLAMVFSLKMSMMAKQ

SEQ ID NO: 160362 - protein, 139 aa, Heterodera glycines
  misc_feature (29)..(29): Xaa can be any naturally occurring amino acid
  Homolog annotation: Hit_ID=AAO33474.1; Match level="QueryCoverage =100%, HitCoverage=100%, E-value=1e-71, Identity=99%"; Hit description=gland-specific protein g4g12 [Heterodera glycines]
  Coding regions on vcDNA: vcDNA=SeqID_86785; Strand=+; Position=17-434
MPNIFKILLIVLLAVVSFRLSASTGDKKXTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160363 - protein, 196 aa, Heterodera glycines
  misc_feature (124)..(124): Xaa can be any naturally occurring amino acid
  Homolog annotation: Hit_ID=NP_493334.1; Match level="QueryCoverage =96%, HitCoverage=59%, E-value=3e-56, Identity=55%"; Hit description =GTP-binding protein like (39.4 kD) (1N870) [Caenorhabditis elegans] emb|CAB07637.1| Hypothetical protein
  Coding regions on vcDNA: vcDNA=SeqID_86786; Strand=+; Position=1-589
ARGGAGGHGNAFYVSNLVRKPLKAEEGGQGEEMSYDIEMRIMATAGLVGIPNVGKSTLLRAISRAKPKVAAYPFTTLSPSVGMVQYGDFFQLAVADIPGLVQGAHRNEGLGFSFLRHIVRCESXMTLYDDELSKKEAAIVINKTDLLDGEMVKSAIVSMFPEQSVFFVSGRHRLGIEPLLMFLREKHERFLKEREA

SEQ ID NO: 160364 - protein, 101 aa, Heterodera glycines
  Coding regions on vcDNA: vcDNA=SeqID_86787; Strand=+; Position=1-306
AADKCPLLPLHFVFFVRPFSSELPILRCSVGGCPSSPNPLAAAARGAVGPSARLRRLRRRLHHRGSVACPQGNATRGKNGAEGTANFEQKRSEMRPKISTK

SEQ ID NO: 160365 - protein, 125 aa, Heterodera glycines
  Homolog annotation: Hit_ID=NP_498263.1; Match level="QueryCoverage =92%, HitCoverage=22%, E-value=8e-47, Identity=76%"; Hit description =ALDH7A2, ALdehyde deHydrogenase (alh-9) [Caenorhabditis elegans] gb|AAC46640.1| Aldehyde dehydrogenase pr
  Gene Ontology: Mol. function=aldehyde dehydrogenase (NAD+) activity; Biological process=aldehyde metabolism
  Coding regions on vcDNA: vcDNA=SeqID_86788; Strand=+; Position=249-623
MNFGPSFFQVGVISAFNFPAAVYGWNAALALVCGNSVLWKPSPSTPLTSIAITRLVGEVLSKNGLSPDICSLICGGGDVGMCLVKDPRVNLLSFTGSTEVGRVVGQHVQARFGKLLLELGGNNAI

SEQ ID NO: 160366 - protein, 111 aa, Heterodera glycines
  Coding regions on vcDNA: vcDNA=SeqID_86789; Strand=+; Position=39-374
MKCRRMEEQPDEIRQQAITEFIGGCPPEFTQILAHIDGLQLEDRPNYEMIETMLREHLTRSRVPEHPYDWEVGRRNAMAQAQSEAARRKKDNTKEGGGGKNNTQGMSPALV

SEQ ID NO: 160367 - protein, 63 aa, Heterodera glycines
  misc_feature (19)..(19): Xaa can be any naturally occurring amino acid
  Homolog annotation: Hit_ID=NP_508272.1; Match level="QueryCoverage =93%, HitCoverage=41%, E-value=7e-17, Identity=66%"; Hit description =spondyloepiphyseal dysplasia late (XC58) [Caenorhabditis elegans] gb|AAB52862.1| Hypothetical protein W05
  Gene Ontology: Cellular component=TRAPP; Biological process=ER to Golgi transport
  Coding regions on vcDNA: vcDNA=SeqID_86790; Strand=+; Position=1-191
CRRIRFLMLHTQKNEDGIXQFFQEIYEMYIKFSMNPFYRQDTPIRSPSFEQKAAMYGRKFLGV

SEQ ID NO: 160368 - protein, 195 aa, Heterodera glycines
  misc_feature (11)..(11): Xaa can be any naturally occurring amino acid
  misc_feature (19)..(19): Xaa can be any naturally occurring amino acid
  misc_feature (36)..(36): Xaa can be any naturally occurring amino acid
  misc_feature (43)..(43): Xaa can be any naturally occurring amino acid
  misc_feature (58)..(58): Xaa can be any naturally occurring amino acid
  misc_feature (105)..(105): Xaa can be any naturally occurring amino acid
  misc_feature (119)..(119): Xaa can be any naturally occurring amino acid
  Homolog annotation: Hit_ID=AAL78227.1; Match level="QueryCoverage =99%, HitCoverage=76%, E-value=9e-90, Identity=83%"; Hit description =hypothetical protein Hgg-18 [Heterodera glycines]
  Coding regions on vcDNA: vcDNA=SeqID_86791; Strand=+; Position=1-582
AENGRGQKGRXQSPVPRPXLTEAADNVNKAVDDLSXLNRQKHXKNAAEATAEKTPEEXGKSIERSGRKRRKRTAEDGCQQNFGGKSEKRRGIGKRSENENGNTFXGQQKGQRRVDFDNXRQKDDFGREGEADGRADSQNVGQHEEGAESEQQCRRRRLRQVVLRRRRAGGGHGGQSMINQSDRRIRHCCVMKCSQ

SEQ ID NO: 160369 - protein, 199 aa, Heterodera glycines
  Coding regions on vcDNA: vcDNA=SeqID_86792; Strand=-; Position=0-596
LLVIPHGAHIASPNCLALHPIDAPVVRDHCRVHPRTLCAALRLLLLLVVFAAAALRLVALSLGHFLCIFQCLFICVQIRQSKHQQFVVLCSVSQQQAKRSLENRSDCRPKSRTKHQNLNTDSSFRMCKQQIRLLIVYQFFARLQNSANSRHINFLFSRLLLIHEFNCSIFSGFHLSFFHRSIKIAKTKQKNKPQQSRIP

SEQ ID NO: 160370 - protein, 143 aa, Heterodera glycines
  Homolog annotation: Hit_ID=NP_783594.1; Match level="QueryCoverage =74%, HitCoverage=83%, E-value=7e-22, Identity=47%"; Hit description =histone 1, H2ba [Mus musculus] emb|CAI35973.1| OTTMUSP00000000673 [Mus musculus] gb|AAO06249.1| histone p
  Gene Ontology: Mol. function=DNA binding; Cellular component =nucleosome; Biological process=nucleosome assembly
  Coding regions on vcDNA: vcDNA=SeqID_86793; Strand=+; Position=1-432
YSFAPLTTAPFSAHRTKMARRRRKKEPRKQSYKLYVRRVLKEVHPGKEISMRALNIMNSFVIDALDRIATEATRMAHNDRRKTITLRDMEFSVRLCLPDVMAKDANQKAQKTVTKFYAAKVRDRMRRTEMRRGEFAMMQMAAL

SEQ ID NO: 160371 - protein, 170 aa, Heterodera glycines
  Coding regions on vcDNA: vcDNA=SeqID_86794; Strand=+; Position=1-510
SRPLLFIAALLFLFGCCRADGNVVHLSSLNCATKDGGIDGFKAVDDGLILDSSSVTADTSDLPLIGFQKNGKEDLIFKLFVRDGGCVSKANFFTNGQPCTLGESEDVTESDKCPGEGGTSSCTSHEVTCTGIGMANVAEESNGHAFKANLANLTKLTNPCAQWKAHFGGV

SEQ ID NO: 160372 - protein, 152 aa, Heterodera glycines
  Homolog annotation: Hit_ID=AAL78226.1; Match level="QueryCoverage =71%, HitCoverage=90%, E-value=3e-49, Identity=95%"; Hit description =hypothetical protein Hgg-17 [Heterodera glycines]
  Coding regions on vcDNA: vcDNA=SeqID_86795; Strand=+; Position=137-592
MNFLNEQIREYSERTKDREEFKGIIEARNKLETAIKPLHGVMESDMASSSLETSMTNSANIARQALEELPVKQVRQMEQIAEEGKSKTVEEQERALREYAEKNSESVKKAVDQVSVAKDRADIALETYLRSHADTFSQEARKANDQMLFVMK

SEQ ID NO: 160373 - protein, 75 aa, Heterodera glycines
  Homolog annotation: Hit_ID=NP_001003835.1; Match level="QueryCoverage= 90%, HitCoverage=5%, E-value=1e-14, Identity=52%"; Hit description =TATA box binding protein (TBP)-associated factor 150kDa [Danio rerio] gb|AAT68099.1| TATA box binding p
  Coding regions on vcDNA: vcDNA=SeqID_86796; Strand=+; Position=2-226
NSDDDSLKTLCYQLLVPTSAANIGFAIGDFQIHVQPEMPEIINFVVPELIPLLKHTMKSLNRIFVFFEELLSCRF

SEQ ID NO: 160374 - protein, 213 aa, Heterodera glycines
  misc_feature (180)..(180): Xaa can be any naturally occurring amino acid
  Homolog annotation: Hit_ID=CAE69683.1; Match level="QueryCoverage =95%, HitCoverage=42%, E-value=3e-30, Identity=41%"; Hit description =Hypothetical protein CBG15936 [Caenorhabditis briggsae]
  Gene Ontology: Cellular component=mitochondrion
  Coding regions on vcDNA: vcDNA=SeqID_86797; Strand=+; Position=3-640
GAFFSIGVRESGEYNPSPALLAIALTLAELALLVFFLPETLVHAKNDDCHKQSGHSLLFLLSPRALFSFDFLSPASASSPPVSVPLLQKYSRVYFLFMLLFSAMEFTLGFLTHLRFNYSSMQQGRLYLFSGFCMLVIQGFVVRRIPSTLKAQSHGALVGLVSIVPAYFVIAFAHCQNGIXTALFMGLLLFSVASATVVPFLTTLFSNQCDQSA

SEQ ID NO: 160375 - protein, 181 aa, Heterodera glycines
  misc_feature (114)..(114): Xaa can be any naturally occurring amino acid
  Homolog annotation: Hit_ID=AAO85452.1; Match level="QueryCoverage =100%, HitCoverage=33%, E-value=2e-95, Identity=99%"; Hit description= putative gland protein G12H04 [Heterodera glycines]
  Coding regions on vcDNA: vcDNA=SeqID_86798; Strand=+; Position=45-586
MALSALLLLLPLLLNVQNIPDESVQSDMKAVYSAISSPEQWKNSQNSLASLESQLTEPQRALAKMHWELETIQKEKPEAPPQFDLGLFSEALEVMVEMDEEAKEVKLRKDKLIXMGRRRGSKKKLKEKMTEEDTVPEVRVNENGKVEVKDGAGGEGRLEVRRTKDEKGREQVVITLMKNGG

SEQ ID NO: 160376 - protein, 117 aa, Heterodera glycines
  misc_feature (97)..(97): Xaa can be any naturally occurring amino acid
  Homolog annotation: Hit_ID=NP_504606.1; Match level="QueryCoverage =93%, HitCoverage=14%, E-value=3e-12, Identity=31%"; Hit description =putative protein, with at least 4 transmembrane domains, a coiled coil-4 domain, of bilaterial origin (5G
  Coding regions on vcDNA: vcDNA=SeqID_86799; Strand=+; Position=2-352
FACTAVPDDYYALRLLYNLPVGFAIALLIYHLAWYRINFADSILINPFWKEFVKWLMIVSAALSYSLNPLVRASLGCALFAGLGSTAHGLLSVSVVXNLNKGPIANVIQNFNISTMI

SEQ ID NO: 160377 - protein, 142 aa, Heterodera glycines; identical to SEQ ID NO: 160319
  Coding regions on vcDNA: vcDNA=SeqID_86800; Strand=+; Position=21-449

SEQ ID NO: 160378 - protein, 96 aa, Heterodera glycines
  Coding regions on vcDNA: vcDNA=SeqID_86801; Strand=+; Position=40-327
VLKLIPVPNHQESKVAEECLEYQKKFDKKINQIASHWHGVRVSAPKAFGGIMIELSISKGKYNLSDTQNFNIEFGNPKDLMTKITDKKKKKKKKKK

SEQ ID NO: 160379 - protein, 87 aa, Heterodera glycines
  misc_feature (12)..(12): Xaa can be any naturally occurring amino acid
  Homolog annotation: Hit_ID=CAE63747.1; Match level="QueryCoverage =100%, HitCoverage=13%, E-value=5e-29, Identity=60%"; Hit description= Hypothetical protein CBG08279 [Caenorhabditis briggsae]
  Gene Ontology: Mol. function=phosphoenolpyruvate carboxykinase activity; Cellular component=mitochondrion; Biological process =glucose metabolism
  Coding regions on vcDNA: vcDNA=SeqID_86802; Strand=+; Position=2-264
IDWIVRRLDTQXNIGIESAIGTIPTRESMHLEGLGNIDWDQLMSLPADYWHEDAKEVRKFLEEQVGTDLPEQILSELEQQEKRIMAL

SEQ ID NO: 160380 - protein, 217 aa, Heterodera glycines
  Homolog annotation: Hit_ID=CAE61387.1; Match level="QueryCoverage =63%, HitCoverage=28%, E-value=6e-24, Identity=43%"; Hit description =Hypothetical protein CBG05236 [Caenorhabditis briggsae]
  Coding regions on vcDNA: vcDNA=SeqID_86803; Strand=+; Position=3-653
QLREKLRSLQEYGDFKQFLRLCHLEPGYGYELLAPVHSDFPAEGSICELQVGRRQLVLIYPDDEGCTVRFALPSKRIRVWRVSHSEHQLLAQMSFQLEYLRQPDEFGLITLRTDQSVLLSLFLQSIADEILQDQQYKTESPFKFVDDAISLKAASDGSSAVASSSIVAGVGDDQKSVKSCSNNSSSSNHANSSSCALDALVNGAGGDGTEYRIKLIS

SEQ ID NO: 160381 - protein, 181 aa, Heterodera glycines
  Homolog annotation: Hit_ID=CAE60153.1; Match level="QueryCoverage =91%, HitCoverage=16%, E-value=4e-13, Identity=31%"; Hit description =Hypothetical protein CBG03703 [Caenorhabditis briggsae]
  Coding regions on vcDNA: vcDNA=SeqID_86804; Strand=+; Position=161-703
MTMFERCVNKHIQFIMLVDEKRKDTHGLLKLSEAMHKVTTQHVTLEKANDVVRKNQRQTLENILNKLNMKNFGLNYVPVMEPSACRRFSLENGNVLVIGYDVNHPAPMPQQTRRLLASQGESQLSSLDPSCVGICANMAPDFNAFVGDYFFQESRREAIDQMQLVDRMKWILQNVEKHRPG

SEQ ID NO: 160382 - protein, 180 aa, Heterodera glycines
  Homolog annotation: Hit_ID=CAE72411.1; Match level="QueryCoverage =81%, HitCoverage=94%, E-value=1e-16, Identity=29%"; Hit description =Hypothetical protein CBG19572 [Caenorhabditis briggsae]
  Coding regions on vcDNA: vcDNA=SeqID_86805; Strand=+; Position=57-599
MEPLHQQSFQRKFSISACRRQSSIDLEDNHFLLTIVISNATNHESISYKQDGGRFDSSQFTLKFHANTLYKIYVKTKPAQQFLSLNIAGNVLSLAPIEGGSGEYVAIWNTADKEPTKKGTRQDIEFVLSAKDKTLSKNLQVKFYPHNDTHAGWGQKLDQITWRCSTNDIGHVFVLEEQAL

SEQ ID NO: 160383 - protein, 214 aa, Heterodera glycines
  Homolog annotation: Hit_ID=CAE63705.1; Match level="QueryCoverage =98%, HitCoverage=26%, E-value=3e-38, Identity=39%"; Hit description =Hypothetical protein CBG08220 [Caenorhabditis briggsae]
  Gene Ontology: Biological process=signal transduction
  Coding regions on vcDNA: vcDNA=SeqID_86806; Strand=+; Position=2-643
IPVEPTVEVLLAHLRHDRMETRMATLNWIRHLHSVQPNNMFRYMDRFFPILLELLSDPADDVLMLDIMLITEICGQPKQQQQLDIRTLRLGEELNQELKSVSPYLVKFSVALLKMFKDDDKLIDERGIHIVRQVCLLLEPTDVFRSLALLLGTMVNIDGFVLPTAGQQQPQLTTAPSGTKDPFFDLQVAEMVKILNQILMTTSELFPLRQRLRC

SEQ ID NO: 160384 - protein, 67 aa, Heterodera glycines
  Coding regions on vcDNA: vcDNA=SeqID_86807; Strand=-; Position=0-200
ASTTSSSKNICRSSPSLSPFGAGGLTWKTFWLTKASTAKICQFLMENHAQLLVSVKNCVPSCCSHSV

SEQ ID NO: 160385 - protein, 219 aa, Heterodera glycines
  Coding regions on vcDNA: vcDNA=SeqID_86808; Strand=+; Position=1-657
GPSGGCPVPTVNGFRASFSGVIDMRKKSMADEIVPSIFVPRKRSACDFGTFSALRGMSRQNTAPIKIRATTVRDDSSKRPETEIVHRSQLLAPESVAWAVPTTRQNSAEVPKEKSNAQPLKHQRNCQRHAPASRGTLSFPLVKRIALGREIRVNHYLLNDGEDLTDLIVPDNEDGQKGTKERQNEQQQRPRNGTEVPKTPNGTLFGSASFRGPSLNIPS

SEQ ID NO: 160386 - protein, 204 aa, Heterodera glycines
  Homolog annotation: Hit_ID=CAA52290.1; Match level="QueryCoverage =95%, HitCoverage=100%, E-value=1e-102, Identity=97%"; Hit description=polyubiquitin [Volvox carteri] pir||S40611 polyubiquitin 5 - Volvox carteri
  Coding regions on vcDNA: vcDNA=SeqID_86809; Strand=+; Position=11-622
GQDPDRRASPGPQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIF

SEQ ID NO: 160387 - protein, 237 aa, Heterodera glycines
  Homolog annotation: Hit_ID=CAE62153.1; Match level="QueryCoverage =100%, HitCoverage=44%, E-value=1e-104, Identity=73%"; Hit description=Hypothetical protein CBG06199 [Caenorhabditis briggsae]
  Gene Ontology: Cellular component=mitochondrion; Biological process =glutamate catabolism
  Coding regions on vcDNA: vcDNA=SeqID_86810; Strand=+; Position=3-713
GFGNVGLHSHRYLHRDGAICIGVQEYDCAIYNPNGIHPKELEDWKIANGSIRGFPGAKAFEPFTDLIFEKCDILVPAACEKAIHLGNAHRIQAKVIAEAANGPTTPAADAVLMNRGDCLIVPDMFINSGGVTVSYFEWLKNLNHVSFGRLTFKYERDSNYHLLESVQKSLERTFDRAVPVDPSEEFQLRIAGASEKDIVHSGLEYTMNRSAKQIIATTNKYNLGLDLRTAAYANAIE

SEQ ID NO: 160388 - protein, 192 aa, Heterodera glycines
  misc_feature (12)..(12): Xaa can be any naturally occurring amino acid
  Homolog annotation: Hit_ID=CAE57679.1; Match level="QueryCoverage =67%, HitCoverage=31%, E-value=8e-19, Identity=34%"; Hit description =Hypothetical protein CBG00673 [Caenorhabditis briggsae]
  Gene Ontology: Cellular component=mitochondrion; Biological process =growth
  Coding regions on vcDNA: vcDNA=SeqID_86811; Strand=+; Position=1-580
SVKKAKQRLTCXKKFKIQRKVREHSRKLKKMTKEFGRKKSEKSIAVPNKCPFKAEMLMEAEQKRAEAKKMEQERKARQKMAKKGGANAKSVRSFAAEVRRTIENADIVIEASGSEHNICRQRAVKKKGAKQRKTKKKNTDWTDESPPPIVSLLGEEEDNAVASPPSVPISSRAIRKAVKRHKKKPTENCQIC

SEQ ID NO: 160389 - protein, 222 aa, Heterodera glycines
  misc_feature (14)..(14): Xaa can be any naturally occurring amino acid
  Homolog annotation: Hit_ID=NP_740900.1; Match level="QueryCoverage =100%, HitCoverage=6%, E-value=2e-53, Identity=43%"; Hit description =chorein A (359.3 kD) (1J482) [Caenorhabditis elegans] emb|CAB02304.1| Hypothetical protein T08G11.1a [Cae
  Gene Ontology: Mol. function=intracellular transporter activity; Cellular component=extrinsic to membrane; Biological process=Golgi to endosome transport
  Coding regions on vcDNA: vcDNA=SeqID_86812; Strand=+; Position=3-668
KGVAALTLDEDYQXDGECKSLQQPTSIGEGMFRGVRGLGTSVVEGVTGVVSKPVEGVKQGGLLGGIKGIGKGMVGAIARPVSGVVDLVTTTADNVRNAIINVEDVKPIRPPRVISHDKIIRPYVFEEAVGYKIFRETDRGQFAKTDHYLTYGGITKRLVIIVTDKHVIEARQHKLTGNWNATWNPKYAELKRPTRVGSNGKFGIKLRLKKEKRGFSFFSSKD

SEQ ID NO: 160390 - protein, 103 aa, Heterodera glycines
  Coding regions on vcDNA: vcDNA=SeqID_86813; Strand=+; Position=54-365
GHTEHRKSPNFADDIFHLPSTFNSDSPSSDRRIPFLNKTLDWALKSAKGKPEMLRACALLQRKFGDVFFSEGQEEQAERYARSAEYLLDEVILMLIGQLLIVL

SEQ ID NO: 160391 - protein, 94 aa, Heterodera glycines
  Coding regions on vcDNA: vcDNA=SeqID_86814; Strand=+; Position=3-287
FLSTLLNIPQMRVLPLLFSALLLLSVGLCFAQFDQSPSAALNHVRAKRGYKPWKKQSFSSSSSEMYRRRRPSGNGHYRDYNGYERALGKITRSY

SEQ ID NO: 160392 - protein, 112 aa, Heterodera glycines
  Homolog annotation: Hit_ID=AAO33474.1; Match level="QueryCoverage =100%, HitCoverage=81%, E-value=9e-59, Identity=99%"; Hit description= gland-specific protein g4g12 [Heterodera glycines]
  Coding regions on vcDNA: vcDNA=SeqID_86815; Strand=+; Position=2-340
KKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESRRLSPSGPDPHHH

SEQ ID NO: 160393 - protein, 72 aa, Heterodera glycines
  Homolog annotation: Hit_ID=ZP_00241912.1; Match level="QueryCoverage =90%, HitCoverage=94%, E-value=2e-22, Identity=75%"; Hit description =COG4391: Uncharacterized protein conserved in bacteria [Rubrivivax gelatinosus PM1]
  Coding regions on vcDNA: vcDNA=SeqID_86816; Strand=-; Position=162-380
MSNTASKPKSVVEVTAADVQGPGVVFCPNPKMPLWSNHPRVFIDVAKTGEGMCPYCGTVYKVKEGEHIGHGH

SEQ ID NO: 160394 - protein, 78 aa, Heterodera glycines
  Homolog annotation: Hit_ID=NP_490882.2; Match level="QueryCoverage =88%, HitCoverage=20%, E-value=3e-24, Identity=68%"; Hit description =ubiquitin conjugating enzyme (ubc-3) [Caenorhabditis elegans] gb|AAK73914.2| Ubiquitin conjugating enzyme
  Gene Ontology: Mol. function=ubiquitin-protein ligase activity; Cellular component=nucleus; Biological process=DNA replication initiation
  Coding regions on vcDNA: vcDNA=SeqID_86817; Strand=+; Position=104-337
MSSSSGHPQTSSASAIRALQMELRSLQSQPLEGFTVTCDDDNMFKWTVGIFGPPGTLYQGGYFKAHLKFPTNYPYSPP

SEQ ID NO: 160395 - protein, 231 aa, Heterodera glycines
  misc_feature (21)..(21): Xaa can be any naturally occurring amino acid
  Homolog annotation: Hit_ID=CAG11319.1; Match level="QueryCoverage =99%, HitCoverage=38%, E-value=2e-61, Identity=52%"; Hit description =unnamed protein product [Tetraodon nigroviridis]
  Gene Ontology: Mol. function=glutamine-tRNA ligase activity; Cellular component=cytoplasm; Biological process=glutaminyl-tRNA aminoacylation
  Coding regions on vcDNA: vcDNA=SeqID_86818; Strand=+; Position=2-693
IDPAMFDAFLRDHLNVTAPRXMAVLEPLRLRITNYRELGFIPAKSTLRVKQFPSSINESTDEWEISFDEFVYIEQADFREVAEKSYRRLTLEQPVGLRHVNLAVKIDKLERDEHGNPIELVVTANPVSSECKPKAFIHWVARPVLCEVRLYDKLFVHKNPEDPAEVPGGFLTDINPNSLHVLSNAMVDGSIIRTIRPLDRFQFERNGFFCLDPNDSWSSEKKFVFNRIVSL

SEQ ID NO: 160396 - protein, 223 aa, Heterodera glycines
  Homolog annotation: Hit_ID=S29742; Match level="QueryCoverage=100%, HitCoverage=36%, E-value=7e-87, Identity=68%"; Hit description =malate dehydrogenase (oxaloacetate-decarboxylating) (NADP)  (EC 1.1.1.40) - pig roundworm
  Gene Ontology: Mol. function=electron transporter activity; Cellular component=cytosol; Biological process=pyruvate metabolism
  Coding regions on vcDNA: vcDNA=SeqID_86819; Strand=+; Position=1-669
IGLRRNRVRGEEYDQLIDNFMNACRKKYGQNVLVQFEDFGNKNAYRLLERYQDEYCMFNDDIQGTASVVVAGLLACTRVTKLRMRDTKYVFFGAGGAALGVAEMCVRQMQSEGLSFEEACGQIYMMDIDRLITTQRKNIEPRHLPFAKNLPDSQSLLEVVLSVRPGALIGASTVRGAFTDDVIRTMAEHNARPIIFALSNPTSKAECTADDAYRVTNGTALFA

SEQ ID NO: 160397 - protein, 202 aa, Heterodera glycines
  misc_feature (73)..(73): Xaa can be any naturally occurring amino acid
  misc_feature (194)..(194): Xaa can be any naturally occurring amino acid
  Homolog annotation: Hit_ID=CAE58599.1; Match level="QueryCoverage =93%, HitCoverage=26%, E-value=6e-21, Identity=32%"; Hit description =Hypothetical protein CBG01766 [Caenorhabditis briggsae]
  Coding regions on vcDNA: vcDNA=SeqID_86820; Strand=+; Position=8-726
RTVLFEDNGLCRVEIRKQSEPFRLAIRVFKLLDPAVGSFGMLTKVRYEAELSTFHMAPQSLADCPPPVGSVNXPIFSASNLNCGREDGQNENFEECLWADFAKTPGTNTAHWAIGEHTQHWEQIMRTTPSSRPKGQFYFQYAQICTLGSDNVALSCVYLNDADAPGPLTIDVDTADHQPFRFAFNMLRIDRGAXGGAGGGRI

SEQ ID NO: 160398 - protein, 112 aa, Heterodera glycines
  misc_feature (13)..(13): Xaa can be any naturally occurring amino acid
  Homolog annotation: Hit_ID=CAE62725.1; Match level="QueryCoverage =91%, HitCoverage=22%, E-value=6e-40, Identity=71%"; Hit description =Hypothetical protein CBG06885 [Caenorhabditis briggsae]
  Gene Ontology: Mol. function=enoyl-CoA hydratase activity; Cellular component=mitochondrial membrane; Biological process=fatty acid beta- oxidation
  Coding regions on vcDNA: vcDNA=SeqID_86821; Strand=+; Position=24-361
SRIVHQDIDVFEXHEAFAGQVLANLKALDSDWFCQNYMKRKAKFGLLPLEKVNMWGGSLSLGHPFGATGVRLLAHAANRLQAEGGRFAVIAACAAGGHGMGMLVENYESKQK

SEQ ID NO: 160399 - protein, 210 aa, Heterodera glycines
  Homolog annotation: Hit_ID=AAP30770.1; Match level="QueryCoverage =99%, HitCoverage=81%, E-value=6e-69, Identity=61%"; Hit description =putative gland protein G17G01 [Heterodera glycines]
  Coding regions on vcDNA: vcDNA=SeqID_86822; Strand=+; Position=116-745
MEKKIIYFKLMQIGLTLAFMWELLSLHQFCGTFADPKAFIHDISVGHCESFTLIGKDSKSGEFGAVFDQDKWHNQLSMSSTNRQPIEEQDELAAKLPSAERHCIPITISLFDWIGEERNLLNNGTLFFFSLLLWIAFWSLLPLGLTTIIVLHSAEEYEGFPFYFNAFASIFFWCVSAAVSTNFLLYWTSFWTCVNFQADHTNVPMVTLVI

SEQ ID NO: 160400 - protein, 59 aa, Heterodera glycines
  Coding regions on vcDNA: vcDNA=SeqID_86823; Strand=+; Position=70-246
LCHEIQNNNLFFMLVKKYNQKEIKPPPSLSPSRHLPTRPLVPHFILTISCAFAPILLIA

SEQ ID NO: 160401 - protein, 166 aa, Heterodera glycines
  Homolog annotation: Hit_ID=AAN32890.1; Match level="QueryCoverage =100%, HitCoverage=100%, E-value=5e-87, Identity=98%"; Hit description=secretory protein 4D09 [Heterodera glycines]
  Coding regions on vcDNA: vcDNA=SeqID_86824; Strand=+; Position=28-528
MAKFVAIALLSLTIVSMALAKTGKSQTADEVEGFRNMNIGDNNKVDAGKEPAADKATKKGKAQKAGTKSAAATNEPAAAKGTKNGKAPKTKAKQEVATNEPAAANEWNDQLMGMGVEKFNEELAVLLPKANTFMENALSFINEQMEKNGIATGAAGDSCSTGIPAN

SEQ ID NO: 160402 - protein, 82 aa, Heterodera glycines
  Coding regions on vcDNA: vcDNA=SeqID_86825; Strand=+; Position=3-251
FDCVDRRPSPKGFGFCEFRTTRSSECGYKSERSRAQWACAACQLDQQIRRLCLNWTDDDGWIVIFEDRFDNFHFSLLIGFLK

SEQ ID NO: 160403 - protein, 77 aa, Heterodera glycines
  Coding regions on vcDNA: vcDNA=SeqID_86826; Strand=-; Position=3-233
EISSSSSSSSSAMLTASSSRAMAGFFAQNTAPSGFNGSADNANEAAFDQRRQRAQSDQKNKSDQTKEGHLGRRYRRK

SEQ ID NO: 160404 - protein, 199 aa, Heterodera glycines
  misc_feature (7)..(7): Xaa can be any naturally occurring amino acid
  Homolog annotation: Hit_ID=NP_504291.1; Match level="QueryCoverage =99%, HitCoverage=30%, E-value=3e-83, Identity=76%"; Hit description =heat shock protein (70.8 kD) (hsp-6) [Caenorhabditis elegans] gb|AAB42371.1| Heat shock protein protein 6
  Gene Ontology: Mol. function=enzyme regulator activity; Cellular component=mitochondrial inner membrane; Biological process =mitochondrial translocation
  Coding regions on vcDNA: vcDNA=SeqID_86827; Strand=+; Position=8-603
GGVLAGXVTDLLLLDVTPLSLGIETLGGVFTKLITRNTTIPTKKSQVFSTAADGQTQVEIKVFQGERDMALDNKMLGQFSLVGIPPAPRGVPQIEVAFDIDANGIVNVSARDRGTGKEQQIIIQSSGGLNKDQIENMVREAERHAAADAEKKETIEAINHAESVLHDTESKITEYAEHLNADEVNVVKEKLEELKKKLA

SEQ ID NO: 160405 - protein, 207 aa, Heterodera glycines
  misc_feature (15)..(15): Xaa can be any naturally occurring amino acid
  Homolog annotation: Hit_ID=CAE64944.1; Match level="QueryCoverage =97%, HitCoverage=23%, E-value=4e-26, Identity=38%"; Hit description =Hypothetical protein CBG09775 [Caenorhabditis briggsae]
  Coding regions on vcDNA: vcDNA=SeqID_86828; Strand=+; Position=2-621
RVGRTGRAGNRGFAXTLVTEKDADFCAHLVKNFESAGLPVSAELLHVALKCAWYKTEREQQLQGQPIAGGAVGFGSGARQRTGLGYTAAPTMMMGQGAGTVAPGITTMAKASVTNPLGQSSGPSFSQQATITKQIDRAKSLVATGNVKGMDRVSMMRSALKSTFKHSFQAATVTGSDYSLPASDPRPEWKIKLDEQAEKINQCINRQ

SEQ ID NO: 160406 - protein, 166 aa, Heterodera glycines
  misc_feature (21)..(21): Xaa can be any naturally occurring amino acid
  Homolog annotation: Hit_ID=NP_502296.1; Match level="QueryCoverage =96%, HitCoverage=32%, E-value=5e-30, Identity=45%"; Hit description =HCV NS3-transactivated protein 1 like, possibly N-myristoylated (53.1 kD) (4M871) [Caenorhabditis elegans
  Gene Ontology: Biological process=aspartate metabolism
  Coding regions on vcDNA: vcDNA=SeqID_86829; Strand=+; Position=2-501
ASRMKGIDFETGQQILCPSNXALVGSGSDEQLGGYARHQTVFKSKGLDGVAEELSMEMHRIGARNFGRDDRIGTVNGKSLLAPFLEEPLVCWLNTLPTALKTGFGLPTNDGTANKFLLRNALRSLGVPECFVQRPKRAMQFGTRMVKMENAENGDPKLRGPKFARN

SEQ ID NO: 160407 - protein, 248 aa, Heterodera glycines
  misc_feature (11)..(11): Xaa can be any naturally occurring amino acid
  Homolog annotation: Hit_ID=CAE59601.1; Match level="QueryCoverage =100%, HitCoverage=66%, E-value=1e-63, Identity=48%"; Hit description= Hypothetical protein CBG03009 [Caenorhabditis briggsae]
  Gene Ontology: Mol. function=dodecenoyl-CoA delta-isomerase activity; Cellular component=peroxisome; Biological process=fatty acid beta -oxidation
  Coding regions on vcDNA: vcDNA=SeqID_86830; Strand=+; Position=2-744
KFDAWEKVKGXPKADAQHKYAEIVNSLLKNAGINNANTSETESDGIRRTKEGKVYKIELNRSDKYNAITWEMYEGLISALGDASADRETSVTVITGVGSYFCAGNDLSNFTRGVKTSDDLRAMADRGERVLERYVRAFIEHEKPLIGLINGPAIGISVTVLPLFDLVIASDKATFHAPFSSLGQSPEGCSSYTFPLIMGTSKASELLLFDKKMSAEEALERNLVSRVIPNNSFGTETERMVNSLASLP

SEQ ID NO: 160408 - protein, 167 aa, Heterodera glycines
  Homolog annotation: Hit_ID=CAE63588.1; Match level="QueryCoverage =92%, HitCoverage=53%, E-value=6e-22, Identity=37%"; Hit description =Hypothetical protein CBG08079 [Caenorhabditis briggsae]
  Coding regions on vcDNA: vcDNA=SeqID_86831; Strand=+; Position=213-713
MPSSVGPSSSSDLLIRLFLLLDSAVHFALGAFLFFCPSTCAHFLLKRPSSDGVHWHLLRCVGGQLMASATLSWRCASPRRLPELRSSCLMLRLLGSVLFVFLFLHIRAVHPDLMPFLVLRQLIWFCFSMIALCVALLIVSGWPIGDKLFAANRWGNVLYQIDTIASI

SEQ ID NO: 160409 - protein, 214 aa, Heterodera glycines
  misc_feature (58)..(58): Xaa can be any naturally occurring amino acid
  Homolog annotation: Hit_ID=NP_741567.1; Match level="QueryCoverage =99%, HitCoverage=19%, E-value=2e-61, Identity=52%"; Hit description =IMportin Beta (123.9 kD) (imb-4) [Caenorhabditis elegans] gb|AAB04981.2| Importin beta family protein 4,
  Gene Ontology: Mol. function=protein carrier activity; Cellular component=cytoplasm; Biological process=ribosomal large subunit nucleus export
  Coding regions on vcDNA: vcDNA=SeqID_86832; Strand=+; Position=1-646
TCFDVLIPLPDEVFGLLIQAIVWAVKHTMRNVAENGVDILRELLTKVSTTTDKAQAQXFYKKHFMVIMEHVLGVVTDYNQVNFVGLTNLAESVCLLFQAAETIIEVPLNPTNPSQPNMEFVYEAIATLFTTHFKNLTEPQIRVTVKGFFSFNRTVTKMREHIRDFLVQIREEAGDDTADLFLEEKEAEIQRIQSLKQAIPGVRNPNELLEEDMV

SEQ ID NO: 160410 - protein, 59 aa, Heterodera glycines
  Coding regions on vcDNA: vcDNA=SeqID_86833; Strand=-; Position=220-399
GFTSGPLLPSLGNGAFMNVECSELGLCSQIQMFGCHYYYVVPRNILHPCSWKVGRWSVF

SEQ ID NO: 160411 - protein, 177 aa, Heterodera glycines
  Homolog annotation: Hit_ID=CAE64674.1; Match level="QueryCoverage =96%, HitCoverage=32%, E-value=6e-58, Identity=61%"; Hit description =Hypothetical protein CBG09450 [Caenorhabditis briggsae]
  Coding regions on vcDNA: vcDNA=SeqID_86834; Strand=+; Position=3-536
SASTLHTDAEGRMAMADPLAEAKEKAMKAKNPHLFTIATLTGHLILTYGHCSAAMDNGPARAANYAEQLRKTGDEFGQPVEVSRLFSEDFDFHSAKCEAADLMQSNALPSVRTPRGHMGPAAFLMRVSRIDEAGLDSAQPLKYTHLDIGISMGEYPNTSFPSPLLALIAQHVLPKVK

SEQ ID NO: 160412 - protein, 210 aa, Heterodera glycines
  Homolog annotation: Hit_ID=NP_871674.1; Match level="QueryCoverage =88%, HitCoverage=43%, E-value=5e-23, Identity=31%"; Hit description =g-protein beta WD-40 repeat (46.4 kD) (3H390) [Caenorhabditis elegans] gb|AAN63388.1| Hypothetical protei
  Coding regions on vcDNA: vcDNA=SeqID_86835; Strand=+; Position=7-636
MALAEDVGDMASLLDSNGKYRCNTYGLCFEPIDNEICLGSSNRILIDMVLAPADRDVTCLLFATARSFYQEQQHSVGSCPKIVTKCTVNLRPIEFNLSEEGRESMSSPIYNAHWTSTEPIWSLCFNSHHMKICVGMEKCAKILNVLSGQNFYVGSGGKNVISCIFSKDGNTLFLGRKNADVSMLDMRMTSNHKVGELAQSPSTGYMHLLQ

SEQ ID NO: 160413 - protein, 141 aa, Heterodera glycines
  misc_feature (26)..(26): Xaa can be any naturally occurring amino acid
  Homolog annotation: Hit_ID=AAC60281.1; Match level="QueryCoverage =87%, HitCoverage=12%, E-value=5e-09, Identity=30%"; Hit description =unknown [Gallus gallus]
  Coding regions on vcDNA: vcDNA=SeqID_86836; Strand=+; Position=1-427
PLEYATEIWNPLKKENVHKIEAVQKXTRKAFKKCGLVPMPYEKRLKFCGIKTLEIRRKINDITTTFKIIKKHTHLKPSNFFAVAKRAIRKPFLLQNRIYITKIKNNFFNRVINSWNLLPKNIMEINDPKKFREIAKEIIKQ

SEQ ID NO: 160414 - protein, 165 aa, Heterodera glycines; identical to SEQ ID NO: 160043
  misc_feature (144)..(144): Xaa can be any naturally occurring amino acid
  misc_feature (155)..(155): Xaa can be any naturally occurring amino acid
  Homolog annotation: Hit_ID=AAL78229.1; Match level="QueryCoverage =94%, HitCoverage=84%, E-value=2e-84, Identity=98%"; Hit description =SCN esophageal gland cell protein [Heterodera glycines]
  Coding regions on vcDNA: vcDNA=SeqID_86837; Strand=+; Position=16-512

SEQ ID NO: 160415 - protein, 89 aa, Heterodera glycines
  Homolog annotation: Hit_ID=ZP_00357698.1; Match level="QueryCoverage =70%, HitCoverage=36%, E-value=4e-20, Identity=69%"; Hit description =hypothetical protein Chlo02002738 [Chloroflexus aurantiacus]
  Coding regions on vcDNA: vcDNA=SeqID_86838; Strand=-; Position=92-361
LNFPPPHGAPGIFFKRGVPPKGLFFFFFFFFFFFFFFFFFFFFFFFFFFFFFFFFFFFFFFFCFFFFFFFFFFRPINFYIYVTKQKMAR

SEQ ID NO: 160416 - protein, 159 aa, Heterodera glycines
  Homolog annotation: Hit_ID=AAA93489.2; Match level="QueryCoverage =96%, HitCoverage=45%, E-value=5e-59, Identity=65%"; Hit description =Hypothetical protein F36D4.5a [Caenorhabditis elegans] ref|NP _741591.1| apoptosis-related protein PNAS-4 l
  Coding regions on vcDNA: vcDNA=SeqID_86839; Strand=+; Position=276-752
MARAPVFLNVYDMYKLNDIVFSSLGIGVFHSGIEVYDTEYAYGGHPFPFSGIFENTPRDAEELGENFNFRESIPLGETDFSAEDVNKMIQNLGQEYRGDSYHLITKNCNHFSAILSKVLTGQELPPWINRLANISGSLPFVERWIPQEWLTPIALQQSL

SEQ ID NO: 160417 - protein, 173 aa, Heterodera glycines
  Coding regions on vcDNA: vcDNA=SeqID_86840; Strand=+; Position=117-638
MAENWWRMAAYQNTFLQQQQSQTDGDTSGATSVTDSNGFDVPSNASSAGLDLIGSAATLILNQQQQMIRQGDTAEPSADDLLRADFSMPKLREFFECQKAMGVPNFPEDFDEFWLLVVKARLFNVFKYRGPEAYNRIVLKIRDIAHQFRAQVEENEHSDGTEKPKRGKKQMTN

SEQ ID NO: 160418 - protein, 130 aa, Heterodera glycines
  Coding regions on vcDNA: vcDNA=SeqID_86841; Strand=-; Position=2-391
GHVHMVHLANGGLMHVRAFLQQKCSNFCVSFHNCDQQCKLLSVARVVHLQQGVQLIGAQRVDQRTQSVDVSAVDEVEELAGALRKVIDGTGRSGRTNIIRHWESKKMSAAQFDDEYAAQNRGKGRQWRRN

SEQ ID NO: 160419 - protein, 116 aa, Heterodera glycines
  Coding regions on vcDNA: vcDNA=SeqID_86842; Strand=-; Position=279-629
PFSVIKCGHSLSRKPIGSLLCHKRICGPLLHYAELEQSFLQNLGTNRTLVGKFMVLNDGRHQQSQILDNGKGDRIMHKFGMVFENGIEYGIVIVHHICLQLLLKFLAKILVQSSAL

SEQ ID NO: 160420 - protein, 96 aa, Heterodera glycines
  misc_feature (10)..(10): Xaa can be any naturally occurring amino acid
  Coding regions on vcDNA: vcDNA=SeqID_86843; Strand=+; Position=3-293
PKMAAIEEFXTHLLLTLRKGQLSNPTTVVQTQEASLNQQKMWSLLNGPKRKCKSKNTVRSSLLRRNTNGQKWNRIEKKSKRRKCIFFGLIKRSFDD

SEQ ID NO: 160421 - protein, 102 aa, Heterodera glycines
  Homolog annotation: Hit_ID=ZP_00343300.1; Match level="QueryCoverage =35%, HitCoverage=14%, E-value=2e-13, Identity=89%"; Hit description =hypothetical protein Desu02007544 [Desulfitobacterium hafniense DCB -2]
  Coding regions on vcDNA: vcDNA=SeqID_86844; Strand=-; Position=129-437
IFFFFFFFFFFFFFFFFFFFFFFFFFFFFFFFCINCLLVLQINHRMIALSIQRKCIFFFCFSFQFCSIFVHLCSFLEGSSERCSSICTFSLAHSKVTTSFAD

SEQ ID NO: 160422 - protein, 156 aa, Heterodera glycines
  Homolog annotation: Hit_ID=AAM12418.1; Match level="QueryCoverage =98%, HitCoverage=58%, E-value=2e-11, Identity=28%"; Hit description =spliced leader 30 kDa protein [Ascaris suum]
  Coding regions on vcDNA: vcDNA=SeqID_86845; Strand=+; Position=39-566
MVDLDTQLNNLLDRVDTPQFIMAFMSMSQQDPTFLAKAFEVVMEECRTTGFSNPILPQSATIPSLRPVHPRHQSARSPGSLYLPPPLQPKAYVQGSSLLGPSRPTSTVSYTQITPYAAIPESWVVDAPIRKQPKPSSPAREYRTPVNLPFKDFSQS

SEQ ID NO: 160423 - protein, 208 aa, Heterodera glycines
  Homolog annotation: Hit_ID=XP_322829.1; Match level="QueryCoverage =95%, HitCoverage=18%, E-value=3e-31, Identity=39%"; Hit description =hypothetical protein [Neurospora crassa] emb|CAD70304.1| related to 3-phosphoinositide dependent protein
  Gene Ontology: Mol. function=3-phosphoinositide-dependent protein kinase activity; Cellular component=plasma membrane; Biological process=insulin receptor signaling pathway
  Coding regions on vcDNA: vcDNA=SeqID_86846; Strand=+; Position=1-624
QKRSYGPAEKAPRFSVGQCQFAMAELFLALEHIHALDVIHRDVKPENILLREDGHILLSDFGCAKQIIAKRENVAEENGDKTDGQRADDGQKAEKSADSKSSKKREEEEATKLALRRRCSFVGSGAYVSPEVLNGKEVTGACDWWAFGVTLFQLLVGRLPFSADSEYLLFRQVLALSYKFPDNFPCAAARQLVQALLVLEPTQRIGAA

SEQ ID NO: 160424 - protein, 35 aa, Heterodera glycines
  misc_feature (35)..(35): Xaa can be any naturally occurring amino acid
  Coding regions on vcDNA: vcDNA=SeqID_86847; Strand=+; Position=1-105
NFPFLPAEKKSTAYRERIESLPKVHQSTLKKLLGX

SEQ ID NO: 160425 - protein, 183 aa, Heterodera glycines
  Homolog annotation: Hit_ID=CAE74810.1; Match level="QueryCoverage =100%, HitCoverage=38%, E-value=8e-47, Identity=49%"; Hit description= Hypothetical protein CBG22645 [Caenorhabditis briggsae]
  Gene Ontology: Cellular component=mitochondrion
  Coding regions on vcDNA: vcDNA=SeqID_86848; Strand=+; Position=42-593
WAESEANQLSIWYDIGGIVGSVLGGLASDRLGHRSPIILLMLVLSVPLLFIYSGLGSSRVEHVIGMSLLGVTISGPYNLIVGTIAIDLGSQQALANNAEALSTVTGLIDGIGSAGSALGQLFVPLIQNELGWIWVFHFFILMNFLSSMCLIRRFFHDARLISLSFAPRQNGRRQENEPLISNN

SEQ ID NO: 160426 - protein, 155 aa, Heterodera glycines
  Coding regions on vcDNA: vcDNA=SeqID_86849; Strand=-; Position=0-464
PIISQFISLLKHISAPFSADLSRFFFFVLWRQWPNVLFVATQINADIVQIVQICVLPLNHLSNLVSFNHPADGPSIFTCFSDQCQLLVGSFVHLFKRHHGRRRGMNSKLNFVASRRSGTEKCFFEGVDPFVDVNCWLLIINTVKSLGLAIGCRSG

SEQ ID NO: 160427 - protein, 99 aa, Heterodera glycines
  Coding regions on vcDNA: vcDNA=SeqID_86850; Strand=-; Position=276-575
MKLLTRIDCCCCCCDGGGGDGLAAATIFVGGVAAAKAATAPLSLLMAEMLFLGLLVVAPALFIFSSMPRFVRVSKTRLHSSSPNTQRPRIQPSSRCTKM

SEQ ID NO: 160428 - protein, 166 aa, Heterodera glycines
  Homolog annotation: Hit_ID=AAN32885.1; Match level="QueryCoverage =99%, HitCoverage=27%, E-value=6e-95, Identity=100%"; Hit description= glutamyl transpeptidedase [Heterodera glycines]
  Gene Ontology: Mol. function=protein-glutamine gamma -glutamyltransferase activity; Cellular component=intracellular; Biological process=spermatogenesis
  Coding regions on vcDNA: vcDNA=SeqID_86851; Strand=+; Position=1-501
TSENLGIIWNDEMEDFSFPDVKNWFGYAISPTNFVAPGKRPMSSFSPMVIYNKHTGKVKFVIGGSGGAKIPSSVAKTVLHVLCLNQTVKEAIDAPVLHNQFTPNHVIYENGTPPKLIKDLNENFGHIMKSYDNNNVVVQAIHVADDGFIYANGDFRRRTYMHPAGF

SEQ ID NO: 160429 - protein, 178 aa, Heterodera glycines
  Coding regions on vcDNA: vcDNA=SeqID_86852; Strand=+; Position=1-534
FYYIIAFILFCFVCTKENVIEIVQHKTKPSHLSVLINGQKFDFDKFGAHVSDYRADRNDLIDKPMEFNSMAFLEAKNDPMLVFDELMFKWLAFSEADNVAKTTATTTSSPNGTIRTVDFVIDFVMNVANVDTFLWPKLLYGIDELRNQYNSSSSDRPLSFAYDQNTRKVWLSKGIMSC

SEQ ID NO: 160430 - protein, 218 aa, Heterodera glycines
  misc_feature (26)..(26): Xaa can be any naturally occurring amino acid
  Homolog annotation: Hit_ID=NP_496721.1; Match level="QueryCoverage =97%, HitCoverage=29%, E-value=2e-77, Identity=66%"; Hit description =carnitine palmitoyltransferase 1A (84.1 kD) (2N80) [Caenorhabditis elegans]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_86853; Strand=+; Position=1-652
GWKGTVKELKISPDAFMQWLLATYLXEPGSFSLTYEASITRLFREGRTETIRSCTNESCDFVRAMLDPQQKNEERLRLLRLAAERHQNLTRDAMCGKGVDRHLFALYVVMRHLEESSPFFDKIFPPQYLLSTSQTPLNQFDSEQEGISMAQKLKLVSAGGGFGPVTDAGYGVSYIVAGEDQISFHISSKKSATNTSSIRFREDLKKTLLEMKQLLTVE

SEQ ID NO: 160431 - protein, 181 aa, Heterodera glycines
  misc_feature (13)..(13): Xaa can be any naturally occurring amino acid
  Homolog annotation: Hit_ID=CAG14582.1; Match level="QueryCoverage =99%, HitCoverage=92%, E-value=3e-54, Identity=56%"; Hit description =unnamed protein product [Tetraodon nigroviridis]
  Gene Ontology: Mol. function=protein binding; Cellular component =mitochondrial inner membrane; Biological process=proteolysis and peptidolysis
  Coding regions on vcDNA: vcDNA=SeqID_86854; Strand=+; Position=2-546
SDADFVPFCVLQXLMGGGGSFSAGGPGKGMYTRLYVDVLNQHHWIYNATAFNHSYMDSGLFCIRASADPTKLNDLVDIILAEFGRLTKGVWLDELERAKVQLKSQLLMNLEMRPVQFEDLARQMLAHGQRKTADEYSDLIDRVENTDIIRIAHKMLDSRLSIVGYGDLRNMPTYKSIESRL

SEQ ID NO: 160432 - protein, 246 aa, Heterodera glycines
  misc_feature (211)..(211): Xaa can be any naturally occurring amino acid
  Homolog annotation: Hit_ID=CAE73480.1; Match level="QueryCoverage =98%, HitCoverage=90%, E-value=6e-56, Identity=48%"; Hit description =Hypothetical protein CBG20932 [Caenorhabditis briggsae]
  Gene Ontology: Cellular component=integral to membrane; Biological process=axonogenesis
  Coding regions on vcDNA: vcDNA=SeqID_86855; Strand=+; Position=14-751
MKASRGLIVRDWKPDVVYLVQFPRTHNVLSPSPFALKLETWLRINGLKYRNVNNEFTKASAKGQIPFIELNGRQFADSNLIIDHLRNHFKVSIDSRLSTHERALGRAFTILIEESLFRCLQYDHSIDFGWLATENGWAVHMSGFQKFLFQKIKLKKFQGFYKSVLMAQGYGRHSETEVEEIAKKDLIALSTLLGDKNFLFGEFPTTLDATXFGHLVQFTDTPLHSKAIKPMLEKNVPNLLAFVKRM

SEQ ID NO: 160433 - protein, 194 aa, Heterodera glycines
  misc_feature (10)..(10): Xaa can be any naturally occurring amino acid
  Homolog annotation: Hit_ID=AAP41028.1; Match level="QueryCoverage =100%, HitCoverage=47%, E-value=1e-107, Identity=98%"; Hit description=arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_86856; Strand=+; Position=1-580
NPLLMRDDYXLVLQQKVRMALENLEDDPEIGGTDYPLEGMTKETQKQLIADHFLFKEGDRFLEAANSNHFWPAGRGIFHNAKKTFLVWVNEEDHLRIISMQKGGDVGNVLKRLIRGVKGIEKQVPFARDDRLGYLTFCPSNLGTTIRASVHIRLPKISAKPEFKKICEDLKLQVRGIHGEHSESEGGVYDVSNK

SEQ ID NO: 160434 - protein, 209 aa, Heterodera glycines
  Homolog annotation: Hit_ID=AAH85215.1; Match level="QueryCoverage =73%, HitCoverage=47%, E-value=8e-10, Identity=29%"; Hit description =Unknown (protein for IMAGE:5515247) [Xenopus laevis]
  Coding regions on vcDNA: vcDNA=SeqID_86857; Strand=+; Position=42-668
MNVNKEEERLEKKVTKWAIMLTSEDKIEHALRRLDHVEINLQLLSSTGVGKAVNALRKHHRWGERAAGLVSRWKEVAKAETARAAEEAQRQNENGDGDTTEEEDEREEEERAKSQSEEGTDDDNEESRPNPLVLRIKKEPQEEASPTKHAATPNNSSATKLLSQSARQNEETEAKKRHHFDDDCETFEDEQPIDAFASQLAAADKVQKS

SEQ ID NO: 160435 - protein, 220 aa, Heterodera glycines
  misc_feature (10)..(10): Xaa can be any naturally occurring amino acid
  Homolog annotation: Hit_ID=CAE65711.1; Match level="QueryCoverage =100%, HitCoverage=15%, E-value=1e-102, Identity=83%"; Hit description=Hypothetical protein CBG10790 [Caenorhabditis briggsae]
  Gene Ontology: Mol. function=helicase activity; Cellular component =nucleus; Biological process=chromosome organization and biogenesis (sensu Eukarya)
  Coding regions on vcDNA: vcDNA=SeqID_86858; Strand=+; Position=3-662
EKDVEKSLPXQVEQILRVDMTAQQKQYYKLVLTRNYEELSKGVKGSINGFINIMMELKKSCNHCCLVRQYDEIEEEPQARLQQLLKSSGKLILLDKLLCRLRETGHRVLIFSQMVMMLDILEEYMRLRRFPTQRLDGSMRSDLRKQALDHFNAPGSPDFCFLLSTRAGGLGINLATADTVIIYDSDWNPQNDLQAMSRAHRIGQKKQVNIYRLVTKGSVE

SEQ ID NO: 160436 - protein, 203 aa, Heterodera glycines
  misc_feature (192)..(192): Xaa can be any naturally occurring amino acid
  Homolog annotation: Hit_ID=AAP30771.1; Match level="QueryCoverage =100%, HitCoverage=56%, E-value=1e-115, Identity=99%"; Hit description=putative gland protein G23G11 [Heterodera glycines]
  Coding regions on vcDNA: vcDNA=SeqID_86859; Strand=+; Position=96-704
MSDSEKVTTRNAQPKVLDTRDDGKFTAKFIAPRSREPDSVFLHIFGSKKDPHLYLDVSEVQWGNVYIFDLNKTEVIAVRPRRVADELRKLEERDRPPVKREQPKPQPQPQPQPQPVTFQKILSGLVWPTTEKYTLLVSSRDFDLDGRGSPIKQRATNPDPTRAETNYKGTFDVKMALTERPETFYVWVSSAXGGQKRFVIPAY

SEQ ID NO: 160437 - protein, 106 aa, Heterodera glycines; identical to SEQ ID NO: 158795
  Homolog annotation: Hit_ID=AAP30772.1; Match level="QueryCoverage =100%, HitCoverage=100%, E-value=4e-57, Identity=100%"; Hit description=putative gland protein G23G12 [Heterodera glycines]
  Coding regions on vcDNA: vcDNA=SeqID_86860; Strand=+; Position=67-387

SEQ ID NO: 160438 - protein, 192 aa, Heterodera glycines
  misc_feature (65)..(65): Xaa can be any naturally occurring amino acid
  Homolog annotation: Hit_ID=CAA06097.1; Match level="QueryCoverage =91%, HitCoverage=5%, E-value=4e-10, Identity=31%"; Hit description =very large virion protein (tegument) [Bovine herpesvirus type 1.1 (strain Cooper)] emb|CAB01605.1| UL36 [Bo
  Coding regions on vcDNA: vcDNA=SeqID_86861; Strand=-; Position=110-688
IQYHTFGTSFFNCWADYYSRPPPPSLSQSSAVCPRRCHWPRCAPPPRTPPAVVPLPQGGPPRPIXPAECPSLPPQKPRISPPPNDANGPTRRHCFSPLRPAPLAQSAHPVALLLLSLLTPSLLPLLLPTRLLLLLHLPCPPRPHSVVAGAEIATPRTAEPSRARLCRSTAGPSRPERRCNGRHGQAPGSQSR

SEQ ID NO: 160439 - protein, 205 aa, Heterodera glycines
  misc_feature (32)..(32): Xaa can be any naturally occurring amino acid
  Homolog annotation: Hit_ID=NP_506013.2; Match level="QueryCoverage =99%, HitCoverage=30%, E-value=8e-55, Identity=49%"; Hit description =ADDucin, spectrin assembly factor, adducin head domain related (add -2) [Caenorhabditis elegans]
  Gene Ontology: Mol. function=calmodulin binding; Cellular component =membrane; Biological process=actin cytoskeleton organization and biogenesis
  Coding regions on vcDNA: vcDNA=SeqID_86862; Strand=+; Position=2-615
MIYREVTASSFVKISVDGRIVDPGSTPLGINXAGYILHTAIHEARPDVKCVLHLHSASGAAVSSMKCGLLPLNQESMVIGPVAYHEYCGMLSAEDEKTEIVKHLGDKKVIFLRNHGFAACGASVEEALHLAYHTLIACETQVSAMAAGEKNLIYPNEIAKKRAYDIAQHGANGMNRTASGQNGTMAHTYEKMGDIEWGVGELEWE

SEQ ID NO: 160440 - protein, 168 aa, Heterodera glycines
  misc_feature (147)..(147): Xaa can be any naturally occurring amino acid
  misc_feature (158)..(158): Xaa can be any naturally occurring amino acid
  Homolog annotation: Hit_ID=AAL78229.1; Match level="QueryCoverage =92%, HitCoverage=84%, E-value=2e-84, Identity=98%"; Hit description =SCN esophageal gland cell protein [Heterodera glycines]
  Coding regions on vcDNA: vcDNA=SeqID_86863; Strand=+; Position=6-511
IPLLKPFFNRESNGFFFVLAVLFLVKVDFLQCKYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSELKQYCNNGAENEEENDEXSEREREEERVXEREEQQNSNH

SEQ ID NO: 160441 - protein, 221 aa, Heterodera glycines
  misc_feature (191)..(191): Xaa can be any naturally occurring amino acid
  misc_feature (204)..(204): Xaa can be any naturally occurring amino acid
  Homolog annotation: Hit_ID=CAE62722.1; Match level="QueryCoverage =98%, HitCoverage=24%, E-value=4e-85, Identity=69%"; Hit description =Hypothetical protein CBG06881 [Caenorhabditis briggsae]
  Gene Ontology: Mol. function=transporter activity; Cellular component= integral to membrane; Biological process=negative regulation of locomotion
  Coding regions on vcDNA: vcDNA=SeqID_86864; Strand=+; Position=2-664
IVDAYGIVHYREINPAPYTMVTFPFLFALMFGDLGHGLIMFLFALYLVMKEKRLEAQRIKDEIFQMFFGGRYVIFLMGLFSIYTGLIYNDAFSKSFNLFGSSWLNPYPVDILEKADPEQILTLDPWESYASSPYPVGVDPVWNLAETNKLNFLNSMKMKASVIIGISQMTFGVALSYYNHKYFGSDLDIKXTFIPQMVFLSCIXIYLCLQIIAKWIFYDAL

SEQ ID NO: 160442 - protein, 219 aa, Heterodera glycines
  Homolog annotation: Hit_ID=CAE64562.1; Match level="QueryCoverage =97%, HitCoverage=11%, E-value=3e-77, Identity=60%"; Hit description =Hypothetical protein CBG09312 [Caenorhabditis briggsae]
  Gene Ontology: Mol. function=zinc ion binding; Cellular component =nucleus; Biological process=growth
  Coding regions on vcDNA: vcDNA=SeqID_86865; Strand=+; Position=1-657
GHGSVEGGSPETDPDYWEKLLRHHFEQEQEVERMNLGKGKRVRKQVNYATEALQQDWHAGTPGQDQDYSDSYSGASDHDGSGSNEDEFDSAREERRRKRERDSEKLPPLLARVNGQLEVLGFNPRQRRAFFNAVMRWGMPPHDAYQCQWLVRDLKGKSERAFKAYTSLFMRHLCEPGADSQECFNDGVPREGINRVQVLTRIGIMSLIRKKVQEFEAIN

SEQ ID NO: 160443 - protein, 59 aa, Heterodera glycines
  Coding regions on vcDNA: vcDNA=SeqID_86866; Strand=-; Position=3-179
ICSLHPNATFNVWCRNDVVQTERIDLFVTSKCHVQRLGRKDELRGENRLFVHPNATFNV

SEQ ID NO: 160444 - protein, 152 aa, Heterodera glycines
  Homolog annotation: Hit_ID=CAE58634.1; Match level="QueryCoverage =86%, HitCoverage=95%, E-value=2e-51, Identity=68%"; Hit description =Hypothetical protein CBG01802 [Caenorhabditis briggsae]
  Coding regions on vcDNA: vcDNA=SeqID_86867; Strand=+; Position=64-522
MPLVHNCIAGTRHSLLIVLGLIMIMANCGQAMRQQAVAVRGQLRCGNRPASGVKVKLWDEDDGPDPDDVLDEAFTDSSGSFQMRGSTRELTNIDPVLKIYHDCDDGIMPGQRKVKLRIPSQYITNGGLARRTFEVGVLNLETVFAGEERDFI

SEQ ID NO: 160445 - protein, 240 aa, Heterodera glycines
  Homolog annotation: Hit_ID=EAL30310.1; Match level="QueryCoverage =97%, HitCoverage=62%, E-value=8e-37, Identity=36%"; Hit description =GA21983-PA [Drosophila pseudoobscura]
  Gene Ontology: Mol. function=transcription co-repressor activity; Biological process=ubiquitin cycle
  Coding regions on vcDNA: vcDNA=SeqID_86868; Strand=+; Position=2-721
MTNLPYPNSALPYPTADPPSHIMPQPSSYTPMPQPGNYQAPYPNSYPSDPISYPTPATNVTPQSDGVYPYGTGTIQPTHIHASLLSAVEDRIRQRLRDKIGTPFAELQSIDVNLQELRVGKQNLRDMLDNIARDQRELERVLDIYTDKKEELESALKVVDSNGTTDNGVAFNEEQAIDAQTPVHRQILKCHVQDSAIDDTIYHLGQALHQGAVNLQTYLKYVRQLSKQQFQHRLLMYKCR

SEQ ID NO: 160446 - protein, 194 aa, Heterodera glycines
  misc_feature (71)..(71): Xaa can be any naturally occurring amino acid
  Homolog annotation: Hit_ID=AAT02161.1; Match level="QueryCoverage =98%, HitCoverage=90%, E-value=3e-36, Identity=43%"; Hit description =hypothetical protein L3ni22 [Dictyocaulus viviparus]
  Coding regions on vcDNA: vcDNA=SeqID_86869; Strand=+; Position=3-585
AFLLLVLARDSRLTFSCLDGCECDTDDEAIHCHNRPDRHFVQLPPSRLRGFTVLALTRNNIDVLPSEEVLXLEKLPDLKAVDVEGNEHFDCFTLDHYRTLMVMSDCGKTPEQLEADRAKLPTDTQPNEDCDFECVANRRSRELREYVKHLWEMVKEKVSRLAKKHGLDKVVDDVGNFFDDVGERISNIKLKKKK

SEQ ID NO: 160447 - protein, 226 aa, Heterodera glycines
  Homolog annotation: Hit_ID=CAE62116.1; Match level="QueryCoverage =96%, HitCoverage=13%, E-value=6e-55, Identity=53%"; Hit description =Hypothetical protein CBG06155 [Caenorhabditis briggsae]
  Gene Ontology: Mol. function=microtubule binding; Cellular component =microtubule cytoskeleton; Biological process=gametogenesis
  Coding regions on vcDNA: vcDNA=SeqID_86870; Strand=+; Position=12-692
MRKHRRQLTGAPSAHPSSPCPSSLLPPPVSSLSVPLHHRSSISGGGSRPIAIRKGPQGFGFSIRSVRVYLSEMSEYYSIEHIVAAVREGSPAWEAGLRTNDLITRVHTQSVHNMTHPEMMRRLLSCGNELTVHVVPLSSTSIKEGEPRRNIGKPLRKKPRRPPTAQQKNKQQSRKGSALLRRLSGKRTVGDIVPGTSSQKQMFIPRSVSSQEGRAQPFNSSTSKLE

SEQ ID NO: 160448 - protein, 143 aa, Heterodera glycines
  Homolog annotation: Hit_ID=NP_492512.1; Match level="QueryCoverage =81%, HitCoverage=62%, E-value=1e-11, Identity=30%"; Hit description =SKp1 Related, ubiquitin ligase complex component, required to restrain cell proliferation, to progress th
  Gene Ontology: Biological process=mitotic spindle orientation
  Coding regions on vcDNA: vcDNA=SeqID_86871; Strand=+; Position=29-460
MLQDLNVEANGLSEDFMFDMTKAEIPAETFKKIVSWMEEHKGQPVPEFEEDPNTFERKWLTQNDFQQNFFKCEFAEAAAFLNAANFLDLQSLFRHATQAVAARIKDRSPEEIREMLHLNDKEDKPLTEEEKKAIREKNVWCHY

SEQ ID NO: 160449 - protein, 191 aa, Heterodera glycines
  Coding regions on vcDNA: vcDNA=SeqID_86872; Strand=+; Position=44-616
MPILRPNKRNGPSLDELHLADGIGAECFADGTHGERRRTSRHQIPSVSMEKSNLPSNKNTWCTPSRLICNFEESILNGRIPANSVVSGFRLQLTVIGNGVSTDNRLSFPASKRLTLPVLTYFFNDLMSQHSGRFPVAVPPSPLHLARCELAAETVPIPKRCTLQIVLLRPCGSVVKLFMVAVNVLDMPSNS

SEQ ID NO: 160450 - protein, 201 aa, Heterodera glycines
  Homolog annotation: Hit_ID=XP_372375.1; Match level="QueryCoverage =88%, HitCoverage=30%, E-value=2e-15, Identity=32%"; Hit description =PREDICTED: similar to 1-aminocyclopropane-1-carboxylate synthase [Homo sapiens]
  Coding regions on vcDNA: vcDNA=SeqID_86873; Strand=+; Position=110-712
SANSSAITASASLCSTLSSVARFINRFCRSADSVVPPVAEDELVVVPGVTTGADLLSQILFDPGDFLLVPSPFYYRFVNDFGERGSVHIGCVPALSEDGTRTELRAERFEEVYQEIMQHQQQGKVRAIMLVNPQNPEAGYFSLDEIRPVVHWALSRNLFVLLDEIYDLSIYDEDSECPFRSAVELFEDERSRQKLIWLWGL

SEQ ID NO: 160451 - protein, 171 aa, Heterodera glycines
  Homolog annotation: Hit_ID=XP_309756.1; Match level="QueryCoverage =91%, HitCoverage=56%, E-value=7e-20, Identity=35%"; Hit description =ENSANGP00000012467 [Anopheles gambiae]
  Gene Ontology: Cellular component=cytoplasm; Biological process =autophagy
  Coding regions on vcDNA: vcDNA=SeqID_86874; Strand=+; Position=1-516
IRCRTKETLKFCFLQSLKEACQLKLGSNIAASMTKDEHGRLFDGLCNDRFNDFWMVNDKLMGLRSSSGEEQFSTIPARFYESSYSFRQLLLHSKKQLDDGNMGEVLLIDALHKVFPDYAIETDFEAVTHGILLPLNTPLIWLARNLVYPDNFVHIVIRRKTAPFDKNSKNL

SEQ ID NO: 160452 - protein, 146 aa, Heterodera glycines; identical to SEQ ID NO: 158796
  Homolog annotation: Hit_ID=AAP30773.1; Match level="QueryCoverage =100%, HitCoverage=100%, E-value=4e-80, Identity=100%"; Hit description=putative gland protein G24A12 [Heterodera glycines]
  Coding regions on vcDNA: vcDNA=SeqID_86875; Strand=+; Position=27-467

SEQ ID NO: 160453 - protein, 126 aa, Heterodera glycines
  misc_feature (27)..(27): Xaa can be any naturally occurring amino acid
  Homolog annotation: Hit_ID=CAE61904.1; Match level="QueryCoverage =96%, HitCoverage=16%, E-value=5e-39, Identity=61%"; Hit description =Hypothetical protein CBG05896 [Caenorhabditis briggsae]
  Gene Ontology: Mol. function=phospholipase C activity; Cellular component=intracellular; Biological process=phosphatidylinositol-45 -bisphosphate hydrolysis
  Coding regions on vcDNA: vcDNA=SeqID_86876; Strand=+; Position=3-382
MELAIICAQFCPKREPDSNSIIDPYIXCQIFGVPRDERKAHTRTLRNNGFNPVWNECFSFPLCCPELAILRVCVKDFDRTSSDDFVGEFSVPVNSIRPGYSHVRLNTHRQHTPDEAASILIRTAFS

SEQ ID NO: 160454 - protein, 142 aa, Heterodera glycines
  Homolog annotation: Hit_ID=NP_477414.1; Match level="QueryCoverage =99%, HitCoverage=91%, E-value=5e-50, Identity=61%"; Hit description =CG5788-PA [Drosophila melanogaster] gb|AAF57787.1| CG5788-PA [Drosophila melanogaster] gb|AAS93730.1| RE4
  Gene Ontology: Mol. function=ubiquitin-protein ligase activity; Cellular component=proteasome complex (sensu Eukarya); Biological process=protein modification
  Coding regions on vcDNA: vcDNA=SeqID_86877; Strand=+; Position=2-430
LSEMRGNNSGAVRVLEVDESNLLRWSLMLYPDREPYNKGAFRVNVDFPTEYPFKPPSVTFATKIYHPNIDDKGQVCLGIILAENWKPATRAEQVMNALLSLIAEPEIAHPLRSDLAEEFQRDKKKFFKNAEDYTKKYAERRD

SEQ ID NO: 160455 - protein, 144 aa, Heterodera glycines
  Homolog annotation: Hit_ID=NP_080803.1; Match level="QueryCoverage =70%, HitCoverage=56%, E-value=3e-15, Identity=43%"; Hit description =RIKEN cDNA 2510006C20 [Mus musculus] emb|CAI24537.1| novel protein [Mus musculus] dbj|BAC37498.1| unnamed
  Coding regions on vcDNA: vcDNA=SeqID_86878; Strand=+; Position=1-435
GESRGTNNRKNIESTLKYLDHREKAGYQLKCVQFYPDNGSNPFELCVYISEAGDNIYHSVPTSIDEIVKQIIRSRGPSGSNLEYALRLADCQRRMAPKVWDEHLFEIEQRLLKECEYLRHEDEILEKLNHNLSYLVRERNNSEA

SEQ ID NO: 160456 - protein, 53 aa, Heterodera glycines
  misc_feature (8)..(8): Xaa can be any naturally occurring amino acid
  Coding regions on vcDNA: vcDNA=SeqID_86879; Strand=-; Position=1-159
TVTHSLSXISEKICGMVSGARCGSAQRRRQVQPGTVPPQCAESHRPTRRTPIC

SEQ ID NO: 160457 - protein, 227 aa, Heterodera glycines
  Homolog annotation: Hit_ID=CAE56797.1; Match level="QueryCoverage =99%, HitCoverage=45%, E-value=3e-79, Identity=64%"; Hit description =Hypothetical protein CBG24609 [Caenorhabditis briggsae]
  Gene Ontology: Mol. function=phospholipid binding; Cellular component= nucleoplasm; Biological process=skeletal development
  Coding regions on vcDNA: vcDNA=SeqID_86880; Strand=+; Position=2-682
HAQMTAELLRKAMKGFGCDKSKVIQALVNCNNAQRQEVIRTFKQMYGKELIPELKSELTGDFEHLIIALMELPAVYDAAQLRRSMEGLGTKEHILIEIMTTRPNAQIYAVKMAYRQMYNSDLERDIIGETSGYFQRLLISLCSGARDEQMHTDPIKANQDAQRLWRAGEARLGTDEIAFNSILAVQNFAQLRMVFDEYQRQHGHSIEQAISNEFSGDIRDANLALVK

SEQ ID NO: 160458 - protein, 31 aa, Heterodera glycines
  Coding regions on vcDNA: vcDNA=SeqID_86881; Strand=+; Position=28-120
YPASGKALSFSYRRPYRKPTLVREMSILRRL

SEQ ID NO: 160459 - protein, 240 aa, Heterodera glycines
  Homolog annotation: Hit_ID=NP_492457.1; Match level="QueryCoverage =98%, HitCoverage=27%, E-value=1e-111, Identity=81%"; Hit description= translation Elongation FacTor (94.8 kD) (eft-2) [Caenorhabditis elegans] emb|CAB02985.1| Hypothetical pr
  Gene Ontology: Mol. function=translation elongation factor activity; Biological process=protein biosynthesis
  Coding regions on vcDNA: vcDNA=SeqID_86882; Strand=+; Position=3-722
GVPLQSPTTHRLFCKARPLPDGLPEAIERGDVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASVLTAKPRLLEPVYLVEIQCPEAAVGGIYGVLNRRRGVVFEESQIAGTPMFIVKAHLPVNESFGFTADLRSNTGGQAFPQCVFDHWQVLPGDPFDGTSR

SEQ ID NO: 160460 - protein, 169 aa, Heterodera glycines
  misc_feature (19)..(19): Xaa can be any naturally occurring amino acid
  misc_feature (40)..(40): Xaa can be any naturally occurring amino acid
  Homolog annotation: Hit_ID=NP_492323.1; Match level="QueryCoverage =92%, HitCoverage=91%, E-value=8e-27, Identity=40%"; Hit description =putative protein, with at least 2 transmembrane domains, of bilaterial origin (19.0 kD) (1J169) [Caenorha
  Coding regions on vcDNA: vcDNA=SeqID_86883; Strand=+; Position=2-509
EKSAKRATRGQRQIYEENXQTLLCYVLASICSSVLVFSLXYFLFLPQKGAWIGLALSSASQAFSVILMSMMMKTVRNERNQLVDAGLDLNDPNAFGEYCKDIVILSVSAQLLSLIWTGFFFVLLSIPFFTLYKLWTNILGPWFFRPTLDDDEKEDKKKQKKPKFVHVRR

SEQ ID NO: 160461 - protein, 155 aa, Heterodera glycines
  Homolog annotation: Hit_ID=NP_505526.1; Match level="QueryCoverage =98%, HitCoverage=25%, E-value=3e-27, Identity=44%"; Hit description =zinc finger protein 277 (71.1 kD) (5K268) [Caenorhabditis elegans] emb|CAA94823.1| Hypothetical protein F
  Coding regions on vcDNA: vcDNA=SeqID_86884; Strand=+; Position=122-586
MSFNVEKRGRVSKSKSMSTTLENESNDEEGTMKPAKRDQNHRNSTNDLRTTSTNSVSNGEYADCDEMELDEPFSESEGEDFPQAKGVEKPCLVIPRGRIRSLSGTIPPVGFAPHWGGPTMCLSCFQFFQLPEMICEFSTHLLTEHQIFIDGMDIF

SEQ ID NO: 160462 - protein, 233 aa, Heterodera glycines
  misc_feature (131)..(131): Xaa can be any naturally occurring amino acid
  misc_feature (211)..(211): Xaa can be any naturally occurring amino acid
  Homolog annotation: Hit_ID=NP_509429.1; Match level="QueryCoverage =99%, HitCoverage=35%, E-value=1e-104, Identity=75%"; Hit description= transmembrane 9 superfamily member 2 (75.3 kD) (XJ38) [Caenorhabditis elegans] gb|AAB71307.1| Temporaril
  Gene Ontology: Mol. function=transporter activity; Cellular component= membrane; Biological process=transport
  Coding regions on vcDNA: vcDNA=SeqID_86885; Strand=+; Position=2-698
VWEHTDVKWSSRWDYILDSMPHTNIQWFSIMNSLVIVIFLSGMVGMILLRTLHRDIARYNRLDEEEDAQEEFGWKLVHGDVFRPPRHALLLSVFVGTGSQVLLCAFITLAFACLGFLSPANRGSLMTFALXFFYVLFGVIAGYVSSRIYKTMEGLAWKSNILLTSFLIPGIIFGVFFVSNLMLWSKGSSAAVPFGTLCALLFLWLFISIPXTFVGAYFGFRAKRIQAPVRTNQ

SEQ ID NO: 160463 - protein, 153 aa, Heterodera glycines
  Coding regions on vcDNA: vcDNA=SeqID_86886; Strand=+; Position=169-630
RKKQKPVKCRMFGYVPFASFSNDWSAQFSPPFASPTQPKSRPSSSNSPPSAAEEDENPLPAAFRIGNESESSDESGAERSEHEEEVIRRSKQIRNRERWELLKYKMLISSCCTPSKNPSKNDNELPANCKHETAEDEEQWDEEREREFVFSLL

SEQ ID NO: 160464 - protein, 215 aa, Heterodera glycines
  Homolog annotation: Hit_ID=XP_318701.1; Match level="QueryCoverage =68%, HitCoverage=30%, E-value=8e-14, Identity=31%"; Hit description =ENSANGP00000023724 [Anopheles gambiae]
  Coding regions on vcDNA: vcDNA=SeqID_86887; Strand=+; Position=22-666
MLAWRGIEHIQSLRDNPNLSAQLGVPLGCARSSGLPSLSAKFAAAVRHDTGGMSPSSSAMPTAQQMRAEQSAKLAMAHVRRGAELTRDNKCFEAIQCFNKALNVYEHCADAYVGRGAACAGCRNFPAALADLERAVQLQPNHRNANKYRLEVLHTYAKELERDGKLADARAKFGQLLALCPDHQGALDAIAQLDKNDDNIGDTDIELVELSDDEH

SEQ ID NO: 160465 - protein, 115 aa, Heterodera glycines
  Coding regions on vcDNA: vcDNA=SeqID_86888; Strand=+; Position=2-349
VLPLCRLFYSDTRPNFAEFNCVHLLLRPFSSNALIELTLMRRHQILKKNALKILAKFLPNRCFSNNRITDSGKSQKMVQRIDGQKRWEKRQQKRDNKSNEMTEMHFKKLKEQWQK

SEQ ID NO: 160466 - protein, 234 aa, Heterodera glycines
  misc_feature (211)..(211): Xaa can be any naturally occurring amino acid
  Homolog annotation: Hit_ID=AAC13679.1; Match level="QueryCoverage =85%, HitCoverage=34%, E-value=1e-62, Identity=57%"; Hit description =GLY9 [Caenorhabditis elegans]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_86889; Strand=+; Position=2-704
GPNLPSSLFPVDEHSLVGPDGESPLFTHRIGKSAPEGQPGENGAAVTLTGEEAAEGRRQMSYWFMNVKASDKMSLDRAVPDVRPNACRSLSYDLANLPSASVVIVFTDEPTSVLLRTVHSVFNRSPMSLLCEVVLVDDFSQREELKAPLVAHLRRFGSRVRLLRANERLGLIRAKIVGAKYARGDVVLFLDSHCETSPGWLEPLLHRIKDXRSAVVCPVIDMTSDSSMQYSGGS

SEQ ID NO: 160467 - protein, 231 aa, Heterodera glycines
  Homolog annotation: Hit_ID=NP_500216.1; Match level="QueryCoverage =95%, HitCoverage=22%, E-value=9e-17, Identity=25%"; Hit description =exportin 4 (4D293) [Caenorhabditis elegans] gb|AAK68560.1| Hypothetical protein Y69A2AR.16 [Caenorhabditi
  Coding regions on vcDNA: vcDNA=SeqID_86890; Strand=-; Position=2-694
YKQTQFHRFRSGVFVLRGDSSEEEQQTQDLSSLIEILCLFHSKTYVPPLSVTESECLAGREKISMHGLELLLPLMTEELLNVPHLCASFFRLLIFVSDIAAEGIAQSPPQMLDDILRCVKAALDYSFGGDRVRSALEIVNGLAANCVEDSVKKTGKYATMTERLLALVPKMFQLAMEYSFELDLLSDASSALFSLILLGPDSFKAFVTHLLNLPSNQENRERRRKRLANFY

SEQ ID NO: 160468 - protein, 151 aa, Heterodera glycines; identical to SEQ ID NO: 141876
  Homolog annotation: Hit_ID=A48145; Match level="QueryCoverage=99%, HitCoverage=100%, E-value=2e-49, Identity=62%"; Hit description =ubiquitin-conjugating enzyme ubc-2 - Caenorhabditis elegans
  Gene Ontology: Mol. function=ubiquitin-protein ligase activity; Cellular component=proteasome complex (sensu Eukarya); Biological process=ubiquitin-dependent protein catabolism
  Coding regions on vcDNA: vcDNA=SeqID_86891; Strand=+; Position=86-541

SEQ ID NO: 160469 - protein, 171 aa, Heterodera glycines
  Coding regions on vcDNA: vcDNA=SeqID_86892; Strand=-; Position=2-514
FSEMRIITSNCPLDQRSLGATDQMIPFFGGFSSSDQSLFVRSLFLTLSALQSEPSPPASADPCPRLFRPPRQRRSIPFQRRRLDESAPRGSARNSANETRVVLRVHEQLGGNGCAAGATGRGRTKADGLAIVAEIEFEGDGEENHRKEKKKRTEKQRKRRRKHRQREGTNG

SEQ ID NO: 160470 - protein, 246 aa, Heterodera glycines
  Homolog annotation: Hit_ID=CAE63201.1; Match level="QueryCoverage =99%, HitCoverage=35%, E-value=3e-70, Identity=53%"; Hit description =Hypothetical protein CBG07556 [Caenorhabditis briggsae]
  Gene Ontology: Mol. function=insulin-like growth factor binding; Cellular component=soluble fraction; Biological process =embryogenesis and morphogenesis
  Coding regions on vcDNA: vcDNA=SeqID_86893; Strand=+; Position=2-739
KGPVVVESLKKLDVDLRELALENANIIEIGPKAFAGMRIKKLILDNNKIKTIQKNAFRGLDSVLQELSIASNRLTEVPTAALEGLRALNSLNLRCNRIGNPSNAAFLNTPSLIEVQLECNKICAISDGAFREVKETLQNVILDNNCLEQVPGGALEEMNALISLHMKHNQIEQLDDGHLRNLSSLSLLTLTGNKISQISPNFAQNTPNLRYIYLGDNKLERIDPSSIKQFSAAEIIDLSFNNLAEI

SEQ ID NO: 160471 - protein, 209 aa, Heterodera glycines
  Homolog annotation: Hit_ID=NP_501442.2; Match level="QueryCoverage =97%, HitCoverage=38%, E-value=1e-28, Identity=33%"; Hit description =organic anion transporter, multispecific (59.3 kD) (oat-1) [Caenorhabditis elegans] gb|AAB38003.2| Organi
  Gene Ontology: Cellular component=mitochondrion
  Coding regions on vcDNA: vcDNA=SeqID_86894; Strand=+; Position=33-659
MGLILFLSESPRFLISARKMKEAKEAIIRMHKFDGRPYDEKALDALLEKELQQMLELSVTKKKYNYLHLFYNTKFTMYTLSVSFSLFVVTLITYALVYNIEKMSGNIFLNMIWMGMFKYTMNLAIAFADLKFKWLGRKLSHLLSEVLVLAALGLFVTLRLTGFDANFTFLSNGSLVAAVGFCGILFNSDKLAGSELFPTGVRNLSCSFG

SEQ ID NO: 160472 - protein, 185 aa, Heterodera glycines
  misc_feature (158)..(158): Xaa can be any naturally occurring amino acid
  misc_feature (163)..(163): Xaa can be any naturally occurring amino acid
  misc_feature (172)..(172): Xaa can be any naturally occurring amino acid
  Homolog annotation: Hit_ID=AAL78214.1; Match level="QueryCoverage =97%, HitCoverage=93%, E-value=1e-103, Identity=97%"; Hit description= putative esophageal gland cell protein Hgg-20 [Heterodera glycines]
  Coding regions on vcDNA: vcDNA=SeqID_86895; Strand=+; Position=143-694
MGQINVCDDVWLDTLAWINRVEVGMKFALVNVRLNALADKHFKQRKWCFGEFHTCERMTEESGAEIMTSIDGSDFSTLPLPTTPLPDSVVGFRSISIWYINEEVVNFLRTIRRLLTKDIALEFSTFFTEYRSWKVMAQHIWPLLKDGISTLCLKKCDXGHAPXNTCRPPCCXDCAGLHRIHTQML

SEQ ID NO: 160473 - protein, 132 aa, Heterodera glycines
  Coding regions on vcDNA: vcDNA=SeqID_86896; Strand=-; Position=87-485
SKTSFRLVMRRPKSVPIFRSKKAIIKSEWTAPRRTTFCAAQSVGGRRRHFGAMSCASIRRFAQQQAVAKSVAPIRPANLTSSPGASPATATTQPAKRFRNQCPTRRGPFGEQLFVPPAEAQLRGGQEGMALK

SEQ ID NO: 160474 - protein, 219 aa, Heterodera glycines
  Coding regions on vcDNA: vcDNA=SeqID_86897; Strand=+; Position=91-747
TILLLLLVQHVNGGRDRVQEIQEEEGGYSSSGGNGTETPTKNKAVKQWQQARFKIMQEKIAEYLGGLAKATRKSKYVHKLVDDIQYTTPEPFEGTVTRRTEKTKNGTGKEKNAKTNGTGAKTKIKQMATEYGRAHRTSMAKYKEKAPLFGADDETVETMMLYVQMKLDKMANKYEKYVESDDKKNKKLAENFQKKRADLAKLANEMPAEGCKLSVGYNK

SEQ ID NO: 160475 - protein, 241 aa, Heterodera glycines
  Homolog annotation: Hit_ID=NP_499448.1; Match level="QueryCoverage =86%, HitCoverage=27%, E-value=2e-35, Identity=41%"; Hit description =oxysterol binding protein like (3M348) [Caenorhabditis elegans] emb|CAB57894.2| Hypothetical protein Y47D
  Gene Ontology: Mol. function=oxysterol binding; Cellular component =cytoplasm; Biological process=signal transduction
  Coding regions on vcDNA: vcDNA=SeqID_86898; Strand=+; Position=36-758
MTKKRSSISSASFFVEDTGSNSTDVGVKENSAKTNDPNKFEKAGWLYKWTNYVKGYRQRWFVLNAEGILSYYRHPSEVNRACRGSINLSEANIHSNQGESSHSLIITTPSAQTFHLKASNEIDRSQWLKALEYAKHRAIIQAVSLEEDEEESQLLLNKTKGLKESSTGKLENMSKDLRTSGVKFYKELDELMHFIVGHCNAKEAKNCNEIANQLRAIADNFIKNSNELVLNYKNDYTLLRL

SEQ ID NO: 160476 - protein, 204 aa, Heterodera glycines
  Coding regions on vcDNA: vcDNA=SeqID_86899; Strand=+; Position=3-614
AMGRDGHIARDISPLHDAFAHFVLVKKRLTSMAPIIPREQAQCLQNVFKHFAHFEINSATKDWTQEELRLYKRLFLGLRLCTLTFPPQLLRNLQILFKCIRQFCFNAKLMRENCWSANLRISNEENSLSICEINDQRIERVLRELFVLFFPQKNLECPKSFSLFKLLVEHVTPCLIQTPKWLADEVQKEMKEFVNSGQTHNKQR

SEQ ID NO: 160477 - protein, 89 aa, Heterodera glycines
  misc_feature (11)..(11): Xaa can be any naturally occurring amino acid
  Homolog annotation: Hit_ID=CAE63700.1; Match level="QueryCoverage =71%, HitCoverage=19%, E-value=4e-22, Identity=73%"; Hit description =Hypothetical protein CBG08215 [Caenorhabditis briggsae]
  Coding regions on vcDNA: vcDNA=SeqID_86900; Strand=+; Position=2-269
PRVRCPRWSSXGVDDDVIEFSHGMKIYENCPGSVEPLWVRGAGHNDVELHAAYLDRLRQFIDSEVCNPPTHREQLKNAKRPQTNQQAQN

SEQ ID NO: 160478 - protein, 213 aa, Heterodera glycines
  misc_feature (44)..(44): Xaa can be any naturally occurring amino acid
  misc_feature (76)..(76): Xaa can be any naturally occurring amino acid
  misc_feature (194)..(194): Xaa can be any naturally occurring amino acid
  Homolog annotation: Hit_ID=NP_505941.2; Match level="QueryCoverage =93%, HitCoverage=49%, E-value=1e-48, Identity=47%"; Hit description =DeHydrogenase, Short chain (dhs-20) [Caenorhabditis elegans] emb|CAA98465.2| Hypothetical protein F35B12.
  Gene Ontology: Mol. function=steroid dehydrogenase activity; Cellular component=mitochondrion; Biological process=steroid metabolism
  Coding regions on vcDNA: vcDNA=SeqID_86901; Strand=+; Position=76-715
MILFLPLLVFIYYALRYLWELIPLQNASKRAVFVTGCDSGFGYXLALKLAQYGMLTYAGCLTKQGRDELIEEAKKXRGVAAKLKTVPLDITQDQSVNDAADFVRKDLNSVGNIELWALVNNAGIFSCFGPDAWTSIDEYKLSMEVNCWGTIRCCQAFLPLLKRSRGRIVSISSVAGRVSVPGGAPYAVAKYGGXAYMDAIRLELKCWGIGCSI

SEQ ID NO: 160479 - protein, 226 aa, Heterodera glycines
  misc_feature (169)..(169): Xaa can be any naturally occurring amino acid
  Homolog annotation: Hit_ID=AAQ82687.1; Match level="QueryCoverage =89%, HitCoverage=17%, E-value=5e-16, Identity=32%"; Hit description =Epa5p [Candida glabrata]
  Coding regions on vcDNA: vcDNA=SeqID_86902; Strand=+; Position=96-774
MANLTLGKDKESSVDSERASKRSSSVYSSSEQDPSCDGQGDTSTDHCANVASTIAAEHVSHSTSSSPSLGSSASDQISKSSGTNEVVNRVQQRGTTNSSSSLYSSDQCVQRTVPISAHSSPSVASSLLSSSNSVNSNSNFNEQQQPSSPASLISSSIGLQTSKSAVLKXPKPSKDCANNCPRIDPNLNPLTMGKSPSPLDPNPRLKSPPGTAPLAQSARNFWNSVH

SEQ ID NO: 160480 - protein, 185 aa, Heterodera glycines
  misc_feature (78)..(78): Xaa can be any naturally occurring amino acid
  Homolog annotation: Hit_ID=XP_392577.1; Match level="QueryCoverage =74%, HitCoverage=13%, E-value=5e-20, Identity=38%"; Hit description =similar to dishevelled 3; dishevelled 3 (homologous to Drosophila dsh) [Apis mellifera]
  Gene Ontology: Mol. function=Notch binding; Cellular component =cytoplasm; Biological process=frizzled signaling pathway
  Coding regions on vcDNA: vcDNA=SeqID_86903; Strand=+; Position=203-758
VTFNLDSRRPFGMSIVTKNNRSGFAGIYVHEVNPGGLVALDGRIRPGFIILEVNDISLDDLSSKEALNLIISSVRNAXKPGGNSNWSVLPAAEPARPIDPTAWIQHANAARGVGPPIAALSPSPANRSFARATAADLLYYAATMSAERGETDGQQIVNHSKNKPSATGERSMKNNTNLRVLQIVP

SEQ ID NO: 160481 - protein, 236 aa, Heterodera glycines
  Homolog annotation: Hit_ID=NP_499447.1; Match level="QueryCoverage =85%, HitCoverage=34%, E-value=3e-83, Identity=75%"; Hit description =s6 kinase (3M341) [Caenorhabditis elegans] emb|CAB55075.1| Hypothetical protein Y47D3A.16 [Caenorhabditis
  Gene Ontology: Mol. function=protein kinase activity; Cellular component=nucleus; Biological process=signal transduction
  Coding regions on vcDNA: vcDNA=SeqID_86904; Strand=+; Position=3-710
ILLDCKGPVKLTDFGLCKEAIEGDQKTHTFCGTIEYMAPEILMRTGHGKAVDWWSLGALTFDMLTGGPPFSAENRKRTIDKILKGRLTLPPYLSFEAKDLIKRLLKRHVDTRLGAGPGDAEEIKKHAFFTHHVENWTNVYRREIEAPYKPNITSEEDASLFDSKFTKMTPVDSPTAELPPMSVNPFEGFTYIAPSVLEQVSQPTLVRPRQQRKIHGPAIFHSFHPHQSTTDNGPLE

SEQ ID NO: 160482 - protein, 124 aa, Heterodera glycines
  Coding regions on vcDNA: vcDNA=SeqID_86905; Strand=+; Position=24-395
QMMNKIYTTIHFLLLLTVIANKSTNCATNVQGTQTVKTADATYDEAGKISRDSSSSSDEDDSTTAASKMLLNEANHAFSKDNDEPINQQQKMRPEANFSVKYLPPRLNAAQIDNIAQQASSMIT

SEQ ID NO: 160483 - protein, 182 aa, Heterodera glycines
  Homolog annotation: Hit_ID=NP_502317.1; Match level="QueryCoverage =100%, HitCoverage=34%, E-value=1e-64, Identity=64%"; Hit description= proline HYdroxylase (61.5 kD) (phy-2) [Caenorhabditis elegans] emb|CAA93469.1| Hypothetical protein F35G
  Gene Ontology: Mol. function=procollagen-proline,2-oxoglutarate-4 -dioxygenase activity; Cellular component=cell; Biological process =embryonic development
  Coding regions on vcDNA: vcDNA=SeqID_86906; Strand=+; Position=38-583
NERKRFNDIPERDAFERLCRGEFDISPANASKLYCYFKRDKPYLKLAPHKVEIVHYEPLVVVFRNVISDEEIAVVKQLATPRLRRATVQNSRTGGLEFASYRISKSAWLKGDEHPIIERINRRIHEMTNLDMESAEELQVANYGIGGHYDPHFDFARSGEKSPYKGKGNRIATVLFYMSQPK

SEQ ID NO: 160484 - protein, 193 aa, Heterodera glycines
  Coding regions on vcDNA: vcDNA=SeqID_86907; Strand=+; Position=1-582
DSLAPGTRAGGAPRRTPCKCVVHVFAALQLNHCTYNISIGESSIELEELSREELIRRCNELTERCKMEIRSKNKEKQLKEETIKKLVVLGQQKGIIDTRNKSKKGEKEKRIWELAQHEKNLEINKYEDRYKEMQYALDSTRHELEEEYQNRIKTEEELRQYKDCFGQLPNSYLASANPHNNDRQRNQARRRLK

SEQ ID NO: 160485 - protein, 105 aa, Heterodera glycines
  Coding regions on vcDNA: vcDNA=SeqID_86908; Strand=-; Position=15-332
SIHSINSINFQYLSPILHANLSKLDIFSKNSCAFSAVFSIAPDEFVPFVSSPSIGNEMISLKLFLHSSSGHFSTKVIRQKAIERAKRSEREGGILRKYWPTFQQN

SEQ ID NO: 160486 - protein, 203 aa, Heterodera glycines
  misc_feature (80)..(80): Xaa can be any naturally occurring amino acid
  misc_feature (183)..(183): Xaa can be any naturally occurring amino acid
  Homolog annotation: Hit_ID=CAH81944.1; Match level="QueryCoverage =67%, HitCoverage=96%, E-value=8e-18, Identity=30%"; Hit description =conserved hypothetical protein [Plasmodium chabaudi]
  Gene Ontology: Biological process=N-linked glycosylation
  Coding regions on vcDNA: vcDNA=SeqID_86909; Strand=+; Position=1-651
DLCKIRSIARLRTTTPLKKRKRKQLDVEVDENVAGFDRQEASSPVAAKTFRHFSWAIAPPTAPHPVKEAKKRRNNRKRKXRRKGTKRKKQKKSKMIKFKLDEKLRKPNGSKRRKWAEKMREWKKWSNNRKQRQKNPRTQHSQQRNRRKSKRELKREKRRQEQLKREAEKKKKEEDEARRKKKXKRKRGEKVRKQKRENGDMKR

SEQ ID NO: 160487 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_86910; Strand=+; Position=39-455
MPNIFKILLIVLLAVVSFRLSASTGDKKTANDGSGNNSSAGIGTKIKRIVTAGLLFTSLATGGAEAIGRSNAQGGNAAGLVPSHVTNRSTAPPPPPVQFEMGANRLEKMRAHLRELAEKMPVNESKRLSPSGPDPHHH

SEQ ID NO: 160488 - protein, 76 aa, Heterodera glycines
  misc_feature (74)..(74): Xaa can be any naturally occurring amino acid
  Coding regions on vcDNA: vcDNA=SeqID_86911; Strand=-; Position=41-271
NKKVIIIISRAFLVYRLSSSSALLHNERLLDQHQSGHFLTILLTVLNNGHLSFALALGHVFADKECEILETVFXQQ

SEQ ID NO: 160489 - protein, 138 aa, Heterodera glycines
  Homolog annotation: Hit_ID=AAO33474.1; Match level="QueryCoverage =100%, HitCoverage=100%, E-value=3e-72, Identity=99%"; Hit description=gland-specific protein g4g12 [Heterodera glycines]
  Coding regions on vcDNA: vcDNA=SeqID_86912; Strand=+; Position=39-455
MPNIFKILLIVLLAVVSFRLSASTGDKKTANDGSGNNSSAGIGTKIKRIVTAGLLFTSLATGGAEAIGRSNALGGNAAGLVPSHVTNRSMAPPPPPVQFEMGANRLEKMRAHLRELAEKMPVNESKRLSPSGPDPHHH

SEQ ID NO: 160490 - protein, 176 aa, Heterodera glycines
  Homolog annotation: Hit_ID=AAL78214.1; Match level="QueryCoverage =86%, HitCoverage=78%, E-value=7e-53, Identity=64%"; Hit description =putative esophageal gland cell protein Hgg-20 [Heterodera glycines]
  Coding regions on vcDNA: vcDNA=SeqID_86913; Strand=+; Position=134-661
TLDISHNHHHHHQQQQKQRTTKRMDQNRLSDFAWMETLAWLGRAEVGMKMALVNTRFNMLVDKQFMLRQWRFGEFHICEREGAQRGGAEIMTSEDGTNFITLPLPTTPMPSSVVGFQSLSIWFINADVIKFLRRIRRLFAEDIALEFSTRHTEFRSWQVIARHVWPLLRDGISTLV

SEQ ID NO: 160491 - protein, 204 aa, Heterodera glycines
  misc_feature (14)..(14): Xaa can be any naturally occurring amino acid
  Homolog annotation: Hit_ID=AAG21334.2; Match level="QueryCoverage =100%, HitCoverage=51%, E-value=1e-112, Identity=98%"; Hit description=hypothetical esophageal gland cell secretory protein 4 [Heterodera glycines]
  Coding regions on vcDNA: vcDNA=SeqID_86914; Strand=+; Position=2-612
LRYACRGWQTSFCXKFGTTLAVERTRRDTNAEMMGTKMTANAEREAKKEMNGEMGAKKEMNAEMMNTKKDTNAEVMGTKTNANPERDTKMDAVVMNTKTNANPERDTKTETNAVMVNTKTDFANPERDTKTDAVMVNTKTNVNPERDTKMDTTNAEVMDTKKEANAAAAAPVAASDNTAPAPMTWMMDGIVPRDVNVMVDRTTK

SEQ ID NO: 160492 - protein, 123 aa, Heterodera glycines
  misc_feature (51)..(51): Xaa can be any naturally occurring amino acid
  Homolog annotation: Hit_ID=CAE68824.1; Match level="QueryCoverage =93%, HitCoverage=15%, E-value=4e-31, Identity=54%"; Hit description =Hypothetical protein CBG14783 [Caenorhabditis briggsae]
  Gene Ontology: Mol. function=long-chain-fatty-acid-CoA-ligase activity; Biological process=gametogenesis
  Coding regions on vcDNA: vcDNA=SeqID_86915; Strand=+; Position=1-373
GDGAADHPNVDTFAFMGNPQKDYLIALVVPNRKNLQALAEKNAVNESSWEXLCANKEMAKLLEKELQNFVSGKLRREEIPRKVIICAEPWTADSGMLTEALKLKRKNIERKFAEEIRQLYEGK

SEQ ID NO: 160493 - protein, 221 aa, Heterodera glycines
  misc_feature (16)..(16): Xaa can be any naturally occurring amino acid
  Homolog annotation: Hit_ID=NP_503306.1; Match level="QueryCoverage =98%, HitCoverage=22%, E-value=2e-92, Identity=72%"; Hit description =GEX (Gut on EXterior) Interacting protein GEI-7, bifunctional glyoxylate cycle protein, mainly expressed
  Gene Ontology: Mol. function=malate synthase activity; Cellular component=peroxisomal matrix; Biological process=glyoxylate cycle
  Coding regions on vcDNA: vcDNA=SeqID_86916; Strand=+; Position=2-663
RRRVFMADFEDANSPXWRNQIEGQINLYDAIRGRIRYVNPVTKQEYTLKQDTAVLKIRPRGWHLPEKHVLINEKPMSASLFDFGLYLFHNAKALQEKGSGPYFYLPKLENAQEAKLWADVFGHAETLLGLPHGTIKCTVLIEHLLATFQMDEIVHALKDYIVGINCGRWDYIFSYIKVFRNHRKFLLPDRFLITMTSDFLRAYTLLSIKIAHQRNIFAMGG

SEQ ID NO: 160494 - protein, 221 aa, Heterodera glycines
  Coding regions on vcDNA: vcDNA=SeqID_86917; Strand=+; Position=3-665
NPKNYPISLQIYIKNMRIPIILILLCIVALLIHDACAAGKNTTRKANRNRANKNGNSGTPSRQAAAPGKQNKNTPEARTNGQSPKKGDKSIGNQANPAEVKDVPQLSTPKKLLRAATVGVLLFSSLAGQPIPAGANSHMTEAEQYKMHGQGNNMAAYTKQRSNLYGETAAATKPQITHNNFARHTRTRNPPPPHKKTLRSPNFSALAAERAKQKKEEEERL

SEQ ID NO: 160495 - protein, 66 aa, Heterodera glycines
  Coding regions on vcDNA: vcDNA=SeqID_86918; Strand=-; Position=268-468
KKNVAQLNLILYSIYFYKKSKKIIFFLIKKKDKHTENKKKAKMEVSPINYQTPKINYLFQLNSFYL

SEQ ID NO: 160496 - protein, 115 aa, Heterodera glycines
  Homolog annotation: Hit_ID=NP_492733.1; Match level="QueryCoverage =93%, HitCoverage=95%, E-value=2e-15, Identity=36%"; Hit description =Y106G6H like (1L29) [Caenorhabditis elegans] emb|CAB63338.1| Hypothetical protein Y106G6H.8 [Caenorhabdit
  Coding regions on vcDNA: vcDNA=SeqID_86919; Strand=+; Position=89-436
CGPGLCTRMAGISGGIAVAMNAYGAHFVLANADINDERKRAMTYAINHHFINCIGMALAGVGAHYPTLTSSMFLISTVLFSVPSYLFAIRNDRRLRAVTPYGGVLAMLAWFSFVL

SEQ ID NO: 160497 - protein, 166 aa, Heterodera glycines; identical to SEQ ID NO: 159852
  Homolog annotation: Hit_ID=AAN32890.1; Match level="QueryCoverage =100%, HitCoverage=100%, E-value=2e-87, Identity=99%"; Hit description=secretory protein 4D09 [Heterodera glycines]
  Coding regions on vcDNA: vcDNA=SeqID_86920; Strand=+; Position=32-532

SEQ ID NO: 160498 - protein, 205 aa, Heterodera glycines
  misc_feature (200)..(200): Xaa can be any naturally occurring amino acid
  Homolog annotation: Hit_ID=AAP30755.1; Match level="QueryCoverage =96%, HitCoverage=86%, E-value=8e-85, Identity=80%"; Hit description =putative gland protein 29D09 [Heterodera glycines]
  Coding regions on vcDNA: vcDNA=SeqID_86921; Strand=+; Position=4-620
KYFLPCLLCCSPLPMVFLVCCHAMPKFPCCPGSQQVVAVMSKYIDTFSAADADKSTVCSTAKNTVDGIKSDLFSCGGCPSGGEAQIVGEIDRQLKNIAKMEINYEDECPYNLGFARAMFDLAAAAAGHAGTDTKWQNMKGQFEQESQAIKAIGQELNITVTDVHVGHPSKGFSAHQNVPSPSHVVANPGQKSSVGHGKDXRTVVI

SEQ ID NO: 160499 - protein, 202 aa, Heterodera glycines
  misc_feature (190)..(190): Xaa can be any naturally occurring amino acid
  Homolog annotation: Hit_ID=NP_505501.1; Match level="QueryCoverage =99%, HitCoverage=81%, E-value=1e-45, Identity=47%"; Hit description =lifeguard (27.5 kD) (5K188) [Caenorhabditis elegans] emb|CAA94766.1| Hypothetical protein F40F9.2 [Caenor
  Gene Ontology: Cellular component=integral to membrane
  Coding regions on vcDNA: vcDNA=SeqID_86922; Strand=+; Position=140-746
MPKNELGFNEQSIRAAFVRKVFLLVGVMLGVVTLMCVVPFVHPPLMAFTKNNHSLYFISLITFLVVYFVLICCDSVRRSFPTNLICTAILTLSIGFVTMVMTAFYSFESVLMAAGITTVSCVGIALFAMVTKRDITSLLGFVFIATMVLMMLGFLLVLWSSFSYSRPLHIVYACLGALLFMVYLAIDIQXLLGGRKYEISPD

SEQ ID NO: 160500 - protein, 175 aa, Heterodera glycines; identical to SEQ ID NO: 158782
  Homolog annotation: Hit_ID=AAP30758.1; Match level="QueryCoverage =100%, HitCoverage=100%, E-value=4e-93, Identity=100%"; Hit description=putative gland protein 25A01 [Heterodera glycines]
  Coding regions on vcDNA: vcDNA=SeqID_86923; Strand=+; Position=33-557

SEQ ID NO: 160501 - protein, 160 aa, Heterodera glycines
  misc_feature (28)..(28): Xaa can be any naturally occurring amino acid
  Homolog annotation: Hit_ID=CAC21848.1; Match level="QueryCoverage =95%, HitCoverage=68%, E-value=8e-14, Identity=33%"; Hit description =hypothetical protein [Globodera rostochiensis]
  Coding regions on vcDNA: vcDNA=SeqID_86924; Strand=+; Position=20-498
IPENCWDAFACHEVIEISGDKSLIVQNXGKYNGWRSVFATVFAKYPIVLNKHLSDFFYYEISVMKENEFIWGFNFGFAVKQQTKLDESIRCEKGTYAYENDGELWINGEGKGSNAQYSYDIGDTVGIGINSATRQIIFTKNGLRLDASDFLVDPSFADGS

SEQ ID NO: 160502 - protein, 180 aa, Heterodera glycines
  Coding regions on vcDNA: vcDNA=SeqID_86925; Strand=+; Position=17-556
MTILDQQEEEVIVGSDDSHMIVSNIPHRAHNVCGVLNKHTIIVAPADDSLKRDFGIYELFNINDPQTKYFAWFVRPDAPKKSAIETFLAHYEVIKDAEGDVHIPSLMAARPIKKFHFGMDIIQQSEHDADWRRPVMILKMPAHCVFLVAVRTLSPTASAPSWLALAVGYGLVNALNSLHE

SEQ ID NO: 160503 - protein, 125 aa, Heterodera glycines
  Coding regions on vcDNA: vcDNA=SeqID_86926; Strand=+; Position=3-380
MLDSNILLETESKSRHSPSEVRHIGQIDGGFASPIILTEDAILAHRNRRQTDEETAETAKVFCEKKFSYNCPTALLTISMDWQQKTTEGPRENNRKTNGNGGEEQRECCAGFVPSNGQCVKRERR

SEQ ID NO: 160504 - protein, 66 aa, Heterodera glycines
  Coding regions on vcDNA: vcDNA=SeqID_86927; Strand=+; Position=66-263
KCSNEWKGTTTKSQKTLKFSGPNGHIRHGTTWKTVTTYKGIMGGGMALKEMDSVDLNSIEHLLSCP

SEQ ID NO: 160505 - protein, 221 aa, Heterodera glycines
  misc_feature (8)..(8): Xaa can be any naturally occurring amino acid
  Homolog annotation: Hit_ID=NP_506228.1; Match level="QueryCoverage =98%, HitCoverage=13%, E-value=3e-76, Identity=58%"; Hit description =NIDogen, basement membrane protein (174.4 kD) (nid-1) [Caenorhabditis elegans] emb|CAB01972.1| Hypothetic
  Gene Ontology: Mol. function=protein binding; Cellular component =extracellular space; Biological process=cell-matrix adhesion
  Coding regions on vcDNA: vcDNA=SeqID_86928; Strand=+; Position=1-662
ELVVLPHXIVVDIEFDCHSERFFWSDISGHSIRSAFLNGTGLSSNFSEVLRSPEGIAIDWPSRIIYYVDSIKNELGVLSIDGRFQKALLTEGLNNPRALVIDLESRHLYYSDWSREGPKIGRVSLDGSANEIFISDDVHLPNGMVLLQQRRWLCWVDAGIQQLSCIGLDGTGRRVIYAPLEYPFGLTVNGAEERFYWTDWEDMKIHSVDVFGKGYTQFLPG

SEQ ID NO: 160506 - protein, 217 aa, Heterodera glycines
  misc_feature (12)..(12): Xaa can be any naturally occurring amino acid
  Homolog annotation: Hit_ID=NP_494897.3; Match level="QueryCoverage =100%, HitCoverage=22%, E-value=4e-63, Identity=52%"; Hit description= p-type trefoil domain and Glycoside hydrolase, family 31 precursor (106.8 kD) (2F206) [Caenorhabditis el
  Gene Ontology: Mol. function=catalytic activity; Cellular component =brush border; Biological process=protein modification
  Coding regions on vcDNA: vcDNA=SeqID_86929; Strand=+; Position=3-651
NEPSVFGTMRNXSWYFDTQPAFAGKPPIAPLMCPEPNNKLDYPPYRTWNAYKWDSKNTKRTLNEKTLCMIGKSGRRNWTMYDTHSLYGWSEMVATQKALRVSTGKRGSLTSRSTFPSSGHYGGHWLGDNQSRWPDLRLSIIGVMEFNMFGIPQVGADVCGFIGDSNEELCLRWQQLGAFHSYYRNHNDVNSKVSQDPAQWKSVATATRVANLFRYRH

SEQ ID NO: 160507 - protein, 120 aa, Heterodera glycines
  misc_feature (70)..(70): Xaa can be any naturally occurring amino acid
  Homolog annotation: Hit_ID=CAE67642.1; Match level="QueryCoverage =95%, HitCoverage=31%, E-value=1e-52, Identity=79%"; Hit description =Hypothetical protein CBG13201 [Caenorhabditis briggsae]
  Gene Ontology: Mol. function=transcription factor binding; Biological process=development
  Coding regions on vcDNA: vcDNA=SeqID_86930; Strand=+; Position=3-366
AEQITNSVEELDILYTVPHCVPISAHHKWNFDDLLEKIWAYLNLIRVYTKPKGQLPDYNAPIILNAEKKXLDDLCMKIHKSLSKDFKCALVWGSSVKHNPQSVGKTHLLNDEDVVQVIKK

SEQ ID NO: 160508 - protein, 146 aa, Heterodera glycines
  Homolog annotation: Hit_ID=CAE59319.1; Match level="QueryCoverage =84%, HitCoverage=12%, E-value=4e-33, Identity=54%"; Hit description =Hypothetical protein CBG02659 [Caenorhabditis briggsae]
  Coding regions on vcDNA: vcDNA=SeqID_86931; Strand=+; Position=3-440
VRRRVRFVCAAVGGKGAAASPPSSTMLLDVPVVVVGRHDYDTYRDSVERLKDTGFELGLLNVEAETELVQLRPHIQQMMCEHQILPYDPGPDWRFLDYVSNAEEGTFRVSRHQEQSRTVADVCTLEAEEGTSSRAGIFILDDAFPS

SEQ ID NO: 160509 - protein, 133 aa, Heterodera glycines
  Coding regions on vcDNA: vcDNA=SeqID_86932; Strand=+; Position=107-508
MLVDFLFSASLSLQLLPLLMSIVAASVLVIVTQCCGCGKKDAAEQQMAPTGDQMQQGSVAKQGSQMGQSAAQGGASKMGQSAAQGGASKMGQSAAQDSTMANSQMPGLSTYAGVAQSPTPIEVSAWAQPPKPK

SEQ ID NO: 160510 - protein, 220 aa, Heterodera glycines
  Homolog annotation: Hit_ID=CAE64076.1; Match level="QueryCoverage =89%, HitCoverage=39%, E-value=2e-36, Identity=40%"; Hit description =Hypothetical protein CBG08680 [Caenorhabditis briggsae]
  Gene Ontology: Mol. function=UDP-glycosyltransferase activity; Cellular component=microsome; Biological process=metabolism
  Coding regions on vcDNA: vcDNA=SeqID_86933; Strand=+; Position=48-707
MLTWPFVDAFVIAPKIALLTGRNDFSFDQLYYRSEIALVDSIDLLAFPQPRATDVLSAGAHCEVPTELPKDYRVFVEDPHSKGTVYVAFGTAVPWDYAPPHIANAFFDAFERLSDHRFIFSFRGTFPNRTLSSHIRLVSWAPQLEVLSHPKTKVFLTHSGLKSIKESLCSGTPMLTMPMFAEQAHNAKMLLEFGIGIGLSKFSIDAQTVFDGLSELLHKP

SEQ ID NO: 160511 - protein, 239 aa, Heterodera glycines
  misc_feature (225)..(225): Xaa can be any naturally occurring amino acid
  Coding regions on vcDNA: vcDNA=SeqID_86934; Strand=+; Position=2-718
QKVLPKESEKAKVRQSKALVPQAKANGNSIDGTNTEKRGSACASSTAAAKNDGSIPMEDFVLPAQIKEIVPKTDAAEAPLLISEVDDGGTAIEEGPKNDGPSEGSGADETEEKRRSAPPQLTKECLPTMVTGRYREDLIFYTPKARAKIREKEMQRLSSGSSRRKQIFSSLELTESDAISLVGSSTSSSKDQQKMDSDDKSVPPPPKPKDLGQVPVYLTEHQRDXFFKPLKPLFNLNTV

SEQ ID NO: 160512 - protein, 225 aa, Heterodera glycines
  Homolog annotation: Hit_ID=NP_505107.1; Match level="QueryCoverage =95%, HitCoverage=58%, E-value=3e-35, Identity=33%"; Hit description =serpin (40.4 kD) (srp-7) [Caenorhabditis elegans] gb|AAB37055.1| Serpin protein 7, isoform a [Caenorhabdi
  Gene Ontology: Mol. function=serine protease inhibitor activity; Cellular component=cytosol; Biological process=regulation of proteolysis and peptidolysis
  Coding regions on vcDNA: vcDNA=SeqID_86935; Strand=+; Position=79-753
MTSPPSPNALLILEAQADFALNLLCGVSSVDRSCIVSPFSVAVTLSMVYAGAKEKTGEEMGQLLGNGAPESEVHKYFGTLLKSIASGQNSNTLEMANKVYVKKGIRVKNAFKKKIEENYGGRMETVDFEDIEGTAEKINNFVEEATHEKISDLIAPDTLDKESCLVLINALYFKGAWANKFNKKFTKKATFYVDANTKKELETMHLTSNFIYAENAQLQLLGMPY

SEQ ID NO: 160513 - protein, 243 aa, Heterodera glycines
  Coding regions on vcDNA: vcDNA=SeqID_86936; Strand=+; Position=16-744
TLRDWLPTIFSDSSLQTERRRLLTKRVHVARCPLILDGLYCASTRMETALRFRCSVNRLRPSKKNCLDIGKPEMELLQVNGGQWEFVQRITNESQLYFYINRFNLVFGSSSKATGGRRYFNCIERGGSTKCPYRMMYMLERQVLYQTGEHNHSFSLLRRRKPTKINIKGLLPTPEKGGDFELLSLATDVAQLAEELGLEFREERGRFVLISNSDESDKENCPSTSTAIPQNNEVVKWLVLADK

SEQ ID NO: 160514 - protein, 140 aa, Heterodera glycines
  misc_feature (26)..(26): Xaa can be any naturally occurring amino acid
  Homolog annotation: Hit_ID=NP_620256.1; Match level="QueryCoverage =95%, HitCoverage=52%, E-value=6e-22, Identity=41%"; Hit description =phosphatidylinositol glycan, class L [Rattus norvegicus] gb|AAH74020.1| Pigl protein [Rattus norvegicus]
  Gene Ontology: Mol. function=N-acetylglucosaminylphosphatidylinositol deacetylase activity; Cellular component=endoplasmic reticulum; Biological process=signal transduction
  Coding regions on vcDNA: vcDNA=SeqID_86937; Strand=+; Position=31-451
TIFPAKFGERWLLLIAHPDDETMFFXPTLLFLSSIGVQLHLLCITSGNSEGLGTIRRNELYSSASVYGIQPKYISFVDPEERRFPDGFRDWNITSLSALIYSYIRRLKPDGLITFDEWGISGHPNHRDSFKAILNLNTEG

SEQ ID NO: 160515 - protein, 175 aa, Heterodera glycines
  Homolog annotation: Hit_ID=CAE71886.1; Match level="QueryCoverage =97%, HitCoverage=41%, E-value=2e-25, Identity=35%"; Hit description =Hypothetical protein CBG18941 [Caenorhabditis briggsae]
  Coding regions on vcDNA: vcDNA=SeqID_86938; Strand=+; Position=21-545
IQILLHPRTVGFVHILKRMRKEKYVDFIYDVSVAYGGRIIQSEFDLLLLGLTPAHVHFLVQKIPISLIPEEDEQLEQWLNNKWAEKEEILRRFYSTGEFLPTDANTEKSFQKTELSPRAFLLRLIISAVWLALTAVWTIIFFGFLSAQIRWSCTLLTIIYFVGLQLYFGGFELFL

SEQ ID NO: 160516 - protein, 33 aa, Heterodera glycines
  Coding regions on vcDNA: vcDNA=SeqID_86939; Strand=-; Position=1-99
IKPLNLVIYTNSTLVYEIPEKIWRKFWAKVPRR

SEQ ID NO: 160517 - protein, 205 aa, Heterodera glycines
  Coding regions on vcDNA: vcDNA=SeqID_86940; Strand=-; Position=23-640
STTFSRLMRMVGKDTESESRRRPANVDELGDQLARRTTGRKMGKSSIGFRHFVQLQNVFSVRCFGTETQPFKHKVHLLFGILEQHVERVTGITAFEQFTLLLFLLIISTILISGDQCQFQLPFCFANSARVRPSDAFVTHHARAQQRAKSSWNGRTALPKCMEEDFTCSLSAIRMLSKDCVWPEHSTRSPVPNAWHQFSRMELCP

SEQ ID NO: 160518 - protein, 195 aa, Heterodera glycines
  misc_feature (50)..(50): Xaa can be any naturally occurring amino acid
  Coding regions on vcDNA: vcDNA=SeqID_86941; Strand=+; Position=2-584
HQQHANDAKGDDDGKLERIISGCCWRKDHTCADHRWRTDCNHCPARGCCXCCCCCKKRKRRRRHTSADDDKEDNKKRKRRHHTSDDDKKEEDHYHIDQHNKKEGEQHGKEDNKSPIQSELKVSTISAVPSDYNTNKRLGATELDVEAEEVPKTKPVPKKPKSEGGTKRKLSNFFWSTGTTEKRPSAAEHGVEVPE

SEQ ID NO: 160519 - protein, 196 aa, Heterodera glycines
  misc_feature (13)..(13): Xaa can be any naturally occurring amino acid
  misc_feature (89)..(89): Xaa can be any naturally occurring amino acid
  misc_feature (158)..(158): Xaa can be any naturally occurring amino acid
  Homolog annotation: Hit_ID=NP_740993.1; Match level="QueryCoverage =100%, HitCoverage=46%, E-value=6e-81, Identity=75%"; Hit description= DeHydrogenase, Short chain (dhs-6C) [Caenorhabditis elegans] gb|AAK68187.1| Dehydrogenases, short chain
  Gene Ontology: Cellular component=mitochondrion
  Coding regions on vcDNA: vcDNA=SeqID_86942; Strand=+; Position=62-649
MLNTGKFLGKTFXITGASRGIGKEIALKLAKDGANIVICAKTTQDNPKLPGTIYSAAEEIEKLGGKALPLQVDVRDEQQVEEAVEKAVXKFGAIDSLVNNASAISLTNTLDTPMKRYDLMHSVNVRGTFLMSQKCVPYLRQTSNPHILNLSPPLLMDXQWFAPHVACTMSKYGMSMCVLGMHEEFRKDGIAVNALW

SEQ ID NO: 160520 - protein, 184 aa, Heterodera glycines
  Coding regions on vcDNA: vcDNA=SeqID_86943; Strand=+; Position=1-555
AYCYSSFSDIRSIDSFVDKILIAVKAPFEPQPRSSIEVPDPCETGRYEMTVRNENGGPLQAYLCREPTQKNASELTPNNCKAETEETKAIDSLGTQSFCGPKIPSNELRSPSKQQRMLSPLKLLFANSQPHPDAVSSNSVGPGGVFFPPPGDSFLSLDPPFEENDPYCPLFMNDQNTSLNSLFG

SEQ ID NO: 160521 - protein, 208 aa, Heterodera glycines
  misc_feature (32)..(32): Xaa can be any naturally occurring amino acid
  Homolog annotation: Hit_ID=AAL78214.1; Match level="QueryCoverage =88%, HitCoverage=94%, E-value=2e-12, Identity=30%"; Hit description =putative esophageal gland cell protein Hgg-20 [Heterodera glycines]
  Coding regions on vcDNA: vcDNA=SeqID_86944; Strand=+; Position=90-714
MNRRWICNDVWMDIFPSFDRPQLGLKLALLSXFNALVDKHFNGKSELTIWRTIGISKDKGPEPELSVRIDYEFVPFPLPDDRPLPSKIRFKSLQIYYIDHFVIAFLRSNHQIFDKRGTNLDLCIPYSNTTDGQRIWDVFVREIWPIFSANIHHLRFSHRDHLDHLLRRTSPTILTDLNQLTSIHSFDLFPAAIGDDFDVPNATISAGQ

SEQ ID NO: 160522 - protein, 233 aa, Heterodera glycines
  misc_feature (210)..(210): Xaa can be any naturally occurring amino acid
  Homolog annotation: Hit_ID=AAC13679.1; Match level="QueryCoverage =85%, HitCoverage=34%, E-value=2e-63, Identity=57%"; Hit description =GLY9 [Caenorhabditis elegans]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_86945; Strand=+; Position=3-702
PNLPSSLFPVDEHSLVGPDGESPLFTHRIGKSAPEGQPGENGAAVTLTGEEAAEGRRQMSYWFMNVKASDKMSLDRAVPDVRPNACRSLSYDLADLPSASVVIVFTDEPTSVLLRTVHSVFNRSPMSLLREVVLVDDFSQREELKAPLVAHLRRFGSRVRLFRANERLGLIRAKIVGAKYARGDVVLFLDSHCETSPGWLEPLLHRIKDXRSAVVCPVIDMISDSSMQYSGGS

SEQ ID NO: 160523 - protein, 162 aa, Heterodera glycines
  Homolog annotation: Hit_ID=NP_499618.1; Match level="QueryCoverage =96%, HitCoverage=13%, E-value=2e-61, Identity=73%"; Hit description =E1-E2 ATPase, putative E1-E2 ATPase (3N488) [Caenorhabditis elegans] emb|CAB11550.4| Hypothetical protein
  Gene Ontology: Mol. function=cation-transporting ATPase activity; Cellular component=integral to membrane; Biological process =aminophospholipid transport
  Coding regions on vcDNA: vcDNA=SeqID_86946; Strand=+; Position=85-570
MTKTPFALVTDGASLHHAVIGEARRIFAELILNCHSVICCRMTPMQKAEIVEIVKSLGNDKTVTAVGDGANDVAMIQAANVGVGISGVEGLQAASASDYSIAQFQFLQRLLLVHGTWNFERSVKVILYSFYKNTCLYSIELWFAFFSAFSGVTIFERWTIAM

SEQ ID NO: 160524 - protein, 141 aa, Heterodera glycines
  misc_feature (12)..(12): Xaa can be any naturally occurring amino acid
  misc_feature (18)..(18): Xaa can be any naturally occurring amino acid
  Homolog annotation: Hit_ID=CAE68023.1; Match level="QueryCoverage =99%, HitCoverage=46%, E-value=2e-41, Identity=56%"; Hit description =Hypothetical protein CBG13639 [Caenorhabditis briggsae]
  Gene Ontology: Cellular component=mitochondrion
  Coding regions on vcDNA: vcDNA=SeqID_86947; Strand=+; Position=4-424
MDVGRAELLTRXDLISTXLMLTLLGRFPFLKVISEEKSEFLPEKETERYRADNYELWLGLREVLSKFPSWRIPLARVTVWIDPLDATQEFTEGLTQFVTVMACVAVDGKPIFGAIHAPFSNETVFGMVDFGLFDSNGLPIN

SEQ ID NO: 160525 - protein, 179 aa, Heterodera glycines
  Homolog annotation: Hit_ID=NP_499756.1; Match level="QueryCoverage =75%, HitCoverage=67%, E-value=8e-18, Identity=35%"; Hit description =polyposis locus protein 1 family member (3O468) [Caenorhabditis elegans]
  Gene Ontology: Cellular component=membrane; Biological process =membrane organization and biogenesis
  Coding regions on vcDNA: vcDNA=SeqID_86948; Strand=+; Position=27-566
MSSDESTTSSASVVSVQLREVPIKDFKDVLPVLQKTLNELEHPFIKKAEEISGMEREKLFYITSSLVLLVLMLCPGNMLLSTLITVAYPMYASLLTLNTQNTSEYTQWLVYWCVFAEFCQFDYLFGSINGLLLLYVPLKTVFLLYLALPQTYGAHNLYVKHIRKVLAVTNVLDRMKKMF

SEQ ID NO: 160526 - protein, 205 aa, Heterodera glycines
  Homolog annotation: Hit_ID=CAE69879.1; Match level="QueryCoverage =93%, HitCoverage=38%, E-value=1e-38, Identity=42%"; Hit description =Hypothetical protein CBG16219 [Caenorhabditis briggsae]
  Coding regions on vcDNA: vcDNA=SeqID_86949; Strand=+; Position=3-617
GWSSFRCLYVPGISQSFWSSIYPTTVANTEMFQLNQGVNPKLLLALTAIVQGVGQATSGFFFGILDSRTRRFGRTKIVGFGAALQLCSFLLAYLNLPAHAPLEKTFEHGILNSPSITLALVGGFLLSFGDACWNTQVFATLIAKYPIRASQAFAVFKFFQSLLCCAAFFYATSISLPWHVLILAIGLLIGLIGFLLAERMVRQND

SEQ ID NO: 160527 - protein, 140 aa, Heterodera glycines
  Homolog annotation: Hit_ID=ZP_00308292.1; Match level="QueryCoverage =93%, HitCoverage=22%, E-value=1e-39, Identity=61%"; Hit description =COG1158: Transcription termination factor [Cytophaga hutchinsonii]
  Coding regions on vcDNA: vcDNA=SeqID_86950; Strand=+; Position=174-593
MTSKIRRNQLGVNNLNTTIEGEGVLEIMQDGSGFLRSSDYDYLASPDDVYVSPSQIKLFNLKTGDTAHGVIRAPKEGEKYFALLKVVSMNGITVEEGRNRITFEHLVPLSPNKKLNISNGATQYSTRIMDLFSPIGKGQL

SEQ ID NO: 160528 - protein, 63 aa, Heterodera glycines
  Coding regions on vcDNA: vcDNA=SeqID_86951; Strand=+; Position=166-354
MMANSSLMLPIFTLLALLIVIQFYATDQSSISRDLSQLDRQISDKKQRADQLRQQIASEKNPA

SEQ ID NO: 160529 - protein, 54 aa, Heterodera glycines
  Homolog annotation: Hit_ID=AAO33474.1; Match level="QueryCoverage =85%, HitCoverage=33%, E-value=5e-21, Identity=100%"; Hit description= gland-specific protein g4g12 [Heterodera glycines]
  Coding regions on vcDNA: vcDNA=SeqID_86952; Strand=+; Position=2-166
DVTIANGSPPPPVQFEMGANRLEKMRAHLRELAEKMPVNESKRLSPSGPDPHHH

SEQ ID NO: 160530 - protein, 140 aa, Heterodera glycines
  Homolog annotation: Hit_ID=AAA29605.1; Match level="QueryCoverage =100%, HitCoverage=19%, E-value=7e-15, Identity=35%"; Hit description= glutamic acid-rich protein [Plasmodium falciparum] sp|P13816|GARP _PLAFF Glutamic acid-rich protein precur
  Gene Ontology: Mol. function=phosphopantothenoylcysteine decarboxylase activity; Cellular component=nucleoplasm; Biological process=G1/S transition of mitotic cell cycle
  Coding regions on vcDNA: vcDNA=SeqID_86953; Strand=+; Position=108-530
MSATEQQQPQSQKRARPAEENGNDDGAVLTKTQKVDNGDIPAATANNEASANNNVLKAKLTNNEKPGGAAAAADEETEEQGHEEEEESEGESGAGGEEDDQDDEEDDEDGAEGDDDDEEGDDDDEDAEGDEGGEEEEEEE

SEQ ID NO: 160531 - protein, 234 aa, Heterodera glycines
  Homolog annotation: Hit_ID=CAE65711.1; Match level="QueryCoverage =100%, HitCoverage=15%, E-value=1e-109, Identity=84%"; Hit description=Hypothetical protein CBG10790 [Caenorhabditis briggsae]
  Gene Ontology: Mol. function=helicase activity; Cellular component =nucleus; Biological process=chromosome organization and biogenesis (sensu Eukarya)
  Coding regions on vcDNA: vcDNA=SeqID_86954; Strand=+; Position=3-704
EKDVEKSLPAQVEQILRVDMTAQQKQYYKLVLTRNYEELSKGVKGSINGFINIMMELKKSCNHCCLVRQYDEIEEEPQARLQQLLKSSGKLILLDKLLCRLRETGHRVLIFSQMVMMLDILEEYMRLRRFPTQRLDGSMRSDLRKQALDHFNAPGSPDFCFLLSTRAGGLGINLATADTVIIYDSDWNPQNDLQAMSRAHRIGQKKQVNIYRLVTKGSVEEEIVERAKQKLVLD

SEQ ID NO: 160532 - protein, 173 aa, Heterodera glycines
  Coding regions on vcDNA: vcDNA=SeqID_86955; Strand=+; Position=72-590
MNRRWICNDILMDLFPFFNRPQLGLKLALLSPRFNLLVDAHFDGKSELTIWRQIRIHKNGPKTQLSVDTANNADSVPFPLPDRSLPNKIRFHFLRIGCIDHSVITFLRSNQQIFDGRGTNLRLWLRPDANDYQPIWDAFVREIWPIFVPNIRRLGIPKGDQLDNLLRRTSPTI

SEQ ID NO: 160533 - protein, 141 aa, Heterodera glycines
  Homolog annotation: Hit_ID=NP_495750.1; Match level="QueryCoverage =98%, HitCoverage=25%, E-value=1e-55, Identity=74%"; Hit description =chaperonin Containing TCP-1 (58.4 kD) (cct-4) [Caenorhabditis elegans] emb|CAA88861.1| Hypothetical prote
  Gene Ontology: Mol. function=chaperone activity; Cellular component =cytoskeleton; Biological process=cell organization and biogenesis
  Coding regions on vcDNA: vcDNA=SeqID_86956; Strand=+; Position=27-449
TSGCAVSILVRGSSKLVLDEAERSLHDALCVIRCLVKKRALLPGGGAPEMEVSVRVRAAAQTKHGAEQYCWKAFADALEVVPYTLAENAGLSPIETVTEMRSQHAMGNKEHGVNVRMGAITDIREENVVQPLLVSSFAVKQ

SEQ ID NO: 160534 - protein, 145 aa, Heterodera glycines
  Coding regions on vcDNA: vcDNA=SeqID_86957; Strand=-; Position=57-494
LGCTPRGNTAAYATRLFSHQFHCRPFRKGANGGDSRASSKHICGSSAGMANSPSLFHRWRKFCQGTTFGVQHNKPQCLALRFGKYNRRQRAANSAILSEVRPFLRLSLSSLWLAFLSGSPNRSFASPAMKFHLSSRMLVNSRSPL

SEQ ID NO: 160535 - protein, 239 aa, Heterodera glycines
  misc_feature (40)..(40): Xaa can be any naturally occurring amino acid
  Homolog annotation: Hit_ID=CAE74250.1; Match level="QueryCoverage =97%, HitCoverage=48%, E-value=1e-52, Identity=43%"; Hit description =Hypothetical protein CBG21936 [Caenorhabditis briggsae]
  Coding regions on vcDNA: vcDNA=SeqID_86958; Strand=+; Position=26-741
MPSAGTVGFVNERSLVWEDEEKMIFLFDYVKGAASRGEIXNRVVLKTLKDRGQWRVIRHPLVLNFVNEKLLSCALFYVVHILLYFLFLALLFSYVNGPPSVAKNLLVSTILLFFVFFMLVKAALKLQFGISAVSAWFLISYTWSLITYAITLLYIWSWHLFSFDDYNEELKRTIGWFLPIVATLASWINCLYVLRKAPCGSYILMMSKILFSFLNTTIIWIPTLATFAFAFMLIMRDSG

SEQ ID NO: 160536 - protein, 208 aa, Heterodera glycines
  Homolog annotation: Hit_ID=A35810; Match level="QueryCoverage=96%, HitCoverage=33%, E-value=2e-45, Identity=48%"; Hit description =alpha,alpha-trehalase (EC 3.2.1.28) precursor - rabbit gb|AAA63460.1| alpha,alpha-trehalose glucohydrolase sp|
  Gene Ontology: Mol. function=alpha,alpha-trehalase activity; Cellular component=extrinsic to plasma membrane, GPI-anchored; Biological process=trehalose catabolism
  Coding regions on vcDNA: vcDNA=SeqID_86959; Strand=+; Position=46-669
MFKGDPKHIVDRPLLKSATETVAKFKTLFNVTEWRNVKVPELDRATLKTFVREHFGKADDFLESPQPIDWKENPPKLQNIADPELKTFANQLHDLWKELGKKMPESAKENKSTLIYVPNPFVVPGGRFREFYYWDAYLIVRGLLASGMTESVKHMCDNYAEMVKKFGFVPNGGRIYYNKRSQPPFLTFMVNDYFAETGDTEYLKSILP

SEQ ID NO: 160537 - protein, 163 aa, Heterodera glycines; identical to SEQ ID NO: 158802
  Homolog annotation: Hit_ID=AAP30836.1; Match level="QueryCoverage =100%, HitCoverage=100%, E-value=4e-90, Identity=100%"; Hit description=putative gland protein G30C02; Hg-G30C02 [Heterodera glycines]
  Coding regions on vcDNA: vcDNA=SeqID_86960; Strand=+; Position=13-504

SEQ ID NO: 160538 - protein, 137 aa, Heterodera glycines
  misc_feature (115)..(115): Xaa can be any naturally occurring amino acid
  Homolog annotation: Hit_ID=AAO33474.1; Match level="QueryCoverage =100%, HitCoverage=99%, E-value=8e-69, Identity=96%"; Hit description= gland-specific protein g4g12 [Heterodera glycines]
  Coding regions on vcDNA: vcDNA=SeqID_86961; Strand=+; Position=17-427
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLHXLAVKMPVNESNRLSPIGPDPHH

SEQ ID NO: 160539 - protein, 92 aa, Heterodera glycines
  Coding regions on vcDNA: vcDNA=SeqID_86962; Strand=-; Position=0-275
KKAIIRQHFARRGVMANKSLHFGIIHNFDGERRRVAELDNALMEKQFPFYASLRIFHPIRVDVEAGQIGLGHKSVVHFRTLRSGCTSVSSLT

SEQ ID NO: 160540 - protein, 64 aa, Heterodera glycines
  Coding regions on vcDNA: vcDNA=SeqID_86963; Strand=-; Position=1-192
PLLATVRAKDILRPRPPVGLSPVRHVHVSGGGVAGRRGARRRLWRGMLGVVHVGLIGGTCSVEH

SEQ ID NO: 160541 - protein, 109 aa, Heterodera glycines
  Coding regions on vcDNA: vcDNA=SeqID_86964; Strand=+; Position=30-356
NASFHCPMILQFPFGDFNVLLLLTISTVLLARCLGTIVQFEDELELMENTGTADESADGPLGAFWEWHRMVTGADKFGSTSQRMLHLRPSLKVPSVSKRIAFPSTAFPN

SEQ ID NO: 160542 - protein, 22 aa, Heterodera glycines
  Coding regions on vcDNA: vcDNA=SeqID_86965; Strand=-; Position=27-95
NKCPSVFPSFSFVFSIIFSLFF

SEQ ID NO: 160543 - protein, 217 aa, Heterodera glycines
  Coding regions on vcDNA: vcDNA=SeqID_86966; Strand=+; Position=39-689
MPKRRRDAFMGEDSGQTEGSSGGPSVADHQQQKKLQEKCAKMEMELNVTKLELENRALKAELKQREVMDELNALKKKVAKMEEQKEAAEQRFSQFQNEQKKILEIISELEKQQKQQLNRNTTKAIFERFSKIKIDQNTLFEKVRALEKEQEKGKVLLNFRKNCWDAIACPEGIEIVGDKNLTVHHKGIYKFIKGRRPPVFAKHPISLDNSTDNFYFE

SEQ ID NO: 160544 - protein, 114 aa, Heterodera glycines
  Coding regions on vcDNA: vcDNA=SeqID_86967; Strand=+; Position=50-394
NDPFAYAYIIAFSTLALSKLNTVNFKSDDIVLLDEIRGVAGNQKENNDKNSELANWAVEKGCETIQSLDKYLENDKIDEYTEEMKKFGQIVLQICKQKEVTNAQLISSNFCSPA

SEQ ID NO: 160545 - protein, 66 aa, Heterodera glycines
  Coding regions on vcDNA: vcDNA=SeqID_86968; Strand=+; Position=38-238
TISLVVPYVKFSSIRSLLQRSLPWDRAICMGQTKLLLNVPGVSQNDTDAEYCGVFRDVAAMKLNGI

SEQ ID NO: 160546 - protein, 123 aa, Heterodera glycines
  misc_feature (6)..(6): Xaa can be any naturally occurring amino acid
  Homolog annotation: Hit_ID=AAC48327.1; Match level="QueryCoverage =100%, HitCoverage=25%, E-value=6e-66, Identity=99%"; Hit description= beta-1,4-endoglucanase-1 precursor [Heterodera glycines] gb|AAC15707.1| beta-1,4-endoglucanase-1 precurso
  Coding regions on vcDNA: vcDNA=SeqID_86969; Strand=+; Position=25-392
MCRLQXTHLLARLFLLLALCTALVSSLTAVAPPFGQLSVSGTNLVGANGQPVQLIGNSLFWHQWYPQFWNADTVKALKCNWNANVIRGAMGVDEGGYLSDANTAYNLMVAVIEAAISNGIYVI

SEQ ID NO: 160547 - protein, 83 aa, Heterodera glycines
  Coding regions on vcDNA: vcDNA=SeqID_86970; Strand=-; Position=16-267
MRREMFELIGMIKYYQQISITIIRDSRSESFLLPCLSAGIIEFWRCHGIYPFPNSCNRIWPFSMSTDQQKYSRLVVSSSGTCR

SEQ ID NO: 160548 - protein, 221 aa, Heterodera glycines
  Homolog annotation: Hit_ID=NP_498283.1; Match level="QueryCoverage =100%, HitCoverage=10%, E-value=4e-10, Identity=27%"; Hit description= DEAD/DEAH box helicase and helicase, C-terminal (194.0 kD) (3H3) [Caenorhabditis elegans] gb|AAA62291.2|
  Coding regions on vcDNA: vcDNA=SeqID_86971; Strand=+; Position=16-678
PFTAAFLLRLFAYANSDAVGKREKSETSDPNTEKSKAILGKKQQLVDTNDVRSEVVRRKAALTLLKAPFVLKTKHKNIQTPEEQSSDDTLVFMRILKSLTFFNVQLLRRLQMLDEKCFLHGFAQFALHLSQREPGNLLFVSLLQEGIFHRYFAKHGDLFHHDNLSRAKDDWICILAHIFTAKILPFYVNLQGTNESMPVLPPLDESIEAHIEKHNREVNEL

SEQ ID NO: 160549 - protein, 145 aa, Heterodera glycines
  Coding regions on vcDNA: vcDNA=SeqID_86972; Strand=+; Position=48-485
MTKTISFLPFFLLAVVFVGFGNAGVIHSQLKKLEERYVHGRAQSPQHPSSSSPAVKPSSPKHSSSSSSDDADNEETDGCACPAEKPQSPHHSSSSSPVMPSSPKHSSLPSSPKHHSSEDETEVKQSPPHHHSSSDSEKEEQKLHA

SEQ ID NO: 160550 - protein, 119 aa, Heterodera glycines
  Coding regions on vcDNA: vcDNA=SeqID_86973; Strand=-; Position=148-507
FFFFFFFCEMEQIHFAMHFNVFNTHLNKLGMECGIFVHNDNRSPITFGPSDQSGRPLSSLSLPPFRCRLGCPGAGRASVRCTGAPAASARASRARAALRAHSPAKCWPTPPICALCPPS

SEQ ID NO: 160551 - protein, 162 aa, Heterodera glycines
  Homolog annotation: Hit_ID=NP_509283.1; Match level="QueryCoverage =98%, HitCoverage=44%, E-value=6e-45, Identity=53%"; Hit description =apyrase (40.3 kD) (XI186) [Caenorhabditis elegans] gb|AAA68725.2| Hypothetical protein F08C6.6 [Caenorhab
  Gene Ontology: Biological process=ribonucleoside diphosphate catabolism
  Coding regions on vcDNA: vcDNA=SeqID_86974; Strand=+; Position=2-490
HPMYVKVIHPYGEVLHVDWTKQYKALRGKIGIAFPGYMIHESGQWSDIHKKWFFLPRRASNDTYSETEDEHMGTNLLLIADEDFEHIQVRHIGPPGDGFRGFSAFQFLPNTEDDIIVAIKSEERGGKPIASYLFVFRLSDGHVLLDDQKFDGPYKFEGVVVY

SEQ ID NO: 160552 - protein, 152 aa, Heterodera glycines
  Homolog annotation: Hit_ID=NP_703849.1; Match level="QueryCoverage =98%, HitCoverage=17%, E-value=2e-19, Identity=23%"; Hit description =hypothetical protein [Plasmodium falciparum 3D7] emb|CAG25005.1| hypothetical protein [Plasmodium falcipa
  Gene Ontology: Mol. function=cytoskeletal protein binding; Cellular component=cell-cell adherens junction; Biological process=axon guidance
  Coding regions on vcDNA: vcDNA=SeqID_86975; Strand=+; Position=12-470
SREAPDNRADEENRQVDSADREKRQDNRADREKRQDNRADEENRQVDSADREKRQDNRADREKRQDNRADREKRQDNRADREKRQDNRADREKRQDNRADREKRQDNRADREKRQDNRADREKRQDNRADREKRQDNRADREKRQDNRAIMY

SEQ ID NO: 160553 - protein, 223 aa, Heterodera glycines
  misc_feature (9)..(9): Xaa can be any naturally occurring amino acid
  Homolog annotation: Hit_ID=CAE62116.1; Match level="QueryCoverage =100%, HitCoverage=13%, E-value=1e-101, Identity=80%"; Hit description=Hypothetical protein CBG06155 [Caenorhabditis briggsae]
  Gene Ontology: Mol. function=microtubule binding; Cellular component =microtubule cytoskeleton; Biological process=gametogenesis
  Coding regions on vcDNA: vcDNA=SeqID_86976; Strand=+; Position=2-669
LKSAGTLPXELARLYVAETVLAIEYLHSCGIVHRDLKPDNLLITSMGHIKLTDFGLSKIGLMNRTTLVSEGYLLQDDTQQFKDNQLCGTPEYIAPEVILRQGYGKPVDWWALGVILYEFLVGIVPFMGDTPEALFANIINEDVEYPEGDEALDSDAESLIHLLLEKNPLDRLGTVGGAPQVSAHPFFAPLDFDTILRQKAEFVPQLENDEDTSYFDSRSDRYN

SEQ ID NO: 160554 - protein, 193 aa, Heterodera glycines
  Homolog annotation: Hit_ID=AAC41377.1; Match level="QueryCoverage =86%, HitCoverage=3%, E-value=2e-11, Identity=30%"; Hit description =MLL [Takifugu rubripes]
  Coding regions on vcDNA: vcDNA=SeqID_86977; Strand=+; Position=83-661
MPRALINRQPPVISASTKKTGRKRMSASSSAFVPEDEEDAPAAYRLPSNAMGDARGQKRKRSVSSSSSSSSVSSSDSSSSSGSSSSSSASSHTPLKNAKPNASEHPSKRTPNEREKSNDMSGSGGTTISCSTVDQLALKVTKAEQQEVNAQNVAQMDDESGHKQLSKNIATGERKNVKTEKAPCNSSRLADGD

SEQ ID NO: 160555 - protein, 207 aa, Heterodera glycines
  Homolog annotation: Hit_ID=CAE73615.1; Match level="QueryCoverage =97%, HitCoverage=28%, E-value=1e-53, Identity=50%"; Hit description =Hypothetical protein CBG21105 [Caenorhabditis briggsae]
  Gene Ontology: Mol. function=protein binding; Cellular component =actin cytoskeleton; Biological process=cytoskeletal anchoring
  Coding regions on vcDNA: vcDNA=SeqID_86978; Strand=+; Position=67-687
MLEWLTEHGKPLRVKVTTMDADLNELSIERDSLGQHLFDTVCKIIGLREIWYFGLCFTNRKGFTCWLQMDKRIKDQSVPKQEDGSLHFLFLVKFFPESVKVELIQDLTRHLFFLQIRQSILSMDLYCPSEAAILLASYAVQALYGDIGQQQQQQQPQQQQQADQQQQQQQQQQLDLAKLLPVSVLQQYELTAEMWEQKIRNWWANNS

SEQ ID NO: 160556 - protein, 108 aa, Heterodera glycines
  Homolog annotation: Hit_ID=NP_493659.2; Match level="QueryCoverage =95%, HitCoverage=54%, E-value=2e-46, Identity=80%"; Hit description =RNA-binding region RNP-1 (2A389) [Caenorhabditis elegans] gb|AAN73870.1| Hypothetical protein C50D2.5 [Ca
  Gene Ontology: Biological process=mRNA splicing
  Coding regions on vcDNA: vcDNA=SeqID_86979; Strand=+; Position=3-326
PYKIRAEEMYDIFGKFGAIRQIRIGNTPESRGTAFVVYEDVFDAKNACDHLSGFNVSNRYLVVLYYQATKAWKRMDTDKARVKLEEVKDRYGLGGDIEKKKKKKKKKK

SEQ ID NO: 160557 - protein, 207 aa, Heterodera glycines
  Coding regions on vcDNA: vcDNA=SeqID_86980; Strand=+; Position=7-627
LQSPQNGIYSFEGQVIKRISAFPRPANHSFRLLGFSKSDCLISIPSSSLCHIIKPSDEGVSFSENSDSFHLFAEVLGSENQIAILRDEQTDEEFVLKPYRDDPSKRWMLCLQLLPSATIKWQTVSQQQQSPAKVEFPEVSYKQSASTRIYWTDQHGIQSDVQRLQRLLKRTDRSEQFRQELRRIATYATALGYHNFASVFAEVIERM

SEQ ID NO: 160558 - protein, 179 aa, Heterodera glycines
  Homolog annotation: Hit_ID=AAL78214.1; Match level="QueryCoverage =60%, HitCoverage=57%, E-value=2e-09, Identity=31%"; Hit description =putative esophageal gland cell protein Hgg-20 [Heterodera glycines]
  Coding regions on vcDNA: vcDNA=SeqID_86981; Strand=+; Position=48-584
MPSKMTFLYGVPLFVGCCTILWMFWDRFKKTPKPPADQICLDKMTDNRKEAAEEEMAKVEAKMEKAIFISGDCWLAVFDLLPAYQLGLRISMISHRFNIYVDEHFKTRKWGLDFLRIGSKIDENGTKEMEIVNYDGEELPIPQNEVPHKVIGFECIIISFIDRNAIAFLRRFRQLFATR

SEQ ID NO: 160559 - protein, 39 aa, Heterodera glycines
  Coding regions on vcDNA: vcDNA=SeqID_86982; Strand=+; Position=6-122
ESRLFLQLKEGESDRKRRNLLITPLNWQMPSLRFPPPPL

SEQ ID NO: 160560 - protein, 194 aa, Heterodera glycines
  Homolog annotation: Hit_ID=NP_502793.1; Match level="QueryCoverage =100%, HitCoverage=40%, E-value=1e-98, Identity=92%"; Hit description= sec61 (52.2 kD) (4P588) [Caenorhabditis elegans] emb|CAB16516.1| Hypothetical protein Y57G11C.15 [Caenor
  Gene Ontology: Mol. function=protein transporter activity; Cellular component=endoplasmic reticulum membrane; Biological process =reproduction
  Coding regions on vcDNA: vcDNA=SeqID_86983; Strand=+; Position=12-593
LVVAGLIVLLLDELLQKGYGLGSGISLFIATNICETIVWKAFSPATMNTGRGTEFEGAIIALFHLLATRNDKVRALREAFYRQNLPNLMNLLATVLVFAVVIYFQGFRVDLPIKSARYRGQHSSYPIKLFYTSNIPIILQSALVSNLYVISQMLAAKFGGNILVNLLGTWSDSSGTYRSFPTGGICYYLSPPES

SEQ ID NO: 160561 - protein, 72 aa, Heterodera glycines
  Homolog annotation: Hit_ID=NP_498454.2; Match level="QueryCoverage =59%, HitCoverage=9%, E-value=1e-09, Identity=56%"; Hit description =differentially expressed in FDCP 8 (56.5 kD) (3H680) [Caenorhabditis elegans] gb|AAB53983.2| Hypothetical
  Coding regions on vcDNA: vcDNA=SeqID_86984; Strand=+; Position=315-530
FGKHFFAKWHFQETLELNSPFEAVSTVNGHQFMLQSSKGRNPYCETCLGTIWRLAQHWRRCKSCGYRTHEKY

SEQ ID NO: 160562 - protein, 204 aa, Heterodera glycines
  misc_feature (13)..(13): Xaa can be any naturally occurring amino acid
  Homolog annotation: Hit_ID=CAE65897.1; Match level="QueryCoverage =100%, HitCoverage=21%, E-value=1e-64, Identity=47%"; Hit description= Hypothetical protein CBG11064 [Caenorhabditis briggsae]
  Gene Ontology: Mol. function=ATP binding; Cellular component =extracellular space; Biological process=cell surface receptor linked signal transduction
  Coding regions on vcDNA: vcDNA=SeqID_86985; Strand=+; Position=2-613
VGVTCDRCAPERXFVAPNPQGCLRCFCSGVTRVCESSHWRRNRVELDYARGDRDQLEATTSDAHSPYKPPTQPQVYDGSISFNGFYEARGQTLYWSLPQKFLGDKVTAYGGKLRYTFRFSGAGPLNPDADAIIRGNNIQLEYVSRQQVHADRPNLVEVPITELGWRHSNGVSASREQLMMVLADLDALLIKMSYMRECSQASLV

SEQ ID NO: 160563 - protein, 196 aa, Heterodera glycines
  Homolog annotation: Hit_ID=NP_506650.1; Match level="QueryCoverage =86%, HitCoverage=27%, E-value=3e-21, Identity=36%"; Hit description =sprint (5P266) [Caenorhabditis elegans] emb|CAB60286.1| Hypothetical protein C48G7.3 [Caenorhabditis eleg
  Coding regions on vcDNA: vcDNA=SeqID_86986; Strand=+; Position=3-593
LLPHGANTGDASYFLSILFSAVHVLKHPESLRRLKNVELARSQCGGVHQSYPFADFMGSQSTLQDFDDSDLLLRVAILNEHEGTIEYHSFPILPKMTVAKLCRMIAHQFSVTNPEDYRLYLIFDDYESPPLEPTQIPHLLRSQMNETERPHHLFVYKRADVNISYPGQAVANFFASNTTVLMNPPPLVVTNMRNHR

SEQ ID NO: 160564 - protein, 222 aa, Heterodera glycines
  Homolog annotation: Hit_ID=NP_492997.1; Match level="QueryCoverage =98%, HitCoverage=10%, E-value=6e-31, Identity=37%"; Hit description =VAB-10A protein, Variable ABnormal morphology VAB-10 (vab-10) [Caenorhabditis elegans] pir||T27702 hypoth
  Coding regions on vcDNA: vcDNA=SeqID_86987; Strand=+; Position=1-666
QPGIALTLTDCVEWFFIDDNTGKFSDRFSDDQFSLFDAIHQPRPLVKSNVREIIDMANNRRLTVAEAVRANVLCQDTGRFINVHGHAESLRDAHQLNMIQKPQTLVEVIESGSLDNDGRFIDGVIPRTLLEAICSGMLDPDVAHIKAGPGDELISIGEALKRGRLTPKGEIVLTLGEVGIHRGEKINLFMAHERGLLTGRVRHTIFDVKGVRNAADGSIMSF

SEQ ID NO: 160565 - protein, 206 aa, Heterodera glycines
  misc_feature (191)..(191): Xaa can be any naturally occurring amino acid
  Homolog annotation: Hit_ID=NP_499799.1; Match level="QueryCoverage =98%, HitCoverage=28%, E-value=4e-65, Identity=60%"; Hit description =fatty acid Coenzyme A ligase (75.8 kD) (3O630) [Caenorhabditis elegans] emb|CAA21744.1| Hypothetical prot
  Gene Ontology: Mol. function=long-chain-fatty-acid-CoA-ligase activity; Cellular component=lipid particle; Biological process =gametogenesis
  Coding regions on vcDNA: vcDNA=SeqID_86988; Strand=+; Position=3-622
FTSDRKGEVLVKGPSVTKGYYRDAEKTAELFDENGFLHTGDIGQLLPDGRLKIIDRKKHIFKLAQGEYVAPEKIESVYVQCPLVQQVYVDGDSLERNLVAIVVPPEKTLKRLYKELHGTAQNGDLEKRFQEICTDKKIVEAVLKQMQQMGKEQKLSSIEQVKAIFLEVEPFSVENGLLTPTLKSKRPQLRXKYREQIAALYRTGEK

SEQ ID NO: 160566 - protein, 132 aa, Heterodera glycines
  Homolog annotation: Hit_ID=CAE60421.1; Match level="QueryCoverage =92%, HitCoverage=6%, E-value=2e-15, Identity=38%"; Hit description =Hypothetical protein CBG04027 [Caenorhabditis briggsae]
  Coding regions on vcDNA: vcDNA=SeqID_86989; Strand=+; Position=227-622
MANAFKNGPTSAKSGGSGGEHQQQRQRAANRRQMGKRGADNGDGNGKADGKIDDDEASTVMEATIMQCRNAIGNMVQRRPCVEPTLVKLLKIIHPFYGSEKDHERARAVDFTVLILHIYSENASDCSLGVAN

SEQ ID NO: 160567 - protein, 207 aa, Heterodera glycines
  misc_feature (7)..(7): Xaa can be any naturally occurring amino acid
  misc_feature (24)..(24): Xaa can be any naturally occurring amino acid
  Homolog annotation: Hit_ID=CAE74810.1; Match level="QueryCoverage =99%, HitCoverage=43%, E-value=4e-56, Identity=51%"; Hit description =Hypothetical protein CBG22645 [Caenorhabditis briggsae]
  Gene Ontology: Cellular component=mitochondrion
  Coding regions on vcDNA: vcDNA=SeqID_86990; Strand=+; Position=2-622
TACLKFXNYAFFFWLPYYLTYNIXWAESEANQLSIWYDIGGIVGSVLGGLASDRLGHRSPIILLMLVLSVPLLFIYSGLGSSRVEHVIGMSLLGVTISGPYNLIVGTIAIDLGSQQALANNAEALPTVTGLIDGIGSAGSALGQLFVPLIQNELGWIWVFHFFILMNFLSSMCLIRRFFHDARLISLSFAPRQNGRRQENEPLISNN

SEQ ID NO: 160568 - protein, 51 aa, Heterodera glycines
  Coding regions on vcDNA: vcDNA=SeqID_86991; Strand=-; Position=80-235
DPNLHGSFTQKAHFPASVPSNWHSICFVLKSLQRFSMVSEEAMGRRSINYN

SEQ ID NO: 160569 - protein, 147 aa, Heterodera glycines
  Homolog annotation: Hit_ID=CAE71891.1; Match level="QueryCoverage =87%, HitCoverage=35%, E-value=9e-25, Identity=42%"; Hit description =Hypothetical protein CBG18949 [Caenorhabditis briggsae]
  Gene Ontology: Mol. function=diacylglycerol O-acyltransferase activity; Cellular component=integral to membrane; Biological process=triacylglycerol biosynthesis
  Coding regions on vcDNA: vcDNA=SeqID_86992; Strand=+; Position=38-478
MPFNCEFAGGVCAEIGQVLAVWLFQWMFIDFAFVGTALFLLLLLHRSLWPLALLYFCWYCYDFNTPKKGSRHFRWLRNLHLWKSVAEYFTVETVKTAEIPPDRNYIFSAHPHGVLSISSALAFGTNGTDFQRLFPGIEWRVATLPMN

SEQ ID NO: 160570 - protein, 143 aa, Heterodera glycines
  Homolog annotation: Hit_ID=CAA70694.1; Match level="QueryCoverage =100%, HitCoverage=40%, E-value=3e-75, Identity=100%"; Hit description=cathepsin S-like cysteine proteinase [Heterodera glycines]
  Coding regions on vcDNA: vcDNA=SeqID_86993; Strand=+; Position=29-457
MAFLSRLSILPNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWRE

SEQ ID NO: 160571 - protein, 63 aa, Heterodera glycines
  Homolog annotation: Hit_ID=AAH75564.1; Match level="QueryCoverage =96%, HitCoverage=8%, E-value=2e-16, Identity=67%"; Hit description =Cleavage and polyadenylation specific factor 3, 73kDa [Xenopus tropicalis] ref|NP_001006770.1| cleavage and
  Gene Ontology: Biological process=growth
  Coding regions on vcDNA: vcDNA=SeqID_86994; Strand=+; Position=27-215
GVNPRNTESVQLYFRGQKTAKVVGQLAINVPEDGSIVSGILVRRNFNYHLLHPNELSAYTDLA

SEQ ID NO: 160572 - protein, 236 aa, Heterodera glycines
  Homolog annotation: Hit_ID=CAE61812.1; Match level="QueryCoverage =99%, HitCoverage=8%, E-value=1e-28, Identity=33%"; Hit description =Hypothetical protein CBG05779 [Caenorhabditis briggsae]
  Gene Ontology: Mol. function=ubiquitin-protein ligase activity; Cellular component=cytoplasm; Biological process=embryogenesis and morphogenesis
  Coding regions on vcDNA: vcDNA=SeqID_86995; Strand=+; Position=2-709
QEKSPIRLFIKMTGKDQVKNEEEELVELKDDDSSLFRYVQDLLVTSQKCGQSPNVFSADANSLIWENTFTLIYSVNENEAAECPTEDTEEAMTNNLDETNPLVEQALNVIKILHELSRSISNFDQIIGVEVTFPTLPEESFHSTKLSQKLCQELTDPLVVSAKALPNWCNYLVHNFPCLFSMDIRTSFMNTTAFGTSRAIAYLQTAFNMAGLRRDDHYPEYRIGRVKHERIKVHRS

SEQ ID NO: 160573 - protein, 143 aa, Heterodera glycines
  Homolog annotation: Hit_ID=AAL78229.1; Match level="QueryCoverage =93%, HitCoverage=72%, E-value=1e-70, Identity=97%"; Hit description =SCN esophageal gland cell protein [Heterodera glycines]
  Coding regions on vcDNA: vcDNA=SeqID_86996; Strand=+; Position=14-445
SPFLIGNESNGFFFVLAVLFLVKVDFLQCKYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSGLKQYCYNGAENAEENDE

SEQ ID NO: 160574 - protein, 177 aa, Heterodera glycines
  misc_feature (16)..(16): Xaa can be any naturally occurring amino acid
  Homolog annotation: Hit_ID=NP_496842.1; Match level="QueryCoverage =94%, HitCoverage=57%, E-value=1e-50, Identity=55%"; Hit description =zinc metallopeptidase 2 MEP2 precursor family member (178.0 kD) (2N805) [Caenorhabditis elegans] emb|CAB0
  Gene Ontology: Mol. function=metalloendopeptidase activity; Cellular component=integral to membrane; Biological process=reproduction
  Coding regions on vcDNA: vcDNA=SeqID_86997; Strand=+; Position=2-532
GAFAEEKGDGQNGINXQIILTNAWYQPELNSITVPASILAQPFFDTEWPEAVIFGAIGVVLGHELSHGFDNHGVQWDAEGAANKWMDAHSQRAFDRMAKCVVDEYSQLCPFPPDGIVQPACIDGDKTQAENIADNGGLHAAFRAYRSALEVDGPSKALPGKLVGRFNHDQLFFLFFA

SEQ ID NO: 160575 - protein, 79 aa, Heterodera glycines
  Homolog annotation: Hit_ID=NP_498607.1; Match level="QueryCoverage =98%, HitCoverage=16%, E-value=1e-22, Identity=53%"; Hit description =protein similar to CwfJ, N-terminal 1 and Protein similar to CwfJ, N- terminal 2 (3I397) [Caenorhabditis e
  Coding regions on vcDNA: vcDNA=SeqID_86998; Strand=+; Position=34-270
LVERTLESCSKCINSKLFEKHSIVAYGLKTYLSVVNWDGLSPEHCYIAPMAHCASLVQMDEDVYEEMKLWMKGLVAMWR

SEQ ID NO: 160576 - protein, 148 aa, Heterodera glycines
  Homolog annotation: Hit_ID=NP_505500.2; Match level="QueryCoverage =78%, HitCoverage=39%, E-value=4e-15, Identity=36%"; Hit description =lifeguard (33.2 kD) (5K187) [Caenorhabditis elegans] emb|CAD44126.1| Hypothetical protein F40F9.1b [Caeno
  Coding regions on vcDNA: vcDNA=SeqID_86999; Strand=+; Position=24-467
MSNFGYDQQQVHSYYVQGDNPYDQHADLDVPHRPKNQQPFNSQHFAEQGKAGMPKNDLGFNDQTIRSRFVRKVFFIVGIMLSVVTLMSAFPFMCQPMMEFVQQHPVYAIVAYLIFIVVYLVLMCCGHGIRRSFPINIILLAILTFSIG

SEQ ID NO: 160577 - protein, 144 aa, Heterodera glycines
  Homolog annotation: Hit_ID=NP_085133.1; Match level="QueryCoverage =99%, HitCoverage=18%, E-value=4e-52, Identity=66%"; Hit description =chromosome 17 open reading frame 28 [Homo sapiens] gb|AAH35372.1| Chromosome 17 open reading frame 28 [Ho
  Coding regions on vcDNA: vcDNA=SeqID_87000; Strand=+; Position=58-492
TQQEVEQLKQLENREEGAKNGQQTNETVAIEEEWTPTSEWVESWKKKLPLQTIMRVLQILVPQVEKICIDKGLTDESEILKFLQHGTLVGLLPVPHPILIRKYIANSATNNWFRTYLWGFVYCRNIDPPIWFDSNVTLFEIQRL

SEQ ID NO: 160578 - protein, 184 aa, Heterodera glycines
  Homolog annotation: Hit_ID=CAE63551.1; Match level="QueryCoverage =97%, HitCoverage=32%, E-value=1e-43, Identity=51%"; Hit description =Hypothetical protein CBG08037 [Caenorhabditis briggsae]
  Gene Ontology: Mol. function=glucose-6-phosphate isomerase activity; Cellular component=cytosol; Biological process=neurogenesis
  Coding regions on vcDNA: vcDNA=SeqID_87001; Strand=+; Position=74-625
MTGLSENVAFSRFVSEFGGRCKELKIANEFARDPSRANKYTRTLKDGKGSWQLCVDFSKNLIDDDIFHQLISVARFAEVGQWRDKMFTGERINFTEDRPVLHVAARNTSMTPIFVNNNDVMPSVMAVLTQMKMFCDDLISGRWTGWTGERIKDVVNIGIGGSDLGPLMVTEALKPYQQGPNLHL

SEQ ID NO: 160579 - protein, 90 aa, Heterodera glycines
  Coding regions on vcDNA: vcDNA=SeqID_87002; Strand=+; Position=1-273
RECDIRIVMDALSSGKALLCLPMFAEQFYVSEKLRRMGAAVVLDPRSGSFTPEGISKSIGEALTKRHAVTFPSNEESLKQTILNAFKKLE

SEQ ID NO: 160580 - protein, 125 aa, Heterodera glycines
  Homolog annotation: Hit_ID=NP_499385.2; Match level="QueryCoverage =90%, HitCoverage=10%, E-value=3e-49, Identity=83%"; Hit description =membrane Calcium ATPase, Sarco-Endoplasmic Reticulum Calcium ATPase (115.5 kD) (sca-1) [Caenorhabditis el
  Gene Ontology: Mol. function=calcium-transporting ATPase activity; Cellular component=nuclear envelope-endoplasmic reticulum network; Biological process=calcium ion homeostasis
  Coding regions on vcDNA: vcDNA=SeqID_87003; Strand=+; Position=1-378
VKLSPENFEDLDCAVFVDNHPNAMALSVLVTIEMLNAINSLSENQSILKMPPWTNIWLCAAIALSMSLHFLILYVDIMATIFQITPLNFTEWMAVLKFSIPVILLDEILKFVARRMEAHGRVKAD

SEQ ID NO: 160581 - protein, 171 aa, Heterodera glycines
  misc_feature (11)..(11): Xaa can be any naturally occurring amino acid
  misc_feature (22)..(22): Xaa can be any naturally occurring amino acid
  Homolog annotation: Hit_ID=NP_499298.1; Match level="QueryCoverage =98%, HitCoverage=25%, E-value=2e-50, Identity=57%"; Hit description =FtsH protease (3L509) [Caenorhabditis elegans] emb|CAA88955.1| Hypothetical protein M03C11.5 [Caenorhabdi
  Gene Ontology: Mol. function=ATP-dependent peptidase activity; Cellular component=mitochondrial inner membrane; Biological process =proteolysis and peptidolysis
  Coding regions on vcDNA: vcDNA=SeqID_87004; Strand=+; Position=2-511
DRVLMEPERIXGRLPDEEETDXTAFHEAGHAIVAHFSDHSNPLHKVTIIPRGTSLGHTSQLPDKDRHQETKAQLLAQLDVTMGGRVAEELVFGQEHISTGATSDLRRATKVAERMVKLFGMSDRAGLRDFTVEPIESEQGFCVERGPSTSETIDREIENLLQQSHERVKEL

SEQ ID NO: 160582 - protein, 164 aa, Heterodera glycines
  Coding regions on vcDNA: vcDNA=SeqID_87005; Strand=+; Position=2-493
TLLDKLKREQAELEAEAGGEVQKETAATKSGTVSPEKNAEMDVQDALRRKTRKRAATASSSVSSASSPTRSPKRSNAMDTCDRMEASSSHRTDESPPAINLNESNSLSHRHLAEEANASVAGDSATESTTTACGGTFGQKGTEERVGRTAEDGLWQTLALPDFG

SEQ ID NO: 160583 - protein, 117 aa, Heterodera glycines
  misc_feature (90)..(90): Xaa can be any naturally occurring amino acid
  Homolog annotation: Hit_ID=XP_516103.1; Match level="QueryCoverage =70%, HitCoverage=20%, E-value=9e-12, Identity=41%"; Hit description =PREDICTED: similar to chromosome 2 open reading frame 24 [Pan troglodytes]
  Coding regions on vcDNA: vcDNA=SeqID_87006; Strand=+; Position=69-419
MAHMTKKASNFLIGDFNSVDFDNMADQLGNHGYVSPCNMLTALVYIMRLKESNERDFLAFNPTELFVSSLVLATKYLNDGTLQEFVWNDXWASVSGLALPKLNELEIRLLTSLRWDA

SEQ ID NO: 160584 - protein, 95 aa, Heterodera glycines
  misc_feature (13)..(13): Xaa can be any naturally occurring amino acid
  misc_feature (34)..(34): Xaa can be any naturally occurring amino acid
  Homolog annotation: Hit_ID=AAM50039.1; Match level="QueryCoverage =100%, HitCoverage=28%, E-value=2e-46, Identity=90%"; Hit description= putative gland protein G26D05 [Heterodera glycines]
  Coding regions on vcDNA: vcDNA=SeqID_87007; Strand=+; Position=2-286
GAGAPLFVPEYGXKFVPGDGGPDLVETQNWYDFXNKNSLSYINWAIDDKQEASAALQNTQPPVGPADVCSTDRLTKSGKFVHDHLIGVNQKPDGC

SEQ ID NO: 160585 - protein, 194 aa, Heterodera glycines
  Coding regions on vcDNA: vcDNA=SeqID_87008; Strand=+; Position=38-622
MAHIIVVNKFQDRTMIRGTTLGQNMYKIGGEEAVPVREALVNNMQQKNAKTCRAAEDEPKKAAIGGTGDELDLLSLLIKGDRSKTIGEDGFDLELFDQDDNNNNGGEEQGVNKGKTTTAPQKAKRTPSQPKESSLSKAMKEMDLDRSKQTPSSTEKPPSRKGSRKGAHLLEMMDQETAAPKTTQARKGSVKRGN

SEQ ID NO: 160586 - protein, 218 aa, Heterodera glycines
  Coding regions on vcDNA: vcDNA=SeqID_87009; Strand=+; Position=3-656
PSLFWAFPRQIVPVHRSIGNFVDEVPKKQNEEVLDEDIFENIGKEKAAQLMADLGLAEEKKTGAQSAEKVAEERTEAHGQQRMGTAPRNLRKEMQKKRPQHLAILTDSEEEAEETEEKPNGIDTAVLGNGGEEKGRGATDLSDKAQPPPKSKGVVGISHAEKYIMRVKQNREDTKQQQKTEQKEEMRKGTGKVQKQGSSDDEEPNEWDKLSGASANGG

SEQ ID NO: 160587 - protein, 108 aa, Heterodera glycines
  Coding regions on vcDNA: vcDNA=SeqID_87010; Strand=-; Position=22-348
RRRFFSMMATLFFNDGDFFMEGLYHFKKLLLEAGIFTHYLFPFDDTWQQKFVQQPTGRERIRCGIFGRDERHNFVQKFERKAFGGHCWEMQGAVLLFGVISEQISVLA

SEQ ID NO: 160588 - protein, 92 aa, Heterodera glycines
  misc_feature (22)..(22): Xaa can be any naturally occurring amino acid
  Homolog annotation: Hit_ID=NP_956607.1; Match level="QueryCoverage =97%, HitCoverage=8%, E-value=8e-26, Identity=64%"; Hit description =similar to chromodomain helicase DNA binding protein 1-like [Danio rerio] gb|AAH50498.1| Similar to chromo
  Gene Ontology: Mol. function=ATPase activity; Cellular component =nucleus; Biological process=anti-apoptosis
  Coding regions on vcDNA: vcDNA=SeqID_87011; Strand=+; Position=1-277
EQLDGTVSTPDRQKAIKTLTAXSDVFAFLLTTKAGGLGLNLTAADTAIFLDWDFNPQNDKQAAARCHRIGQDKPVKIIRLVAKHTVEELIKQ

SEQ ID NO: 160589 - protein, 141 aa, Heterodera glycines
  Coding regions on vcDNA: vcDNA=SeqID_87012; Strand=+; Position=78-500
MADDVGPPAPSGAVDDFAQRTGQFFDFIRQGNIDRLRALIDSLSVDELNTLLQMRYNEQQFALLVAVMEGHPEIAALLLDKGADVHQTTVGRVNNVTMGEQFAVTPLWIAVNMRHLEMRRVLIAHGADVDLGSDSSFTPLL

SEQ ID NO: 160590 - protein, 144 aa, Heterodera glycines
  Homolog annotation: Hit_ID=XP_239171.2; Match level="QueryCoverage =90%, HitCoverage=14%, E-value=2e-31, Identity=50%"; Hit description =similar to Solh protein [Rattus norvegicus]
  Gene Ontology: Mol. function=calpain activity
  Coding regions on vcDNA: vcDNA=SeqID_87013; Strand=+; Position=15-471
MSSAKSTPDFCGWEEKPLWVSLIEKALAKAYGNYAILRAGRTVEGLSTLTGQPTLSIDLEYLDMDQQSRTADLDIAWAKLISAREARFLMGCSCGAGKRTMEEAEFQRVGLSSQHAYSLLDVRQTNDGHRLVLLRNPWGENFVW

SEQ ID NO: 160591 - protein, 86 aa, Heterodera glycines
  Coding regions on vcDNA: vcDNA=SeqID_87014; Strand=-; Position=2-259
GLIYKGIGGKERNNKCRVEGGNNSLASFCAACFAGCRLLSAHEIGVLYFEITGWCETRTLKNAVIGSISSVSSSLSLTLSTTGPDA

SEQ ID NO: 160592 - protein, 183 aa, Heterodera glycines
  misc_feature (145)..(145): Xaa can be any naturally occurring amino acid
  Homolog annotation: Hit_ID=CAE58868.1; Match level="QueryCoverage =99%, HitCoverage=25%, E-value=8e-79, Identity=73%"; Hit description =Hypothetical protein CBG02098 [Caenorhabditis briggsae]
  Coding regions on vcDNA: vcDNA=SeqID_87015; Strand=+; Position=23-570
GVTRLLNNQLQTSYLPNSTKKVELHQELLVLVWKCCEYNQKFLYYVLKSSDVLELLVPILFHLNDSRTDPTRIGLIHMGVFLILLLSGERNFGVRLNKPFTSRGLIDVPIFTGSHADLLIIVFHKLITSGNHKLQSLFDCLLTLXVNVSPYLKSLSMVTANKLVHLAEAFSTPWFIFSTPTNH

SEQ ID NO: 160593 - protein, 116 aa, Heterodera glycines
  Coding regions on vcDNA: vcDNA=SeqID_87016; Strand=+; Position=2-352
ILASLKSYNPSLFLRTDKFRSRNACGNKKSEVSLQIDEFDEFYKRWISNYEQEGAGKSHGEENSEHDGKEESESGDEEEEPPQNSRGPVIKCPRMPKIRINLKRRISTISIEKAKE

SEQ ID NO: 160594 - protein, 166 aa, Heterodera glycines
  Coding regions on vcDNA: vcDNA=SeqID_87017; Strand=+; Position=3-500
QHANRVLSIGDAFLYNSAWKMCMPDVVVDWQYELFTRVQLQLDSAEHALTGEGGHDLDFLIRFVINRRNGEKVLLELLQRAILHKSLQFSRITQIFRQILPEIPTENAESSVTKVKWLPHAMPLVPLTVSHNSLLRTVFEPLSQRGDEVDKRNLANLMMEFFLILK

SEQ ID NO: 160595 - protein, 197 aa, Heterodera glycines
  Homolog annotation: Hit_ID=NP_505879.1; Match level="QueryCoverage =89%, HitCoverage=86%, E-value=9e-69, Identity=70%"; Hit description =emp24/gp25L/p24 family (23.7 kD) (5L804) [Caenorhabditis elegans] emb|CAA98480.1| Hypothetical protein F4
  Gene Ontology: Cellular component=COPII-coated vesicle; Biological process=ER to Golgi transport
  Coding regions on vcDNA: vcDNA=SeqID_87018; Strand=+; Position=25-615
MCLSNSVRMLSRTWIVAICFYIFFGTILPFSEAIRFYVASNDKKCLKEEIHKNIVLTGEYELSDSVGHTTTVHVTDTRGHTLYKRENFPEARGKFAFTADEYDIFEICFQMHGPTHQQKLNREVHLVLKHGVEAKNYEDLAKAEKLKPLEVELRRLEDLSDSIVQDFAYMRQREEEMRDTNESTNSRVLYLSIFSML

SEQ ID NO: 160596 - protein, 50 aa, Heterodera glycines
  Coding regions on vcDNA: vcDNA=SeqID_87019; Strand=+; Position=1-150
CLPEEEDYFVWSAIDPGIGSIAHSLKHLDDERKLLDRFERFVCKMIEPVA

SEQ ID NO: 160597 - protein, 51 aa, Heterodera glycines
  Coding regions on vcDNA: vcDNA=SeqID_87020; Strand=+; Position=2-154
LNTDDRMLNAWAPIKKLNQYQSEEEEHKQLMFFQLKSQHIEKKRKLLEEID

SEQ ID NO: 160598 - protein, 82 aa, Heterodera glycines
  Coding regions on vcDNA: vcDNA=SeqID_87021; Strand=-; Position=173-421
CVVCTCCCVCGSSIAVLSLFEVVVAADDEVATSPELRTQCSSAARTFARFSSVSSRMMILNSNSLSEPWTNFICSIIAPSVG

SEQ ID NO: 160599 - protein, 167 aa, Heterodera glycines
  Homolog annotation: Hit_ID=NP_493378.1; Match level="QueryCoverage =100%, HitCoverage=27%, E-value=2e-49, Identity=54%"; Hit description= CYcloPhilin (70.8 kD) (cyp-15) [Caenorhabditis elegans] emb|CAB60429.1| Hypothetical protein Y87G2A.6 [C
  Gene Ontology: Biological process=protein folding
  Coding regions on vcDNA: vcDNA=SeqID_87022; Strand=+; Position=3-671
TPLGITVYNLVSDQVARRIGAGENLRFVGVALCRAVPGVTEKLQGAATSVKVEAADNPNLRINEPDPMLVTCAHRNNRFYLFTNVEPYAEEADGSTHSRDVYNEKPLKEDMITAIEEEAPQSKLCNKAIVYTTYGDIHIELFPDKTPRTVENFCTHARRGYYNGHAF

SEQ ID NO: 160600 - protein, 152 aa, Heterodera glycines
  Coding regions on vcDNA: vcDNA=SeqID_87023; Strand=+; Position=2-457
TRWTPFCLCSFPAIGWRRNGFWPISEIDRHFHRPLYFWARLIIGPHEKNAANRQRIGQTKRNDKNSVGHFCWTGQFANTSGIHRVSGRPFRTFHLCGRLISIYEILVCAYSSRPGVLLLFDGHYFGRCPIFCASNGQWRRITSDQRNCFGQC

SEQ ID NO: 160601 - protein, 194 aa, Heterodera glycines
  Homolog annotation: Hit_ID=NP_506650.1; Match level="QueryCoverage =88%, HitCoverage=27%, E-value=8e-22, Identity=36%"; Hit description =sprint (5P266) [Caenorhabditis elegans] emb|CAB60286.1| Hypothetical protein C48G7.3 [Caenorhabditis eleg
  Coding regions on vcDNA: vcDNA=SeqID_87024; Strand=+; Position=1-582
ELLPHGANTGDASYFLSILFSAVHVLKHPESLRRLKNVELARSQCGGVHQSYPFADFMGSQSTLQDFDDSDLLLRVAILNEHEGTIEYHSFPILPKMTVAKLCRMIAHQFSVTNPEDYRLYLIFDDYESPPLEPTQIPHLLRSQMNETERPHHLFVYKRADVNISYPGQAVANFFASNTTVLMNPPPLVVTNMR

SEQ ID NO: 160602 - protein, 92 aa, Heterodera glycines
  misc_feature (10)..(10): Xaa can be any naturally occurring amino acid
  misc_feature (37)..(37): Xaa can be any naturally occurring amino acid
  Homolog annotation: Hit_ID=AAM50039.1; Match level="QueryCoverage =98%, HitCoverage=27%, E-value=5e-42, Identity=86%"; Hit description =putative gland protein G26D05 [Heterodera glycines]
  Coding regions on vcDNA: vcDNA=SeqID_87025; Strand=+; Position=1-275
APLFVPEYGXKFVPGDGGPDLVETQNWYDFFNKTPSXVINWAIDDKQEASAALQNTQPPVGPADVCSTDRLTKSGKFVHDHLIGVNQKPDGC

SEQ ID NO: 160603 - protein, 165 aa, Heterodera glycines
  misc_feature (144)..(144): Xaa can be any naturally occurring amino acid
  misc_feature (155)..(155): Xaa can be any naturally occurring amino acid
  Homolog annotation: Hit_ID=AAL78229.1; Match level="QueryCoverage =94%, HitCoverage=84%, E-value=5e-83, Identity=96%"; Hit description =SCN esophageal gland cell protein [Heterodera glycines]
  Coding regions on vcDNA: vcDNA=SeqID_87026; Strand=+; Position=10-506
SPFLIGNESNGFFFVLAVLFLVKVDFLQCKYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSGLKQYCNNGAENAEENDEXSEREREEERVXEREEQQNSNH

SEQ ID NO: 160604 - protein, 173 aa, Heterodera glycines
  Homolog annotation: Hit_ID=CAE62532.1; Match level="QueryCoverage =85%, HitCoverage=53%, E-value=6e-17, Identity=31%"; Hit description =Hypothetical protein CBG06641 [Caenorhabditis briggsae]
  Coding regions on vcDNA: vcDNA=SeqID_87027; Strand=+; Position=37-558
MTGARCSLFFASPMIRPYNVYKIAEQMVDQSQKESLTRFLARVIPVEESCHANLDEIKTLLSEMVVKHLKGEKKDTPPTYAVEFKASNTKLLSRQQIYDLVAQLMNELSPESAVNLTQPDLLVIVHTIRTVTMLSIVENYYQRRKFALKLATESEPKEKSNEKQNTTHEEGET

SEQ ID NO: 160605 - protein, 206 aa, Heterodera glycines
  misc_feature (194)..(194): Xaa can be any naturally occurring amino acid
  Homolog annotation: Hit_ID=AAP30755.1; Match level="QueryCoverage =96%, HitCoverage=87%, E-value=1e-105, Identity=95%"; Hit description= putative gland protein 29D09 [Heterodera glycines]
  Coding regions on vcDNA: vcDNA=SeqID_87028; Strand=+; Position=16-632
IYFLPCLLCCSPLPIVFLVCCNAMPNFPCCPGSQQVVAVMSKYIDTFSSAADESTVCSTAKSTVDGIKNELSSRGGCQNGGEAQIVDEIDRQLKNIAKMEINYEDECPYNLGFARAMFDLAAAAAGHAGNGTEWQYMKVQFEQESQAIKAIGQEKNFEVTDVHIGVPSKGVSAHQNVPSPSHVIANPGQHSSVXPRKERRTVVIGL

SEQ ID NO: 160606 - protein, 72 aa, Heterodera glycines
  Coding regions on vcDNA: vcDNA=SeqID_87029; Strand=+; Position=1-219
TRNGEKCQKGTMDQLEYNAGGIGTVATENETKVVASADTQRGTPLRAISMIMPAIVAILNHLHRTLPNMKDL

SEQ ID NO: 160607 - protein, 84 aa, Heterodera glycines
  Coding regions on vcDNA: vcDNA=SeqID_87030; Strand=-; Position=3-254
HMMIGNIGINETKCTIQMINRINDNLISFFCCCAMMLIQCHIRGCRRRRSSRSGRLGVSRRIRRRCRNGRLGLVAASVSSRRSG

SEQ ID NO: 160608 - protein, 144 aa, Heterodera glycines; identical to SEQ ID NO: 154942
  Homolog annotation: Hit_ID=AAP30767.1; Match level="QueryCoverage =100%, HitCoverage=100%, E-value=3e-77, Identity=97%"; Hit description=putative gland protein G21E12 [Heterodera glycines]
  Gene Ontology: Mol. function=structural constituent of cytoskeleton
  Coding regions on vcDNA: vcDNA=SeqID_87031; Strand=+; Position=66-500

SEQ ID NO: 160609 - protein, 139 aa, Heterodera glycines
  misc_feature (45)..(45): Xaa can be any naturally occurring amino acid
  misc_feature (50)..(50): Xaa can be any naturally occurring amino acid
  misc_feature (57)..(57): Xaa can be any naturally occurring amino acid
  misc_feature (72)..(73): Xaa can be any naturally occurring amino acid
  Homolog annotation: Hit_ID=CAE72870.1; Match level="QueryCoverage =71%, HitCoverage=16%, E-value=2e-13, Identity=42%"; Hit description =Hypothetical protein CBG20172 [Caenorhabditis briggsae]
  Gene Ontology: Cellular component=mitochondrion
  Coding regions on vcDNA: vcDNA=SeqID_87032; Strand=+; Position=2-419
TKRTMRRRVNEVIDEFRLEECRPELVGFSGVEKSIKGGETRPSLXASEWXNNPQIKXAPPPTTGLFFSMADXXISVMRALALSGRTLTRTIVQPPLDIYWMAGNNARLTRDELFRAVERLRESILLMDTERARFRRSNG

SEQ ID NO: 160610 - protein, 205 aa, Heterodera glycines
  misc_feature (188)..(188): Xaa can be any naturally occurring amino acid
  Homolog annotation: Hit_ID=NP_499324.1; Match level="QueryCoverage =100%, HitCoverage=51%, E-value=1e-76, Identity=67%"; Hit description= 4-HydroxyPhenylpyruvate Dioxygenase (44.4 kD) (hpd-1) [Caenorhabditis elegans] emb|CAA90315.1| Hypotheti
  Gene Ontology: Biological process=tyrosine catabolism
  Coding regions on vcDNA: vcDNA=SeqID_87033; Strand=+; Position=2-616
IRRASIRTYGDTIHSLIERHHYSGPFLPGFCLVAASSVPRFLLGQLPSVGLNFIDHCVGNQPELQMESVAQWYERVLLFHRFWSVDDSVIHTDYSALRSIVMSNREETVKMPINEPAKSRKAVSQIQEYVDYYGGAGVQHIALNTSDIVHAIQSLRARGLEFLSIPDSYYASLKQRLSDAGVELKEDXEKLRELKILVDFDEQGY

SEQ ID NO: 160611 - protein, 172 aa, Heterodera glycines
  Homolog annotation: Hit_ID=CAE57975.1; Match level="QueryCoverage =94%, HitCoverage=57%, E-value=2e-23, Identity=38%"; Hit description =Hypothetical protein CBG01036 [Caenorhabditis briggsae]
  Coding regions on vcDNA: vcDNA=SeqID_87034; Strand=+; Position=74-589
MVVPLQSILPAIISVAYYLFVFFFAEVSRKLVDLSLKKFLLVHLFLIELIATAQMCTCVYENAIIIKHYGPSGFFLVVTFLQIAGAFFNRGAFVSPLAPIELFLRGKMDTEKFLAILLSQTLGGYSAFRLANSLWYYSQSYSTDHHQFYDSLPCALSYKVPFYCALLFELFG

SEQ ID NO: 160612 - protein, 80 aa, Heterodera glycines
  Coding regions on vcDNA: vcDNA=SeqID_87035; Strand=-; Position=2-241
CEMKWVTVMDIQHLKMERTARTFEQQNLDQLPSLNQSHLYFFRFNDDGGHDFANDEKVCDRESGSENDDAFERRTARTAT

SEQ ID NO: 160613 - protein, 182 aa, Heterodera glycines
  Homolog annotation: Hit_ID=CAG04326.1; Match level="QueryCoverage =92%, HitCoverage=12%, E-value=4e-41, Identity=48%"; Hit description =unnamed protein product [Tetraodon nigroviridis]
  Gene Ontology: Mol. function=cysteine-type endopeptidase activity; Cellular component=intracellular; Biological process=proteolysis and peptidolysis
  Coding regions on vcDNA: vcDNA=SeqID_87036; Strand=+; Position=23-593
MSSAKSTPDFCGWEEKPLWVSLIEKALAKAYGNYAILRAGRTVEGLSTLTGQPTLSIDLEYLDMDQQSRTADLDIAWAKLISAREARFLMGCSCGAGKRTMEEAEFQRVGLSPQHAYSLLDVRQTNDGHRLVLLRNPWGENFVWRGEFSSEWLGWTHQLRRELAADAVFGPGTFWMPFEQFV

SEQ ID NO: 160614 - protein, 197 aa, Heterodera glycines
  Homolog annotation: Hit_ID=NP_504313.1; Match level="QueryCoverage =91%, HitCoverage=43%, E-value=3e-11, Identity=26%"; Hit description =predicted CDS, UDP-glucoronosyl/UDP-glucosyl transferase family member (5F376) [Caenorhabditis elegans] g
  Coding regions on vcDNA: vcDNA=SeqID_87037; Strand=+; Position=56-646
GPFQEQCISYSGKIVRRCKSFVRNTTPLLDYDIGSLPKRVKFIGGIDLMQPDHKDALPQVFGQPKPVIVFSMSSLLEPSKMPLDKFKTVIQGLGMCEKEVIWKYAKQEDHGRMSLLQKHAPNVHLVEHYDQATVIGNKKTELVISECDIRIVMDALSSGKALLCLPMFAEQFYVSEKLRRMGAAVVLDPRSGSFTPE

SEQ ID NO: 160615 - protein, 143 aa, Heterodera glycines
  Homolog annotation: Hit_ID=NP_501793.1; Match level="QueryCoverage =92%, HitCoverage=24%, E-value=6e-26, Identity=43%"; Hit description =SH2 motif and protein kinase family member (kin-5) [Caenorhabditis elegans] emb|CAA93289.1| Hypothetical
  Gene Ontology: Mol. function=protein binding; Cellular component =soluble fraction; Biological process=regulation of cell cycle
  Coding regions on vcDNA: vcDNA=SeqID_87038; Strand=+; Position=29-460
PHPLQGIIHCDIAARNCLYSNGVVKISDFGMAHRGPVNKMEPNARVPVKWLSPDALAERCFTAKSDTWAYGVMCWEIFTNGEVPYSQMAGSDVAVSLINGQRLDFPRDAPSKFVEFILQHIWDAETSGRYSMAAVHDWLKRHT

SEQ ID NO: 160616 - protein, 198 aa, Heterodera glycines
  misc_feature (181)..(181): Xaa can be any naturally occurring amino acid
  Homolog annotation: Hit_ID=CAE64198.1; Match level="QueryCoverage =98%, HitCoverage=29%, E-value=1e-94, Identity=87%"; Hit description =Hypothetical protein CBG08827 [Caenorhabditis briggsae]
  Gene Ontology: Mol. function=enzyme regulator activity; Cellular component=mitochondrial inner membrane; Biological process =mitochondrial translocation
  Coding regions on vcDNA: vcDNA=SeqID_87039; Strand=+; Position=1-593
RHERLVGAPARRQAVTNSENTLYATKRLIGRRFDDPEVQKDIKVVPYKIVKASNGDAWLEAQGKLYSPSQIGAFVLMKMKETAESFLGTSVANSVVTVPAYFNDSQRQATKDAGKIAGLHVLRVINEPTAAALAYGLDKAEDKVIAVYDLGGGTFDISILEIQKGVFEVKSTNGDTFLGGXDFDNVLVHHLVAEFKRE

SEQ ID NO: 160617 - protein, 203 aa, Heterodera glycines
  misc_feature (170)..(170): Xaa can be any naturally occurring amino acid
  Homolog annotation: Hit_ID=AAN14978.1; Match level="QueryCoverage =100%, HitCoverage=57%, E-value=1e-111, Identity=99%"; Hit description=chitinase [Heterodera glycines]
  Gene Ontology: Mol. function=extracellular matrix structural constituent; Cellular component=extracellular matrix; Biological process=response to bacteria
  Coding regions on vcDNA: vcDNA=SeqID_87040; Strand=+; Position=1-609
LLFFVLFFNAAINFVSSHRIVGYYQGIRPLTNDQAKKLTHLILAFSTPDSQGNLSPLSSVLKQALKAGKSANGALKVMIAIGGGGLDPAIFTSLASNSGTRKSFINNIVSYLKTNELDGCDIDWEFPTSSDKAIFVTFLRDLKKAMAPSGAVLSMASAASAFYLDPGYDXPGIESAVDFINVMCYDYYGSWTKTSTGPNSPLF

SEQ ID NO: 160618 - protein, 182 aa, Heterodera glycines
  misc_feature (43)..(43): Xaa can be any naturally occurring amino acid
  Homolog annotation: Hit_ID=EAL28756.1; Match level="QueryCoverage =94%, HitCoverage=48%, E-value=1e-15, Identity=30%"; Hit description =GA13144-PA [Drosophila pseudoobscura]
  Coding regions on vcDNA: vcDNA=SeqID_87041; Strand=+; Position=1-545
SLLLSVFFSLLLILPSDALHLAGFTIPKIFVNFLGDERLQFVXFHLRRTLLTAFIHSAFFFLCFVGLGLSIDQPVFSHSPNNFIQWLSLFSLLIVAASIAILSFCRSNNYERHPLVHTLRNLSDARNWQTLAREIDDEVRAPLLFTILYKDCSRVLVTRLWLIKVTNYAIQLAPISDSQFLV

SEQ ID NO: 160619 - protein, 160 aa, Heterodera glycines
  misc_feature (56)..(56): Xaa can be any naturally occurring amino acid
  Homolog annotation: Hit_ID=AAS54525.1; Match level="QueryCoverage =56%, HitCoverage=23%, E-value=9e-11, Identity=39%"; Hit description =AGR036Wp [Ashbya gossypii ATCC 10895] ref|NP_986701.1| AGR036Wp [Eremothecium gossypii]
  Gene Ontology: Mol. function=tRNA methyltransferase activity; Cellular component=cytoplasm; Biological process=tRNA methylation
  Coding regions on vcDNA: vcDNA=SeqID_87042; Strand=+; Position=3-486
LRVAQRYFSSSRKQTEQYLERQANDQYSRRAREHSYRARSAFKLMQINDKMHFIRXVPIIIDSLRLTRVQVHFCYSFLLKLALCPSPGSWCQVLSELIFPNNFAPKKRTKADERTDECPFDGTEQRQGYILGVDLLVRPLLFLLSHFLRFISPLSDNKSN

SEQ ID NO: 160620 - protein, 82 aa, Heterodera glycines
  misc_feature (6)..(6): Xaa can be any naturally occurring amino acid
  Coding regions on vcDNA: vcDNA=SeqID_87043; Strand=-; Position=22-270
FFFFLXTEETFALKDNDVINNNHTLVIFTNKYTNLVVFTDKCFFYLFTIFPLLFSLLLGTLSPMPSSTLPSRSTIRSSVRYE

SEQ ID NO: 160621 - protein, 189 aa, Heterodera glycines
  Homolog annotation: Hit_ID=AAP06023.1; Match level="QueryCoverage =73%, HitCoverage=80%, E-value=3e-09, Identity=28%"; Hit description =similar to NM_003197 transcription elongation factor B polypeptide 1- like [Schistosoma japonicum]
  Coding regions on vcDNA: vcDNA=SeqID_87044; Strand=+; Position=10-576
MSNNENENVMNGEAVGGVEIKVEANEEVNTESQEDGEEAIIPQFSKEQMERSVMCCLYEGEIVNAPWHLMAQSKTFMQMWESLDMEEKTQEDFTDFVFPLNDITSDCFQQILAWMREHHNLPEPIVKEDPVTQERIWFKFTDWERQFFDVDFERVKEYFLASNFLDIRSLYLYCAQECARCIMDKSAED

SEQ ID NO: 160622 - protein, 98 aa, Heterodera glycines
  Coding regions on vcDNA: vcDNA=SeqID_87045; Strand=+; Position=42-338
MTTPANAARARSAKAKLRDAKRRMVAVGRAGYTRKAQRGDRLAICMTNVSAITRTTLGCTHPFHRRCLYRWIRYHTNCPVCRYNFARTIPRGERNQPL

SEQ ID NO: 160623 - protein, 101 aa, Heterodera glycines
  Coding regions on vcDNA: vcDNA=SeqID_87046; Strand=+; Position=126-431
KKYRFPFFQKFNGEGKELPNWANESVIERIWQLNDLSSNYLYKTTKLVRFRAGVLFTEILQRMKNVQQQQRSAAAGGGGDNNNYDGRQRVQAYSAHDTTRE

SEQ ID NO: 160624 - protein, 201 aa, Heterodera glycines
  misc_feature (101)..(102): Xaa can be any naturally occurring amino acid
  Homolog annotation: Hit_ID=NP_498090.1; Match level="QueryCoverage =100%, HitCoverage=62%, E-value=1e-51, Identity=53%"; Hit description= protein conserved like (3G242) [Caenorhabditis elegans] gb|AAF60781.1| Hypothetical protein Y54H5A.3 [Ca
  Gene Ontology: Mol. function=DNA binding; Cellular component =cytoplasm; Biological process=nucleobase, nucleoside, nucleotide and nucleic acid metabolism
  Coding regions on vcDNA: vcDNA=SeqID_87047; Strand=+; Position=94-694
MMLPPAGSSVVIESGPTLYVQPPATLFSNNGKADMPMSFSSSSTSTLHSQPFKTLALPSDVELLAAKKQATKAHENSYLGAVPRGEKKMKRFVRSCGGQVXXEDSSMAEWDPNDFRIFCGDLGNEVSDELLAKAFRKYPSFQKAKVVRDSRTNKSKGFGFVSFKHQDDFIRAMKEMDGKYVGNRPIKLRKSNWKERNLDIV

SEQ ID NO: 160625 - protein, 158 aa, Heterodera glycines
  Coding regions on vcDNA: vcDNA=SeqID_87048; Strand=+; Position=23-499
NFVECLRQKDNHNLTNTLVNKEKASIVQESSFVTPGIFRRRKMLTGRQLNDEGNIEAKEKSADFKWSIDQIAKIQPIEFDETEEFSLPPENWDPCAKFKTPQFENIDHFWTHNSLIAPSPGLFATASALRRVQPSANSPTTSPFQLALSPFGSGPSCS

SEQ ID NO: 160626 - protein, 199 aa, Heterodera glycines
  Homolog annotation: Hit_ID=CAE56905.1; Match level="QueryCoverage =98%, HitCoverage=50%, E-value=3e-63, Identity=56%"; Hit description =Hypothetical protein CBG24746 [Caenorhabditis briggsae]
  Gene Ontology: Biological process=sulfur amino acid metabolism
  Coding regions on vcDNA: vcDNA=SeqID_87049; Strand=+; Position=2-598
PNFTLGLAAIAAVSHLLNSGQHVIVSGDCNGGTKNYFDKICVPHHGLELSFVDLTRLENLENEFKPNTKMVLFETPSNPLLKIVDIEAVCRMVRARSKDCVVVVDNTFMTPYFQRPLELGADVTVQSLTKYINGHTDVLMGTVVTNKEQLDQHIYAQQIYAGAVPSAFDAFLVLRGIKTLPLRMRQHMENALAIGRWLE

SEQ ID NO: 160627 - protein, 112 aa, Heterodera glycines
  Homolog annotation: Hit_ID=S25548; Match level="QueryCoverage=100%, HitCoverage=68%, E-value=1e-19, Identity=40%"; Hit description =surface-associated glycoprotein gp15/400 - nematode (Brugia pahangi) (fragment)
  Coding regions on vcDNA: vcDNA=SeqID_87050; Strand=+; Position=19-354
KRQEAGRFAMSCRRIFAMIERRRRSADNAEHSLDQLFKSHLIWLNEQQLYELKQMKGSGKGRTEMQQRVMEWYGQLEGQDKQKAREHPRDGCRDILAQVLGKEKADQLKQLR

SEQ ID NO: 160628 - protein, 142 aa, Heterodera glycines
  misc_feature (16)..(16): Xaa can be any naturally occurring amino acid
  misc_feature (57)..(57): Xaa can be any naturally occurring amino acid
  Homolog annotation: Hit_ID=CAE66017.1; Match level="QueryCoverage =98%, HitCoverage=15%, E-value=5e-33, Identity=46%"; Hit description =Hypothetical protein CBG11210 [Caenorhabditis briggsae]
  Gene Ontology: Mol. function=transcription co-activator activity; Cellular component=nucleus; Biological process=transcription from Pol II promoter
  Coding regions on vcDNA: vcDNA=SeqID_87051; Strand=+; Position=3-427
ERKREVAEELGEHLIXRNREHERHKIYEHEQNFKALLVDSIFSTDLSWHDGRKLMRXSSRYQNCDLLEKDVKERLFKEPVRELERKRRDVFFQLSDEHQDITFTTRWHSAQKIIAEDERLGKSKMDDQKLEQDYREWMDRRR

SEQ ID NO: 160629 - protein, 197 aa, Heterodera glycines
  Coding regions on vcDNA: vcDNA=SeqID_87052; Strand=+; Position=1-594
PASARHCSEFRPFILNRRAVPCRPSLHLPYRMPNNNNDSTPKTAFSLRPTRTHCQQPMYIHNPFSCPPPPRHRSNLSKFDPSKVPPQFPAFGNPPSPEGMTLTGRMPRQKTKFHRQCAQFSPFWKCFLASSHCSWVRSCPNALSLSKFARPIRRCAQCESVQLSHPTQRAHLFDPFRHPFDHQWSGTPFPKPFCFSD

SEQ ID NO: 160630 - protein, 112 aa, Heterodera glycines
  misc_feature (9)..(9): Xaa can be any naturally occurring amino acid
  Homolog annotation: Hit_ID=XP_419481.1; Match level="QueryCoverage =91%, HitCoverage=57%, E-value=3e-32, Identity=61%"; Hit description =PREDICTED: similar to glyoxylase 1; glyoxalase 1 [Gallus gallus]
  Gene Ontology: Mol. function=lactoylglutathione lyase activity; Biological process=carbohydrate metabolism
  Coding regions on vcDNA: vcDNA=SeqID_87053; Strand=+; Position=3-338
FPSTVTCSXMRLLKQLDFPEGKFSLFFMGYKDLDEIPSDDAAQKKFALSTHSTIELTHNWEHGTDFKGYHNGNSEPRGFGHIGIAVPDVDSACARFEQLGVKFVEKPNDGRM

SEQ ID NO: 160631 - protein, 223 aa, Heterodera glycines
  Homolog annotation: Hit_ID=CAE73354.1; Match level="QueryCoverage =93%, HitCoverage=31%, E-value=5e-35, Identity=39%"; Hit description =Hypothetical protein CBG20786 [Caenorhabditis briggsae]
  Gene Ontology: Mol. function=DNA topoisomerase activity; Cellular component=nucleus; Biological process=electron transport
  Coding regions on vcDNA: vcDNA=SeqID_87054; Strand=+; Position=2-670
LDKMKKCTAATLSDVLANLHSVKKPEALRTVEMLKMASIRLGMSPARTMAVAEKLYTRGNTSYPRTETSAYHDEFEFERVLSALERSPTFARIVRQIRSDGKLLPENGTNKGDHPPITPLRSFCLDGGAKNQLKSAVNRKNEVDKWLYEDAHALYEQIAYHFLATLMRPCKYMLKSVIFDIGGEQFLCQSRKVEDAGFTEVLSWLAVPESNTNAMDALSKLSI

SEQ ID NO: 160632 - protein, 160 aa, Heterodera glycines
  Homolog annotation: Hit_ID=E86336; Match level="QueryCoverage=81%, HitCoverage=37%, E-value=3e-23, Identity=47%"; Hit description =hypothetical protein F14O10.11 - Arabidopsis thaliana gb|AAF88160.1| Contains weak similarity to an unknown pr
  Gene Ontology: Mol. function=protein binding; Cellular component =axoneme; Biological process=eye photoreceptor cell development
  Coding regions on vcDNA: vcDNA=SeqID_87055; Strand=+; Position=21-500
MDNRLRFAQEIKDSIRDCYPQLFIDAPIPTKEDIEKLRDSLNLSDQVLVCDKDEEVDDGEHEEDGEEAAMDKDNANEDEEEDGEEDGEDEEEKEEEDVEKEEEEEEEETEQQSTANDEEEAEEVIGEGEEDEEEEETEQAAEKMEARKYPEEEEDEDEFS

SEQ ID NO: 160633 - protein, 214 aa, Heterodera glycines
  Coding regions on vcDNA: vcDNA=SeqID_87056; Strand=+; Position=4-645
MTILDQQEEEVIVGSDDSHMIVSNIPHRAHNVCGVLNKHTIFVAPADDSLKRDFGIYYLFNINDPQTKYFAWFVRPDAPKKSAIETFLAHYEVIKNAEGDVHIPSLMAARPIKKFHFGMDIIQQSEHDADWRRPVMILKMPAHCVFLVAVRTLSPTASAPSWLALAVGYGLVNALNSLHEKGFIHRFVTPWNFMVPMPFTMDNITKKMIIMDLS

SEQ ID NO: 160634 - protein, 184 aa, Heterodera glycines
  Homolog annotation: Hit_ID=NP_504369.1; Match level="QueryCoverage =74%, HitCoverage=26%, E-value=4e-17, Identity=37%"; Hit description =udp-glucuronosyltransferase 1A5 family member (5F584) [Caenorhabditis elegans] gb|AAF98598.1| Hypothetica
  Coding regions on vcDNA: vcDNA=SeqID_87057; Strand=+; Position=76-627
MSAKSRTLWHMQRHRAGLFRTIPSEQRANKGKSVPLCPLSSSDSNDVFSPDRFVHRIYALLDIIQEAVAVNIFALHFLMPNIAKFGVPNFSFTEFYSRSQLFLHDSIDRLGLPVTTAADIFGVGAHCKTPKDSSALSAKIKQFLEDPSSKGTIYIAFGSHIDWKFAPRKFLDDFVTVFRKLPQY

SEQ ID NO: 160635 - protein, 48 aa, Heterodera glycines
  Coding regions on vcDNA: vcDNA=SeqID_87058; Strand=-; Position=1-144
PRQGISSSRTIIAMSDPNHGRFSPVDRPLSGKNKRADFASVARVQPRT

SEQ ID NO: 160636 - protein, 88 aa, Heterodera glycines
  Coding regions on vcDNA: vcDNA=SeqID_87059; Strand=+; Position=49-315
RGCAWHCLWYSMSSVLRHLARVILYSSWAPLVGPRPSRAPSVRVSGGSPWPPSGGLVSWMTVSIANSTSRTMPGAMTGVSRRLSSLSP

SEQ ID NO: 160637 - protein, 163 aa, Heterodera glycines
  Homolog annotation: Hit_ID=CAG02019.1; Match level="QueryCoverage =97%, HitCoverage=25%, E-value=1e-12, Identity=31%"; Hit description =unnamed protein product [Tetraodon nigroviridis]
  Coding regions on vcDNA: vcDNA=SeqID_87060; Strand=+; Position=1-489
HGSLPLQLIILFVLTLQISTQSPEISVPSDVQILSAVRNVDLTTQIVKVKTDFELKNGRNEELSSFVHAVSAEEAARLSWMSAYESGKESGKLRISRVRVKGVSSDMVFHKIEFLDLLMSGSNIKLSVDYALTEYLVPSPKDILQSENQLVIFSGTANVLSAY

SEQ ID NO: 160638 - protein, 133 aa, Heterodera glycines
  misc_feature (11)..(11): Xaa can be any naturally occurring amino acid
  misc_feature (30)..(30): Xaa can be any naturally occurring amino acid
  Homolog annotation: Hit_ID=CAE59477.1; Match level="QueryCoverage =100%, HitCoverage=32%, E-value=6e-50, Identity=70%"; Hit description= Hypothetical protein CBG02861 [Caenorhabditis briggsae]
  Gene Ontology: Mol. function=transcription factor activity; Cellular component=mitochondrion; Biological process=regulation of transcription, DNA-dependent
  Coding regions on vcDNA: vcDNA=SeqID_87061; Strand=+; Position=1-399
LGAFGLTEPDXGSNPAGMETKAEWDERNSXRLSGSKSWISNSSAADLFIVWARSPKLGHAVKGFIFERGAKGLSTPKIEGKLSLRTSITGQIVMDEVPVPEANLLPGAQGLSGPFGCLNSARLGISRGALGAA

SEQ ID NO: 160639 - protein, 150 aa, Heterodera glycines
  Coding regions on vcDNA: vcDNA=SeqID_87062; Strand=+; Position=105-557
MIIEKFPSYRHPGLLQRLNELKRIYTVYNGGVFILFTIPYRYYEDYASITVNQAVNDINAMDKTGVLQNLKIAYIECNVGYWHEWDTTKKEPKSIFKTDETLGLRQLPTLLEYSLTQGRHVEGRRVDLDEQFLSVEYVINFFLKRQLNLF

SEQ ID NO: 160640 - protein, 64 aa, Heterodera glycines
  Coding regions on vcDNA: vcDNA=SeqID_87063; Strand=+; Position=93-284
MLRPHHELAISLSGCGFLCSYHIGAMICFQKHANSLLSRVNFYCGASAGALIASLLVLSPHSLE

SEQ ID NO: 160641 - protein, 117 aa, Heterodera glycines
  misc_feature (57)..(57): Xaa can be any naturally occurring amino acid
  misc_feature (63)..(64): Xaa can be any naturally occurring amino acid
  misc_feature (96)..(96): Xaa can be any naturally occurring amino acid
  Coding regions on vcDNA: vcDNA=SeqID_87064; Strand=-; Position=3-353
HHRQPSVQCIASGCKSRRRPASRALLLVAPLASAVPAGRTASACTCHHRWGPRSKWXQQKQCXXLREGVFVPIGDGCGLNDSRRSGFESIEGGTIXVTVFFFSMKGKREKEGAALMA

SEQ ID NO: 160642 - protein, 148 aa, Heterodera glycines
  Coding regions on vcDNA: vcDNA=SeqID_87065; Strand=+; Position=161-604
SELVLTIGTDHIKPKEDAANTSVKSKAVIIDLGDPKENNVNDRKKTTTDDKAPKVMPFAQTEKSLHKINDQIDQRIKPREENRDHIKQSRANTEHPLPGQRIKPTKFRKPFDPLSTVADTLERTMLGDDDRDQRQEKSRFETGVGNVN

SEQ ID NO: 160643 - protein, 121 aa, Heterodera glycines
  Coding regions on vcDNA: vcDNA=SeqID_87066; Strand=+; Position=201-563
GMDAFTGTTSGVLKGLCFSNSSFLNYRTAQLSSSADFSICSVSDEQNQPTKALPSAVTAMSFSGADQMEVLVGRENGRVDHFNSLTDQFNALFALPQPSELKGIHRIDGDRILTAEECGTL

SEQ ID NO: 160644 - protein, 104 aa, Heterodera glycines
  Coding regions on vcDNA: vcDNA=SeqID_87067; Strand=-; Position=2-313
FVRLLHHHLVNVLGPVVLGRVFSVLLFKVRECVIGLEQERTAQVFGQNKAFLAPAKLLSPPHFHPDTFPDFLLPFLFHCFQFAHVVPLFFGISVLTWLISSSFV

SEQ ID NO: 160645 - protein, 183 aa, Heterodera glycines
  Homolog annotation: Hit_ID=CAE57201.1; Match level="QueryCoverage =98%, HitCoverage=20%, E-value=1e-47, Identity=55%"; Hit description =Hypothetical protein CBG00051 [Caenorhabditis briggsae]
  Gene Ontology: Mol. function=co-chaperone activity; Cellular component=cytoplasm; Biological process=response to stress
  Coding regions on vcDNA: vcDNA=SeqID_87068; Strand=+; Position=1-549
QIADLNLLQLLGSGTAAGLNYGVFRHKEITEKPQTLLIYDVGSTKTLVTIVQFLLVNDSNEGGSSYPQVETIGVGYDRALGGHHLTLRLRDHLVKEFKKQNASLNADISANPQAMAKLLKEADRVKQVLSANAEAFAQVECVFEDRDFRVKVTRDELEAMFRDFEQRHMEPINVALTMAQLTL

SEQ ID NO: 160646 - protein, 74 aa, Heterodera glycines
  Coding regions on vcDNA: vcDNA=SeqID_87069; Strand=+; Position=2-226
TTAISFAITAFSELVGKVLRFIRAGFDTHYFLDLWPYSLALISIWLYPIVYRSLNLFNKMMNTKTVDRMDRMPK

SEQ ID NO: 160647 - protein, 201 aa, Heterodera glycines
  Homolog annotation: Hit_ID=AAM50038.1; Match level="QueryCoverage =100%, HitCoverage=85%, E-value=1e-109, Identity=100%"; Hit description=putative gland protein G27D09 [Heterodera glycines]
  Coding regions on vcDNA: vcDNA=SeqID_87070; Strand=+; Position=20-622
MVCLVMAVLMEMANSKAVKKDNKKGAVAASPAKGKSSPKGGKSPAKGKAAKKLKPKKDAKGIKAKKAKPAKKSKAAKAVKGAPKTVKKLAIAKTAAQVKEIKSPAKPMVLKAVPPHQMHLMNEKVQTAVSPPAHARSLATVPYSTPMAADRNSLPSYTSDGTNLDMAHENDDYQNYYYGTEDSSREFDASAEEEDELYEEG

SEQ ID NO: 160648 - protein, 149 aa, Heterodera glycines
  Homolog annotation: Hit_ID=AAT85577.1; Match level="QueryCoverage =75%, HitCoverage=21%, E-value=9e-20, Identity=49%"; Hit description =U2 small nuclear ribonucleoprotein auxiliary factor large subunit [Alvinella pompejana]
  Gene Ontology: Mol. function=DNA binding; Cellular component=nucleus; Biological process=mRNA processing
  Coding regions on vcDNA: vcDNA=SeqID_87071; Strand=+; Position=6-455
MDDESHQANMERLREDEDEKIGLMDIKREIKAELNEAIGRQTEDGETEPKAERDRSMKSDRDMERKKKSKRTSRDRSRSKSRERKRSRERRRSRSRSKERHRERERSREKERGEKRSKVKSNKYWDVPPAGYEHMSPKEYKELQVVVVH

SEQ ID NO: 160649 - protein, 84 aa, Heterodera glycines
  Coding regions on vcDNA: vcDNA=SeqID_87072; Strand=+; Position=1-252
KHFDGQNGKLIGNDIYESLESLVSFISKNGFGLINDERRTKFVQAIQEIEQIVKKWNFFRKLLSWVPTNWAHSPNNQTSMPFVL

SEQ ID NO: 160650 - protein, 120 aa, Heterodera glycines
  Coding regions on vcDNA: vcDNA=SeqID_87073; Strand=+; Position=1-360
SSNEETQHQKRASGETEKKRGTGGEGTEGEAGGDNFQATRDGLEQQRRVDQQHIGANVLLFRWDGYCQQWHQGQCETNRSNTCKCWLWPARLRSATRRRRLPFATRSTTRKRSRWKWHTT

SEQ ID NO: 160651 - protein, 61 aa, Heterodera glycines
  misc_feature (25)..(25): Xaa can be any naturally occurring amino acid
  misc_feature (28)..(28): Xaa can be any naturally occurring amino acid
  Coding regions on vcDNA: vcDNA=SeqID_87074; Strand=+; Position=2-184
PSPFSFSLLKMTSPIAYDQLREMTXQFXSQKASVPWKQMPFSRENLAPKILRLFARFTNGE

SEQ ID NO: 160652 - protein, 211 aa, Heterodera glycines
  Coding regions on vcDNA: vcDNA=SeqID_87075; Strand=+; Position=4-636
MTILDQQEEEVIVGSDGSHMIVSNIPHRAHNVCGVLNKHTIIVAPADDSLKRDFGIYELFNINDPQTKYFAWFVRPDAPKKSAIETFLAHYEVIKNAEGDVHIPSLMAARPIKKFHFGMDIIQQSEHDADWRRPVMILKMPAHCVFLVAVRTLSPTASAPSWLALAVGYGLVNALNSLHEKGFIHRFVTPWNFMVLMPFTMDNITKKMIIM

SEQ ID NO: 160653 - protein, 101 aa, Heterodera glycines
  Coding regions on vcDNA: vcDNA=SeqID_87076; Strand=-; Position=240-545
PPFSTFGLLFHRKINVGCVAVGRPSHFVIFSEETARVALSTDISRMCKIHRGESFPMLDFFFSILVHQRNNYRRARKSLSALPLGKMMNSPRGSVPILLGI

SEQ ID NO: 160654 - protein, 135 aa, Heterodera glycines
  misc_feature (20)..(20): Xaa can be any naturally occurring amino acid
  Homolog annotation: Hit_ID=NP_496721.1; Match level="QueryCoverage =93%, HitCoverage=17%, E-value=1e-43, Identity=67%"; Hit description =carnitine palmitoyltransferase 1A (84.1 kD) (2N80) [Caenorhabditis elegans]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_87077; Strand=+; Position=1-408
HLTRDAMCGKGVDRHLFALXVVMRHLEESSPFFDKIFPPQYFFSTSQTPLNQFDSEQDGSSMAQKFFLVSAGGGFGPVTDAGYGVSYIVAGEDQISFHISSKKSATNTSSIRFREDLKKTLLEMKQLLTVEQRMT

SEQ ID NO: 160655 - protein, 170 aa, Heterodera glycines
  Homolog annotation: Hit_ID=CAE59495.1; Match level="QueryCoverage =85%, HitCoverage=39%, E-value=7e-26, Identity=41%"; Hit description =Hypothetical protein CBG02880 [Caenorhabditis briggsae]
  Gene Ontology: Mol. function=protein serine/threonine kinase activity; Cellular component=kinetochore microtubule; Biological process=protein amino acid phosphorylation
  Coding regions on vcDNA: vcDNA=SeqID_87078; Strand=+; Position=45-554
MLQAHQYQLRQGHRRVSARSILAHFGFEFSNDYRLGCGHYSKVYKGYFKEAQRTFAIKVTDLESVSEKFKQKFLPRELEVWRELDHPNLVYLYKDFQWNNYQFAVMELVVGGDLLSFLQKCGHVSETTCHNWMLQIVAALDYLHRKGIAHRDLKLENVLLCENGVIKVTD

SEQ ID NO: 160656 - protein, 84 aa, Heterodera glycines
  Coding regions on vcDNA: vcDNA=SeqID_87079; Strand=+; Position=225-476
PGRTFIWLDVPFCFLSIVILNPFVLSFLPYLLQHLHLHSFINVILNLFNNYFQLMIIYGVDSFCVCHCLSVILSENTNKSRCRP

SEQ ID NO: 160657 - protein, 120 aa, Heterodera glycines
  Coding regions on vcDNA: vcDNA=SeqID_87080; Strand=+; Position=29-388
FGPLFVPMKNQNADIEHSVHSLRIGPKPFQKLFIARVLCRDSQFLRNLFFQHSRSLQKAIQHFAICEASAPFLCRPQSSMALRIRCAARNYRIKWPYLGQRFRNGRQRSIHCEHATATFV

SEQ ID NO: 160658 - protein, 134 aa, Heterodera glycines
  misc_feature (66)..(66): Xaa can be any naturally occurring amino acid
  Homolog annotation: Hit_ID=AAP30775.1; Match level="QueryCoverage =100%, HitCoverage=69%, E-value=2e-60, Identity=88%"; Hit description= putative gland protein G32E03 [Heterodera glycines]
  Coding regions on vcDNA: vcDNA=SeqID_87081; Strand=+; Position=39-440
MRAILFLAMVCLVMAVILETANSKAVKNKKGTVATPAKGKAAPKGAAKGGIKKDAKSKGKGKKDAXGKKDIKANPSKGKGVPKNDKKSPAAKANDKKSPFKPMAAVKAVPKAAENAQKGPSSAEVVAEENNLDT

SEQ ID NO: 160659 - protein, 161 aa, Heterodera glycines
  Homolog annotation: Hit_ID=CAE68875.1; Match level="QueryCoverage =100%, HitCoverage=15%, E-value=3e-64, Identity=77%"; Hit description= Hypothetical protein CBG14838 [Caenorhabditis briggsae]
  Gene Ontology: Mol. function=electron transporter activity; Cellular component=mitochondrion; Biological process=energy pathways
  Coding regions on vcDNA: vcDNA=SeqID_87082; Strand=+; Position=2-484
AAVKTCLFLGAYIGGFTFTGSLMAYGKLQGLLGSAPTLLPAFYMLNFALLSANVAALGPYLTTDSLAMGLSMLGTTSLLSSLMGVTLTMAIGGADMPVVITALNSYSGWALCAEGLMLNNNLLTIVGALIGRSGALLSHIMCKAMNRTLFNVILGGVGTKS

SEQ ID NO: 160660 - protein, 227 aa, Heterodera glycines
  Coding regions on vcDNA: vcDNA=SeqID_87083; Strand=+; Position=2-682
FAYFEDARKLYETRMKNASNGNNEADCRIKNLEKELKVLKRQLSALGDLLDQFLDTSLAMRERTLLMEGELGRRLERLEAQNVQLRANLAAMGQQTHKNGDNEQRNEAEQTIETIHFDELSISDGVPLQQNVQQQPQPPNVSNCPVNDEGGDGDGIGDELAHFLAGLPPVDELGQLVLNKFKYSCEFAQLLYTGGGHVDSVFCNIFSGYPPTFFEELIEYALTTHRP

SEQ ID NO: 160661 - protein, 136 aa, Heterodera glycines
  misc_feature (6)..(6): Xaa can be any naturally occurring amino acid
  misc_feature (52)..(52): Xaa can be any naturally occurring amino acid
  Homolog annotation: Hit_ID=AAO33475.1; Match level="QueryCoverage =100%, HitCoverage=100%, E-value=5e-69, Identity=93%"; Hit description=gland-specific protein g5d08 [Heterodera glycines]
  Coding regions on vcDNA: vcDNA=SeqID_87084; Strand=+; Position=13-421
MFSSSXLFALFLASSVLAVLIIGIKMDGPTEAKCVAPPNAAGPMGLLLLPSXKQSAAFEKGKAPSGESKPKPGQKPSGERRKRDVLGHAGGYVGGWDHPIDSTLDWAKSQWNDANWLADVVNRNGWENTGTPTGGR

SEQ ID NO: 160662 - protein, 202 aa, Heterodera glycines
  Homolog annotation: Hit_ID=AAL78214.1; Match level="QueryCoverage =73%, HitCoverage=78%, E-value=4e-16, Identity=31%"; Hit description =putative esophageal gland cell protein Hgg-20 [Heterodera glycines]
  Coding regions on vcDNA: vcDNA=SeqID_87085; Strand=+; Position=40-645
MSSGLLWRAVLLLVDCASILWFFLDHAKKRRRPREKEIFICADCWLLVFDFLAPSQLGLEIALISRRFDLRVDEHFKTRKWMLNKQLLIQWKTVGNGPKQMQIDDADGNPLPIPRNPLPNKVIGFRRITIIYIDQNVIAFLRRFHCLFPICSIFLDITMVNDRILDYFLLHIWPMFRDSMRFMILNTNAFHRMRQWAPSSLS

SEQ ID NO: 160663 - protein, 199 aa, Heterodera glycines
  misc_feature (62)..(62): Xaa can be any naturally occurring amino acid
  misc_feature (92)..(92): Xaa can be any naturally occurring amino acid
  Homolog annotation: Hit_ID=CAE70051.1; Match level="QueryCoverage =76%, HitCoverage=6%, E-value=7e-51, Identity=64%"; Hit description =Hypothetical protein CBG16483 [Caenorhabditis briggsae]
  Gene Ontology: Cellular component=CCR4-NOT core complex; Biological process=reproduction
  Coding regions on vcDNA: vcDNA=SeqID_87086; Strand=+; Position=2-597
TAAGRAVLVLFVGLHQSPPNSNNGGGGFSSFTTTTTKYSIFVVNAVVMYVGVRAISLLLAKXHLFSLETIAHSPFMDIFQNLAVSLCNEGRXLLFNAIANQLRYPNSHTHYFSCTLLYLFLGANSKHIQEQITRILFERLVALRPHPWGLLITFIELIRLQRYGSWKHESVYCATEIERLFLSAANPCSASGPKVITQT

SEQ ID NO: 160664 - protein, 188 aa, Heterodera glycines
  Coding regions on vcDNA: vcDNA=SeqID_87087; Strand=+; Position=1-564
PSSASIIASLLFLFGCCRADGNVVPLSSLNCATKDGGIDGFNFVDDGLILDSSSVTAVPPDLPLICFQKNGKEDLIFKLFVRDGGCVSKANFFTNGQPCTLGESEDVTESDKCPGEGGTSNCTSHEVTCPGIGMAKVAEESNGHAFKVNLANLTKLTNPCAQWKAHFGGVHQVLKGSSSGEKCASAGF

SEQ ID NO: 160665 - protein, 130 aa, Heterodera glycines
  Coding regions on vcDNA: vcDNA=SeqID_87088; Strand=+; Position=2-391
TVGNPSSQPNKEMCRSDLACRPFVTASAASGSGKLSPKMSKAAAPRRLRTGRSVFLSSSPQPPTRPFVAECAASCGDLCGEEQQSVVIIAASDAISVSALPLIKPPPECLFSASSCAFSEWEKCAASEGA

SEQ ID NO: 160666 - protein, 138 aa, Heterodera glycines
  Coding regions on vcDNA: vcDNA=SeqID_87089; Strand=+; Position=126-539
HSNSRKTAMAYATKYYDYQIAVVFAILLGGLLLLALVVTAIYYICVVNMRGKKGGITRVPSGRSTVRTRMNPQQYSPSAQPQIFHQQYPQYSPYGGMEGMSSQQTQQQQQQQHPFQAQNYEQAGVRVREMQPEYFQQQ

SEQ ID NO: 160667 - protein, 137 aa, Heterodera glycines
  Coding regions on vcDNA: vcDNA=SeqID_87090; Strand=+; Position=1-411
IVVTIHRPSEGMCQKFERDRLLKLLERTQKDVQRLTTANQQLTTANQQLTTANQQLTTTNQQQQNTINHQQQNIQQLQNLLAGQQPLVPSFAPGVFAEQQQHHHAPADFLGDQHALGGQNPHAAPFGPDFFGGQPEN

SEQ ID NO: 160668 - protein, 135 aa, Heterodera glycines
  Coding regions on vcDNA: vcDNA=SeqID_87091; Strand=+; Position=1-408
QMLLPVPSVGTFARVPFVTLLRLQNVTNSGHFLLRRGCFGSESPHIRYNNELKPFTSLNECFLILWKDIEYLLGICADSDFCNVCNYWSELAAEKSAAVGIMRAGGENTLRGKKLLMGTAALLPLLALYFIDKII

SEQ ID NO: 160669 - protein, 184 aa, Heterodera glycines
  misc_feature (56)..(56): Xaa can be any naturally occurring amino acid
  Coding regions on vcDNA: vcDNA=SeqID_87092; Strand=-; Position=3-554
IVQRIQQLPHFQWRFFSVRFWSINQVCCSIWARQKVWCVNRLAFFCVHSFAVNRQXHDKCFRNHLFVSGLLSPRCDASAPRHSSFFIANAFDLLFKSLLFWLIRTFPFCVSLFIRFRKLAQISLKKEQSPQTLCSFPPLFRREISDFIPSSNSLAFHHFTPFLHFSDNRLRKCLHWTGFSVRFS

SEQ ID NO: 160670 - protein, 138 aa, Heterodera glycines
  misc_feature (55)..(55): Xaa can be any naturally occurring amino acid
  Homolog annotation: Hit_ID=AAO33474.1; Match level="QueryCoverage =100%, HitCoverage=100%, E-value=6e-69, Identity=94%"; Hit description=gland-specific protein g4g12 [Heterodera glycines]
  Coding regions on vcDNA: vcDNA=SeqID_87093; Strand=+; Position=11-426
MPNIFKILLIVLFSVVSFRLSASTGDKKTANDGSGNNSSSGIGTKIKRIVTAGLXLPSLATGVAEAIGRSNAQGGNAAGLVPSHVTNRSMAPPPPPVQFEMGANRLEKMRAHLRELAEKMPVNESKRLSPSGPDPHHH

SEQ ID NO: 160671 - protein, 221 aa, Heterodera glycines
  Coding regions on vcDNA: vcDNA=SeqID_87094; Strand=+; Position=2-664
VMTDACACGLTEKHSKVRLHLPLELQCELLSALPFEHAARLLLLSKAIAKNCNSLVQKQTKGWNAFSEKCVDKLMKFFHPFVLPRLESIETEHHSFVHSAAHQEEKLLKEEIRLSRAQLSPLVGANLVRRLEKCGTAGEAMTELLNSVVKMYHIIEMYKKRRKELDERFNEVKRMADAIKPDFVPRDIPPRICPTATVWSAERLRLDYTEHLHSLRVRLRQ

SEQ ID NO: 160672 - protein, 132 aa, Heterodera glycines
  Coding regions on vcDNA: vcDNA=SeqID_87095; Strand=+; Position=1-399
PPLPSSAAVVLFRPVRRALPQSSMASAGWLPPGATVGCGGPPQQQQQQTISMMMMHQQQQNGIMVNGNGTVVGIGHLQQQQQYHQFIAANPGMVGATSLPQDLENVNAMPFDQSLLDLNDYEIAPDGQFDFP

SEQ ID NO: 160673 - protein, 208 aa, Heterodera glycines
  Coding regions on vcDNA: vcDNA=SeqID_87096; Strand=+; Position=2-625
IRELESPDEHSLVLFNPLRSCFRPTRDELFRAVERLRESILLMDTERARFRRSNGALLRMIVRLSGGIPPNFNHAHFAAAAQPVVNVTAVLANANPTGQNYQRLLNLNADLTETIARLTVEISQLGYMNEQLTEQLEHLTEVPPNANFNLDDVVFHPPLDQQHEVPPNANFNLDDVVFHPPLDQQHEVPPNPNFNPALLEFDDVGLQP

SEQ ID NO: 160674 - protein, 175 aa, Heterodera glycines
  Homolog annotation: Hit_ID=AAO25691.1; Match level="QueryCoverage =61%, HitCoverage=81%, E-value=4e-13, Identity=40%"; Hit description =ankyrin repeat protein E4_2 [synthetic construct]
  Gene Ontology: Mol. function=structural constituent of cytoskeleton; Cellular component=membrane; Biological process=induction of apoptosis
  Coding regions on vcDNA: vcDNA=SeqID_87097; Strand=+; Position=54-578
MSDDVAPPAPSGAVDDFAQRISQFFFFIHGGNIDRLRALIGSLSADELNTLLQMNDPRNGQQFALLIAIMKGHTEIAALLLEKGADVHQTTVRQVNHVNMAVTPLWVAVNMRQLEMCRVLIAHGANVDLGSDASLTPLLLACDKGSTEIVTLLVENGADVNLGDSEGMMPLMVIC

SEQ ID NO: 160675 - protein, 129 aa, Heterodera glycines
  Homolog annotation: Hit_ID=AAQ09597.1; Match level="QueryCoverage =94%, HitCoverage=58%, E-value=9e-22, Identity=41%"; Hit description =NS5ATP2 [Homo sapiens]
  Coding regions on vcDNA: vcDNA=SeqID_87098; Strand=+; Position=186-572
MSPFPPSATDLFSLLDAIDKLKHLKRTGWVLVGISEPETVASHMYRMATVAMTLSAHRTDLDVNKCIRMALVHDIGEAIIGDITPHCGVSNEEKFKIEKDAAETISNWLPETVGDEWKNLWREYDEGKS

SEQ ID NO: 160676 - protein, 203 aa, Heterodera glycines
  misc_feature (31)..(31): Xaa can be any naturally occurring amino acid
  Homolog annotation: Hit_ID=NP_957220.1; Match level="QueryCoverage =100%, HitCoverage=30%, E-value=4e-62, Identity=55%"; Hit description= similar to excision repair cross-complementing rodent repair deficiency, complementation group 2 [Danio
  Gene Ontology: Mol. function=ATP dependent DNA helicase activity; Cellular component=nucleus; Biological process=post-embryonic development
  Coding regions on vcDNA: vcDNA=SeqID_87099; Strand=+; Position=3-610
FPYEYVYPEQLLYMEQLKKVLDAPVSSWECXSGHCLLEMPSGTGKTVSLLALVVAYMRKYPERLHKLIYCSRTIPEIEKCVEELKRLFRYYTNVTGSAPDFLALTLSARKNLCINKSVVSFRYGSAVDGACQRLTASYVRAKRRLNPNLPCCSFFEKFDEKRDMTLPKGVYNLSDLRGWGKEHGMCPYFVARHLVNRADIIVY

SEQ ID NO: 160677 - protein, 66 aa, Heterodera glycines
  Homolog annotation: Hit_ID=ZP_00340573.1; Match level="QueryCoverage =69%, HitCoverage=29%, E-value=3e-11, Identity=69%"; Hit description =hypothetical protein RakaH01001082 [Rickettsia akari str. Hartford]
  Coding regions on vcDNA: vcDNA=SeqID_87100; Strand=+; Position=3-203
VPQRAQPLSLVATQEHSKETAGDIPEEGGDDVKSSWPLWVGLHTSYNGRSRGLPTREGELIPENRS

SEQ ID NO: 160678 - protein, 48 aa, Heterodera glycines
  Coding regions on vcDNA: vcDNA=SeqID_87101; Strand=-; Position=3-146
VERFLQHRKHVIEVFDGHFTQLNAHSTGRRSRRFVRRHCCALCQPKTL

SEQ ID NO: 160679 - protein, 127 aa, Heterodera glycines
  Homolog annotation: Hit_ID=NP_510362.1; Match level="QueryCoverage =100%, HitCoverage=33%, E-value=1e-49, Identity=73%"; Hit description= isocitrate dehydrogenase (41.6 kD) (XO790) [Caenorhabditis elegans] emb|CAB02822.1| Hypothetical protein
  Gene Ontology: Mol. function=isocitrate dehydrogenase (NAD+) activity; Cellular component=mitochondrion; Biological process =isocitrate metabolism
  Coding regions on vcDNA: vcDNA=SeqID_87102; Strand=+; Position=1-384
QLVARPEQFDVMVMPNLYGSIVDNLAAGLVGGAGVVNGESVGSDYVIFQPGARHTFKEAFGKQIANPTAMILCCANMLNHLHLNSYGTALRHAVEKVLKEGKVRTRDLGGFANTSDFASEVIANFQM

SEQ ID NO: 160680 - protein, 243 aa, Heterodera glycines
  misc_feature (208)..(208): Xaa can be any naturally occurring amino acid
  misc_feature (211)..(211): Xaa can be any naturally occurring amino acid
  Homolog annotation: Hit_ID=NP_001002205.1; Match level="QueryCoverage= 85%, HitCoverage=63%, E-value=2e-67, Identity=64%"; Hit description =dehydrogenase/reductase (SDR family) member 1 [Danio rerio] gb|AAH72703.1| Dehydrogenase/reductase (SD
  Gene Ontology: Cellular component=mitochondrion
  Coding regions on vcDNA: vcDNA=SeqID_87103; Strand=+; Position=26-754
NIPNGLAVRALEGKIAVVTGASRGIGRGIALQLGQAGATVYVTGRAPAASYSLIEKGLPSLEQTAKEIKSRGGEAHPVYCDHANSDDVRRLFKRVEEEQNGRLHILVNNAYSGVPSLIENAGKKFWECEPEFWDDINEVGLRNVYFCSTLAARLMVPHEDGLIVHISSAGGLQYLFSVPYGVGKAAVDRMASDMGLELKSRGVAVISXWPXFVQTEITTMGENAEQFASAARMSMDAFNAALK

SEQ ID NO: 160681 - protein, 234 aa, Heterodera glycines
  misc_feature (14)..(14): Xaa can be any naturally occurring amino acid
  Homolog annotation: Hit_ID=NP_493130.1; Match level="QueryCoverage =98%, HitCoverage=29%, E-value=3e-33, Identity=38%"; Hit description =glycosyl transferase, family 14 (1M951) [Caenorhabditis elegans] emb|CAB03539.1| Hypothetical protein T09
  Coding regions on vcDNA: vcDNA=SeqID_87104; Strand=+; Position=1-701
SPALFKRRVRALAXCFPNVIMGDERPMKSDGEGMMEAVLDCFERLDTPKRKWEYVTLLQNHDTAIKTRVQMAQIFAWMDGANDVQVLVPPPGRVDKIKAMDWSFEALNLFKNATRNSAVAGSASAHGFPAHLELAKGGFHASLTRAMVQFIRLELNLTELVRRMNLIGFGRDEIMLITLHSADQLNAPGGFTQTCFRQKNGRDTRFLTREALWAPHAFCPSHKWRHAVCIFGVE

SEQ ID NO: 160682 - protein, 171 aa, Heterodera glycines
  Coding regions on vcDNA: vcDNA=SeqID_87105; Strand=+; Position=164-676
MEKAKKEGEKAPIHPFKMSGHCDGEAVEKEEEEYGSKQLIPCAPYARLLLFGTPSAIQSAQLAQLRALVPGAQLAVANCRPGLDTDEAVEEEIVALGASHLVFVHGADGETRDAWEAGGPANLRENVRVNLFSPWLLSNICDRFGIVFVEFDGEGKNCCNSNGKVPTNADA

SEQ ID NO: 160683 - protein, 207 aa, Heterodera glycines
  misc_feature (7)..(7): Xaa can be any naturally occurring amino acid
  Homolog annotation: Hit_ID=CAE74810.1; Match level="QueryCoverage =99%, HitCoverage=43%, E-value=8e-58, Identity=52%"; Hit description =Hypothetical protein CBG22645 [Caenorhabditis briggsae]
  Gene Ontology: Cellular component=mitochondrion
  Coding regions on vcDNA: vcDNA=SeqID_87106; Strand=+; Position=2-624
TACLKFXNYAFFFWLPYYLTYKYQWAESEANQLSIWYDIGGIVGSVLGGLASDRLGHRSPIILLMLVLSVPLLFIYSGLGSSRVEHVIGMSLLGVTISGPYNLIVGTIAIDLGSQQALANNAEALSTVTGLIDGIGSAGSALGQLFVPLIQNELGWIWVFHFFILMNFLSSMCLIRRFFHDARLISLSFAPRQNGRRQENEPLISNN

SEQ ID NO: 160684 - protein, 208 aa, Heterodera glycines
  misc_feature (129)..(129): Xaa can be any naturally occurring amino acid
  Homolog annotation: Hit_ID=AAP30764.1; Match level="QueryCoverage =100%, HitCoverage=47%, E-value=1e-112, Identity=98%"; Hit description=putative gland protein G28B03 [Heterodera glycines]
  Coding regions on vcDNA: vcDNA=SeqID_87107; Strand=+; Position=2-623
MNILLKSVLFISLLSLFGDCMKNSDQIGVKRKSAGIRIEEPNDVKGKGKVVETSRKGKEKVGEKISVMNTAERIEKMDLAQDKAKMDIDTNGKPKQNEENAPPKYVFIWSGNNEKKNLEVDLRVIRHSXKKLSELFHAKSDQSVNAKHGKQEALPVPKQEAEKILKEVEEWYAHHKNDKHKNAPVFVFKCKDNVSLVINVHLDAVRLS

SEQ ID NO: 160685 - protein, 95 aa, Heterodera glycines
  Homolog annotation: Hit_ID=AAC46878.1; Match level="QueryCoverage =85%, HitCoverage=21%, E-value=2e-13, Identity=50%"; Hit description =cathepsin B proteinase
  Gene Ontology: Mol. function=peroxidase activity; Cellular component =extracellular space; Biological process=protein targeting
  Coding regions on vcDNA: vcDNA=SeqID_87108; Strand=+; Position=3-290
YIPVDLLVYNHLFVYDGGILLQRREDGVQRGAHVVRLIGYGRVNCTDGRRVKYWLGVNSWNTSWGENGGFFRIKRGENVFGIESRDISFGRVELP

SEQ ID NO: 160686 - protein, 130 aa, Heterodera glycines
  misc_feature (6)..(6): Xaa can be any naturally occurring amino acid
  Homolog annotation: Hit_ID=AAC48327.1; Match level="QueryCoverage =100%, HitCoverage=27%, E-value=2e-70, Identity=97%"; Hit description= beta-1,4-endoglucanase-1 precursor [Heterodera glycines] gb|AAC15707.1| beta-1,4-endoglucanase-1 precurso
  Coding regions on vcDNA: vcDNA=SeqID_87109; Strand=+; Position=24-412
MCRLQXTHLLARLFLLFALCTAFVSSLTAVAPPFGQLSVSGTNLVGANGQPVQLIGNSLFWHQWYPQFWNADTVKALKCNWNANVIRGAMGVDEGGYLSDANTAYNLMVAVIEAAISNGIYVIVDWHAHN

SEQ ID NO: 160687 - protein, 177 aa, Heterodera glycines
  Coding regions on vcDNA: vcDNA=SeqID_87110; Strand=+; Position=2-535
WKIALGKLVGMQLLLLLEFENPLIFSLDIFCDKQLALDYAILFCTNPTVSSDAENRLSIRLYFAKIMAIFTKIFNFIKTSTEKENKQKYLLVFVEIWNKICPRIHTELQQNDISSTVGILYNIWRGIASRYNQIPLGIFQGYEPIRVLSSDNGLLLLDEKGTYSSNVIRAELLRTMW

SEQ ID NO: 160688 - protein, 164 aa, Heterodera glycines
  Homolog annotation: Hit_ID=CAE75501.1; Match level="QueryCoverage =92%, HitCoverage=19%, E-value=4e-21, Identity=33%"; Hit description =Hypothetical protein CBG23510 [Caenorhabditis briggsae]
  Coding regions on vcDNA: vcDNA=SeqID_87111; Strand=+; Position=171-662
MDIADEQKAEWETVGETAAMVSGPVPPPPLPSEEPTPAQVESPTPVKKTIVTTLQQKQVVPLSKLNGVFQEEEEDEVDTLHQIKKKIKPFEITREDRLQSMTPEERKKLIKDLITRIPTDKAKLFSFEVCWEFVDENLMEQRVRPWVNKIICEYIGEDEQSLVA

SEQ ID NO: 160689 - protein, 202 aa, Heterodera glycines
  Homolog annotation: Hit_ID=CAE71307.1; Match level="QueryCoverage =98%, HitCoverage=59%, E-value=3e-61, Identity=56%"; Hit description =Hypothetical protein CBG18196 [Caenorhabditis briggsae]
  Coding regions on vcDNA: vcDNA=SeqID_87112; Strand=+; Position=15-672
MDPPDLSETQPTIPKRGHHHRRRVDISASRLPRAVLVRIFGHLSVAELGAVSLVCCSWKFIVDSNDFDLWARHARAQLPESALSDPYLFVNTSSHREMLRAFKHAWNPSDCSRNAFVRTNGFTVHRQPIAQSTDGIRGKVGVSSGAHCWEFCWEGPLGTTAVVGVATKHAALHCPGYLPLIGSDDQSWGWNLVNNTIAHNGE

SEQ ID NO: 160690 - protein, 235 aa, Heterodera glycines
  misc_feature (217)..(217): Xaa can be any naturally occurring amino acid
  Coding regions on vcDNA: vcDNA=SeqID_87113; Strand=+; Position=3-707
KIVPSPKPGKFPKTPTTNNMKYLPPELLDEMTFYIYPNQNCSRILTSSWLLMEFLRPHIERWKKIFKILLNELIDLHKLCKEEIPWRTFTALAEKDKNCNAFVAALLELVKEDAYASIDGSGSNALLIRLRELYPSVIETLAWTGLQTLNAELFPSTQRMVQALRELIETTGLYFGAVPKASSSKEHFYHSVACVGDVPPNVDDHPPPQLKIIDAGXQSTSSSTAPIPKPLDKSM

SEQ ID NO: 160691 - protein, 87 aa, Heterodera glycines
  Coding regions on vcDNA: vcDNA=SeqID_87114; Strand=-; Position=163-426
ITTVVSGVFSVIVPLFCLFSSSPPVATTASFTAAEFVDGSVENVRPNTESICCWCCCCCMASTATTVSASYSSTIEVPYIRKVLSVQ

SEQ ID NO: 160692 - protein, 125 aa, Heterodera glycines
  Homolog annotation: Hit_ID=NP_498282.1; Match level="QueryCoverage =100%, HitCoverage=58%, E-value=2e-49, Identity=73%"; Hit description= kdel receptor (24.7 kD) (3G997) [Caenorhabditis elegans] gb|AAA62292.1| Hypothetical protein C28H8.4 [Ca
  Gene Ontology: Mol. function=KDEL sequence binding; Cellular component=integral to membrane; Biological process=intracellular protein transport
  Coding regions on vcDNA: vcDNA=SeqID_87115; Strand=+; Position=29-406
DEDTFRVELLVLPCIVLALFVNADFTALEVLWTFSIYLEAVAILPQLFMLQKRGEAETITAHYLFLLGIYRALYIFNWVYRYYTEAFYDPIVIVSGIVQTVLYADFFYLYVTRVVKDGAKLELPI

SEQ ID NO: 160693 - protein, 221 aa, Heterodera glycines
  Coding regions on vcDNA: vcDNA=SeqID_87116; Strand=+; Position=2-664
KNGKSQRRKSLQNHRMLRFYILSLSEQLISRAEVDPEICVVQIADTSVNSVVDHLVTETYSTTECASPLRTNPTFLTNVCRINISSKGQQKIFFCDLNEPLLNVINEFAERTNVDPKRVNLYTKQYKRCDPKDTPRTLGLSEKCDEIELDAFEDLEENEGKRLALKYQTKGQRPTIVRVLPDATFASLKELFCTDHALDPAKTRFLLGSIEMIADDETPNS

SEQ ID NO: 160694 - protein, 138 aa, Heterodera glycines
  Homolog annotation: Hit_ID=AAO33474.1; Match level="QueryCoverage =100%, HitCoverage=100%, E-value=5e-73, Identity=99%"; Hit description=gland-specific protein g4g12 [Heterodera glycines]
  Coding regions on vcDNA: vcDNA=SeqID_87117; Strand=+; Position=39-455
MPNIFKILLIVLLAVVSFRLSASTGDKKTANDGSGNNSSAGIGTKVKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160695 - protein, 86 aa, Heterodera glycines
  Coding regions on vcDNA: vcDNA=SeqID_87118; Strand=+; Position=226-486
GKVRAIMLVNPQNPEAGYFSLDEIRPVVHWALSRNLFVLLDEIYDLSIYDEDSECPFRSAVELFEDERSRQKLIWLWGPSKAKAKK

SEQ ID NO: 160696 - protein, 107 aa, Heterodera glycines
  Coding regions on vcDNA: vcDNA=SeqID_87119; Strand=-; Position=277-600
VSSVSSVVSSFVALFSASAASAAPSFGCSSAVTASSSFFSAVWSPPSSSFFCSSSSCSNGTVTPKRVAGDSIRGSVFVSSVGPFSTSASPSPSSSPVPSLFGFINSR

SEQ ID NO: 160697 - protein, 174 aa, Heterodera glycines
  Homolog annotation: Hit_ID=NP_491476.1; Match level="QueryCoverage =91%, HitCoverage=69%, E-value=4e-22, Identity=35%"; Hit description =putative protein, with at least 3 transmembrane domains (26.1 kD) (1F480) [Caenorhabditis elegans] gb|AAB
  Coding regions on vcDNA: vcDNA=SeqID_87120; Strand=+; Position=107-628
CRPPLGLENEKYKVLCRSIHVSKAALYIGYMRLLVSLVSSLFFAYQYMMAVTGQLSSDHWINQVTARFMSQAMMSICLQVIVVVLMVHGVKAEKKSLLLPFIVYAAIAVLAGSIKVMSDLVYLDTSVYKNNEAESRAAKVQFLTNLLRTVLQAWCLSVVWRCYGYLTEKKWHVR

SEQ ID NO: 160698 - protein, 137 aa, Heterodera glycines
  Homolog annotation: Hit_ID=NP_498420.1; Match level="QueryCoverage =91%, HitCoverage=25%, E-value=5e-26, Identity=50%"; Hit description =mannosyltransferase (3H551) [Caenorhabditis elegans] gb|AAC77507.1| Hypothetical protein T26A5.4 [Caenorh
  Gene Ontology: Mol. function=beta-14-mannosyltransferase activity; Cellular component=integral to membrane; Biological process=N-linked glycosylation
  Coding regions on vcDNA: vcDNA=SeqID_87121; Strand=+; Position=2-415
RILRRTHSEYQWEKVRIFTAWLSADDYPKFLSCADLGVSLHTSTSGFDLPMKVVDMLGSGVPVLAKNFPAIGELIDGTNGLLFDTPEELENLLADLSLGFPGNSKLTDLTKNVKEEAKKNDWTKNWDDVVWPHFENL

SEQ ID NO: 160699 - protein, 83 aa, Heterodera glycines
  Coding regions on vcDNA: vcDNA=SeqID_87122; Strand=+; Position=107-358
IRRALLWMLHLSSPPLFNVRKSLTTSFLSELRTYDVWRCEDGNECASGCCECELGRHWGQWERRVIGGKGNRLAKWRRIYTKL

SEQ ID NO: 160700 - protein, 179 aa, Heterodera glycines
  Coding regions on vcDNA: vcDNA=SeqID_87123; Strand=+; Position=194-730
MISKQFNRAQRMTRFSRKHVSVDLLRKLFPDEVPDTDVDNSNNDGTERSVGMLEVMDPLRQHLRSSPPRNIREVDMSKFSTFRESHFVELFRSISNGRELLTEVRRLNVQKCVIELRDMEFLAQLMPKVWYIRCSAQTLVIPEDIDQSKLALSVEQMRQLHAKLDKFDYVARKCTKKHL

SEQ ID NO: 160701 - protein, 160 aa, Heterodera glycines
  Homolog annotation: Hit_ID=CAE64728.1; Match level="QueryCoverage =97%, HitCoverage=16%, E-value=5e-56, Identity=62%"; Hit description =Hypothetical protein CBG09515 [Caenorhabditis briggsae]
  Gene Ontology: Mol. function=metallopeptidase activity; Cellular component=proteoglycan integral to plasma membrane; Biological process=pathogenesis
  Coding regions on vcDNA: vcDNA=SeqID_87124; Strand=+; Position=27-509
MAFPDFAAGAMENWGLVTYREKYLLYSPELYTAQQKQAVASVVAHELAHQWFGNLVTMRWWSDLWLNEGFATLMEYLGTNAISDGMFRMDDYFLVEALDSAFDRDSRATSHPLFFEIRKAEDVTEAFDSITYSKGASVLRMIRAVMGEEHFKKGLNVCTN

SEQ ID NO: 160702 - protein, 178 aa, Heterodera glycines
  Homolog annotation: Hit_ID=NP_505734.1; Match level="QueryCoverage =74%, HitCoverage=32%, E-value=6e-41, Identity=57%"; Hit description =protein phosphatase (pph-1) [Caenorhabditis elegans] pir||T18936 phosphoprotein phosphatase (EC 3.1.3.16)
  Gene Ontology: Mol. function=protein serine/threonine phosphatase activity; Cellular component=plasma membrane; Biological process =sodium ion homeostasis
  Coding regions on vcDNA: vcDNA=SeqID_87125; Strand=+; Position=76-609
MAREDYGFDATAAAAAEQSRPSATTSTPYWQHDSLDIALQAIIRKVRQSPVHRFTDEITDEELQQLCMAATDVFRMQPTLVRIQPPVVVVGDIHGQFTDLQRIFDTHGYPPEQQYVFLGDYVDRGPQSLETIVLLFCYKVKYPANFMLLRGNHECANINRVYGFFDEFINRYKRPDPC

SEQ ID NO: 160703 - protein, 57 aa, Heterodera glycines
  Coding regions on vcDNA: vcDNA=SeqID_87126; Strand=-; Position=30-203
VHCCPLDSKIELIIFVAFHLPISRNFRLHVVAKSAMLHFVCVEQLAKSCAVFGHAVC

SEQ ID NO: 160704 - protein, 189 aa, Heterodera glycines
  Homolog annotation: Hit_ID=NP_625385.1; Match level="QueryCoverage =64%, HitCoverage=62%, E-value=3e-14, Identity=42%"; Hit description =putative acetyltransferase [Streptomyces coelicolor A3(2)] emb|CAB95978.1| putative acetyltransferase [St
  Coding regions on vcDNA: vcDNA=SeqID_87127; Strand=+; Position=56-622
MRDPLRADLLAGSKLKEVKKTDYNQCKSMLLDLFDGTRVILVGETRDRSGRKRLISCFQLYRQSRAAAYFGMFAVHPFFQASGLGKRLLTVAERYARIVWGSDEMHLDVGGSLAELKLGMGRLQRYYKRRGFLSTGILRPFNGAVARFITVDRNDLWIELMVKDIRGALDDIGGDPEKRMKRVNSRGRL

SEQ ID NO: 160705 - protein, 133 aa, Heterodera glycines
  Homolog annotation: Hit_ID=AAH80129.1; Match level="QueryCoverage =99%, HitCoverage=70%, E-value=3e-46, Identity=63%"; Hit description =MGC84827 protein [Xenopus laevis]
  Gene Ontology: Mol. function=lactoylglutathione lyase activity; Biological process=carbohydrate metabolism
  Coding regions on vcDNA: vcDNA=SeqID_87128; Strand=+; Position=1-402
PFYCNVLGMRLLKQLDFPEGKFSLFFMGYKDLDEIPSDDAAQKKFALSTHSTIELTHNWEHGTDFKGYHNGNSEPRGFGHIGIAVPDVDSACARFEQLGVKFVEKPNEGRMRGLAFITDPDGYWIEIFNPNNM

SEQ ID NO: 160706 - protein, 117 aa, Heterodera glycines
  Homolog annotation: Hit_ID=XP_456171.1; Match level="QueryCoverage =54%, HitCoverage=30%, E-value=4e-10, Identity=53%"; Hit description =unnamed protein product [Kluyveromyces lactis] emb|CAG98879.1| unnamed protein product [Kluyveromyces lac
  Coding regions on vcDNA: vcDNA=SeqID_87129; Strand=+; Position=15-365
MVAANLKLSLIFVAGFCLLFIADSDAGKSCKPGEKGPPGPPGKPGNKGKPGVCKPKYETTSKYGTTTSKYDTTTSKYGTTTPEYDTTTSKYDTTTSKYDTTTSDYGTTTSKYDTTTS

SEQ ID NO: 160707 - protein, 147 aa, Heterodera glycines
  Coding regions on vcDNA: vcDNA=SeqID_87130; Strand=+; Position=2-445
CKHACAMAMQMLVMYTPINSYEGSDQLLFPLYRSDLHLFRQKPQEFLANALLSNTDVVHTHPMELLPSTDRSINNNNNPYTLMMKRISTPPIFDEEAIDGEALNARTEQKEEEQNLLRAGRNIEEVTAPKMYARHLGDLGGTMFRFG

SEQ ID NO: 160708 - protein, 213 aa, Heterodera glycines
  Homolog annotation: Hit_ID=NP_995878.1; Match level="QueryCoverage =93%, HitCoverage=42%, E-value=3e-09, Identity=24%"; Hit description =CG6477-PB, isoform B [Drosophila melanogaster] gb|AAS64816.1| CG6477- PB, isoform B [Drosophila melanogast
  Coding regions on vcDNA: vcDNA=SeqID_87131; Strand=+; Position=87-725
MVTSYGAPCESDDRILKALQILVYFIPETHKQCLECLLIHLKRVSAHSDKNKMDESNLGLLFSSYVFPVQQQKYESIEKAKDEIAQFCRLFPVLLKHCDALFKLPAELVQTFDASLMKRALEQQNCGDLTISSTPSFAFSPLLPTPNRNTKTPRRDEDDAEVAIVHSCSKRVATPNQNTTDLEVAKLAANIASMDEGSARSRLLNKMMTVQRQ

SEQ ID NO: 160709 - protein, 233 aa, Heterodera glycines
  Coding regions on vcDNA: vcDNA=SeqID_87132; Strand=+; Position=4-702
IFGLYLHLQELKHFDGQNGKLIGNDSDESLESLVSFISKNGFGLINDERRTKIDQAIQEIEQIVKKWNRKAKIIVMGSYQLGALTKQSDIDAICVVPELRTWRAAKFFGKAKCQIQWNGFRRCADDSLFCHFCLAAQVTGLNRIQDAWVPLIKFKFEIDPKTSVDFDIGLETFAIHDDIFKSEEPIKYEQCDALSAKMANEIGQLANRRRAFITRGGDYEELMEMNSEREKLR

SEQ ID NO: 160710 - protein, 144 aa, Heterodera glycines
  Homolog annotation: Hit_ID=CAE66916.1; Match level="QueryCoverage =58%, HitCoverage=30%, E-value=1e-19, Identity=55%"; Hit description =Hypothetical protein CBG12304 [Caenorhabditis briggsae]
  Gene Ontology: Mol. function=DNA N-glycosylase activity; Cellular component=nucleus; Biological process=base-excision repair
  Coding regions on vcDNA: vcDNA=SeqID_87133; Strand=+; Position=325-756
MIALIITQMPFLIAHPMQRISTLKLFRKRMHKRKIGTTRAEIEIENCNVRIPELVQSHLKLIRQIRENVVAPVDTIGCHALADKCADPKTYRFQILVALMLSSQTKDQVTAEAMERLKKEGCTVDNFIGIADKRLEQLLNPVGF

SEQ ID NO: 160711 - protein, 156 aa, Heterodera glycines
  Homolog annotation: Hit_ID=XP_375838.1; Match level="QueryCoverage =94%, HitCoverage=53%, E-value=2e-43, Identity=57%"; Hit description =PREDICTED: similar to membrane targeting translocation system protein like (2A562) [Homo sapiens]
  Gene Ontology: Cellular component=mitochondrion
  Coding regions on vcDNA: vcDNA=SeqID_87134; Strand=+; Position=1-471
HLKNGDADKEEQRKVFRAQIELAKELQLPLNVHSRSAGTPVIEWLAAHGAQNVLLHAFSGNVENAQKGIEKGFFFSIPPSFALSKEKEALIQKIPLSKLCLESDSPVLGPVAEERNEPKNIKLSAEFIARIKNVSTDEVIRVTTENAKKLFPKLKI

SEQ ID NO: 160712 - protein, 113 aa, Heterodera glycines
  Homolog annotation: Hit_ID=CAE71390.1; Match level="QueryCoverage =61%, HitCoverage=7%, E-value=1e-12, Identity=46%"; Hit description =Hypothetical protein CBG18297 [Caenorhabditis briggsae]
  Coding regions on vcDNA: vcDNA=SeqID_87135; Strand=+; Position=2-343
VRIEGRALQLLDVEQLCGELEEITGLRPLPHRPFVENFVKAFYLPFGELQNWMVNHTEYSLSQTSAILNAAAGAAANSSSSVATNSRKATMSRIMANLLGASGIGEGGNSLFQ

SEQ ID NO: 160713 - protein, 121 aa, Heterodera glycines
  misc_feature (86)..(86): Xaa can be any naturally occurring amino acid
  Coding regions on vcDNA: vcDNA=SeqID_87136; Strand=+; Position=3-368
RLSAFCWPQHNISLTTFDRLRHDAYDERGILLLYFDCCCTELGPNKLPTSGRATEQPCGHAHRQTFAHDFRAVHFRSQCSRHSQAXANVTVGVLQQQSMLIHLQPPVVLCGDIPMANFGTC

SEQ ID NO: 160714 - protein, 228 aa, Heterodera glycines
  Coding regions on vcDNA: vcDNA=SeqID_87137; Strand=+; Position=2-685
NLDERIIHRWRQVPPIDHQLPPRLWHCAALLPPDTLLFYGGMNEVPSRDSPFVRTLLVRRLCPPTLRHLSLNALAFQIVIRWSQEMNARKMAGAPESAAGTLGRRMNSESDSDLLNFVSRTFFAHLPNSLHFHLTVLLTIRKHSKALNLMGAGGANIPRVPSPMPSHWNLPPIPLQFHLLHLVDGRNLAGGNEESGGENEISTFSRPPLIALSPKSQRRALADEITAL

SEQ ID NO: 160715 - protein, 73 aa, Heterodera glycines
  Coding regions on vcDNA: vcDNA=SeqID_87138; Strand=-; Position=1-219
SPHGIFEEHHLCSCCWCCSPNSLRFPPFLLGHKLSVVRWSSLARGKMPKMAKQIGAKQRQICPQICSLFYFMM

SEQ ID NO: 160716 - protein, 74 aa, Heterodera glycines
  Coding regions on vcDNA: vcDNA=SeqID_87139; Strand=-; Position=2-223
SSTFALSMLLAVPPTSNWMAFCSYSCFSCCPLVFEEASDQCQRTIVLFFGLGLYSLLFFSSDNAWSTHYQKIAG

SEQ ID NO: 160717 - protein, 138 aa, Heterodera glycines
  Homolog annotation: Hit_ID=AAO33474.1; Match level="QueryCoverage =100%, HitCoverage=100%, E-value=9e-73, Identity=99%"; Hit description=gland-specific protein g4g12 [Heterodera glycines]
  Coding regions on vcDNA: vcDNA=SeqID_87140; Strand=+; Position=39-455
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPMQFEMGANRLEKMRAHLRELAEKMPVNESKRLSPSGPDPHHH

SEQ ID NO: 160718 - protein, 206 aa, Heterodera glycines
  Coding regions on vcDNA: vcDNA=SeqID_87141; Strand=+; Position=59-676
SIMDISRLRRICAIYASDWINGYPFSLAVIKKALESKLNVCSLLFLHLRRDLPDTLKNNPKFVALECFGFDSLEAIRKRLAKEDISRESLVFIDSLPVLIEQFSLPSTSWFLTQIAELSACVLALVHSSESEDDQNSEDWRRIESIASTVFELRARDKHTLCRTKTKKRNGTAEEKLEQFSIEEDYSITFSPFDYSSDRTDDKFVE

SEQ ID NO: 160719 - protein, 117 aa, Heterodera glycines
  misc_feature (25)..(25): Xaa can be any naturally occurring amino acid
  misc_feature (63)..(63): Xaa can be any naturally occurring amino acid
  Coding regions on vcDNA: vcDNA=SeqID_87142; Strand=+; Position=133-484
KKIFFFFSLYIFFYLMNKFLILQLXFYFFFYFFFGYIKTLRQKSIYKVTFFIFFFKFFLFFYXFNIIFRGKKKIFFFFFSLYIFFYLMNKFLILQGNFIFFLFFFGGHKNPAPKIYF

SEQ ID NO: 160720 - protein, 206 aa, Heterodera glycines
  Coding regions on vcDNA: vcDNA=SeqID_87143; Strand=+; Position=76-693
DCAFSFHPFSSYCEPFDGYLKFDGESICFSGWVQLPQGMFKHRKRGWAVVRNNTFSISQDDESRTPFFGPVELSKCVFLGKESDSESVVVFILRDLSKRSKNQKHLLNSSGELNTVRFTPEENHEFWLSLMAKCCSPRNDLFGEKLPMVECCGRLWVKQGISGHWNEGWAFVHGHSLTYWVQAPNAIAEVDIRKIFLVKQNDIPSS

SEQ ID NO: 160721 - protein, 212 aa, Heterodera glycines
  Homolog annotation: Hit_ID=NP_956607.1; Match level="QueryCoverage =98%, HitCoverage=19%, E-value=1e-59, Identity=56%"; Hit description =similar to chromodomain helicase DNA binding protein 1-like [Danio rerio] gb|AAH50498.1| Similar to chrom
  Gene Ontology: Mol. function=helicase activity; Cellular component =nucleus; Biological process=chromatin modeling
  Coding regions on vcDNA: vcDNA=SeqID_87144; Strand=+; Position=22-657
KDSNEVPLCSEVILYHGLSKLQYDMYRAILSSNRSFFAKNMRTEKQARQSLMSTLVQLCKCCDHPYLFRGIEKEPFEEGEHLVNDSGKALILDRLLAYLHKKGHRVLIFTQMQRFLDIVYDIMSLRGYICEQLDGTVSQPDRQKAIQNFQRPDSDVFAFLLTTKAGGLGLNLTAADTAIFLDWDFNPQNDKQAAARCHRIGQDKPVKIIRLV

SEQ ID NO: 160722 - protein, 205 aa, Heterodera glycines
  misc_feature (19)..(19): Xaa can be any naturally occurring amino acid
  Homolog annotation: Hit_ID=AAP30764.1; Match level="QueryCoverage =99%, HitCoverage=46%, E-value=1e-113, Identity=98%"; Hit description= putative gland protein G28B03 [Heterodera glycines]
  Coding regions on vcDNA: vcDNA=SeqID_87145; Strand=+; Position=3-616
ARHVRLVINVHLDAVRLSXELSNMLEDTADEGYPKPIPSPVQNFKSDIMLKLIKLCEEYKYKFDGLKKTTDVPTGEVAEASASNVQEGDVGEASASKVKAGTIAEEIQKFVPPPHIMQWDVKTDLEMVRAADFYNINRLINDDYIDNVYEIVKVKWINGKTPQEIRKGFGVEEPYPPGHPEWARVEKENEWEESDEEREARHAKE

SEQ ID NO: 160723 - protein, 226 aa, Heterodera glycines
  Coding regions on vcDNA: vcDNA=SeqID_87146; Strand=+; Position=43-720
NDHNYHANLSIWLCNDVWMDILPLFDRPQLGLKLAMLSPRFDALVDIHFDAKTELTLWRPIAIRNDGGTDTATPELRVFIDDAYNSVPFPLPDAHSPPMPNNIRFKDLRINCIDHSVIAFLSANQLIFQKGTNLRLSLPFGTFNTNVKQIWDDFARQIWPIFAPTIRHFGFPNGHHLDMLLRLVSPTILTDDQINIHSIDSGRQFPEPIGDDHFDGPTITNFDGSI

SEQ ID NO: 160724 - protein, 235 aa, Heterodera glycines
  Coding regions on vcDNA: vcDNA=SeqID_87147; Strand=+; Position=3-707
LFAYFEDARKLYETRMKNASNGNNEADCRIKNLEKELKVLKRQLSALGDLLDQFLDTSLAMRERTLRMEGELGRRLERLEAQNVQLRANLAAMGQQTHKNGDNEQRNEAEQTIETIHFDELSISDGVPLQQNVQQQPQPPNVSNCPVNDEGGDGDGIGDELAHFLAGLPPVDELGQLVLNKFKYSCEFAQLLYTGGGHVDSVFCNIFSGYPPTFFEELIEYALTTHRPDALIRRI

SEQ ID NO: 160725 - protein, 71 aa, Heterodera glycines
  Coding regions on vcDNA: vcDNA=SeqID_87148; Strand=-; Position=1-213
FAKNQCVTELEPICSAMNAFAVAIAASFCLFFSPSSSRTAAGALPNSPAVTSQRILSTSSWLILPYVRFGG

SEQ ID NO: 160726 - protein, 223 aa, Heterodera glycines
  Homolog annotation: Hit_ID=NP_499105.1; Match level="QueryCoverage =78%, HitCoverage=17%, E-value=3e-09, Identity=26%"; Hit description =MUTator MUT-7, HBE269 like (mut-7) [Caenorhabditis elegans] emb|CAA80137.1| Hypothetical protein ZK1098.8
  Coding regions on vcDNA: vcDNA=SeqID_87149; Strand=+; Position=40-708
MYRLLSKVDQYPEASRIVFDRTDVAKPTLSLSGVSEYFLNIKLEKTEREGNWSQRPLRLEQKKYAAQDAHCLNRIFRIVASKLKRLKDNELAKELKRHSLIDFNEEKAKPTMAIPLLSGQLVRVKEGEEDFILNVQKAAVEIERSANGVLDGFRTIGDVRFIVDSMLFGLGKRLRKCGFDTRMIGDREQIVEFCKQSKDEKSVVLSAGKGHKQLALQMPDNEV

SEQ ID NO: 160727 - protein, 138 aa, Heterodera glycines
  Homolog annotation: Hit_ID=AAO33474.1; Match level="QueryCoverage =100%, HitCoverage=100%, E-value=4e-72, Identity=98%"; Hit description=gland-specific protein g4g12 [Heterodera glycines]
  Coding regions on vcDNA: vcDNA=SeqID_87150; Strand=+; Position=37-453
MPNIFKILLIVLLAVVSFRLSASTGDKKTANDGSGNNSSAGIGTKIKRIATAGLLFTSLATGGAEATGRSNAQGGNAAGLVPSHVTNRSMAPPPPPVQFEMGANRLEKMRAHLRELAEKMPVNESKRLSPSGPDPHHH

SEQ ID NO: 160728 - protein, 139 aa, Heterodera glycines
  Coding regions on vcDNA: vcDNA=SeqID_87151; Strand=+; Position=1-420
LSSGAGSNHRNRRRNHQKIGCSPHDGPQRDQRGLGTRRRQLSTEPDRLHRQEPDRPACHHDQSRDIGQVRSLQDRSTQRDEDGAWGRQITLGIEWRLKGLTTDLLALSVQKTCGRHKRNEAEHQRPKQRQILLRVEQKK

SEQ ID NO: 160729 - protein, 215 aa, Heterodera glycines
  Homolog annotation: Hit_ID=XP_320116.1; Match level="QueryCoverage =64%, HitCoverage=7%, E-value=1e-08, Identity=25%"; Hit description =ENSANGP00000018055 [Anopheles gambiae]
  Coding regions on vcDNA: vcDNA=SeqID_87152; Strand=+; Position=7-651
MLSVWLDLAPKCAIAEAIASGTGTTVGGTARTSASKRGGKAAAAAAAAAAVATQPHDPNREMRDAFKRLDRAYFFSSYSQMISRITHSDAATYALLKEMLSELIVHFPHRCLWLSQSIVRSTRVAVRSKRCLEIFELAKKKARSNNDNNAAVVDLNLLIQQYDYLTTLLIGIAETQIVQQRLSGLSMARFFPNIVDFFENGTMRGGVSTRGTGRL

SEQ ID NO: 160730 - protein, 40 aa, Heterodera glycines
  Coding regions on vcDNA: vcDNA=SeqID_87153; Strand=-; Position=1-123
KYLSIRCPTCHGQCRCAVREKGWIQKNRPSSAKFLRESTK

SEQ ID NO: 160731 - protein, 84 aa, Heterodera glycines
  Homolog annotation: Hit_ID=AAL78214.1; Match level="QueryCoverage =89%, HitCoverage=38%, E-value=2e-13, Identity=48%"; Hit description =putative esophageal gland cell protein Hgg-20 [Heterodera glycines]
  Coding regions on vcDNA: vcDNA=SeqID_87154; Strand=+; Position=306-560
MEQIDTFTDQIWLDTLAWLGREEIGWHFALVNARFAALVDTQLQQRRWYLTELHINKRRSRGSGAEVMVLNSEGAFFSLPLATI

SEQ ID NO: 160732 - protein, 190 aa, Heterodera glycines
  Homolog annotation: Hit_ID=NP_498420.1; Match level="QueryCoverage =99%, HitCoverage=41%, E-value=3e-28, Identity=34%"; Hit description =mannosyltransferase (3H551) [Caenorhabditis elegans] gb|AAC77507.1| Hypothetical protein T26A5.4 [Caenorh
  Gene Ontology: Mol. function=beta-14-mannosyltransferase activity; Cellular component=integral to membrane; Biological process=protein modification
  Coding regions on vcDNA: vcDNA=SeqID_87155; Strand=+; Position=84-653
MDSEVEDANATLFVVGDIGRSPRMGYHAYSLARQGAYVNLVGYMDNQPHGDVFGEQINFVALPKPPISSSSDNPFRRFLIRLVKMVWLLFAIPYAFFVLCRGHRHRQLIMVQNPPGIPAMIVCYLLAKIRFATFVVDWHNYSSSMLDNSWISYLVGLIEGFFGRRASFNFCVSNAMKNDLERRWGVNAIT

SEQ ID NO: 160733 - protein, 115 aa, Heterodera glycines
  misc_feature (6)..(6): Xaa can be any naturally occurring amino acid
  Homolog annotation: Hit_ID=AAP30772.1; Match level="QueryCoverage =88%, HitCoverage=96%, E-value=2e-53, Identity=99%"; Hit description =putative gland protein G23G12 [Heterodera glycines]
  Coding regions on vcDNA: vcDNA=SeqID_87156; Strand=+; Position=66-412
MRTFLXIAVVGLMLAVILENVNATGKNSPTKELIHEQGNLQNHATGQSPPDSPNHKNDHENEISNLQNRATGQSPPDSTKRETEHKIEKGKPSPDSPKYDEQGNQQKNATGCQIL

SEQ ID NO: 160734 - protein, 230 aa, Heterodera glycines
  Coding regions on vcDNA: vcDNA=SeqID_87157; Strand=+; Position=26-715
QLDDLNSCLNQLLRTIKEDTSEFPPSDLLDEIKQCLDFLANSPKILAKQRAEYISLSWPADLRVVLNRLLRTFNIPEEYVKLCFELSNCAAQSLGADWLKSSDKQFLRLLASLSSGRLRILLDKPEEIDMAQLIACLQLQEYFCGCVEDEQIWMSDDDATFVSKCCQEAAAFVCSYTAACAHQLSDITSRMDLFFVLYRFICAFLSIGGHEIIDVKLLTDALPILTDVCG

SEQ ID NO: 160735 - protein, 40 aa, Heterodera glycines
  Coding regions on vcDNA: vcDNA=SeqID_87158; Strand=-; Position=170-292
FFFFFFFFFLFFFFFFFFFFNFKRFNLYQIKFKPEKIHIK

SEQ ID NO: 160736 - protein, 173 aa, Heterodera glycines
  misc_feature (11)..(11): Xaa can be any naturally occurring amino acid
  Homolog annotation: Hit_ID=CAE71449.1; Match level="QueryCoverage =95%, HitCoverage=42%, E-value=5e-63, Identity=72%"; Hit description =Hypothetical protein CBG18361 [Caenorhabditis briggsae]
  Gene Ontology: Biological process=tyrosine catabolism
  Coding regions on vcDNA: vcDNA=SeqID_87159; Strand=+; Position=1-520
MSNREETVKMXPITSPAKSRKAVSQIQEYVDYYGGAGVQHIALNTSDIVHAIQSLRARGLEFLSIPDSYYASLKQRLSDAGVELKEDLEKLRELKILVDFDEQGYLLQIFSKPCQDRPTLFLEIIQRHNHQGFGAGNLKALFESIEAEQNERGNLFYKDVAVGGEKILQKNKK

SEQ ID NO: 160737 - protein, 165 aa, Heterodera glycines
  Homolog annotation: Hit_ID=CAE69483.1; Match level="QueryCoverage =97%, HitCoverage=75%, E-value=1e-65, Identity=75%"; Hit description =Hypothetical protein CBG15686 [Caenorhabditis briggsae]
  Gene Ontology: Mol. function=GTP binding; Cellular component=membrane fraction; Biological process=signal transduction
  Coding regions on vcDNA: vcDNA=SeqID_87160; Strand=+; Position=8-502
MVGSGGVGKSALTLQFLYDEFVENYEPTKADAHRKQVVLDREYCAVDILDTAGQEDYSAIRDNYYRSGEGFICVFSITDLDSFDQLVEFREQILRVKNADPNVCILLVGNKSDLDAERKVPLEQAQQRAELWGCPFVETSAKTRENVDKVFYDIMREKKKKPNNK

SEQ ID NO: 160738 - protein, 177 aa, Heterodera glycines
  misc_feature (134)..(134): Xaa can be any naturally occurring amino acid
  Homolog annotation: Hit_ID=CAE74645.1; Match level="QueryCoverage =89%, HitCoverage=20%, E-value=3e-36, Identity=48%"; Hit description =Hypothetical protein CBG22442 [Caenorhabditis briggsae]
  Gene Ontology: Cellular component=cytosol; Biological process =embryogenesis and morphogenesis
  Coding regions on vcDNA: vcDNA=SeqID_87161; Strand=+; Position=3-534
SARVARRCLSFRQDILEDGADEVLINPNMLENERHKLNVERRKKKDHYNPYEEEVDEFGQVKKQQMLSKYDEGIDGEKERDTFRLDESGQYDLDAETAELETRRQLMMLNKKFESLESTKYTLANEFHTEEEMXHFRRPKKKGGKSTRKRKALKADDLETETTEETEEEKKKKKKKK

SEQ ID NO: 160739 - protein, 239 aa, Heterodera glycines
  misc_feature (216)..(216): Xaa can be any naturally occurring amino acid
  Homolog annotation: Hit_ID=XP_396110.1; Match level="QueryCoverage =71%, HitCoverage=17%, E-value=2e-26, Identity=39%"; Hit description =similar to ENSANGP00000013453 [Apis mellifera]
  Coding regions on vcDNA: vcDNA=SeqID_87162; Strand=+; Position=18-734
NGKARIERAGGAVAMKSGIFRVIWKRPMRGHRGPVRRSTATENIPFLAVARSLGDFWSLNPISNEYIVSPEPDVDVFELKHTDDFVVVATDGLTTVVGVRAIIEALREAEQRSKHFTCNGKESPSVDENNCDQLIDIDQFDVDLPLNQAQCLLQYAFKRWSTLRADNISIICVKLNANEVPTDRNIVVNDEQSLNVCEAIAEQPMAILVTDNGTQXLRTNAVRLQYLGAMDKCVKTSSQ

SEQ ID NO: 160740 - protein, 211 aa, Heterodera glycines
  misc_feature (188)..(188): Xaa can be any naturally occurring amino acid
  Homolog annotation: Hit_ID=NP_499530.1; Match level="QueryCoverage =98%, HitCoverage=77%, E-value=2e-64, Identity=57%"; Hit description =putative protein, with at least 2 transmembrane domains (29.8 kD) (3M907) [Caenorhabditis elegans] emb|CA
  Coding regions on vcDNA: vcDNA=SeqID_87163; Strand=+; Position=34-664
MAKLEVQVRHCFCCGLTPGSVLVGLYTLFLYALLTGLAAWALSDTALNGDKPIYEDCELEVQGNSSGDADNKKLKIHGGQTTIQFEDTSSYHCSIGMYTEEMKWSYGNRYVLLVIALCLYIPLIFASILLLAGVSLSSKWLLMPWLILLPLDILRGLFSSLFIFLFSQSDLARIATGIFFLGLQLFHXISLWIIILAKFQRIHYRKHGNAF

SEQ ID NO: 160741 - protein, 146 aa, Heterodera glycines
  Coding regions on vcDNA: vcDNA=SeqID_87164; Strand=-; Position=2-439
CAPAAILRRSGHFSGPFSGVEPLSSVTRHHHGSQIHYHRKLIRQTLERHVAGTRPCDQLSCSESTLDARRALGFVANKCAPLWGDWSFGACISSRITTVIQVRSQGQVNYSWCNEPYAVSLSGRLNLHMHGLIFRMNTSVQAGSTR

SEQ ID NO: 160742 - protein, 61 aa, Heterodera glycines
  Coding regions on vcDNA: vcDNA=SeqID_87165; Strand=-; Position=2-184
RRKKRAGRGCTSPFCFCRNDLTLFSNGSANIPYIAYVFRVENIRAFPVLSKFGRRFRKAHC

SEQ ID NO: 160743 - protein, 153 aa, Heterodera glycines
  Homolog annotation: Hit_ID=ZP_00357698.1; Match level="QueryCoverage =32%, HitCoverage=22%, E-value=7e-12, Identity=79%"; Hit description =hypothetical protein Chlo02002738 [Chloroflexus aurantiacus]
  Coding regions on vcDNA: vcDNA=SeqID_87166; Strand=-; Position=51-512
FFFFFFFFFFFFFFFFFFFFFFFFFFFFCTLQFYCPNNLFMYNTKLDIAFVRSQLEMSADHLSTVALFTIRYEHNVSIVVRALKHGVSRMIQFRAKVEQTDGAKQTIFEPTVEADVVEHVVTDGAHLTDLGHFLQADQTNGAPVGSLHFAMNE

SEQ ID NO: 160744 - protein, 165 aa, Heterodera glycines
  misc_feature (163)..(163): Xaa can be any naturally occurring amino acid
  Homolog annotation: Hit_ID=NP_499801.1; Match level="QueryCoverage =81%, HitCoverage=45%, E-value=2e-11, Identity=31%"; Hit description =putative protein, with a coiled coil-4 domain, of bilaterial origin (32.0 kD) (3O636) [Caenorhabditis ele
  Coding regions on vcDNA: vcDNA=SeqID_87167; Strand=+; Position=74-679
MLCEEVNAMFGKRFLAGSEITVISLRANVSEAQQMTTTTATSEEEEDKTGTENTDNERSAPTMARADLIVPSYEFVRVANALCSALRAAKFWADFVDPRNGRPYRRRKNRRPAEPSLGQQSLNAENDDGPTCKIIERADWTASDFCGQLFTDCPPNSDEMQQXLS

SEQ ID NO: 160745 - protein, 241 aa, Heterodera glycines
  misc_feature (182)..(182): Xaa can be any naturally occurring amino acid
  Homolog annotation: Hit_ID=CAE69879.1; Match level="QueryCoverage =81%, HitCoverage=39%, E-value=3e-42, Identity=43%"; Hit description =Hypothetical protein CBG16219 [Caenorhabditis briggsae]
  Coding regions on vcDNA: vcDNA=SeqID_87168; Strand=+; Position=2-723
VDGTSSAAAVRDPSTVSTELAHSIDEGAEGSGEAVAVAEQPSHLAILSSTVKLMGTRRMVFFSLPFMYTGIIQSFWSSIYPTTVANTEMFQLNQGVNPKLLLALTAIVQGVGQATSGFFFGILDSRTRRFGRTKIVGFGAALQLCSFLLAYLNLPAHAPLEKTFEHGILNSPSITLALVGGXLLSFGDACWNTQVFATLIAKYPIIASQAFAVFKFFQSLLCCAAFFYATSISLPWHVLIL

SEQ ID NO: 160746 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87169; Strand=+; Position=18-434

SEQ ID NO: 160747 - protein, 252 aa, Heterodera glycines
  misc_feature (226)..(226): Xaa can be any naturally occurring amino acid
  Homolog annotation: Hit_ID=NP_495141.1; Match level="QueryCoverage =99%, HitCoverage=49%, E-value=2e-59, Identity=46%"; Hit description =cell-derived chemotaxin 2 (2G83) [Caenorhabditis elegans] gb|AAA68720.2| Hypothetical protein K05F1.5 [Ca
  Coding regions on vcDNA: vcDNA=SeqID_87170; Strand=+; Position=36-792
MCAGSGVRIDGRGQWQGYHALISSVQLFRFGGEVNAGQRIGVARDLECAGTRPKPRGDENFVRMELFREDKPIDPTHHLIDCMCTGQICETNRANALEGLPFKFDSRFNGVRGWEIVCPNVRPEEPNSSGESPEQSDDRQTMSPKIYSPIEGEVIGRVRLSASSNSQSYSGCANEGIFVVGTGKWTDYEVRIYNARFRESLALGKQHIEQGQHIGHRLDCAGEGCXQSVFMDVRFQGIVVDVSEAISAHNCK

SEQ ID NO: 160748 - protein, 55 aa, Heterodera glycines
  Coding regions on vcDNA: vcDNA=SeqID_87171; Strand=-; Position=2-166
HWFSFCSIFIIISFLSFLFHPLPNISSKFGRILPDSITKIKKNIINNECHKLFYI

SEQ ID NO: 160749 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87172; Strand=+; Position=18-434

SEQ ID NO: 160750 - protein, 213 aa, Heterodera glycines
  Homolog annotation: Hit_ID=NP_495449.1; Match level="QueryCoverage =95%, HitCoverage=51%, E-value=1e-81, Identity=67%"; Hit description =cystathionine gamma-lyase (43.1 kD) (2H346) [Caenorhabditis elegans] gb|AAB93432.1| Hypothetical protein
  Gene Ontology: Biological process=sulfur amino acid metabolism
  Coding regions on vcDNA: vcDNA=SeqID_87173; Strand=+; Position=19-657
MLPLPIGNPAGNEPEKWDMNQVVPPISLATTYKQQFAGMPKGHDYARGGNPTRDVLQQSIAALENARHCRVFSSGLSATAAMANWLHSGDHIIASDDGYGGTQRYFRQISVQHHGMELSFVDLTKLSNLEKEFKPNTKMVWFETPSNPLLKVIDIEAVCRAVQSRSKECIIVVDNTFMTPYFQRPLELGADVVMHSLTKYINGHTDVLMGAMV

SEQ ID NO: 160751 - protein, 200 aa, Heterodera glycines
  Homolog annotation: Hit_ID=AAB02615.1; Match level="QueryCoverage =98%, HitCoverage=20%, E-value=2e-98, Identity=85%"; Hit description =Na,K-ATPase alpha subunit
  Gene Ontology: Mol. function=sodium/potassium-exchanging ATPase activity; Cellular component=sodium/potassium-exchanging ATPase complex; Biological process=transport
  Coding regions on vcDNA: vcDNA=SeqID_87174; Strand=+; Position=1-600
FRRSTVPDVILFGIPLPLGTVTILCIDLGTDMVPAISLAYEEAESDIMKRLPRDPVRDKLVNERLISLAYGQIGMIQASAGFFTYFWIMADNGFLPKDLYQLRAQWDSRGINNLVDSYGQEWTYMDRKILEHTCQTAYFVSIVIVQWADLIISKTRRNSIVQQGMSNWVLNIGLVFETLLAVFLCYCPGLDKGLRMYGLR

SEQ ID NO: 160752 - protein, 210 aa, Heterodera glycines
  Homolog annotation: Hit_ID=CAE59356.1; Match level="QueryCoverage =94%, HitCoverage=54%, E-value=5e-11, Identity=28%"; Hit description =Hypothetical protein CBG02705 [Caenorhabditis briggsae]
  Coding regions on vcDNA: vcDNA=SeqID_87175; Strand=+; Position=23-652
MAEDGVLKSVIGLRIERVAELDGVAKFSPDKRIAKLPWRLEVRKSAGGGQHSPPTLAVYVWCNWANKSQCWRCKAIVKFVIKSRELDFVRNFEHIFCARQPFVNWTRLLESTAANSLRRAEDTLEIEAQISVTEIVGYGVPPKEDQLFVNGRAFDVNKYLLAAHSPYFRAFFFHDNFREYQTQTFTINDSAVDAELFGMMLECVYPECGK

SEQ ID NO: 160753 - protein, 163 aa, Heterodera glycines
  Homolog annotation: Hit_ID=EAL26247.1; Match level="QueryCoverage =76%, HitCoverage=20%, E-value=2e-10, Identity=30%"; Hit description =GA21040-PA [Drosophila pseudoobscura]
  Coding regions on vcDNA: vcDNA=SeqID_87176; Strand=+; Position=2-493
FTLAWYPAAEFLEFERINKAYSFNVPAFSVDTSTTDGPKYTQIMNALSEQLQQHVAKANLLISLNEKIPQFDVEVGEMMRIAIGRTQLLLNKRMKQFREHLSRHLKPIPGQKVTKLNDLHALWVLIDMQLDDIRSIFNSIEQFRLRCWAVAEPKAAATAASGN

SEQ ID NO: 160754 - protein, 236 aa, Heterodera glycines
  Coding regions on vcDNA: vcDNA=SeqID_87177; Strand=+; Position=2-709
EIRGRSVSDWIIEQLKITHYENIGKHRTFTVPKSEFLHDTVFRVDLFSCGIALCGIEFSGHFAGNYDLLSFDAIITDILSNEEILMQNILVDFVDNIYPTATDSLLISNAENKKHNETDGCAFSVSPSKSLSNLLLDDSPSDESADERDDQTDFCGQRQQIGDTHSHSSFVAEVVDSLQGALEDGFLRENEKAKLSGDLLNKIKLEVNASKLAYNIPAEEVPGLLFTAFLSLPGVV

SEQ ID NO: 160755 - protein, 146 aa, Heterodera glycines
  Homolog annotation: Hit_ID=CAE67929.1; Match level="QueryCoverage =96%, HitCoverage=82%, E-value=9e-36, Identity=49%"; Hit description =Hypothetical protein CBG13529 [Caenorhabditis briggsae]
  Gene Ontology: Cellular component=extracellular space
  Coding regions on vcDNA: vcDNA=SeqID_87178; Strand=+; Position=4-444
VCTDLFTEVMKKVDESGEKGEPAVKKMIIEHCKSVKGVDDKKEKLCFFIGAHPDSSTSVLGDIAKPLSFHKPPNKVCSQLKERDSQICALKYDKPIDWDSLVLEKMRVKQLKELLLKLGDSCKGCTEKVDYITRINELKPKPKGEL

SEQ ID NO: 160756 - protein, 143 aa, Heterodera glycines
  Coding regions on vcDNA: vcDNA=SeqID_87179; Strand=-; Position=76-507
MVVGWAFREQSVRLNLAKVGTVAEDGRRNELTETGEHITVHAQLAHIGRRQGPNLLGHDVPCADGLRPNDHFKGNGRVTEEATNAVQKGHDSMINVPYANAFECDESVGRRRMGKCQLFVESNTLDEQKSIFFSNDCCFCCCR

SEQ ID NO: 160757 - protein, 120 aa, Heterodera glycines
  Coding regions on vcDNA: vcDNA=SeqID_87180; Strand=+; Position=3-365
KLAFCYIQISSHILLWQLIYVAISNPTTEELSKNEDGGGNADDIQMLVEEAIDMAQNLSMIVSPKALVGRRDTAEIVAFSLFPSPFPRQLFEQAKNVQMDFNLLYFRISNDYKFLVETYE

SEQ ID NO: 160758 - protein, 99 aa, Heterodera glycines
  Coding regions on vcDNA: vcDNA=SeqID_87181; Strand=+; Position=143-442
MATKCLPLELLYEIVPLIPAENATPNALSSCRLLHKLLLPRVIKWKESIPFTGQSKYCHNFRPLSLVHNIECSFRVITVFVDGQEEASETFTGRLTRNA

SEQ ID NO: 160759 - protein, 113 aa, Heterodera glycines
  Homolog annotation: Hit_ID=CAE65849.1; Match level="QueryCoverage =81%, HitCoverage=5%, E-value=3e-09, Identity=36%"; Hit description =Hypothetical protein CBG10982 [Caenorhabditis briggsae]
  Coding regions on vcDNA: vcDNA=SeqID_87182; Strand=+; Position=219-560
LGHKTYGSIGPTQSIDLRLFCRNFIFILGSLDNVDDAQLDTVEKLLKEAENRFDSSGNEVKMRERIIQAETKAVKQKREIDTLAKELENLRQIRDSLPTRCYNYVNLEQEGQR

SEQ ID NO: 160760 - protein, 217 aa, Heterodera glycines
  Coding regions on vcDNA: vcDNA=SeqID_87183; Strand=+; Position=3-653
FFFALFVPNVFRFSAQILFFVLLLFSLGFFHHSLSHTEAPTNSLSQIICFFCLTVPLVCFFTILLWPADHVEKGQHFNKKGRIFISADCWLSVFELLPSRQLGLGIALISHRFDCYVDEHFRTRRWALEYVQIWRKKKKNGTKKMQIFKGRGGPMEIPQKSMPKKVIGFQYLLISYIDRNVIEFLRRFSSAFANCGNYLIIQINNDRLLELSLRNIW

SEQ ID NO: 160761 - protein, 100 aa, Heterodera glycines
  Coding regions on vcDNA: vcDNA=SeqID_87184; Strand=-; Position=2-301
VILVLSSNDISSGALKLFPRICRYTFLRLFSHRFVHLPNVPNPEHFVLVCGDYVLSARTLTKCQHASAMCLVQLRRLLKLFDFVGLVVPNANARLWGPRP

SEQ ID NO: 160762 - protein, 144 aa, Heterodera glycines
  Homolog annotation: Hit_ID=AAL78228.1; Match level="QueryCoverage =100%, HitCoverage=61%, E-value=5e-76, Identity=100%"; Hit description=SCN esophageal secretory protein [Heterodera glycines]
  Coding regions on vcDNA: vcDNA=SeqID_87185; Strand=+; Position=2-433
MNILLKSVLFISLLSLFGDCMKNSDQIGVKRKSAGIRIEEPNDVKGKGKVVETSRKGKEKVGEKISVMNTAERIEKMDLAQDKAKMEIDNIDTNAKPKQNEDKGVMNTAERIEKMDLAQDKAKMDIDTNGKPKQNEENAPPKYV

SEQ ID NO: 160763 - protein, 61 aa, Heterodera glycines
  Homolog annotation: Hit_ID=ZP_00340573.1; Match level="QueryCoverage =75%, HitCoverage=29%, E-value=1e-12, Identity=71%"; Hit description =hypothetical protein RakaH01001082 [Rickettsia akari str. Hartford]
  Coding regions on vcDNA: vcDNA=SeqID_87186; Strand=+; Position=1-186
PPLSLVATQEHSKETAGDKPEEGGDDVKSSWPLWVGLHTSYNGLNRGLPTREGELIPQIFS

SEQ ID NO: 160764 - protein, 216 aa, Heterodera glycines
  Homolog annotation: Hit_ID=NP_871815.1; Match level="QueryCoverage =92%, HitCoverage=57%, E-value=3e-40, Identity=45%"; Hit description =DeHydrogenase, Short chain (dhs-2) [Caenorhabditis elegans] gb|AAO38639.1| Dehydrogenases, short chain pr
  Gene Ontology: Mol. function=oxidoreductase activity; Cellular component=mitochondrion; Biological process=androgen biosynthesis
  Coding regions on vcDNA: vcDNA=SeqID_87187; Strand=+; Position=1-648
REKGLRFGHNAGISGNESWDDWLIPKDYEDVFQVNTLGTIRVTHAFKRLVKRERESRIVIMASSCGRVALPTLGPYSVSKFAVEAYADIIRTELILFGVKVAVIEPGFFRTPITNLDRGNAILEKIWARLPEITKQEYGPNFYKFCQNYLLFFLNPTRLNPPEMVVDAYWHAISSAWPRRRRQVGLDMHFFYWPVSMLCAEFQDLFFLLSTFIFRI

SEQ ID NO: 160765 - protein, 202 aa, Heterodera glycines
  Coding regions on vcDNA: vcDNA=SeqID_87188; Strand=+; Position=55-663
MPSPLTMDGTAAVPGTSQQPPFGTATDMAHFSNALQLRQLQLLQLQKQQQAAQVKKNLSFLVQQQQTVRSGEIGYFTQVMGQLTVAYNNDPIYKLCFQVPGMQAKTAYRIFQIKQFLSYFINLIPAEDLGEMNSANAFANYFNGILQNAIKEKQSQESVEEKAMITLATTIEIARSHQRCQAGILFIQQTFPEVMQHLNHSQ

SEQ ID NO: 160766 - protein, 200 aa, Heterodera glycines
  Coding regions on vcDNA: vcDNA=SeqID_87189; Strand=+; Position=3-602
GVRLRPALRPLLLPSADATFSLRGFACAKKDAAVHGGTFTVIGDKRLRVDPSQLTTKEGKAKIDALRLDAADKRLVMSVLFPNGGGINCKSSFLSRVQMPDGCDVDERVVALEGRAGQDRFGENCGQGKCAFLNVSCNFLQMTPVEGLPNARHFTMSLWKNISDDDDLLQCEWKAFIDDVVVLLNKAESGAELLVEQCWQ

SEQ ID NO: 160767 - protein, 157 aa, Heterodera glycines
  Homolog annotation: Hit_ID=AAL78214.1; Match level="QueryCoverage =92%, HitCoverage=74%, E-value=4e-39, Identity=50%"; Hit description =putative esophageal gland cell protein Hgg-20 [Heterodera glycines]
  Coding regions on vcDNA: vcDNA=SeqID_87190; Strand=+; Position=180-650
MDQIGGTFSDQIWLDTLAWIGRGEVGWHLALVNARFAALVNMQLQQRRWCLEEFHISERKPKRTGAEVLSLANNGSYFSLPLATSPLPDSVIGFNGTFNIWYLDAEVINFLQRFRRLFNTYISLKFTIPITEFRAWQAVAPHIWPLLKNGLGTLVNV

SEQ ID NO: 160768 - protein, 192 aa, Heterodera glycines
  Coding regions on vcDNA: vcDNA=SeqID_87191; Strand=+; Position=43-618
MKAHDFEKNCERSTHAQLKDREEALNRMEKRNDEMGSKVRRLKDKLNDRQALAGDEKRNVERIDKILLGAQCEDDECKKLFAQEEENRKRLDNNIVNSPERIIEELSNMEVEVEDIRRKNDQAVQNDRKLEREYGEQRVTSQCAESLINGMQQLEMMQEQMVEMRAKEEERRKQMDDLEMTRKNLVAEIEVL

SEQ ID NO: 160769 - protein, 133 aa, Heterodera glycines
  Coding regions on vcDNA: vcDNA=SeqID_87192; Strand=+; Position=3-404
AELSSILQQTHQQQQLQNAGVPLLGLPAQLLASGIENSNILQPNALRMVPGTQYAIMDGPGGAQNLILLATAASGQMNALANIEQQQHHNGGDGATTASAAAHAAMQFVGQPPDMRSLMTNGLIGANIFHNQQ

SEQ ID NO: 160770 - protein, 89 aa, Heterodera glycines
  Coding regions on vcDNA: vcDNA=SeqID_87193; Strand=-; Position=1-267
MRKSLASSELLNRGKPAQIKVLCCSCAIWSIRSKIALSSFVWRSFSSEIPSQFNCTIFLHVVPTNVVLGLFANLLASRRLMDSAVEKRL

SEQ ID NO: 160771 - protein, 52 aa, Heterodera glycines
  Coding regions on vcDNA: vcDNA=SeqID_87194; Strand=-; Position=63-221
KWGGKKSRTVGNSSNSQMDNHRPERLIFVRLIKTEHPSITTNDRHSIHSPVF

SEQ ID NO: 160772 - protein, 193 aa, Heterodera glycines
  Homolog annotation: Hit_ID=AAP30755.1; Match level="QueryCoverage =97%, HitCoverage=82%, E-value=1e-106, Identity=99%"; Hit description= putative gland protein 29D09 [Heterodera glycines]
  Coding regions on vcDNA: vcDNA=SeqID_87195; Strand=+; Position=3-581
IFFCLSSLLLSIFPIVFLVCCNAMPNFPCCPGSQQVVAVMSIYIDTFSSAADESTVCFFAKSTVDGIKNELSSRGGCQNGGEAQIVDEIDRQLKNIAKMEINYEDECPYNLGFARAMFDLAAAAAGHAGNGTEWQYMKVQFEQESQAIKAIGQEKNFEVTDVHFGVPSKGVSAHQNVPSPSHVIANPGQHSSV

SEQ ID NO: 160773 - protein, 111 aa, Heterodera glycines
  Coding regions on vcDNA: vcDNA=SeqID_87196; Strand=-; Position=60-395
FSVLLVTVPSNGSGVVYWMSSTSLCTYLLFLVAFANPPRYSTIFSCIILNRACCHCFTALFFCWCFGTVAATTTVATLFLLNLLHSISSSIYMLDQQQEKNCLRIQKKTLG

SEQ ID NO: 160774 - protein, 185 aa, Heterodera glycines
  Homolog annotation: Hit_ID=CAE70385.1; Match level="QueryCoverage =100%, HitCoverage=33%, E-value=2e-81, Identity=85%"; Hit description= Hypothetical protein CBG16947 [Caenorhabditis briggsae]
  Gene Ontology: Mol. function=pyruvate kinase activity; Cellular component=cytosol; Biological process=glycolysis
  Coding regions on vcDNA: vcDNA=SeqID_87197; Strand=+; Position=19-573
GSRVYIDDGLLSLIVEEILGDDAAILCKVENGGKLGSRKGVNLPGISVDLPAVSEKDIKDLRFGVEQGVDIIFASFIRNANGIRTIREVLGEAGKNIKIIAKIENQEGVDNVDEIIAASDGVMVARGDLGIEIPAQKVFLAQKMMIAKCNMAGKPVITATQMLESMVNKPRPTRAEVSDVANAVL

SEQ ID NO: 160775 - protein, 132 aa, Heterodera glycines
  misc_feature (18)..(18): Xaa can be any naturally occurring amino acid
  Coding regions on vcDNA: vcDNA=SeqID_87198; Strand=+; Position=231-626
KKTRRKRKMIMKKKKHKXRKEKKQKGKRKKQNKEKAVTKSRCKMKSQVKRLLSQKNHQQSHHLLLVSKRSRIKKYHQLTLWMNRMLDNRKRYSIRCQTLDTVIKYRNRIQLSEMIRSCIQLGHQCYRIRCHL

SEQ ID NO: 160776 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87199; Strand=+; Position=39-455

SEQ ID NO: 160777 - protein, 172 aa, Heterodera glycines
  Homolog annotation: Hit_ID=CAE75369.1; Match level="QueryCoverage =91%, HitCoverage=25%, E-value=1e-50, Identity=62%"; Hit description =Hypothetical protein CBG23353 [Caenorhabditis briggsae]
  Gene Ontology: Mol. function=calmodulin binding; Cellular component =membrane; Biological process=actin cytoskeleton organization and biogenesis
  Coding regions on vcDNA: vcDNA=SeqID_87200; Strand=+; Position=79-594
MNVSLSLNGLGEMPLVPIADLNGTKKYTAGEVECRNKLAALYRLIDHFRWSQSIYNHITFRLPGSDNEILINPLGMLYREITASSFAKISVDGCVIDPGSTPLGINQAGYVLHSAIHAARHDVNCVLHLHTASAAAVSAMKCGLLPIIQEAMILGPVAYHEYRGILTDVQER

SEQ ID NO: 160778 - protein, 89 aa, Heterodera glycines
  Coding regions on vcDNA: vcDNA=SeqID_87201; Strand=+; Position=2-268
PLDVLVVEISTYITCEGGDLELKRKLQEEERQAQQISQSAVISAPPSSVDDFDKEQQLKLDAKALSNTEEAIELQKQAERAKKKKKKKK

SEQ ID NO: 160779 - protein, 165 aa, Heterodera glycines
  Coding regions on vcDNA: vcDNA=SeqID_87202; Strand=-; Position=10-507
TRSQKFLVFFLIFLQFVHIFHCSTEMLSSRQLGMSRNDANGCPQLSAKCTTRPAPNAAFFGISNFLAFRKINDNLCLLNFMADVIVVVADDDNENEDASSSLLLLSESEYDKFYLPILCHLGQIFAFLNRHNSEPTTLLLGWRTTIVLLLVLVTIQTLAHFLIDG

SEQ ID NO: 160780 - protein, 90 aa, Heterodera glycines
  Homolog annotation: Hit_ID=ZP_00357698.1; Match level="QueryCoverage =64%, HitCoverage=39%, E-value=8e-18, Identity=80%"; Hit description =hypothetical protein Chlo02002738 [Chloroflexus aurantiacus]
  Coding regions on vcDNA: vcDNA=SeqID_87203; Strand=-; Position=180-452
FFFFFFFFFFLFFFFFFFFFFFFFFFFFFFFFFFFFFFFFFFFFENVKKFSADCDINCECQKKTQKKINSKNLRQIKKIGWKMGGFSIGA

SEQ ID NO: 160781 - protein, 154 aa, Heterodera glycines
  Homolog annotation: Hit_ID=AAL78214.1; Match level="QueryCoverage =100%, HitCoverage=79%, E-value=2e-85, Identity=98%"; Hit description= putative esophageal gland cell protein Hgg-20 [Heterodera glycines]
  Coding regions on vcDNA: vcDNA=SeqID_87204; Strand=+; Position=144-605
MGQINVCDDVWLDTLAWINRVEVGMKFALVNVRLNALADKHFKQRKWCFGEFHICERMTEESGAEIMTSIDGSDFSTLPLPTTPLPDSVVGFRSISIWCINEEVVNFLRTIRRLLTKDIALEFSTFFTEYRSWKVMAQHIWPLLKDGISTLCLK

SEQ ID NO: 160782 - protein, 73 aa, Heterodera glycines
  Homolog annotation: Hit_ID=AAG44847.1; Match level="QueryCoverage =91%, HitCoverage=20%, E-value=8e-16, Identity=55%"; Hit description =microsomal retinol dehydrogenase 1 [Branchiostoma floridae]
  Gene Ontology: Mol. function=electron transporter activity; Cellular component=mitochondrion; Biological process=lipid metabolism
  Coding regions on vcDNA: vcDNA=SeqID_87205; Strand=+; Position=34-255
AFLPLLKRSRGRIVSISSVAGRVSVPGGAPYAVAKYGVEAYMDAIRLELQCWGIGCSILEPGMFRTKLVISPY

SEQ ID NO: 160783 - protein, 66 aa, Heterodera glycines
  misc_feature (21)..(21): Xaa can be any naturally occurring amino acid
  Homolog annotation: Hit_ID=BAC87222.1; Match level="QueryCoverage =100%, HitCoverage=85%, E-value=8e-13, Identity=41%"; Hit description= unnamed protein product [Homo sapiens]
  Coding regions on vcDNA: vcDNA=SeqID_87206; Strand=+; Position=241-439
KYKKQVKQHKKEKKQQKQKQXKKKRRSKKKKRRKRNNKRSRKKKRSSSNSRSRKKRSMKKKEKKKK

SEQ ID NO: 160784 - protein, 115 aa, Heterodera glycines
  Coding regions on vcDNA: vcDNA=SeqID_87207; Strand=-; Position=2-346
SAHFRLLLPFGFLNFSSNLNLIILLFICFFLFVPFLLISAFYYFFIFFASFTGKWRRWGCNCPRKVSKCLDGNWRRCFLSIKASNILINFNIELLLLSLFRGVVVLGGRGSDFTQ

SEQ ID NO: 160785 - protein, 211 aa, Heterodera glycines
  Homolog annotation: Hit_ID=AAL78228.1; Match level="QueryCoverage =100%, HitCoverage=90%, E-value=1e-109, Identity=94%"; Hit description=SCN esophageal secretory protein [Heterodera glycines]
  Coding regions on vcDNA: vcDNA=SeqID_87208; Strand=+; Position=2-634
ILLKSVLFISLLSLFGDCMKNSDQIGVKRKSAGIRIEEPNDVKGKGKVVETSRKGKEKVGEKISVMNTAERIEKMDLAQDKAKMEIDNIDTNAKPKQNEDKGVMNTAERIEKMDLAQDKAKMDIDTNGKPKQNEENAPPKYVFIWSGNNEKKNLEVDLRVIRHSKKLSELFHAKSDQSVNAKHGKQEALPVPKQEAKKMLKEVEEWYAHHK

SEQ ID NO: 160786 - protein, 207 aa, Heterodera glycines
  Homolog annotation: Hit_ID=CAE56729.1; Match level="QueryCoverage =97%, HitCoverage=61%, E-value=8e-50, Identity=51%"; Hit description =Hypothetical protein CBG24516 [Caenorhabditis briggsae]
  Gene Ontology: Mol. function=protein binding; Cellular component =mitochondrion; Biological process=steroid metabolism
  Coding regions on vcDNA: vcDNA=SeqID_87209; Strand=+; Position=72-692
MKIQAGHRYEIGDQTGKTYIVTGATSGIGKTIATELAMKNAEVVMACRNRNKCLEVRRDIVLNTRNKKVFCRMCDLSDMESVHEFVRKMTKGKYDFKKIDGVILNAATKSKKYSTNKDGVETNLATNHLGSFLLVGLLLQKLLDQDGQSRIVFVGTDIATKNSLKLELDKLNTAKYTNKFLRSTEKLDIEKCKYDMHGAYKFSKLTQ

SEQ ID NO: 160787 - protein, 190 aa, Heterodera glycines
  Coding regions on vcDNA: vcDNA=SeqID_87210; Strand=+; Position=7-579
KTRVQTVHISGEYYEHKLCIPMHSLAFSERSDEFFDIWDVNESVIYAVKTAEERGRAKWLQRLTKITLLYEQKMAESAQEGIPMEPFPPWHSKNNDSSATNNKSSRPQSWTTTSSSEDGGAGTAPSAAGVLSDRSSTASSYSTTVEEKCAQSQGENSAEKNGGRDTQKKKRTEDKPTNSRGREAQQKDDG

SEQ ID NO: 160788 - protein, 134 aa, Heterodera glycines
  Coding regions on vcDNA: vcDNA=SeqID_87211; Strand=+; Position=204-605
WKKTTGGSLQIVLKSILCAMAPLLRIGLFAVDIFAIIGSHFYAHLSSDSSLSVITKSPDFNDAAEFVATFKSMTDASADVLDKISNIGNGAFTLLKFAGPIGQMVHIGLSIGLKQQDSPELRAIQALQRQITEQ

SEQ ID NO: 160789 - protein, 197 aa, Heterodera glycines
  Coding regions on vcDNA: vcDNA=SeqID_87212; Strand=+; Position=2-592
ENVGQNDVEQLRSCTNFAERVSISEPSDGAETVGRWTQCPSKGMPTAFTDDASVAGEFGMEAANVGQFGKISKECPLSVGEKIGLRVAIRVQQKPQTFYFLFLYFDQNGRSRQFRFSARVRPLSRIFDADHCVLSGSIGLSMLTLRCLPFNSHESDATAKATTAVTLTKLDLLRLSVKVTDGNARTNVRRVENEPIQ

SEQ ID NO: 160790 - protein, 189 aa, Heterodera glycines
  Homolog annotation: Hit_ID=EAL47348.1; Match level="QueryCoverage =82%, HitCoverage=93%, E-value=2e-35, Identity=47%"; Hit description =ubiquitin-conjugating enzyme, putative [Entamoeba histolytica HM -1:IMSS]
  Gene Ontology: Mol. function=ubiquitin-protein ligase activity; Cellular component=endoplasmic reticulum; Biological process =conjugation with cellular fusion
  Coding regions on vcDNA: vcDNA=SeqID_87213; Strand=+; Position=82-648
MSSSHRETGRSPRSVLMRQYEMLLQNSNDNSGFRAWFDNNNLFKWRILIDGPPGTPYAGCKLTALLHFPASYPNDPPTMTFLTDILHPNIDQSGKVCISILHAPGIDPLGHEQPSERWNPNRSVESILVSIQVLLAEPNFNSPANVDAAILFRNDPAQYRKEVRRRVERASASTPRAMSSSTPPPVAQP

SEQ ID NO: 160791 - protein, 98 aa, Heterodera glycines
  Coding regions on vcDNA: vcDNA=SeqID_87214; Strand=+; Position=23-319
MSFAYGKSIQQNGGPNRVTFILRKGAIFFTGMVVGTVVVFKAFKPTRPFDEAAERGKRELLEKYTEEYNALQEELRQAEEQQRNGGMSKRRKRERLSR

SEQ ID NO: 160792 - protein, 119 aa, Heterodera glycines
  misc_feature (33)..(33): Xaa can be any naturally occurring amino acid
  Homolog annotation: Hit_ID=NP_105252.1; Match level="QueryCoverage =99%, HitCoverage=16%, E-value=2e-21, Identity=42%"; Hit description =hypothetical protein mll4364 [Mesorhizobium loti MAFF303099] dbj|BAB51038.1| mll4364 [Mesorhizobium loti
  Coding regions on vcDNA: vcDNA=SeqID_87215; Strand=+; Position=1-356
RLVFIAAILCLLGSLVATRLFQKLRFAEKAGVXAWAFMGAIATGATIWCTHFVAMIAYQPGVDVTYEPGLTGVSLGIAICGSALALWFGSRQMRFAAPIGGVLFGLAVTLMHYIGMKAF

SEQ ID NO: 160793 - protein, 193 aa, Heterodera glycines
  Homolog annotation: Hit_ID=AAV68500.1; Match level="QueryCoverage =97%, HitCoverage=42%, E-value=2e-28, Identity=35%"; Hit description =SAP-97B [Danio rerio]
  Gene Ontology: Mol. function=protein binding; Cellular component =cytoplasm; Biological process=learning
  Coding regions on vcDNA: vcDNA=SeqID_87216; Strand=+; Position=26-604
HSSGPYIRVTDIAPGGGVARDGRIRIGDVILKVNNTDTVDVPHQVAVNALKVAGSVVRLLIKRPKTSQASAFRPSSAEPLSRGSPPEGFGFGPPPPVPTHQQSFGESEAVKELEQMPGVRRMDLIKVESDGIHKGLGFSIAGGTGNQHYPGDDGIFVTRIIKGTPAYYDGRLQKGDQILAVDNTIFKNVSHQF

SEQ ID NO: 160794 - protein, 189 aa, Heterodera glycines
  Homolog annotation: Hit_ID=AAP06023.1; Match level="QueryCoverage =73%, HitCoverage=80%, E-value=7e-10, Identity=28%"; Hit description =similar to NM_003197 transcription elongation factor B polypeptide 1- like [Schistosoma japonicum]
  Gene Ontology: Biological process=reproduction
  Coding regions on vcDNA: vcDNA=SeqID_87217; Strand=+; Position=41-607
MSNNENENVMNGEAVGGVEIKVEANEEVNTESQEDGEEAKIPQFSKEQMERSVMCCTNEGEIVNAPWHLMAQSKTFMQMWESLDMEEKTQEDFTDFVFPLNDITSDCFQQILAWMREHHNLPEPIVKEDPVTQERIWFKFTDWERQFFDVDFERVKEYFLASNFLDIRSLYLYCAQECARCIMDKSAED

SEQ ID NO: 160795 - protein, 198 aa, Heterodera glycines
  Coding regions on vcDNA: vcDNA=SeqID_87218; Strand=+; Position=2-595
FLMFNFFYFFAHKNVLLLNFLLFSFIGSFCALKATTHLNFSPIVSELALKIVEECLDEYGQLVETRPFIKRISSPETSPDSEMENDEQNEFKYLWVVFHSLLKKVLLHNTTKNYVQIAMSCKKWSKNDGKESFLSPFCDFVKCFTFVKWLFVQLKRTSKLDTSELERAQEMFRTMRSAYKIGREEAIQTGKNGLNAER

SEQ ID NO: 160796 - protein, 168 aa, Heterodera glycines
  Homolog annotation: Hit_ID=1NEX; Match level="QueryCoverage=91%, HitCoverage=88%, E-value=4e-18, Identity=33%"; Hit description=Chain C, Crystal Structure Of Scskp1-Sccdc4-Cpd Peptide Complex pdb|1NEX|A Chain A, Crystal Structure Of Scskp1-
  Gene Ontology: Mol. function=protein binding; Cellular component=SCF ubiquitin ligase complex; Biological process=G1/S transition of mitotic cell cycle
  Coding regions on vcDNA: vcDNA=SeqID_87219; Strand=+; Position=78-584
MLQREVFCECLGGERVSVRASLMFQSQTFANMWKSLNVDTNELPDDFVFPMTSVAVPVFKKIINWMESHVGQQVPEFEEDPNTRERKWFVQTDFEKDFFKVEVEELVDFLNASNFLNLQSLYRHSCQAMAALPKDRSPEEIRDLLGIEDDLTEEQKAEIRRKNVWCNY

SEQ ID NO: 160797 - protein, 216 aa, Heterodera glycines
  Homolog annotation: Hit_ID=AAL78214.1; Match level="QueryCoverage =79%, HitCoverage=90%, E-value=4e-19, Identity=30%"; Hit description =putative esophageal gland cell protein Hgg-20 [Heterodera glycines]
  Coding regions on vcDNA: vcDNA=SeqID_87220; Strand=+; Position=45-692
MSSEILWSTVFLLLVDCATILFWFFFGHVKKRRRPHKNEIFICGDCWLLVFDFLAPSQLGLEIALVNRRFNCIVDEHFKTRKWKLGCMRICHKIGENGTKQLQIVNSDAKPLPIPQNPLPNKVLGFRHIQIYYIDQNVIAFLRRFHRRIFDVCSMVLYIHTDNDRILDYFLLNIWPMFRHSMRLMNLNSISLRRLRQLAGPSLLSDCPSLRVSFNE

SEQ ID NO: 160798 - protein, 165 aa, Heterodera glycines
  Homolog annotation: Hit_ID=NP_502699.1; Match level="QueryCoverage =89%, HitCoverage=13%, E-value=1e-19, Identity=39%"; Hit description =no mechanoreceptor potential A (81.7 kD) (4O859) [Caenorhabditis elegans] emb|CAB05199.1| Hypothetical pr
  Coding regions on vcDNA: vcDNA=SeqID_87221; Strand=+; Position=52-549
SNCLDSGTNELFMSHGRRKRRNIGGQQLLAQQQQHEQQTEETLSAIIRVLAEGEHEEEVERFYNRTASSISNIDGGPSVPFSYKIAGNGTQHRQNHRRKNHRQEVQRESISPGYVCLSDSWFISTVVSMSMVCLMLSALIVIWGCHSLRKSNAPPEANGAKCQKC

SEQ ID NO: 160799 - protein, 104 aa, Heterodera glycines
  Coding regions on vcDNA: vcDNA=SeqID_87222; Strand=-; Position=3-314
SGRPPFCVGCFSSRNFLPLLLALPAFVVCFPCRLAFWQFRAFKTPSKAAAVGQAMMKNGPSLGPITVKKWRQSLCASCCSRRTTNHHSSRSEHQVGPLEGAHRK

SEQ ID NO: 160800 - protein, 164 aa, Heterodera glycines
  Homolog annotation: Hit_ID=AAL78214.1; Match level="QueryCoverage =75%, HitCoverage=63%, E-value=1e-14, Identity=36%"; Hit description =putative esophageal gland cell protein Hgg-20 [Heterodera glycines]
  Coding regions on vcDNA: vcDNA=SeqID_87223; Strand=+; Position=42-533
MPSKIRWRAVPLLLVDCGASILWFFFDRVKKRRRPPKKEIFICADCWLLVFDFLAPSQVGLEIALISRRFDFYVDEHFKTRKWMLNKQLLITWKIVGNGPKQMQIDDADGNPLPIPRNPLPNKVIGFRRIQIIYIDQNVIEFLHRFHRLFGTCATALDITTENV

SEQ ID NO: 160801 - protein, 111 aa, Heterodera glycines
  Coding regions on vcDNA: vcDNA=SeqID_87224; Strand=+; Position=3-338
HKKRRRTNSACRRRTNLVKRERRPRIARSTGPLMEERKAAEAGLGRTRICSNPPRRMRAAPLRQRSSRARRRTKQPETHLPPPKKRPMKNRRSRRRRKQPETHLPPPKKRP

SEQ ID NO: 160802 - protein, 195 aa, Heterodera glycines
  Homolog annotation: Hit_ID=AAR35032.1; Match level="QueryCoverage =68%, HitCoverage=68%, E-value=8e-35, Identity=55%"; Hit description =SXP/RAL-2 protein [Meloidogyne incognita]
  Coding regions on vcDNA: vcDNA=SeqID_87225; Strand=+; Position=2-586
GCFLVLRFVLPSPLFLLSLSSFVFCHFRPHFPPFLQKASVEQRRQYNRIVTSQNDTKAQINSNVQNWASNAGVASDYNNFTSEQQQRSQQFHDAVSGNLTGQALQLFNNLWSIRQNDQITRLAECQQIRAALNATGRDHVLHLLVPIPPPSIVGPPPSGCFPRPPYSKPFGGGFGPKSGGAAIPGRGGPQTPERR

SEQ ID NO: 160803 - protein, 227 aa, Heterodera glycines
  Homolog annotation: Hit_ID=NP_502164.1; Match level="QueryCoverage =92%, HitCoverage=34%, E-value=2e-62, Identity=59%"; Hit description =white family member (67.1 kD) (4M237) [Caenorhabditis elegans] emb|CAB05682.3| Hypothetical protein C10C6
  Gene Ontology: Mol. function=xenobiotic-transporting ATPase activity; Cellular component=mitochondrion; Biological process=transport
  Coding regions on vcDNA: vcDNA=SeqID_87226; Strand=+; Position=2-682
RDALTLDYGLGRIRRRRSNYGAMSPTKSVQEVQPVALSWHGLTAVHAKSGRKILDNVPGMADAGQLVALMGASGAGKTTLLNTLLNRNLKSLSVEGQVLVNGHSLGRSITYVSGYVQQDDLFMGTLTVKEHLMAQAQLRMVGHSKRTMRRRVNEIIDELGLQECRHARIGFSGVKKGISGGEARRLLFASELLNNPQIIFADEPTTGLDSSMAESVISVMRALTLSG

SEQ ID NO: 160804 - protein, 194 aa, Heterodera glycines
  Coding regions on vcDNA: vcDNA=SeqID_87227; Strand=+; Position=5-589
MAHIIVVNKFQDRTMIRGTTLGQNMYKIGGEEAVPVREALVIYMQQKNAKTCRAAEYVPKKAAIGCTGDELDLLSLLIKGDRSKTIGEDGFDLELFDQDDNNNNDGEEQGVNKGKTTTAPQKAKRTPSQPKESSLSKAMKEMDLDRSKQTPSSTEKPPSRKGSRKGAHLLEMMDQETAAPKTTQARKGSVKRGN

SEQ ID NO: 160805 - protein, 96 aa, Heterodera glycines
  Coding regions on vcDNA: vcDNA=SeqID_87228; Strand=+; Position=1-291
PGRLWSVEARSEHSKALFRRALALNRMGLKGRARDYASRCAKLVGGGDSGLKELLDTLRDENDAPLIDLTVFHRSEALQSQRLLTKKGIILCKGKC

SEQ ID NO: 160806 - protein, 109 aa, Heterodera glycines
  Homolog annotation: Hit_ID=AAL78226.1; Match level="QueryCoverage =61%, HitCoverage=55%, E-value=4e-28, Identity=98%"; Hit description =hypothetical protein Hgg-17 [Heterodera glycines]
  Coding regions on vcDNA: vcDNA=SeqID_87229; Strand=+; Position=293-619
MNFLNEQIREYSERTKDREEFKGIIEARNKLETAIKPLHGVMESDMASSSLETSMTNSANIARQALEELPVKQVRQMEQIAEEGKSKTVEEHERALREYAEKNSESVKN

SEQ ID NO: 160807 - protein, 99 aa, Heterodera glycines
  Coding regions on vcDNA: vcDNA=SeqID_87230; Strand=+; Position=1-297
HPRPSASMQMLRSLLFAAAFASLLINCYEARTIRLANIFLCANSGFTVEESLTFFEANNIEVKGEDISNTQTEPVPIVLVTANVEFDVVFHTNSKDCKE

SEQ ID NO: 160808 - protein, 147 aa, Heterodera glycines
  Coding regions on vcDNA: vcDNA=SeqID_87231; Strand=-; Position=155-598
RAFAVGVRRWFWPRTQIVAQMLSGTEMPSLCWWCCSSVAPANRRSDWRWELGLKNCVLWCQFKSDHLAGIQIVYFSSHYWRVFDQFPKRTLRIRLFVYVRTGTNMWQKRGEVLSRLLNTTVAVVRTAEIEKSDEIVASQQKNMSSES

SEQ ID NO: 160809 - protein, 70 aa, Heterodera glycines
  Coding regions on vcDNA: vcDNA=SeqID_87232; Strand=+; Position=135-347
NGNWHCTFFAIASYFSAAHQCFIPLFGMKFLNIQLIHLIFNLKNSFKLIQNFRPCLTGGFTQSHALWAVF

SEQ ID NO: 160810 - protein, 202 aa, Heterodera glycines
  Coding regions on vcDNA: vcDNA=SeqID_87233; Strand=+; Position=1-606
SFPCRQFPCFPMDLALFHCKMIDTLVILHRLNGLQHPPFCSSPVILASFRSTPMPTLSLGSSITQNLSIASNHLATFAYDGHFVFVINAFNGTLKTEPLRFSERQKEVVAVGEGGNVLFVGISERGALSVLTPNSPQTIGHSAELPKQKGTAFSHLMAANGRTTKRSGEQSEERGGRTNHAVVLLEMPSIKQFIDGPAHSLP

SEQ ID NO: 160811 - protein, 140 aa, Heterodera glycines
  misc_feature (21)..(21): Xaa can be any naturally occurring amino acid
  Homolog annotation: Hit_ID=AAP30836.1; Match level="QueryCoverage =97%, HitCoverage=82%, E-value=6e-67, Identity=95%"; Hit description =putative gland protein G30C02; Hg-G30C02 [Heterodera glycines]
  Coding regions on vcDNA: vcDNA=SeqID_87234; Strand=+; Position=1-419
TFQFLLLFSACCYLQRKEVYXSPKKTERKIHRAANKKHKEETEGMAEVALFQMAMACMANLMDFQMADLAAPVSIQIAAGRIAFQMVDLAAPVAFHRWDITRADSTALGPAHLLEATDTEAVLVEENEKKTESDRRENDS

SEQ ID NO: 160812 - protein, 155 aa, Heterodera glycines
  Coding regions on vcDNA: vcDNA=SeqID_87235; Strand=+; Position=3-467
PYLYLTNEAMEKTEKEHKEKDSAEANSDTTNANSLDKEKQPSAPIQLGNKRKLGDGVIIDNGEEYLMKLSTHNSEEPVDNGNVSYVSSFSSRSSTTTMSSVEDEEDSGTNAGDDGWMVVKKESFKKLCDFYEKRRRVECGGGTVAADPFAEQLER

SEQ ID NO: 160813 - protein, 221 aa, Heterodera glycines
  Homolog annotation: Hit_ID=NP_505849.1; Match level="QueryCoverage =86%, HitCoverage=24%, E-value=6e-14, Identity=31%"; Hit description =beta-galactosidase (5L700) [Caenorhabditis elegans] emb|CAA98542.1| Hypothetical protein T19B10.3 [Caenor
  Coding regions on vcDNA: vcDNA=SeqID_87236; Strand=+; Position=1-663
VIDEAGLIPPLYGRIRNWIGAKKDWPNPPLPLPKNRTGVSIQNVFAVKLGDFIALTNSSSLSSSDSRQRCIHSSDGPLNFEAFYRDHGFVWYSASLETDGKTLEVPELRDHAYVFLDGIFQGNLSVNDKTGGQMKMELKGGGKRGQRMDILVENIGRLTYPLTKTDPKGLFSPPFIDGKVISKRWIQCGVNLDNVYAEIEKRMAKSKNRKEPTDTIRSALL

SEQ ID NO: 160814 - protein, 72 aa, Heterodera glycines
  Coding regions on vcDNA: vcDNA=SeqID_87237; Strand=-; Position=98-316
MAQRHAQCRVRHALPHRIQYQNSSTHAERFGQCPTDSPRLHAMVVSAAVVAQHFHFHFRCYWLRWLCCCRCC

SEQ ID NO: 160815 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_87238; Strand=+; Position=13-429
MPNIFKILLIVLLAVVSFRLSASTGDKKTANDGSGNNSSFGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160816 - protein, 53 aa, Heterodera glycines
  Coding regions on vcDNA: vcDNA=SeqID_87239; Strand=-; Position=1-159
VRADQSVPFGRINGPSFSLCATFVSVLPCSLCVSLPPRLSLSILVFHFVSLRR

SEQ ID NO: 160817 - protein, 102 aa, Heterodera glycines
  Homolog annotation: Hit_ID=NP_956841.1; Match level="QueryCoverage =81%, HitCoverage=27%, E-value=1e-12, Identity=43%"; Hit description =purine-rich element binding protein B [Danio rerio] gb|AAH56517.1| Purine-rich element binding protein B
  Coding regions on vcDNA: vcDNA=SeqID_87240; Strand=+; Position=6-311
MPSSSGSEKGNGRFGVRGEEEVKGGKEIASKTLNIQSKRFYLDVKQNDRGRFVNLVVVAMNGRMNRLFMSMRICKNIKELLGKFEGHVPASEEVNGKAENVT

SEQ ID NO: 160818 - protein, 113 aa, Heterodera glycines
  Coding regions on vcDNA: vcDNA=SeqID_87241; Strand=+; Position=47-385
RCSSDASTSTSNSSCWWMKSARTPIGLLKLSEAMHKVTTHFVTLEKANDVVRKNQRQTLENILNKLNMKNFGLNYVPVMEPSACRRFSLENGNVLVIGYDVNHPAPMPQQTRR

SEQ ID NO: 160819 - protein, 196 aa, Heterodera glycines
  Homolog annotation: Hit_ID=EAA58591.1; Match level="QueryCoverage =89%, HitCoverage=39%, E-value=7e-29, Identity=41%"; Hit description =hypothetical protein AN6773.2 [Aspergillus nidulans FGSC A4] ref|XP _410910.1| hypothetical protein AN6773.
  Coding regions on vcDNA: vcDNA=SeqID_87242; Strand=+; Position=1-588
DLAALPTVTTFLVPSHAHRDRVVTISSPENSNFIQCAPSYAFRKTGVLEIANFEPRWEQMLYTLFLAEGWIVNAPDHEGPESAFSAGRFGGHMVLDSMRAANNFKPLQLSKRPMHIGHGYSGGSTPNGWAASLHETYANELNVVGWSLGGSMTDPLYTLNSLDGKPTSSLVVAGAIGLMDAYRDEVGNLPDDDVWT

SEQ ID NO: 160820 - protein, 59 aa, Heterodera glycines
  Coding regions on vcDNA: vcDNA=SeqID_87243; Strand=+; Position=44-223
WKFARERKIWRGQSAWRRPAAILLTPMRRCRQHSASADRRERKNSNPFIRLSLITLGVK

SEQ ID NO: 160821 - protein, 127 aa, Heterodera glycines; identical to SEQ ID NO: 158789
  Homolog annotation: Hit_ID=AAP30766.1; Match level="QueryCoverage =100%, HitCoverage=100%, E-value=4e-68, Identity=100%"; Hit description=putative gland protein G30D08 [Heterodera glycines]
  Coding regions on vcDNA: vcDNA=SeqID_87244; Strand=+; Position=30-413

SEQ ID NO: 160822 - protein, 225 aa, Heterodera glycines
  misc_feature (12)..(12): Xaa can be any naturally occurring amino acid
  Homolog annotation: Hit_ID=NP_508927.1; Match level="QueryCoverage =99%, HitCoverage=20%, E-value=6e-98, Identity=73%"; Hit description =dihydropyrimidine dehydrogenase (XG89) [Caenorhabditis elegans] gb|AAK39195.1| Hypothetical protein C25F6
  Gene Ontology: Mol. function=dihydropyrimidine dehydrogenase activity; Cellular component=cytoplasm; Biological process=uracil catabolism
  Coding regions on vcDNA: vcDNA=SeqID_87245; Strand=+; Position=3-676
LGGDIAGVAETXVESVNDGKTAAWHMHRYLQKLQGYQIERVPKLPLFHTPIDYVDLSVQLCGLRFEHPFGLASAPPTTTGAMCRRAFEQGWAFVLTKTFGMDKDLVTNVSPRIVRGTTSGPIFGPGQGSFLNIELISEKSAEYWLTCVKELKRDFSQKIVIASIMASFNQQDWEFLASRSEEADADALELNLSCPHGMGERGMGLACGQNPEMVKQISEWVRSAV

SEQ ID NO: 160823 - protein, 200 aa, Heterodera glycines
  Homolog annotation: Hit_ID=CAI21055.1; Match level="QueryCoverage =97%, HitCoverage=36%, E-value=4e-27, Identity=36%"; Hit description =novel protein similar to human and mouse BTB (POZ) domain containing 3 (BTBD3) [Danio rerio]
  Gene Ontology: Mol. function=protein binding
  Coding regions on vcDNA: vcDNA=SeqID_87246; Strand=+; Position=1-600
LELNGDNLFAVLYAAKKYGVVGLVKACVNYPKLDPTNVFLVLAQARFYEEEDLSRRCWEYIDLFVGAVLFSKEFLQMEHKLLCEILDRDQLIISGEIVIWNAVLRWSDEQLRQKGKECSVENRRKMLGPAFFKVRIPLIPMQDFAEKLVPSGMLNKDELISVYLFHSHPARALPELYPLQFPTQRRAQPKSHREQLQKPT

SEQ ID NO: 160824 - protein, 33 aa, Heterodera glycines
  Coding regions on vcDNA: vcDNA=SeqID_87247; Strand=-; Position=1-99
PLVTKRTLPRSNSHVPCAPSPPGHSLRLPFALL

SEQ ID NO: 160825 - protein, 148 aa, Heterodera glycines
  Homolog annotation: Hit_ID=AAP30774.1; Match level="QueryCoverage =100%, HitCoverage=80%, E-value=4e-80, Identity=99%"; Hit description= putative gland protein G30E03 [Heterodera glycines]
  Coding regions on vcDNA: vcDNA=SeqID_87248; Strand=+; Position=31-474
MASSFCSSIISIVAIVCLLCKCCFSAPHPCCPGSQHVVSMMKDHTGTFSASMPKSSLCLSAERVAAAVENQLKTIWCPGNGGQTLINEINAAQSSSDECARSLGFIRAMFEIAASAASHAGANAELANLAVQLREQVGTIDTNCAALG

SEQ ID NO: 160826 - protein, 174 aa, Heterodera glycines
  Homolog annotation: Hit_ID=NP_510032.1; Match level="QueryCoverage =97%, HitCoverage=60%, E-value=2e-62, Identity=68%"; Hit description =reductase (29.2 kD) (XM767) [Caenorhabditis elegans] emb|CAA91943.1| Hypothetical protein M153.1 [Caenorh
  Gene Ontology: Mol. function=pyrroline 5-carboxylate reductase activity; Biological process=proline biosynthesis
  Coding regions on vcDNA: vcDNA=SeqID_87249; Strand=+; Position=7-528
MLSETVKIGFIGAGKMAQALARGLINSGRYPAENLMASCPKTDESLLEQCKKLGIGTTIDNTRIARENDVIILAVKPMNISKVTSEIAPNFRREHLLISIALGITLRYIEQLLPSKSRVVRVMPNTTAVVGAGASAYSMGSACQDGDSKVVQDLLSTVGYSVEVPEIHLDPITG

SEQ ID NO: 160827 - protein, 122 aa, Heterodera glycines
  Coding regions on vcDNA: vcDNA=SeqID_87250; Strand=+; Position=95-460
SATTFWWTFSLILTVLSSDSNWHMLSPRFEALVDKYFDGKSELTLWRTISAHMDTEAGKAQLYANNTVTFPLPERPLPRKIRFQALEILYIDHSVIEFLCANNQIFDNKGTNLVFKLSSYLA

SEQ ID NO: 160828 - protein, 199 aa, Heterodera glycines
  Homolog annotation: Hit_ID=EAA10559.3; Match level="QueryCoverage =88%, HitCoverage=52%, E-value=1e-17, Identity=38%"; Hit description =ENSANGP00000021579 [Anopheles gambiae str. PEST]
  Gene Ontology: Mol. function=structural molecule activity; Cellular component=nuclear speck; Biological process=cell adhesion
  Coding regions on vcDNA: vcDNA=SeqID_87251; Strand=+; Position=46-642
MVVPPAPQIPKKIAEEHKKNGTQPQKEESKKDIGKKKQPQMAERRESSGYSGKRGRGSGMSRESSKRAQGNSRKRGRERSRESSGDKGRKTMRRSSRSRSVKRRRRDSSSSSYSSTSRSRSRSRSYRRSPKRSPARDRCRDRTRRSTSNSSRSSSSSSASSSSQYSSSERSHSQSRSFTSDRDEEEERIRDRIIARTLS

SEQ ID NO: 160829 - protein, 67 aa, Heterodera glycines
  Coding regions on vcDNA: vcDNA=SeqID_87252; Strand=+; Position=148-348
HNDDYYLREGEGHRRRLLNQTEEGRRTDENHSDDSSIRGKARENRRQTNQQHHQPNLEFLPVCATGQ

SEQ ID NO: 160830 - protein, 85 aa, Heterodera glycines
  Coding regions on vcDNA: vcDNA=SeqID_87253; Strand=+; Position=3-260
ALLAEKEGGNEERKQRAEELRKRTTELLAKIKRSREEKISLIERADSLDVELNNFHTSIEELIDQIDQVTSEIDRRVEFHATCDA

SEQ ID NO: 160831 - protein, 160 aa, Heterodera glycines
  Homolog annotation: Hit_ID=NP_506352.1; Match level="QueryCoverage =93%, HitCoverage=95%, E-value=3e-47, Identity=60%"; Hit description =transthyretin-like protein precursor family member (17.8 kD) (5O10) [Caenorhabditis elegans] emb|CAB01136
  Coding regions on vcDNA: vcDNA=SeqID_87254; Strand=+; Position=25-507
MLLLRQLCLLLFAVFYLIDARTQSVAVKGRLLCGTAPARNVRVKLYDEDAGVDPDDQLDAGYSDPNGNFQLSGHTSELTDIDVVFKVYHDCDDGIKPGSRKLKFKIPNSYVTDSATPKKTFDIGVLNLETVFKDEERELIVTMKKERRSHRYQDFLDILP

SEQ ID NO: 160832 - protein, 86 aa, Heterodera glycines
  misc_feature (6)..(6): Xaa can be any naturally occurring amino acid
  Coding regions on vcDNA: vcDNA=SeqID_87255; Strand=+; Position=16-273
MPSFWXAQADFALNLMRELSKNGNSCIVSPFSVAIALSMVYVGAKEKTGKEMGQLLAKGAPEAEMHKYFGALLNAIKNGQNNYTFG

SEQ ID NO: 160833 - protein, 89 aa, Heterodera glycines
  Coding regions on vcDNA: vcDNA=SeqID_87256; Strand=+; Position=212-478
RRRPWNSREDGRGGEAQEKRAGPKEPSSKRKRLRKAVKIQLKRKRTKSQATKELILNAREVIPFGDRVDAPPTFTSELARTIRPLHERA

SEQ ID NO: 160834 - protein, 192 aa, Heterodera glycines
  Homolog annotation: Hit_ID=EAL35528.1; Match level="QueryCoverage =26%, HitCoverage=3%, E-value=7e-10, Identity=64%"; Hit description =hypothetical protein Chro.20329 [Cryptosporidium hominis]
  Coding regions on vcDNA: vcDNA=SeqID_87257; Strand=+; Position=1-576
RKCPSAKGLMCECHYGEKGQDMGNEPFVLLPIPNGLMCKLGQFDVNGIGSLLEGKCLHNDHYCFMARCNKGNKYFKTEWGCAVSQDRVSINQQIGETVKAVVACEAMFGQKDVAFSNENFTIDMLDVETSTTTTTTTTRQLEVITTAQPTTTTSSSTTTTTTTTTTTKPTIEESTNSTNGGNIVCVHHTSIS

SEQ ID NO: 160835 - protein, 80 aa, Heterodera glycines
  Homolog annotation: Hit_ID=NP_496273.1; Match level="QueryCoverage =100%, HitCoverage=10%, E-value=4e-29, Identity=77%"; Hit description= transitional endoplasmic reticulum ATPase TER94 (89.8 kD) (2K850) [Caenorhabditis elegans] emb|CAA90050.
  Gene Ontology: Mol. function=ATPase activity; Cellular component =cytosol; Biological process=microtubule cytoskeleton organization and biogenesis
  Coding regions on vcDNA: vcDNA=SeqID_87258; Strand=+; Position=2-241
TVGFSGADITEICQRACKLAIRESIEKAVAIEKDRQAKEQRGEEVMDVAEDPVPQLTRKHFEDAMKFARRSVSDNDIRKY

SEQ ID NO: 160836 - protein, 205 aa, Heterodera glycines
  Homolog annotation: Hit_ID=NP_499625.2; Match level="QueryCoverage =95%, HitCoverage=38%, E-value=3e-29, Identity=34%"; Hit description =CD36 antigen family member (60.2 kD) (3N544) [Caenorhabditis elegans] emb|CAB11566.3| Hypothetical protei
  Gene Ontology: Mol. function=transporter activity; Cellular component= plasma membrane; Biological process=apoptosis
  Coding regions on vcDNA: vcDNA=SeqID_87259; Strand=+; Position=3-617
FLLLCQWCSVIALLIFGIICLCFGVFSLIFVPKLVNKAIRENVFVGRFPNGSDNFAMEQYRDPIYDVKMQIWVFSVQNPNEIVNKGEKANVTELGPFTYDIRMHKNNVKFGSNDSRLFYRNVKSFFFNPHLSCSECNLSSSVVVPNIIFQKLVHACGNNTFLIPFIEPFLMNKEKVFVSVTLDELLFQGYEDKFVNDICSNPLTK

SEQ ID NO: 160837 - protein, 115 aa, Heterodera glycines
  Coding regions on vcDNA: vcDNA=SeqID_87260; Strand=-; Position=1-348
HRMAITTHGILQRLVTARNSAGEVVAAHGAIGVVADPAIQAAAMERMGAAENSPRDGDRRSHADGTSLAPLRFSCRPARPTAALLRLASRSFALALRALAENEGYDVCDVMVRRF

SEQ ID NO: 160838 - protein, 197 aa, Heterodera glycines
  Homolog annotation: Hit_ID=CAE68631.1; Match level="QueryCoverage =78%, HitCoverage=33%, E-value=2e-10, Identity=26%"; Hit description =Hypothetical protein CBG14519 [Caenorhabditis briggsae]
  Coding regions on vcDNA: vcDNA=SeqID_87261; Strand=+; Position=3-593
GFVEEEGRETILDNHRQIHQNRRAPSICGSKALDCPPKSHYICALKATKLSLKNFSLSVAAFTLLKVFNSLSRSNTKTPRVVSSNKSIRKLFELLRVPTFIGTLPLLCQFSQCFCAHFFPTKSVTICRPIGVGISATVAMAFLWPNNTLALYAFWKMVEFAFFRLADVGTLPVLPWADALLFSVLSSYLLGLAVLEP

SEQ ID NO: 160839 - protein, 190 aa, Heterodera glycines
  Homolog annotation: Hit_ID=NP_492730.2; Match level="QueryCoverage =89%, HitCoverage=19%, E-value=2e-46, Identity=50%"; Hit description =FAD dependent oxidoreductase and glycine cleavage T protein (94.9 kD) (1L16) [Caenorhabditis elegans] emb
  Coding regions on vcDNA: vcDNA=SeqID_87262; Strand=+; Position=3-572
IWYDFPAHPPDSSASSDFNEPRTHRQALFAAQDPLVGNLIWFPMVAREYEACRDCVGIIDMTCFAKFDISGPDVVPLLQKLCSANIDRAVGTTIYTGMHNEQGGYVSDATVSRMGNDSYFIVAPTVQQVRLALWIQRWADEWAMDVRLQDVTNNFIALDIVGPASRDLMRALTSESVTPHDFPSFAFRTI

SEQ ID NO: 160840 - protein, 165 aa, Heterodera glycines
  misc_feature (22)..(22): Xaa can be any naturally occurring amino acid
  Homolog annotation: Hit_ID=AAL78214.1; Match level="QueryCoverage =95%, HitCoverage=81%, E-value=4e-76, Identity=84%"; Hit description =putative esophageal gland cell protein Hgg-20 [Heterodera glycines]
  Coding regions on vcDNA: vcDNA=SeqID_87263; Strand=+; Position=120-614
MGHFNLCDDVWLDTLAWIILLXVGMKFSLVNARFNTLVDRHFEQRKWCFGEFHICERMTEESGAEIMTSIDGSDFSTSPLPTTPLPDSVVGFQSISIWYINEEVINFLCTIRRLLAEDIALEFSTYFTEYRSWKVMARHIWPLLRDGISTLFLKKCDLAMLRKHV

SEQ ID NO: 160841 - protein, 151 aa, Heterodera glycines
  Homolog annotation: Hit_ID=NP_741175.1; Match level="QueryCoverage =91%, HitCoverage=26%, E-value=3e-17, Identity=34%"; Hit description =putative cytoplasmic protein of fungal and metazoan origin (3H286) [Caenorhabditis elegans] gb|AAM22038.1
  Coding regions on vcDNA: vcDNA=SeqID_87264; Strand=+; Position=86-541
WPLSLAKLSSDIFTPRLSKEQVRNCSKLPFEYRMDLVKRIVNCLIEIAPGENIDGWRCGGSISLQLLAQKLLTADDRRMLANQDKGLQTFLRNQHQIFCVIKGIVSMRKWSTVNEEFARKSGGKPPRSHCFFHRLHPDGCPLEAHICSYKP

SEQ ID NO: 160842 - protein, 154 aa, Heterodera glycines
  Coding regions on vcDNA: vcDNA=SeqID_87265; Strand=+; Position=3-464
SPAAITTSNNNEENGGTTIRQKNATKTSNGILPPKTPKEMRLIVGTTVPQKSQQQQPLKGNSSAISKALTSPAPKKKDDESSILPFYRLQHSKSLPVDRTPTPTNEQEENVTSNIKIAKKINVTADGNCLFRSFAVSLYGRDDGFEHKRLRKQA

SEQ ID NO: 160843 - protein, 95 aa, Heterodera glycines
  Coding regions on vcDNA: vcDNA=SeqID_87266; Strand=+; Position=180-464
LLGQALFQLEFGPWHSDGFTPLLIAYDCPADMLIGQDLINEISATLPIKFEYHKNSVNVGGTRVSMLDPMAAEEKFFSVRVVDPRTNEEIGLETW

SEQ ID NO: 160844 - protein, 161 aa, Heterodera glycines
  Coding regions on vcDNA: vcDNA=SeqID_87267; Strand=+; Position=9-491
YKRCATTRPKHADPGSVKRSLQLDANIYKRLRRNSSEKKQQQQSANLNYGNSILYHRRVENGAKDGTERTVADTVAPNVNKMLVPKRKVTADALLDSLRAEDGAKKHKQNAKMCPPPPSVPSSLSSSSATLSSALWDHENDENAIVVIDNNTSTTAQSQDA

SEQ ID NO: 160845 - protein, 123 aa, Heterodera glycines
  Homolog annotation: Hit_ID=NP_496450.1; Match level="QueryCoverage =95%, HitCoverage=34%, E-value=8e-16, Identity=36%"; Hit description =kinase serine threonine 22 (2L766) [Caenorhabditis elegans] emb|CAA91402.1| Hypothetical protein W02B12.1
  Coding regions on vcDNA: vcDNA=SeqID_87268; Strand=+; Position=17-388
MQVHHHHHHKSHHQRHKRSYSSARHVLINFGFQFPHDFKLGSGRYSKVYKGFYREANRYFAIKITDLEAVSDRFKHKFVPRELKVWRELSHPNHVRLYKDFMKNDFLFEIIDLAVGGDMVGQS

SEQ ID NO: 160846 - protein, 150 aa, Heterodera glycines
  Homolog annotation: Hit_ID=NP_595283.1; Match level="QueryCoverage =99%, HitCoverage=99%, E-value=4e-36, Identity=50%"; Hit description =ubiquitin-conjugating enzyme e2-16 kd [Schizosaccharomyces pombe] emb|CAA17917.1| ubc4 [Schizosaccharomyc
  Gene Ontology: Mol. function=ubiquitin conjugating enzyme activity; Cellular component=proteasome complex (sensu Eukarya); Biological process=mitosis
  Coding regions on vcDNA: vcDNA=SeqID_87269; Strand=+; Position=125-577
MSKRRLRQELQDMVKNPLPDGCTARPLDQRTMNSWTVTIRGRAGTPYANGNFQLSMAFPRDYPFKAPQVTFTTRIFHPNIDTRGKVCLDILQTHWAPTLTIEKVVISIIVLLNDPNPDNSPINAQAASLYRTDRAEFNRRAREMTLAYAR

SEQ ID NO: 160847 - protein, 220 aa, Heterodera glycines
  Homolog annotation: Hit_ID=CAE73733.1; Match level="QueryCoverage =97%, HitCoverage=78%, E-value=4e-63, Identity=56%"; Hit description =Hypothetical protein CBG21259 [Caenorhabditis briggsae]
  Coding regions on vcDNA: vcDNA=SeqID_87270; Strand=+; Position=3-662
NTFRLSRYLATSAFSKARYGFRPSGGAGQYAFRFKEAFAARQVAPALRERLLGPTTGKPFIVGTYALAGASVFGIGMLCYYGLTTTVDSAAVRSNLWPDYVRQRLQSTYAYLAGSLALTAGAGVAAARSPGILALTSAPSLLVWFGSLAAIIGSGIVVQKIDYHGNSAAEHLAWLAHCGILGAVVAPLCFVGGPALMRAVWCTAGLVGRLSATAICAPSD

SEQ ID NO: 160848 - protein, 126 aa, Heterodera glycines
  Homolog annotation: Hit_ID=AAB61596.1; Match level="QueryCoverage =99%, HitCoverage=51%, E-value=4e-29, Identity=54%"; Hit description =galectin [Globodera rostochiensis]
  Coding regions on vcDNA: vcDNA=SeqID_87271; Strand=+; Position=1-381
QFEHRMSPDSVRSLEVNGDVVLHRVNLVNMAQPASAPAPTLQPMAPAPQFGQPMYPFSPSQPFGYAAPPPDVGFSPSIGGGHYPSMPPYPSASVPQPNAPADASQWHQPDYGTPKPNATYPPYGHH

SEQ ID NO: 160849 - protein, 124 aa, Heterodera glycines
  Coding regions on vcDNA: vcDNA=SeqID_87272; Strand=-; Position=1-372
HRTAITTHGILQRLVTLTARNGAGEVVAAHGAIGVVADPAIQAAAMERMGAAERRPRDGDHVGHTNGTSSPRCAFLVYPARPTETLLRLASRSFALALRALAAFAGVVMRVMMCVTLWNDAFEN

SEQ ID NO: 160850 - protein, 201 aa, Heterodera glycines
  misc_feature (136)..(136): Xaa can be any naturally occurring amino acid
  Homolog annotation: Hit_ID=AAP30757.1; Match level="QueryCoverage =99%, HitCoverage=84%, E-value=1e-108, Identity=99%"; Hit description= putative gland protein 30G12 [Heterodera glycines]
  Coding regions on vcDNA: vcDNA=SeqID_87273; Strand=+; Position=26-628
MSNFIFVSFLTAAFFSSGLALPAPYDAESVVSFVLNVPLLSADANVEASPPNESDAVFEIQAPSIPVPIEHQTAADITHPTETGNESSIASSSSTPKSEQTPKKVMNMKSALEGAAANVYGGLPLDKQPKTIAEAXAKAKQTPAKLPADYDVNRVAERAAARVYGWLPEDKQPKAIYDAAENAKNTPKPPGDYDVERVAQN

SEQ ID NO: 160851 - protein, 162 aa, Heterodera glycines
  Homolog annotation: Hit_ID=CAE59495.1; Match level="QueryCoverage =83%, HitCoverage=37%, E-value=6e-25, Identity=42%"; Hit description =Hypothetical protein CBG02880 [Caenorhabditis briggsae]
  Gene Ontology: Mol. function=3-phosphoinositide-dependent protein kinase activity; Cellular component=plasma membrane; Biological process=signal transduction
  Coding regions on vcDNA: vcDNA=SeqID_87274; Strand=+; Position=45-530
MLQAHQYQLRQGHRRVSARSILAHFGFEFSNDYRLGCGHYSKVYKGYFKEAQRTFAIKVTDLESVSEKFKQKFLPRELEVWRELDHPNLVYLYKDFQWNNYQFAVMELVVGGDLLSFLQKCGHVSETTCHNWMLQIVAALDYLHRKGIAHRDLKLENVLLCE

SEQ ID NO: 160852 - protein, 45 aa, Heterodera glycines
  Homolog annotation: Hit_ID=AAO33474.1; Match level="QueryCoverage =100%, HitCoverage=32%, E-value=3e-16, Identity=88%"; Hit description= gland-specific protein g4g12 [Heterodera glycines]
  Coding regions on vcDNA: vcDNA=SeqID_87275; Strand=+; Position=1-135
ATGGAEAIGRTGAQGGNAAGLVPSHVTNRSLAPPPPTVQLEMGAN

SEQ ID NO: 160853 - protein, 210 aa, Heterodera glycines
  Homolog annotation: Hit_ID=AAL78214.1; Match level="QueryCoverage =70%, HitCoverage=78%, E-value=2e-17, Identity=32%"; Hit description =putative esophageal gland cell protein Hgg-20 [Heterodera glycines]
  Coding regions on vcDNA: vcDNA=SeqID_87276; Strand=+; Position=39-668
MSSAQILLCAMFLLLLVVCAIILWILFDHVKKRLRPHKEIFICGDCWLLVFDFLAPSQLGLEIALVNRRFNCIVDEHFKTRKWKLGGIRICHKIGENGTNQMQIVNSDGNPLPIPQNPLSNKVIGFRGIQINYIDQNAVAFLRRFRRIFAFSSIYLVITENVCVSEFVLLNVLPMLRDSIVVMMLNTIAFRRFRQLAPSMLNDCPSLHTV

SEQ ID NO: 160854 - protein, 221 aa, Heterodera glycines
  Homolog annotation: Hit_ID=CAE57630.1; Match level="QueryCoverage =49%, HitCoverage=26%, E-value=2e-09, Identity=34%"; Hit description =Hypothetical protein CBG00615 [Caenorhabditis briggsae]
  Coding regions on vcDNA: vcDNA=SeqID_87277; Strand=+; Position=6-668
MLNFPVKLSPFFLFHSQFRHIFLRPLSSSVKSANKFRKDVRITTEKDKNNITSGSATSSPSDDNFAHFVGARLSLTVDPKFAAVELISRDSFDGTSSKPLRIPLVWLRDHCRSNASYNSRTNQRRSDCTNLFAGATLADDCYPIHFDADRQRLTLSWADGHESAFGVRELLSWAMFSQKHYGEEWEAGAECPSRSLWDARRLREVPSVSSSEFDFALFARL

SEQ ID NO: 160855 - protein, 71 aa, Heterodera glycines
  Coding regions on vcDNA: vcDNA=SeqID_87278; Strand=+; Position=355-570
YSHKHKTEQKFIPKAYVLQTKNQLGTPFKAIAIAKVFSSGQCLPPPNLSFPSLPLPFPSSFRQISFEFPFV

SEQ ID NO: 160856 - protein, 219 aa, Heterodera glycines
  Coding regions on vcDNA: vcDNA=SeqID_87279; Strand=+; Position=1-660
RRCRLLLGVRVLVEKRRRSRREPSDAEPVTLDLVQLRTQTIFIQQTVTIKTHSQLILLFQIEHGLFTGFTSHPHLVQILNSSVHFQAGPRVSFSAVHFVLSNLTKEEAIVYTVALIEPDNPYSPTDLAPIAITANYHQLTLGQLIALPDNLDFVSTSAEMDSLDSLLKRAPRHRRSKKHRRSRGHHHAEHQHQRGGCVRRGKPTKMDNLLHLDPTRSHF

SEQ ID NO: 160857 - protein, 214 aa, Heterodera glycines
  Coding regions on vcDNA: vcDNA=SeqID_87280; Strand=+; Position=41-682
STHMRSPPPFPPSGADQQSPSNQQTFFVSSAAQSLNAGKQPDKMPFLHKFYEYYTLGCISMRTESLALCVAVQFLLTNAFLIWLSLQGWHPYWRLALPAVFNAGASLSLIYAWWADKSSYSLLFLIVNGLSICALALSLFALLLAETDPALLKQLINNNDETETEQHQWDNYAYEEKTVVKTKDGSEHEHVRQNTIATAWRHYARRLELSGWLR

SEQ ID NO: 160858 - protein, 71 aa, Heterodera glycines
  Coding regions on vcDNA: vcDNA=SeqID_87281; Strand=+; Position=43-258
LPTWTRSSEKEGTPKGTPFLRKGRNGEREERRQSMTKMEGEGTAMVSHPPVEVNERTNEEPSLRFCCCYVY

SEQ ID NO: 160859 - protein, 119 aa, Heterodera glycines
  misc_feature (26)..(26): Xaa can be any naturally occurring amino acid
  Homolog annotation: Hit_ID=NP_500247.1; Match level="QueryCoverage =94%, HitCoverage=59%, E-value=4e-42, Identity=64%"; Hit description =putative cytoplasmic protein of ancient origin (4D482) [Caenorhabditis elegans] gb|AAF60889.1| Hypothetic
  Coding regions on vcDNA: vcDNA=SeqID_87282; Strand=+; Position=3-361
RYLMDTNRAGTLIGEDQFGNRYFEDXTYFVPRNRYVVYAERVWLDYDASQIPPEWHRWLHHICDKPPTVEPPPERKKWMLEHEPNNSIVMSKKYVPYSTTRPKVEGWVPGRKRSEEGTH

SEQ ID NO: 160860 - protein, 174 aa, Heterodera glycines
  Homolog annotation: Hit_ID=NP_497740.1; Match level="QueryCoverage =98%, HitCoverage=35%, E-value=1e-45, Identity=58%"; Hit description =glutathione reductase (51.5 kD) (3E741) [Caenorhabditis elegans] emb|CAB03763.1| Hypothetical protein C46
  Gene Ontology: Mol. function=thioredoxin reductase (NADPH) activity; Cellular component=mitochondrion; Biological process=response to oxidative stress
  Coding regions on vcDNA: vcDNA=SeqID_87283; Strand=+; Position=39-560
SKQKTLVSKVERSETTGKLTVHMTDESKLEDVDKLIWAIGRDPLTAELNLADVGVKLIAGDYIKVDDYQNTTKEGIYAVGDVCTPKFELTPVAIAAGRRLAHRLFNKEAENRLTYENIPTVVFSHPPLATTGLSEKEAVERFGRDQVKTYNAGFTNMYFAMTQHKEKTHMKIVC

SEQ ID NO: 160861 - protein, 161 aa, Heterodera glycines
  Homolog annotation: Hit_ID=CAE71896.1; Match level="QueryCoverage =81%, HitCoverage=56%, E-value=9e-30, Identity=49%"; Hit description =Hypothetical protein CBG18954 [Caenorhabditis briggsae]
  Gene Ontology: Mol. function=ubiquitin C-terminal hydrolase activity; Biological process=protein deubiquitination
  Coding regions on vcDNA: vcDNA=SeqID_87284; Strand=+; Position=3-485
KGIYGHLTGFRQRRGVPEWGLLHEAENHNACGTFALFHALTNNTDRIDIGNGVFYDWFKAAKQLNVEQRSDLLANDSELAHLHEHCALRESETDVPRNVAHHFISYFTHGGRLFEFDSGQEFPRDCGPSSEETLLTDAGKICKELMGQLEDISCNAIALCA

SEQ ID NO: 160862 - protein, 197 aa, Heterodera glycines
  Homolog annotation: Hit_ID=AAB96364.1; Match level="QueryCoverage =98%, HitCoverage=53%, E-value=4e-63, Identity=64%"; Hit description =L-glycerol-3-phosphate [Takifugu rubripes] sp|O57656|GPDA_FUGRU GLYCEROL-3-PHOSPHATE DEHYDROGENASE [NAD+],
  Gene Ontology: Mol. function=ATP binding; Cellular component =cytoplasm; Biological process=nucleotide-sugar metabolism
  Coding regions on vcDNA: vcDNA=SeqID_87285; Strand=+; Position=31-621
MTKKQVTIVGSGNWGTAIARIVGKTVQMHNSEFDDSAVKMWVFEEVVEGRKLSEIINEKHENVKYLPGKKLPTNVIAVTDVVEASKNADVLIFIIPHQFLHKVCEQLKGNIKKSAIAISLIKGLATFHEKDIGLRLISNEIATSLGIDTSVLMGANLANEVAEDHFCEATIGTKNPQHGNELKKLFHTDNFRINVVE

SEQ ID NO: 160863 - protein, 94 aa, Heterodera glycines
  Coding regions on vcDNA: vcDNA=SeqID_87286; Strand=+; Position=48-332
MFAPKFLLALLVCVAFAIGTKHGKTARKMAKNNVAKDELEQAFSPLVPVELAQKKFERRIDQMEKQLSEVINSVRGDCMPKKGDDEEEEEEEKK

SEQ ID NO: 160864 - protein, 86 aa, Heterodera glycines
  Homolog annotation: Hit_ID=AAP30768.1; Match level="QueryCoverage =100%, HitCoverage=47%, E-value=1e-42, Identity=98%"; Hit description= putative gland protein G22C12 [Heterodera glycines]
  Coding regions on vcDNA: vcDNA=SeqID_87287; Strand=+; Position=5-265
DECARSLGFVRAMFEIAASAASHAGANADLAVQFREQVGTIDSNCAALGIHVGQISLDAPRGDHPQVHDSESVLSNPGTSGSHKRF

SEQ ID NO: 160865 - protein, 208 aa, Heterodera glycines
  Homolog annotation: Hit_ID=NP_496112.1; Match level="QueryCoverage =100%, HitCoverage=39%, E-value=2e-47, Identity=48%"; Hit description= cytochrome P450 family member (2K86) [Caenorhabditis elegans] emb|CAA88604.1| Hypothetical protein T10B9
  Gene Ontology: Mol. function=oxidoreductase activity; Biological process=epoxygenase P450 pathway
  Coding regions on vcDNA: vcDNA=SeqID_87288; Strand=+; Position=3-626
IDLFLETEQNEQQQLTEQCQNEGEAMLSKTALQRVAKRCTLEEITSQLLMFLLAGFDTSANTLSLVCHALALHAEVQEKVQEEIDSVCFDEDPTYEQLSQLKYTEAVVKETLRLLPIATNVMNRTCCQTTTLGDITVEKGTVVMCDILSLHHDKTVWGEDADEFRPERWLEAGHQLPPFYAFGGGPRICIGMRFAMIEEKLALVRILR

SEQ ID NO: 160866 - protein, 85 aa, Heterodera glycines
  Coding regions on vcDNA: vcDNA=SeqID_87289; Strand=-; Position=3-257
DFFFFFFFFFCFFFFFFFFFFKKESVRTNKTITKSSIRLLLFIFAWIICFLFQFTCALRFPPCHTTQAHIEHRCLNRHSFGASEE

SEQ ID NO: 160867 - protein, 202 aa, Heterodera glycines
  Homolog annotation: Hit_ID=NP_001005348.1; Match level="QueryCoverage= 96%, HitCoverage=83%, E-value=9e-33, Identity=41%"; Hit description =testis enhanced gene transcript [Sus scrofa] gb|AAU05320.1| Bax inhibitor-1 [Sus scrofa]
  Coding regions on vcDNA: vcDNA=SeqID_87290; Strand=+; Position=15-620
MCVTFAQVYGTLALTMLSAILGIVVNAVMDFSSLLPIFSLMELGFLIALMVTNPSHQNENKRLGFMYAFAFLFGCEVGPLIEYVGIDDPTIVFNAIFVTMLVFGSFTMSALYADSTKYLHLGGILSSALFCMLIVLLFAPYTPFVRSFMLWAGLAINSAFVLYDTQLIVERCRRGDNDYIWHTVMLFQDLAYIFRYVLILLK

SEQ ID NO: 160868 - protein, 88 aa, Heterodera glycines
  misc_feature (68)..(68): Xaa can be any naturally occurring amino acid
  misc_feature (77)..(77): Xaa can be any naturally occurring amino acid
  misc_feature (84)..(84): Xaa can be any naturally occurring amino acid
  Homolog annotation: Hit_ID=NP_503059.1; Match level="QueryCoverage =93%, HitCoverage=10%, E-value=1e-14, Identity=48%"; Hit description =peptidase M3 (4S197) [Caenorhabditis elegans] pir||T27909 hypothetical protein ZK550.3 - Caenorhabditis e
  Coding regions on vcDNA: vcDNA=SeqID_87291; Strand=+; Position=5-268
LQCAGDSAGLWQSYVTRSAFSSQMLNNSQNIEELRHNTEGFAKALGFSSTAHHRISSKMAGSPQTVRXSLSTKTFQXRFRPVFXLPTR

SEQ ID NO: 160869 - protein, 67 aa, Heterodera glycines
  Coding regions on vcDNA: vcDNA=SeqID_87292; Strand=-; Position=75-278
ASSEALAFCSAASDALAFCCWIAGSDALAFCCALAFCCWIAGSDALAFCCALAFCCWIAGSDALAFC

SEQ ID NO: 160870 - protein, 164 aa, Heterodera glycines
  Homolog annotation: Hit_ID=NP_956267.1; Match level="QueryCoverage =95%, HitCoverage=32%, E-value=3e-29, Identity=38%"; Hit description =ubiquitin specific protease 14 [Danio rerio] gb|AAH44553.1| Ubiquitin specific protease 14 [Danio rerio]
  Gene Ontology: Mol. function=tRNA guanylyltransferase activity; Cellular component=proteasome regulatory particle (sensu Eukarya); Biological process=protein modification
  Coding regions on vcDNA: vcDNA=SeqID_87293; Strand=+; Position=40-531
MAKIKIKWGTKELNVDANPEEPPLLLKAQLFGLTNVPPERQKLIVKGKTISDEAWNGIKIKDGTVIMLIGSTESMLIKAENAESSGHTNSTETEPRQQFPIGLRNLGNTCYMNSSLQCLKIVPEFETALKQYNPNQSVDGSNQRIKLFTNSMKKLYNEMNVLAK

SEQ ID NO: 160871 - protein, 171 aa, Heterodera glycines
  Homolog annotation: Hit_ID=NP_502402.2; Match level="QueryCoverage =97%, HitCoverage=54%, E-value=4e-26, Identity=39%"; Hit description =predicted CDS, inositol polyphosphate multikinase (4N313) [Caenorhabditis elegans] emb|CAB05842.2| Hypoth
  Coding regions on vcDNA: vcDNA=SeqID_87294; Strand=+; Position=1-513
DVNAELPPDFEWYQNQIAGHLPSVIRNGVRQIGILHERGRTDVILKLVQEGIRGQREIGFYRRIAAICEGQGINCEETDEVEGTLLKELAMFIPRFYGCRQILLDENGPPKEFIQLEDVTEKFKCPCIMDVKMGRVSADPLASEEKRMAEEVKSPLQKKIGFRILGHRVQN

SEQ ID NO: 160872 - protein, 181 aa, Heterodera glycines
  Homolog annotation: Hit_ID=BAA91422.1; Match level="QueryCoverage =90%, HitCoverage=38%, E-value=1e-22, Identity=34%"; Hit description =unnamed protein product [Homo sapiens]
  Coding regions on vcDNA: vcDNA=SeqID_87295; Strand=+; Position=4-546
MERCRSCNCAVELGASPDVLMVFSCPDCRLKFCRLCDEPWQDEHKGVSCEQFAKKQNRERLLEKRLSEAVVHCCAKCKMSFVKHDGCNKVTCPCGATHCYICRQNNITYAHFCACLQEKAPKHPFKCAKCGKSCLLWQNSVTVEKQQMDNIRKEMVEEEKREKAKQKRPTTGNTPNANKKK

SEQ ID NO: 160873 - protein, 100 aa, Heterodera glycines
  Coding regions on vcDNA: vcDNA=SeqID_87296; Strand=+; Position=3-305
FEQDCERMAAHKTFIIKRKLAKGCQTKSSASPLGSNEDGQSHSLQRKASSLAQNQTEVVSDGRRERKSENIGRRRTDDDFRLFCLFMELIFIHFCVDYCW

SEQ ID NO: 160874 - protein, 207 aa, Heterodera glycines
  Homolog annotation: Hit_ID=NP_505750.1; Match level="QueryCoverage =92%, HitCoverage=83%, E-value=3e-68, Identity=67%"; Hit description =proteasome Alpha Subunit (25.3 kD) (pas-2) [Caenorhabditis elegans] emb|CAA98441.1| Hypothetical protein
  Gene Ontology: Mol. function=endopeptidase activity; Cellular component=proteasome core complex (sensu Eukarya); Biological process=proteolysis and peptidolysis
  Coding regions on vcDNA: vcDNA=SeqID_87297; Strand=+; Position=3-623
FFCCRNEHGTLFLLSTTFSPSGKLMQIEYALNAVKGSAPSVGTRAKDCVVFATENKHSVLTQPVSKISKLSDHIACVYSGMGPDAQLLVKKARKIAMDYQVLYGYEIPVPQLVSRVAAVMQEYTQSGGVRPFGVSLLIGGWDSEKGALLFQADPAGSYFGWKSTAIGKNDQLAKKLLEKRYNEDIEKVDAIHMALLAMRETYDVAMT

SEQ ID NO: 160875 - protein, 201 aa, Heterodera glycines
  Homolog annotation: Hit_ID=AAL78214.1; Match level="QueryCoverage =77%, HitCoverage=78%, E-value=2e-13, Identity=30%"; Hit description =putative esophageal gland cell protein Hgg-20 [Heterodera glycines]
  Coding regions on vcDNA: vcDNA=SeqID_87298; Strand=+; Position=71-673
MNRRRWICGDVWMDILPSFDHAQLGLKMALLSDRFDVLVDKHFDGKTTGFTIWRRIRIRKDKGPKAKVSVRIDGKFVDFPFPDNPLPNKIRFKNLQIRYINYSVIKFLRSNKPIWDRNGTKLEVFVPLYMTDVKLIWDVFTREIWPIFAKSIRHLSFHNADALDNLRRRTSPTILTDSIQLNSICSYGLFPDGIADDGPNA

SEQ ID NO: 160876 - protein, 161 aa, Heterodera glycines
  Homolog annotation: Hit_ID=CAE64130.1; Match level="QueryCoverage =55%, HitCoverage=9%, E-value=3e-20, Identity=54%"; Hit description =Hypothetical protein CBG08746 [Caenorhabditis briggsae]
  Coding regions on vcDNA: vcDNA=SeqID_87299; Strand=+; Position=35-517
MRRFGKTYLCSYSRLCIDAKLRCNGEDNCGENDDSDEAHCSRIEALASPTTIVVAYIVSGIIFFFILSLFCFLFKSKLEKKNNAKGEEKRSRREREKRKRAQRKRREGRKSGRKAEGEAQRQTARQPSRQPRPRRTVADGHKLSGIYGGVGGTQSVFGRRG

SEQ ID NO: 160877 - protein, 166 aa, Heterodera glycines
  misc_feature (150)..(150): Xaa can be any naturally occurring amino acid
  Homolog annotation: Hit_ID=CAI14295.1; Match level="QueryCoverage =94%, HitCoverage=56%, E-value=2e-23, Identity=36%"; Hit description =acid sphingomyelinase-like phosphodiesterase (ASML3B) [Homo sapiens]
  Gene Ontology: Mol. function=endopolyphosphatase activity; Cellular component=extracellular space; Biological process=polyphosphate metabolism
  Coding regions on vcDNA: vcDNA=SeqID_87300; Strand=+; Position=25-522
MALLSIFCLLLALCPVLSINSTGHFLHITDVHIDPNYDLSGDPQKWCHGSGDSRNKSPKLGVFGDHNCDSPMALLEFMLKEAKAKVPNPNLIIWTGDSLPHDKYDKKVLFDILQKVTNAISAQFPDAVLLPVLGNHDSAPGNSFTDHPAXQQIYEKMFIIWKQWIG

SEQ ID NO: 160878 - protein, 192 aa, Heterodera glycines
  Homolog annotation: Hit_ID=CAE60538.1; Match level="QueryCoverage =98%, HitCoverage=55%, E-value=1e-69, Identity=71%"; Hit description =Hypothetical protein CBG04165 [Caenorhabditis briggsae]
  Gene Ontology: Mol. function=fructose-bisphosphatase activity; Cellular component=cytosol; Biological process=gluconeogenesis
  Coding regions on vcDNA: vcDNA=SeqID_87301; Strand=+; Position=2-577
WRFVLNEQKKFPDATGDLTTLLTSLLTAVKAISSAVRKAGLAQLYGVAGNVNVQGEDVKKLDVLSNELMINMLKSSYTVSTLVSEENEQVIEVEVSGTQGKYIATFDPLDGSSNIDCLVSIGTIFGIFRKASNTSTKEEDTLQTGRKMVAAGYALYGSATMVVLSTPGRVDGFTLDPSIGEFILTNPAMRVP

SEQ ID NO: 160879 - protein, 132 aa, Heterodera glycines
  Homolog annotation: Hit_ID=AAT09130.1; Match level="QueryCoverage =98%, HitCoverage=55%, E-value=4e-45, Identity=66%"; Hit description =translation initiation factor 4E [Ascaris suum]
  Gene Ontology: Mol. function=translation initiation factor activity; Cellular component=ribosome; Biological process=regulation of translation
  Coding regions on vcDNA: vcDNA=SeqID_87302; Strand=+; Position=3-398
PASGLSWNATIPFKEGIKPMWEDKGNLDGGRWLVLVDKQKRQTKLDMYWQEMMMCMIGEQFEKWSDHICGAVVNIRQKGDKVSLWTRDAKDDSANMQIGHILNAKLNIPDTENLRYEVHAEYSARTGSAVKS

SEQ ID NO: 160880 - protein, 185 aa, Heterodera glycines
  Homolog annotation: Hit_ID=EAA36783.1; Match level="QueryCoverage =86%, HitCoverage=88%, E-value=5e-37, Identity=45%"; Hit description =GLP_382_5313_4777 [Giardia lamblia ATCC 50803]
  Gene Ontology: Mol. function=ubiquitin conjugating enzyme activity; Cellular component=proteasome complex (sensu Eukarya); Biological process=mitosis
  Coding regions on vcDNA: vcDNA=SeqID_87303; Strand=+; Position=50-607
RRHLYILRQFVVDCCILLFVVFITHSSSCWLSAMSKRRLRQELKDMEKNPLPEGCTARPLDQRTMTPWTVTIRGRAGTPYENGNFQLSMAFPRDYPFKAPQVTFTTRIFHPNIDTRGKVCLDILQTHWAPTLTIEKVVISIIVLLNDPNPDNSPINAQAASLYRTDRAEFNRRAREMTLAYAWRR

SEQ ID NO: 160881 - protein, 70 aa, Heterodera glycines
  Coding regions on vcDNA: vcDNA=SeqID_87304; Strand=-; Position=74-286
HCANHYCKLANFSDFFGNDLGETVGTIRADHLQTRIRGNPKKESEQTEGGGEVIDHIAIILFKHLIISNR

SEQ ID NO: 160882 - protein, 198 aa, Heterodera glycines
  Homolog annotation: Hit_ID=NP_501395.1; Match level="QueryCoverage =85%, HitCoverage=32%, E-value=1e-12, Identity=32%"; Hit description =tubulin-specific chaperone e (56.7 kD) (4J61) [Caenorhabditis elegans] gb|AAC04426.1| Hypothetical protei
  Coding regions on vcDNA: vcDNA=SeqID_87305; Strand=+; Position=3-596
LNFGDGSGFCALKTLILQDNPISRWESLDGLARLPALAKLILRGAPLPGARGADSREMIIAKLPQITDLDRCDVSPVARRSAELLFLSRFGADPVPAEHRAAIARLATIYSISNDGDPSSAVSVPRPAQPFSTIHSKKVRLEHAGRSMERSLSLALPIHKVVGLGARLFGFAPDTLTGVELRRADPAYPSELLCRTRD

SEQ ID NO: 160883 - protein, 84 aa, Heterodera glycines
  Coding regions on vcDNA: vcDNA=SeqID_87306; Strand=+; Position=29-283
CLFQLQQVSVCVCLLFSDLTVTDIIYFFFSLPLFFNFCSFSLSLYYFHNLRALSPPLLFLLHLHKIQVVITFYVFSITQAFSSI

SEQ ID NO: 160884 - protein, 165 aa, Heterodera glycines
  misc_feature (131)..(131): Xaa can be any naturally occurring amino acid
  misc_feature (147)..(147): Xaa can be any naturally occurring amino acid
  Homolog annotation: Hit_ID=CAE70294.1; Match level="QueryCoverage =96%, HitCoverage=89%, E-value=1e-43, Identity=50%"; Hit description =Hypothetical protein CBG16815 [Caenorhabditis briggsae]
  Coding regions on vcDNA: vcDNA=SeqID_87307; Strand=+; Position=33-527
MSKELKITREDELLLQDFSSAVSKKGTLIFYGISAFVGLTPVYLFYGAHQMEIADSWFIWLAAAIGVAYLLAQSYKNMKHVLKHQIVIKRGDAIAREMNRILSDDKKMSKKEKDERILWKKNEVGDYEATXFAIFYNNLLFFVLLVXLSFFILYSISPIFNCLVS

SEQ ID NO: 160885 - protein, 144 aa, Heterodera glycines
  Homolog annotation: Hit_ID=AAL78214.1; Match level="QueryCoverage =73%, HitCoverage=55%, E-value=2e-14, Identity=36%"; Hit description =putative esophageal gland cell protein Hgg-20 [Heterodera glycines]
  Coding regions on vcDNA: vcDNA=SeqID_87308; Strand=+; Position=52-483
MSSEILWSTVTLLLVDCATILFWFFLDNAKKRRRPHKKEIFICGDCWLLVFDFLAPSQLGLGIALISRRFDFYVDEHFKTRKWKLNKQFLIQWDIQENGTKKMQIVNSDGNPLPIPQNPLPNKVIGFRHIQIIYIDQNVITFLR

SEQ ID NO: 160886 - protein, 142 aa, Heterodera glycines
  Homolog annotation: Hit_ID=NP_506715.1; Match level="QueryCoverage =99%, HitCoverage=40%, E-value=2e-36, Identity=53%"; Hit description =AHA1 activator of heat shock 90kDa protein ATPase homolog 1 (38.6 kD) (5P564) [Caenorhabditis elegans] em
  Coding regions on vcDNA: vcDNA=SeqID_87309; Strand=+; Position=10-435
IFRLKKLEGEATANNRKAKLIFFFEWSIDVNFIATVSGSETEYKGSVEILNLSDENEAHEIEISVHIETAGPHENEIRHILSTDGLSFVRSKVGTYVRELKEEFSKGIILPVDSKGAIRSQAVTTQGKTVVDKRRFQNDIIQ

SEQ ID NO: 160887 - protein, 153 aa, Heterodera glycines
  misc_feature (40)..(40): Xaa can be any naturally occurring amino acid
  Homolog annotation: Hit_ID=NP_505733.1; Match level="QueryCoverage =97%, HitCoverage=45%, E-value=4e-84, Identity=95%"; Hit description =yeast Glc Seven-like Phosphatase (37.2 kD) (gsp-1) [Caenorhabditis elegans] emb|CAA98273.1| Hypothetical
  Gene Ontology: Mol. function=protein phosphatase type 1 activity; Cellular component=cytoplasm; Biological process=adult locomotory behavior
  Coding regions on vcDNA: vcDNA=SeqID_87310; Strand=+; Position=26-485
PWQASLETICLLLAYKIKYPENFFLLRGNHECASINRIYXFYDECKRRFSIKLWKTFTDCFNCLPIAALIGEKIFCCHGGLSPDLQNMEQIRRIMRPTDVPDTGLLCDLLWSDPDKYVQGWGENDRGVSFTFGPDVVAKFLNRHDLDLICRAH

SEQ ID NO: 160888 - protein, 186 aa, Heterodera glycines
  Coding regions on vcDNA: vcDNA=SeqID_87311; Strand=+; Position=4-561
WLCNDVWMDILPFFDRPQLGLKLAMLSPRFDALVDIHFDGKTELTLWRPIAIRNSAAAVPELHVFFDGANNSVPFPLPDVHSPPMPNNIRFKDLRINCIDHSVIAFLRANQLIFQKGTNLRLSVPFGPFNIDDVQPILDDFARQIWPIFASTIRHFWFPDCRILDTLLRLVSPTILTDDQINIHSI

SEQ ID NO: 160889 - protein, 84 aa, Heterodera glycines
  misc_feature (11)..(11): Xaa can be any naturally occurring amino acid
  misc_feature (13)..(13): Xaa can be any naturally occurring amino acid
  misc_feature (76)..(76): Xaa can be any naturally occurring amino acid
  Homolog annotation: Hit_ID=CAE71709.1; Match level="QueryCoverage =100%, HitCoverage=100%, E-value=8e-24, Identity=63%"; Hit description=Hypothetical protein CBG18686 [Caenorhabditis briggsae]
  Gene Ontology: Mol. function=RNA binding; Cellular component=nucleus; Biological process=mRNA cleavage
  Coding regions on vcDNA: vcDNA=SeqID_87312; Strand=+; Position=52-306
MASSGFSVYVXQXPYNATEADIGNLFSQCGVVTNVRIVYDRETNRPKGFGFCEFQDQQGAQNAVTNLNGAELNGRXLRVNWTNK

SEQ ID NO: 160890 - protein, 64 aa, Heterodera glycines
  misc_feature (34)..(34): Xaa can be any naturally occurring amino acid
  Homolog annotation: Hit_ID=AAQ91046.1; Match level="QueryCoverage =98%, HitCoverage=27%, E-value=4e-09, Identity=45%"; Hit description =LRRGT00090 [Rattus norvegicus]
  Coding regions on vcDNA: vcDNA=SeqID_87313; Strand=+; Position=244-434
MEEEEQREKEQKGREEEEEETDDDEIIVIEQSKXHRGREDEKRKRKKSKSMRRKKSKKKKKKKK

SEQ ID NO: 160891 - protein, 150 aa, Heterodera glycines
  misc_feature (15)..(15): Xaa can be any naturally occurring amino acid
  misc_feature (49)..(49): Xaa can be any naturally occurring amino acid
  Homolog annotation: Hit_ID=NP_492378.1; Match level="QueryCoverage =94%, HitCoverage=37%, E-value=1e-36, Identity=52%"; Hit description =Malate/L-lactate dehydrogenase (40.5 kD) (1J377) [Caenorhabditis elegans] emb|CAB09417.1| Hypothetical pr
  Coding regions on vcDNA: vcDNA=SeqID_87314; Strand=+; Position=5-455
TDPLAVLDGGGLLPXGGVSEEDGSHKGTGIAMMGELFCGLLGGASFGKXTVRSWREVQKAANLGQCFVAIDPECFAPTFVDNLQLFLDQTRGLNPRDPSKSVLVPGDPERMNIERSAKAGGVIYSERQIRDLEKLAKKQNVGMFPYKANL

SEQ ID NO: 160892 - protein, 129 aa, Heterodera glycines
  Coding regions on vcDNA: vcDNA=SeqID_87315; Strand=+; Position=2-391
YSRRRSAGPSLTAFLSLPGVVDKFSEFTKMYNHWRGLWKMFYRTTFAQSQMLFAIEEKASDSDRFRRVLPKVLYFLSQEVKAMDDALIVDWYSNLEEKSQLKKEEKLAELVTWFQNAEESSETDDEGED

SEQ ID NO: 160893 - protein, 96 aa, Heterodera glycines
  misc_feature (70)..(70): Xaa can be any naturally occurring amino acid
  Homolog annotation: Hit_ID=AAM95699.1; Match level="QueryCoverage =92%, HitCoverage=100%, E-value=2e-44, Identity=97%"; Hit description= 33A09 [Heterodera glycines]
  Coding regions on vcDNA: vcDNA=SeqID_87316; Strand=+; Position=11-302
MGECCRQMNLIFEIFAFGMDDFSSEKNVSLLRLFLFFFSTVVLFGSAHPMVNKLCEDLDKPEGWQLLKKXTIEKCRMSIMWNSPNGKTATKALKSL

SEQ ID NO: 160894 - protein, 144 aa, Heterodera glycines
  Homolog annotation: Hit_ID=CAA52290.1; Match level="QueryCoverage =100%, HitCoverage=100%, E-value=3e-73, Identity=97%"; Hit description=polyubiquitin [Volvox carteri] pir||S40611 polyubiquitin 5 - Volvox carteri
  Coding regions on vcDNA: vcDNA=SeqID_87317; Strand=+; Position=1-432
QRLIFAGKQLEDGRTLADYNIQKESTLHLVLRLRGGMQIFVKTLTGRTITLEVEASDTIENVKAKIQDKEGIPPDQQRLIFAGKQLEDGRTLADYNIQKESTLHLVLRLRGGMQIFVKTLTGKTITLEVEASDTIENVKAKIQD

SEQ ID NO: 160895 - protein, 169 aa, Heterodera glycines
  Homolog annotation: Hit_ID=NP_500523.2; Match level="QueryCoverage =97%, HitCoverage=8%, E-value=2e-73, Identity=82%"; Hit description =DNA-directed RNA polymerase II largest subunit, AMAnitin resistant AMA-1 (205.0 kD) (ama-1) [Caenorhabditi
  Gene Ontology: Mol. function=protein binding; Cellular component=DNA -directed RNA polymerase II, core complex; Biological process =regulation of transcription, DNA-dependent
  Coding regions on vcDNA: vcDNA=SeqID_87318; Strand=+; Position=2-508
SGRNFSTQAEWLLETDGTALLRVLSEPDVDFIRTHSNDICEIFEVLGIEAVRKAIEREMNQVISFDGSYVNYRHLALLCEVMTARGYLMAITRHGINRQEVGALMRCSFEETVDILMEAAVHAETDPVKGVSENIMLGQMAKAGTGCFDLVLDSDKCKLAMDIPDFIMA

SEQ ID NO: 160896 - protein, 186 aa, Heterodera glycines
  Coding regions on vcDNA: vcDNA=SeqID_87319; Strand=+; Position=3-560
LESYVPRHSRNYRGIQPTIDSVHNHQQVDPFLPLSTIPPASTVENADFERQPIPLGMPIQLLPTSQKTPPSSQQVLLMSAQPTPNQPLVLPVSSVPTFQFVQQHMFPSMSQQQPLMPIRLQPSSMLHHQINQQAEHSQQDGTVSDSPDSGHVVTPSSYPLQQIGNGIDCIDLTHHRHSERMGSDAM

SEQ ID NO: 160897 - protein, 143 aa, Heterodera glycines
  misc_feature (8)..(8): Xaa can be any naturally occurring amino acid
  Homolog annotation: Hit_ID=A48449; Match level="QueryCoverage=100%, HitCoverage=38%, E-value=9e-73, Identity=96%"; Hit description=Actin- 1A - nematode (Onchocerca volvulus)
  Gene Ontology: Mol. function=structural constituent of cytoskeleton; Cellular component=cytoskeleton; Biological process=reproduction
  Coding regions on vcDNA: vcDNA=SeqID_87320; Strand=+; Position=1-430
MFETSNNXGLYVAIQAVLSLYASGRTTGIVLDSGDGVTHTVPIYEGYALPHAILRLDLAGRDLTDYLMKILTERGYSFTTTAEREIVRDIKEKLCYVALDFEQEMATAASSSSLEKSYELPDGQVITVGNERFRCPEALFQPS

SEQ ID NO: 160898 - protein, 185 aa, Heterodera glycines
  Homolog annotation: Hit_ID=CAE73542.1; Match level="QueryCoverage =88%, HitCoverage=87%, E-value=2e-18, Identity=36%"; Hit description =Hypothetical protein CBG21010 [Caenorhabditis briggsae]
  Coding regions on vcDNA: vcDNA=SeqID_87321; Strand=+; Position=3-557
MMNSMLGDAWDMLNGFGMMGPPFPNHPMLTDGLNRQNQALRRQQPPQHHFGPDTMMSPFGGFGLFGGMMQQMQNMHNHAISDPNSVVFSESTMVSYDGNGQPKVVQHSTRKAGDVKETRNALRDGVREEMTVGHSIGDRSHVIEKKRDKDGKVRQQQKFFNLAEDEAEDFNRQFQTRARENMGGL

SEQ ID NO: 160899 - protein, 98 aa, Heterodera glycines
  Coding regions on vcDNA: vcDNA=SeqID_87322; Strand=+; Position=3-299
AFLFLSFLCISHFSLPFFLTWSKMLMIVFVTKLQIVQMRHFSFIVNYFVLVLDQFGQIVYVLMMRDAILVDDDGDPFLGLNLPLFVLVFFIIHYFSFC

SEQ ID NO: 160900 - protein, 77 aa, Heterodera glycines
  Coding regions on vcDNA: vcDNA=SeqID_87323; Strand=-; Position=1-231
IVLSPNDSVYTSESSSSSMPPFSISSPRVLFPSICPCPKSPPLMPCQSADCAWHSSVLFPPPLWGPFPPVLHVHSDH

SEQ ID NO: 160901 - protein, 92 aa, Heterodera glycines
  Homolog annotation: Hit_ID=AAH65651.1; Match level="QueryCoverage =84%, HitCoverage=19%, E-value=4e-09, Identity=37%"; Hit description =Nr2f1l protein [Danio rerio]
  Coding regions on vcDNA: vcDNA=SeqID_87324; Strand=+; Position=46-324
MMMGHPHAHGPSVPLSSALSVAASDQQDHCCAVCGCVGATIYCSVFSCRPCASFFRRSIKDQREYKCRANGDCPIDKGEREKAKSMNGKWLF

SEQ ID NO: 160902 - protein, 141 aa, Heterodera glycines
  misc_feature (58)..(58): Xaa can be any naturally occurring amino acid
  Homolog annotation: Hit_ID=NP_505750.1; Match level="QueryCoverage =92%, HitCoverage=56%, E-value=7e-46, Identity=70%"; Hit description =proteasome Alpha Subunit (25.3 kD) (pas-2) [Caenorhabditis elegans] emb|CAA98441.1| Hypothetical protein
  Gene Ontology: Mol. function=endopeptidase activity; Cellular component=26S proteasome; Biological process=ubiquitin-dependent protein catabolism
  Coding regions on vcDNA: vcDNA=SeqID_87325; Strand=+; Position=23-444
AGTLFLLSTTFSPSGKLMQIEYALNAVKGSAPSVGTRAKDCVVFATENKHSVLHSPSXKISKLSDHIACVYSGMGPDAQLLVKKARKIAMDYQVLYGYEIPVPQLVSRVAAVMQEYTQSGGVRTFGVSLLIGGWDSEKGAL

SEQ ID NO: 160903 - protein, 90 aa, Heterodera glycines
  Homolog annotation: Hit_ID=CAE68939.1; Match level="QueryCoverage =76%, HitCoverage=10%, E-value=1e-22, Identity=71%"; Hit description =Hypothetical protein CBG14919 [Caenorhabditis briggsae]
  Gene Ontology: Mol. function=peptidyl-glycine monooxygenase activity; Cellular component=integral to plasma membrane; Biological process =peptide metabolism
  Coding regions on vcDNA: vcDNA=SeqID_87326; Strand=+; Position=186-455
LCTIFIAKPTVYPWNISFFVPFSVEFEPFAHADRVHHMLLYGCSTPAYADRNFWQGMATCGGNSHILYAWARNAPPLELPKDVAFAVGNE

SEQ ID NO: 160904 - protein, 163 aa, Heterodera glycines
  Homolog annotation: Hit_ID=CAE72971.1; Match level="QueryCoverage =95%, HitCoverage=46%, E-value=9e-69, Identity=80%"; Hit description =Hypothetical protein CBG20308 [Caenorhabditis briggsae]
  Coding regions on vcDNA: vcDNA=SeqID_87327; Strand=+; Position=2-490
TDKTCGVGRINQRASEGGYGYLKEWLWWMGVITMGVGEACNFAAYAFAPASLVTPMGALSVLVTAVLSSKLLKERLNLLGKIGCAICLLGSTSIVIHSPKEEEVSTMAELAEKMKASVFILYVVLVLLFTFVLVVYVAPRYGHTNILVYIAVCSLIGSLSVIS

SEQ ID NO: 160905 - protein, 57 aa, Heterodera glycines
  Coding regions on vcDNA: vcDNA=SeqID_87328; Strand=+; Position=2-172
IREDIVRQIAGGMDGQIAIHRRRQPKLAAATSRETGPSSRVSDRSGRLGREKSAEDG

SEQ ID NO: 160906 - protein, 170 aa, Heterodera glycines
  Homolog annotation: Hit_ID=AAL78214.1; Match level="QueryCoverage =85%, HitCoverage=75%, E-value=2e-14, Identity=32%"; Hit description =putative esophageal gland cell protein Hgg-20 [Heterodera glycines]
  Coding regions on vcDNA: vcDNA=SeqID_87329; Strand=+; Position=41-550
MPSEMRFISADCWLLVFDFLAPSQLGLGIALISRRFDFYVDEHFKTRKWMLNKQLLITWDIEENGTKKMQIIDADRKETLPIPQKPLPNKVIGFSGRIQIIYIDQNVLTFLGHFHRFFATSAMDLDIVIENGRILEFVLLNIWPMFRDSIRRLFLNAIAFRCLRQLAPSM

SEQ ID NO: 160907 - protein, 188 aa, Heterodera glycines
  Homolog annotation: Hit_ID=NP_036694.1; Match level="QueryCoverage =86%, HitCoverage=35%, E-value=2e-63, Identity=61%"; Hit description =fucosidase, alpha-L- 1, tissue [Rattus norvegicus] emb|CAA34268.1| unnamed protein product [Rattus norveg
  Gene Ontology: Mol. function=alpha-L-fucosidase activity; Biological process=fucose metabolism
  Coding regions on vcDNA: vcDNA=SeqID_87330; Strand=+; Position=5-568
MSFTVVHILFCFFLPALSIYKPNWDSIDSRPLPNWYDEAKFGIFSHWGVYSVPAFGSEWFWWYWKGQRDAKFERFAQKHYPNGTTYADFAESFTAVDFDANNFAEIVKSSGARYFVLTSKHHEGFTLWPSATSWNWNAVDIGPHRDLVKALSDSIRAQNIRFGLYFSLFDWFHPLFLNDVKKHRTDFV

SEQ ID NO: 160908 - protein, 180 aa, Heterodera glycines
  Homolog annotation: Hit_ID=XP_448713.1; Match level="QueryCoverage =66%, HitCoverage=90%, E-value=1e-43, Identity=73%"; Hit description =unnamed protein product [Candida glabrata] emb|CAG61676.1| unnamed protein product [Candida glabrata CBS1
  Gene Ontology: Mol. function=DNA binding; Cellular component=nuclear nucleosome; Biological process=chromatin assembly/disassembly
  Coding regions on vcDNA: vcDNA=SeqID_87331; Strand=+; Position=66-605
MSDNRGASVASTGTTNSQESQVASPVKAGKATTKTTASGKGGKAKADGKVKAGGKGAKKAGGKGGKVKIAASGTYSTRSARAGVAFPVGRIHRLLRHGRHAQRIGAGAPVYMASVLEYLAAEVLELAGNAARENKKLRITPRHLQLAVRNDEELNKLLSEVTISRGGVLPNIHTELLSKM

SEQ ID NO: 160909 - protein, 174 aa, Heterodera glycines
  misc_feature (22)..(22): Xaa can be any naturally occurring amino acid
  Homolog annotation: Hit_ID=NP_502296.1; Match level="QueryCoverage =91%, HitCoverage=32%, E-value=6e-30, Identity=45%"; Hit description =HCV NS3-transactivated protein 1 like, possibly N-myristoylated (53.1 kD) (4M871) [Caenorhabditis elegans
  Gene Ontology: Biological process=aspartate metabolism
  Coding regions on vcDNA: vcDNA=SeqID_87332; Strand=+; Position=3-526
VASRMKGIDFETGQQILCPSNXALVGSGSDEQLGGYARHQTVFKSKGLDGVAEELSMEMHRIGARNFGRDDRIGTVNGKSLLAPFLEEPLVCWLNTLPTALKTGFGLPTNDGTANKFLLRNALRSLGVPECFVQRPKRAMQFGTRMVKMENAENGDPKLRGPKFARNWCYDLLC

SEQ ID NO: 160910 - protein, 65 aa, Heterodera glycines
  Coding regions on vcDNA: vcDNA=SeqID_87333; Strand=+; Position=1-195
SGVDFASLSCLSTITQSTSDELGKKSKGSPTIELLRAESDCLPPEWLLPNSSDIILKPLIPMAEH

SEQ ID NO: 160911 - protein, 127 aa, Heterodera glycines
  Homolog annotation: Hit_ID=EAL26247.1; Match level="QueryCoverage =95%, HitCoverage=19%, E-value=5e-09, Identity=29%"; Hit description =GA21040-PA [Drosophila pseudoobscura]
  Coding regions on vcDNA: vcDNA=SeqID_87334; Strand=+; Position=127-510
MPKYTQIMNALSEQLQQHVAKANLLISLNEKIPQFDVEVEEMMRIAIGRTQLLLNKRMKQFREHLSRHLKPIPGQKVTKLNDLHALWVPIDMQLDDIRSIFNSIEQFRLRCWAVAEPKAAATAASGN

SEQ ID NO: 160912 - protein, 169 aa, Heterodera glycines
  Coding regions on vcDNA: vcDNA=SeqID_87335; Strand=+; Position=11-517
ASYLLHILLFSPNQTCKCATHKVSNQLWYKSAENDELINLMVSDKIEEGGNGEFFVGFTLSEHRLENLPRNKCVAVKKMKCANQDQFCNPKYRNAKYCNAKYCNGKHCDANYCNTTRVLKWLQRHIDGTKRGHIAKLFDTGFEEATNSFVIVSELGDETLKHRLYAENR

SEQ ID NO: 160913 - protein, 149 aa, Heterodera glycines
  Coding regions on vcDNA: vcDNA=SeqID_87336; Strand=+; Position=75-521
MNRRWICNDILMDLFPFFNRPQLGLKLALLSPRFNLLVDAHFDGKSELTIWRQIRIHKNGPKTQLSVDTANNADSVPFPLPDRSLPNKIRFHFLRIGCIDHSVITFLRSNQQIFDGRGTNLRLWLRPDANDYQPIWDAFVREIWPIFVP

SEQ ID NO: 160914 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87337; Strand=+; Position=23-439

SEQ ID NO: 160915 - protein, 134 aa, Heterodera glycines
  Homolog annotation: Hit_ID=AAO33474.1; Match level="QueryCoverage =100%, HitCoverage=97%, E-value=1e-70, Identity=100%"; Hit description=gland-specific protein g4g12 [Heterodera glycines]
  Coding regions on vcDNA: vcDNA=SeqID_87338; Strand=+; Position=1-405
FKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160916 - protein, 162 aa, Heterodera glycines
  misc_feature (148)..(148): Xaa can be any naturally occurring amino acid
  Coding regions on vcDNA: vcDNA=SeqID_87339; Strand=+; Position=45-530
MHEMPQIKFGGNVMGYFQDRVNPGVRFLETSTLMKAWVVGFTRQVGEGDVRNFIQQIVVMGRKRGMNLPDPQYECIELENISERMQQLSDRRIQFLLYIDKKFVKSHAILKLNEKKYGLLTQHVTFEVASKARAMTLSNVLNKMNMKXFGFNYMPMFPQASK

SEQ ID NO: 160917 - protein, 165 aa, Heterodera glycines
  Homolog annotation: Hit_ID=XP_391857.1; Match level="QueryCoverage =93%, HitCoverage=20%, E-value=5e-28, Identity=38%"; Hit description =similar to Na+/H+ antiporter [Apis mellifera]
  Gene Ontology: Mol. function=solute:hydrogen antiporter activity; Cellular component=integral to membrane; Biological process=sodium ion transport
  Coding regions on vcDNA: vcDNA=SeqID_87340; Strand=+; Position=2-496
SASVCYLFGNKRRVERIGLVDQFIMGYGGIRGAVCYGLVMSLDPELVECRNMLATTTIIVILFTVFVQGGSIEKLVTYLKVKQFEAHKKTVFEMIADNVSSHMVGGMESIAGLRGDYWFRMKLERYNKKYIKPFIMLNPNDKDMKIVRHNEEIQVKEAVIYLKST

SEQ ID NO: 160918 - protein, 107 aa, Heterodera glycines
  Coding regions on vcDNA: vcDNA=SeqID_87341; Strand=-; Position=236-559
RTVTFSSMTVTFFSMTVTRELSSATSPWRAFTISRICCWKPVFSLIISFHLMTRGSKSLCSSRQDESAFGAAFSAGMKGTISNKSSSGRHLVAIVGRCRGSFVIWGN

SEQ ID NO: 160919 - protein, 106 aa, Heterodera glycines
  Coding regions on vcDNA: vcDNA=SeqID_87342; Strand=-; Position=1-318
NSKCLISNVILLQRIYNPSTQIDHYYCHRLSLSRFRLFDIPPFRCCSSACLSSSCNALYSSVYFSNSSLLPRSAASSKGHVGLNALKTTTVPTTIPVKKIAPFRRM

SEQ ID NO: 160920 - protein, 212 aa, Heterodera glycines
  misc_feature (5)..(5): Xaa can be any naturally occurring amino acid
  Homolog annotation: Hit_ID=CAE70100.1; Match level="QueryCoverage =76%, HitCoverage=21%, E-value=2e-14, Identity=28%"; Hit description =Hypothetical protein CBG16544 [Caenorhabditis briggsae]
  Gene Ontology: Mol. function=MAP kinase kinase kinase activity; Cellular component=cytoplasm; Biological process=cytoskeleton organization and biogenesis
  Coding regions on vcDNA: vcDNA=SeqID_87343; Strand=+; Position=2-636
PNCWXPEPADRPDMRYVLAVLQQIGNDAELQREVAQFLVFRKDEWREMIREQTFALEELKLDLARQMEDLRRREAIVRKRENSHRNFLHLVDVMNVEDVCEWNEDCVCEWVQNIAASAMEDFSEAIVDQLISCILQYEINGCRLLKITEKDLECLGIESVAVRRYFGLKLDELRAMNVQLCNFGCSSLADEQNDSFSSPVEKPILLHVGLYS

SEQ ID NO: 160921 - protein, 194 aa, Heterodera glycines
  Homolog annotation: Hit_ID=NP_494897.3; Match level="QueryCoverage =98%, HitCoverage=19%, E-value=7e-37, Identity=42%"; Hit description =p-type trefoil domain and Glycoside hydrolase, family 31 precursor (106.8 kD) (2F206) [Caenorhabditis ele
  Gene Ontology: Mol. function=catalytic activity; Cellular component =brush border; Biological process=glycogen catabolism
  Coding regions on vcDNA: vcDNA=SeqID_87344; Strand=+; Position=3-584
NKGYTIQSNVPGNLKLKWTSNTLNNPYSRPNLDIEVQYQKMGDGIYVRIGTEDRWLPPLNELRNPSNFEQVISSNSLSFELGNANEPFSFKIQRNDSNKQSIWDTSIGGLVFGDQFIQIATFLSSDRLYGLGENMHHELKHDFSIYKTWSAFSRDQGNEYYVPGSYNGYGVHPFYVGLEPSGKAHGVLILNSNA

SEQ ID NO: 160922 - protein, 203 aa, Heterodera glycines
  Homolog annotation: Hit_ID=NP_504912.2; Match level="QueryCoverage =45%, HitCoverage=34%, E-value=1e-11, Identity=37%"; Hit description =zn-finger, C4-type steroid receptor and Ligand-binding domain of nuclear hormone receptor family member (
  Gene Ontology: Mol. function=ligand-dependent nuclear receptor activity; Cellular component=nucleus; Biological process=regulation of transcription, DNA-dependent
  Coding regions on vcDNA: vcDNA=SeqID_87345; Strand=+; Position=17-625
MEKLAPQNYCLADSTASSLAKAAQMELDFIQSVLLGPQRGNLTAIECLLAQNFSKQSSMMPNYGTERKNAKVPKLEMEKAGGGDEAKLDNGSETDQSDQKQKRKGVGRPKRHPSECKVCGRKSFYCYYSVRCCESCKQFFRRIVAKRTLLNCFGAKNCQIGKDGIRCRGCRLDKCLLAGMDPTMINAMQQEGMAQYLDRLELR

SEQ ID NO: 160923 - protein, 174 aa, Heterodera glycines
  Coding regions on vcDNA: vcDNA=SeqID_87346; Strand=+; Position=61-585
NIQFHKSHKKGKKESDGDKEGEVPSQTEDNGTGLMSNILKKTAVALALQSPFITGSAIRLPSSSTSKAPPMFNQRTNTKNNVLENAVKIPPFKELHANPLGNGIELAKHGQMENEMAAHFHDQRKLSTKSSVAEGKFNPKMRTIDPKFYPQAPRGNVKDTYKSQSGKEVKKVNV

SEQ ID NO: 160924 - protein, 143 aa, Heterodera glycines
  Homolog annotation: Hit_ID=AAO33474.1; Match level="QueryCoverage =93%, HitCoverage=97%, E-value=1e-70, Identity=100%"; Hit description= gland-specific protein g4g12 [Heterodera glycines]
  Coding regions on vcDNA: vcDNA=SeqID_87347; Strand=+; Position=2-433
LKDPKKCQHFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160925 - protein, 101 aa, Heterodera glycines
  Coding regions on vcDNA: vcDNA=SeqID_87348; Strand=+; Position=3-308
FCNWHCGGAATVAEIAKTVLNEEHRLFLSGIRRGLLTFLHIQRQLFVLSNGTLSLRFWHSDYQRFEKEIGREKLRTFQCLFHQNHPNGCPIGPEECPFKHN

SEQ ID NO: 160926 - protein, 151 aa, Heterodera glycines
  misc_feature (11)..(11): Xaa can be any naturally occurring amino acid
  misc_feature (89)..(89): Xaa can be any naturally occurring amino acid
  misc_feature (123)..(123): Xaa can be any naturally occurring amino acid
  misc_feature (131)..(131): Xaa can be any naturally occurring amino acid
  misc_feature (151)..(151): Xaa can be any naturally occurring amino acid
  Homolog annotation: Hit_ID=AAF01032.1; Match level="QueryCoverage =99%, HitCoverage=35%, E-value=3e-53, Identity=69%"; Hit description =casein kinase I epsilon [Xenopus laevis]
  Gene Ontology: Mol. function=casein kinase I activity; Cellular component=nucleus; Biological process=signal transduction
  Coding regions on vcDNA: vcDNA=SeqID_87349; Strand=+; Position=26-476
MELRVGGRNRXLGRKIGGGSFGDIYLRENIMTHEEVALKLECVKTKHPQLHIEAKLHKMMSGGVGIPQVRRCGCEGEYNETVMELLGPXVYDLYHNCSQKFTLKTVLLLAHQMLARIHYSHSXDVIHQYIXSYNCLMGLGKRGNLVYIIDX

SEQ ID NO: 160927 - protein, 57 aa, Heterodera glycines
  Coding regions on vcDNA: vcDNA=SeqID_87350; Strand=+; Position=229-402
FAQLKVKVNLICPFQRFKRTSSPSFTQRLNSYWLTGEWQIHSRENYPTKSDKLTGNK

SEQ ID NO: 160928 - protein, 106 aa, Heterodera glycines
  Coding regions on vcDNA: vcDNA=SeqID_87351; Strand=+; Position=238-555
LPQITKLPLHLPTMATKCLPLELLFEIVPFIPAENAAPNALSSCRLLHKLLLPRVIKWKEIMSENTGFQQQILEMVKALQGDVAELSSRVTVIEKKSHPSLTKKSP

SEQ ID NO: 160929 - protein, 216 aa, Heterodera glycines
  Homolog annotation: Hit_ID=NP_491999.1; Match level="QueryCoverage =87%, HitCoverage=45%, E-value=8e-22, Identity=31%"; Hit description =putative protein (46.1 kD) (1H635) [Caenorhabditis elegans] emb|CAA95854.1| Hypothetical protein W01A8.1a
  Coding regions on vcDNA: vcDNA=SeqID_87352; Strand=+; Position=3-650
EFAVGLSDFDKNAGKDAINRGLSVEQAIEKRIYAAIEATQEIAKNPSEKLTAHANSFLDIANSLSESILGLPRAVEDPEWGLKERVTFLASRIGHRISSKTNERIVEPLLQQMCVLTEQLSKCIVLVDYAKQRQEWTFNKVSQLSTSVVELRNKIETEATRTRKNPGEVLLKIIRFYSSKLNVQMSKLRDRSSELLSSSMQKQILTLTAYVQQLDD

SEQ ID NO: 160930 - protein, 176 aa, Heterodera glycines
  Coding regions on vcDNA: vcDNA=SeqID_87353; Strand=-; Position=7-537
AIVARAIVVAVASVAGAIVVAVSVAPESPPSVSSNRCFNELRLYTTRPSAAAADSPGTPNSLGCCRPHANTTCLQRSVKVRCSAVFGTVSVPCSSQWHVPTKEGWQIFFPLLLCDEKMTFISQKTMNECEKNGRQLNDWGRERDRRESEKERKKGKGRDERTAEECTIKGVNYMCN

SEQ ID NO: 160931 - protein, 99 aa, Heterodera glycines
  Coding regions on vcDNA: vcDNA=SeqID_87354; Strand=-; Position=274-573
MKLLTRIDCCCCCCDGGGGDGLAAATIFVGGVAAAKAATAPLSLLMAEMLFLGLLVVAPALFIFSSMLRFARVSKTRLHSSSPNTQRPRIQPSSRCTKM

SEQ ID NO: 160932 - protein, 128 aa, Heterodera glycines
  misc_feature (37)..(37): Xaa can be any naturally occurring amino acid
  Coding regions on vcDNA: vcDNA=SeqID_87355; Strand=+; Position=3-386
FRPITHFLLSVLSSNCCHFQLPFTAMADTPPPPPPPXPAAAAAAGGGDEAVDLEQRVRQLIMSIGLRNEDALREISILIESFNREHLLHFVEIMARMHAESGTSIDMPGGQNGTTMLMIAAASGRVDF

SEQ ID NO: 160933 - protein, 95 aa, Heterodera glycines
  misc_feature (30)..(30): Xaa can be any naturally occurring amino acid
  Homolog annotation: Hit_ID=CAE56797.1; Match level="QueryCoverage =95%, HitCoverage=18%, E-value=1e-28, Identity=64%"; Hit description =Hypothetical protein CBG24609 [Caenorhabditis briggsae]
  Gene Ontology: Mol. function=protein binding; Cellular component =nucleoplasm; Biological process=skeletal development
  Coding regions on vcDNA: vcDNA=SeqID_87356; Strand=+; Position=2-288
NEFSGDIRDANLALVKSIRNRASYFAELLXNSMKGIGTRDTDLIRLVVTRSEVDLADIRQAYQNMYGTSLENAIASDCSGAYKDGLVAIVKGYYH

SEQ ID NO: 160934 - protein, 95 aa, Heterodera glycines
  Homolog annotation: Hit_ID=CAE56797.1; Match level="QueryCoverage =95%, HitCoverage=18%, E-value=1e-29, Identity=65%"; Hit description =Hypothetical protein CBG24609 [Caenorhabditis briggsae]
  Gene Ontology: Mol. function=phospholipase inhibitor activity; Cellular component=nucleoplasm; Biological process=skeletal development
  Coding regions on vcDNA: vcDNA=SeqID_87357; Strand=+; Position=2-289
NEFSGDIRDANLALVKSIRNRASYFAELLHNSMKGIGTRDTDLIRLVVTRSEVDLADIRQAYQNMYGTSLENAIASDCSGAYKDGLVAIVKGYYH

SEQ ID NO: 160935 - protein, 120 aa, Heterodera glycines
  Coding regions on vcDNA: vcDNA=SeqID_87358; Strand=+; Position=29-391
MEPNDGITDQPTDQDGSDTEATDSTTVGSDSGPNDNDQNATGPTDEDETGTEATNSTTTTTESNAIGEEGTDQDATNSSDQGESDAEAEATDSTTNGSDLEPNDQDENGADADSTTTNGI

SEQ ID NO: 160936 - protein, 153 aa, Heterodera glycines
  Coding regions on vcDNA: vcDNA=SeqID_87359; Strand=+; Position=2-460
TTKMVPWWSSNPSTLNSSMESIEAAAAGEQHRHVRPVHATPPPADEFDGIVIVGQGVTADVTAAGDFVPCSTSTLAQSIERVFGNLQHQQIHPESYEEAKRLLVFAGLFFLLMCAFVLIKFQVAFDDVFRRSPAVWLVGVIICALLMNMSVQI

SEQ ID NO: 160937 - protein, 200 aa, Heterodera glycines
  Coding regions on vcDNA: vcDNA=SeqID_87360; Strand=+; Position=2-601
KFSGFLLHLQELKHFDGQNGKLIGNDSDESLESLVSFISKNGFGLINDERRTKIDQAIQEIEQIVKKWNRKAKIIVMGSYQLGALTKQSDIDAICVVPELRTWRAAKFFGKAKCQIQWNGFRRCADDSLFCHFCLAAQVTGLNRIQDAWVPLIKFKFEIDPKTSVDFDIGLETFAIRDDIFKSEEPIKYEQCDALSAKMA

SEQ ID NO: 160938 - protein, 169 aa, Heterodera glycines
  Homolog annotation: Hit_ID=NP_498775.2; Match level="QueryCoverage =95%, HitCoverage=26%, E-value=2e-45, Identity=51%"; Hit description =protein disulfide isomerase (69.8 kD) (3J225) [Caenorhabditis elegans] gb|AAM22024.1| Hypothetical protei
  Gene Ontology: Mol. function=phospholipase C activity; Cellular component=mitochondrion; Biological process=protein-nucleus import
  Coding regions on vcDNA: vcDNA=SeqID_87361; Strand=+; Position=1-507
RNWHSFDKVDSTIEKKLPDEYAVKGFPTLKILRNGRRFDYNGPREADGIVSYMLDQAKPAAKRLNSAKEVLKFMSPSDVTVVGFFSSESGAFYEAFADAAERTRGDFAVGYALDGAIAQHFGAKFGEVVLFWPEIFHSEYEPKRKIFPRETATSEELVSFWRDNAIPLV

SEQ ID NO: 160939 - protein, 178 aa, Heterodera glycines
  misc_feature (153)..(153): Xaa can be any naturally occurring amino acid
  misc_feature (159)..(159): Xaa can be any naturally occurring amino acid
  Homolog annotation: Hit_ID=CAE69683.1; Match level="QueryCoverage =97%, HitCoverage=37%, E-value=7e-32, Identity=46%"; Hit description =Hypothetical protein CBG15936 [Caenorhabditis briggsae]
  Gene Ontology: Cellular component=mitochondrion
  Coding regions on vcDNA: vcDNA=SeqID_87362; Strand=+; Position=1-534
FATEERGKGMALIGGSFSLAFLIGPSIGAFFSIGARESGEFDPSPALLAIALTLAELALLVFFLPETLAKAKNDDCHKQSGHSLRHLLSPRALFSFDFLSPASASSPPVSVPLLQKYSRVYFLFMLLFSAMEFTLGFLTHLRFNYSSMQQGRXYLFSGXCMLVIQGFVVRRIPSTLKA

SEQ ID NO: 160940 - protein, 117 aa, Heterodera glycines
  Coding regions on vcDNA: vcDNA=SeqID_87363; Strand=-; Position=2-352
FFFFFFLFGKNKNLYGKNPVHRKEGIKLNKNRKWGRERELNHKICTIILSNGQCAGRPMFVPEGIVTECQQFDRAKQQRDDEQHTGHAHAELVRNVPCSGTARSHSDLAGTQVQRAL

SEQ ID NO: 160941 - protein, 213 aa, Heterodera glycines
  Coding regions on vcDNA: vcDNA=SeqID_87364; Strand=+; Position=1-639
VDLIFYTRNTAMLSRPLLFIAALLFLFGCCRADGNVVHLSSLNCATKDGGIDGFKAVDDGLILDSSSVTADTSDLPLIGFQKNGKEDLIFKLFVRDGGCVSKANFFTNGQPCTLGESEDMTESDKCPGEGGTSNCTSHEVTCTGIGMAKVAEESNGHAFKVNLANLTKLTNPCAQWKAHFGGVHQVLKGSSSGEKCASAGFPVWIIVVIVIIA

SEQ ID NO: 160942 - protein, 203 aa, Heterodera glycines
  Homolog annotation: Hit_ID=XP_222149.2; Match level="QueryCoverage =89%, HitCoverage=33%, E-value=1e-24, Identity=38%"; Hit description =similar to 2810021H22Rik protein [Rattus norvegicus]
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_87365; Strand=+; Position=1-609
QSPTGTGKTLAFMLPTLQILVQKKLTGAGEGKEQPTSVSDSCRILALVVAPGRDLIVQLFHLFSPLCKKLGLSTLKLHGAGGKQKKKSPKKHMKGKCILICTPGSFEHFLEKEAELKQYLKHLEVLIIDEADRYSDRESMSSLTTLLAALPKQRRTALFSATQSSSIEQLLRFGLRNPTRVHMAADTGEVCTDSTGFDVKVAE

SEQ ID NO: 160943 - protein, 162 aa, Heterodera glycines
  Coding regions on vcDNA: vcDNA=SeqID_87366; Strand=+; Position=2-490
SVRTREHAFVHKIMANREDMMELMVRVKKKDEDIGEQERQMILKGLAVLTEEKLRCHRCSRVDLSVAEASKIRLCPNCNAIYCIDCFTIRKNCMRKECRAPLQALTEDIDFYVDSSCEEDDDGDIVLEPPVAAETEPEESQKEDEQREEGKAEEEAANSKAI

SEQ ID NO: 160944 - protein, 146 aa, Heterodera glycines
  Homolog annotation: Hit_ID=NP_741658.1; Match level="QueryCoverage =92%, HitCoverage=36%, E-value=1e-28, Identity=50%"; Hit description =mitochondrial ribosomal protein S28 (5T457) [Caenorhabditis elegans] emb|CAB61063.1| Hypothetical protein
  Coding regions on vcDNA: vcDNA=SeqID_87367; Strand=+; Position=3-440
YGTPPKQCADRSGRQVNKLFIMPPNRPTRIKKAMNILFGRTEEEKRVTGNFVSRIAERNPRREDMSTTQDWPSVWPTAQSFRSSVVPLPVRMGFRRRPERFAPKGPYGNLELMKIPNFLHLTPAHVHRHGQAIKKFCTKFPEELKH

SEQ ID NO: 160945 - protein, 127 aa, Heterodera glycines
  Coding regions on vcDNA: vcDNA=SeqID_87368; Strand=-; Position=1-381
CIRLTRERGNINKGNWGGGESLEATRRVRWCQSRYVPSACSCAVHSSAHTAAAGRNQRKVGTANASDRSSSSGDGGTLRRPSPLHKLPSHRQISWTSICPGIWSSTISRHWPTFSPNSTKSCRKARR

SEQ ID NO: 160946 - protein, 184 aa, Heterodera glycines
  Homolog annotation: Hit_ID=XP_392892.1; Match level="QueryCoverage =100%, HitCoverage=63%, E-value=1e-92, Identity=68%"; Hit description= similar to ENSANGP00000021747 [Apis mellifera]
  Gene Ontology: Mol. function=protein binding; Cellular component =cytosol; Biological process=microtubule cytoskeleton organization and biogenesis
  Coding regions on vcDNA: vcDNA=SeqID_87369; Strand=+; Position=2-553
RGVLFYGPPGCGKTLLAKAIARECQANFISIKGPELLTMWFGESEANVRDVFDKARAAAPCVLFFDELDSIAKSRGGNVGDAGGAADRVINQVLTEMDGMGSKKNVFIIGATNRPDIIDSAILRPGRLDQLIYIPLPDEPSRLQIYRASLRKTPIAKDVELEYLAKVTVGFSGADITEICQRAC

SEQ ID NO: 160947 - protein, 150 aa, Heterodera glycines
  Coding regions on vcDNA: vcDNA=SeqID_87370; Strand=+; Position=9-461
SASPNVGRFEAVEFIIQSFRGWLFSSRMILPAFYSFTFGLTSCTSATFRDEDDSWNWIAASAICGLAHATIRNNIPQGFALAAIGSLLGVSFQAVRISHNGFGMVHNRMTQGFLPFTGPLDWKHIPTDAVDVFFEFGAESFTFRHFLPKA

SEQ ID NO: 160948 - protein, 130 aa, Heterodera glycines
  Coding regions on vcDNA: vcDNA=SeqID_87371; Strand=-; Position=1-390
CIRLTRERGNINKGNWGGGESLEATRRVRWCQSRYVPSACSCAVHSSAHTAAAGRNQRKVGTANASDRSSSSGDGGTLRRPSPLHKLPSHRQISWTSICPGIWSSTISRHWPTFSPNSTKSCRKARRKQD

SEQ ID NO: 160949 - protein, 171 aa, Heterodera glycines
  Homolog annotation: Hit_ID=CAE59922.1; Match level="QueryCoverage =94%, HitCoverage=18%, E-value=1e-36, Identity=48%"; Hit description =Hypothetical protein CBG03408 [Caenorhabditis briggsae]
  Gene Ontology: Cellular component=membrane; Biological process =intracellular protein transport
  Coding regions on vcDNA: vcDNA=SeqID_87372; Strand=+; Position=5-517
GEDKRFPQEQFALQLASMPEFAACGALFKSCAAVELTETITEYNVSCVKHIFNDDFVLLQFDCRNTLNDQLLEEVFVEIEPQDEGEDCPWHVQSVHPLAQLPFGQPCTTYVLLKMPEDGRIAGTFGAKLKFKICDVDPATGEPESNDLYDEVYTLEPIEVGLADFLLATAP

SEQ ID NO: 160950 - protein, 149 aa, Heterodera glycines
  misc_feature (28)..(28): Xaa can be any naturally occurring amino acid
  Homolog annotation: Hit_ID=XP_393373.1; Match level="QueryCoverage =97%, HitCoverage=19%, E-value=1e-25, Identity=44%"; Hit description =similar to CG16941-PA [Apis mellifera]
  Gene Ontology: Mol. function=pre-mRNA splicing factor activity; Cellular component=nucleus; Biological process=embryogenesis and morphogenesis
  Coding regions on vcDNA: vcDNA=SeqID_87373; Strand=+; Position=10-460
MGAMPPHMQPGMPPPGMMRPPHGSFMLXLRPPGASVGDEPPNKRPREETLEPEERWLQKVHGQIAVQIATPQNDEWNLKGNTVQIQLDISPSVTALKSLIQEQIGVPATKQKLVYEGIFMKDSQSLAYYNFMPNASVQLQLKERGGRKK

SEQ ID NO: 160951 - protein, 188 aa, Heterodera glycines
  Homolog annotation: Hit_ID=CAE64972.1; Match level="QueryCoverage =95%, HitCoverage=10%, E-value=3e-65, Identity=64%"; Hit description =Hypothetical protein CBG09806 [Caenorhabditis briggsae]
  Gene Ontology: Mol. function=structural molecule activity; Cellular component=clathrin vesicle coat; Biological process=intracellular protein transport
  Coding regions on vcDNA: vcDNA=SeqID_87374; Strand=+; Position=1-564
GFTCVACSYKVVHALLSWDQFEKIILYAKKVNFEPDYLFQMRQVLRTHPENSSKFALMLLNEGPSGEPLADINQIVDCFAEAGNIQQCTAFLLEALKSDDESQGHLQTRLLEMNLMSNPQVADAILGNRMFNHYDRASIGQLCEKAGLPQRALEHFTDLYDIKRTVVHTQHFNSEWLVSYFGRLNVQD

SEQ ID NO: 160952 - protein, 86 aa, Heterodera glycines
  Coding regions on vcDNA: vcDNA=SeqID_87375; Strand=+; Position=2-259
QRMFHEWMSSLRSVLPEPLCHFEDTGLIVLAFVITALVVHLVNLLFASNSGPAPFNHRLLHDCITRLKEQELIIEKANKKKKKKKK

SEQ ID NO: 160953 - protein, 126 aa, Heterodera glycines
  Coding regions on vcDNA: vcDNA=SeqID_87376; Strand=+; Position=41-421
MHLFPLLLVTFAVAGFLSLASGQQNANSTDGPADDDDEAAPVDAEEQFRQLFQAVDADDNGSISGAEALQFWQNKSKTMDPAELKKKLDTFNAKTLDEAVERGFKKVDKNGDSAVSPEELKAYIQS

SEQ ID NO: 160954 - protein, 160 aa, Heterodera glycines
  Coding regions on vcDNA: vcDNA=SeqID_87377; Strand=+; Position=32-511
TCSFSNENYKRTQTFPILLEKMEEINQWVPTYFIEFGTEEQKSSIREKASTEKIIGKSDKRNSAIGNILNEIEPEKVNDKWAKVIHFVPASDDENMLIFFQIENPKFSKSISKNTDLLPYENDPERFESLSMCELYGDDCQPIRELLVKIEELEYCGNEA

SEQ ID NO: 160955 - protein, 137 aa, Heterodera glycines
  Homolog annotation: Hit_ID=AAO33474.1; Match level="QueryCoverage =97%, HitCoverage=97%, E-value=4e-70, Identity=99%"; Hit description =gland-specific protein g4g12 [Heterodera glycines]
  Coding regions on vcDNA: vcDNA=SeqID_87378; Strand=+; Position=13-426
MPTFQILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 160956 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87379; Strand=+; Position=18-434

SEQ ID NO: 160957 - protein, 82 aa, Heterodera glycines
  Coding regions on vcDNA: vcDNA=SeqID_87380; Strand=-; Position=1-246
KITKKQPKKIIYFKFLFFGPPIRSSDSQFNCQSVEAIQFVHGASLKAATPGRTLPSSSSRLAPPPVLTWLTLSSAPHFSAAV

SEQ ID NO: 160958 - protein, 192 aa, Heterodera glycines
  Homolog annotation: Hit_ID=NP_510115.1; Match level="QueryCoverage =95%, HitCoverage=47%, E-value=4e-42, Identity=47%"; Hit description =nuclear Hormone Receptor (nhr-17) [Caenorhabditis elegans] emb|CAA90291.1| Hypothetical protein C02B4.2 [
  Coding regions on vcDNA: vcDNA=SeqID_87381; Strand=+; Position=37-612
MSIDQIDDPLIRELVVKERQFLKLLTSTTAPIHPSVTDALSKPSCFRQFVQHEHNQMKFGDQMNFSYWRAKILSTSIEWAKSFEEIERMDDSDKEAMVVNSAFSILVFSEAFHTPERFTDRIMFPDGLSGFRNFSANIIKERSGLIPTVVAVINNILVPIRRMQMTEIEYVLLLAIVLFDSECLSLSKSAVA

SEQ ID NO: 160959 - protein, 41 aa, Heterodera glycines
  misc_feature (5)..(6): Xaa can be any naturally occurring amino acid
  misc_feature (11)..(11): Xaa can be any naturally occurring amino acid
  misc_feature (15)..(15): Xaa can be any naturally occurring amino acid
  misc_feature (19)..(20): Xaa can be any naturally occurring amino acid
  Coding regions on vcDNA: vcDNA=SeqID_87382; Strand=+; Position=3-128
PPPPXXGKGEXKNRXFFSXXKHSSMSLLNILCLIISAFGGC

SEQ ID NO: 160960 - protein, 154 aa, Heterodera glycines
  Homolog annotation: Hit_ID=AAP30775.1; Match level="QueryCoverage =100%, HitCoverage=84%, E-value=3e-78, Identity=93%"; Hit description= putative gland protein G32E03 [Heterodera glycines]
  Coding regions on vcDNA: vcDNA=SeqID_87383; Strand=+; Position=6-467
MRAVLFLAMVCLVMAVILETANSKAVKKDNKKGAITTPAKGKAAPKGAAKGGIKKDAKSKGKGKKDAKGKKDKKAKPAKGKASPKNDKKPPAAKANDKKSPTKPMAAVKAVPKAAENAQKGPSSAEVVAEESNLDTEAVDDLGAEESDFDQLAE

SEQ ID NO: 160961 - protein, 167 aa, Heterodera glycines
  misc_feature (146)..(146): Xaa can be any naturally occurring amino acid
  misc_feature (157)..(157): Xaa can be any naturally occurring amino acid
  Homolog annotation: Hit_ID=AAL78229.1; Match level="QueryCoverage =93%, HitCoverage=84%, E-value=2e-84, Identity=98%"; Hit description =SCN esophageal gland cell protein [Heterodera glycines]
  Coding regions on vcDNA: vcDNA=SeqID_87384; Strand=+; Position=3-505
FKALFTIGNESNGFFFVLAVLFLVKVDFLQCKYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSELKQYCNNGAENEEENDEXSEREREEERVXEREEQQNSNH

SEQ ID NO: 160962 - protein, 42 aa, Heterodera glycines
  misc_feature (1)..(1): Xaa can be any naturally occurring amino acid
  Coding regions on vcDNA: vcDNA=SeqID_87385; Strand=-; Position=0-125
XKGRDRKRHNTIERVVWRFIVKSRSPPPNECLFFVLRLLFVP

SEQ ID NO: 160963 - protein, 214 aa, Heterodera glycines
  Coding regions on vcDNA: vcDNA=SeqID_87386; Strand=+; Position=31-672
MVVFISTPLYSWCVAIALVLMIISQCCGCSKKKQKKAKEPLKAMPTQKAEEASTGSEKTGQSVVSVRPPNVPTTAPVASNPPISAEQNIASITLTPSDVKTPAPVGGKTGQSVVSDTPPNVPTTVTSKTPIKAGQNAASVRPPVPANTSTSSKHVKAQGTVSKKPSKASSSHTSLKVPDDLVSAIKSHVPSFLHDLASQITGRMDQSSASAMSS

SEQ ID NO: 160964 - protein, 156 aa, Heterodera glycines
  misc_feature (16)..(16): Xaa can be any naturally occurring amino acid
  misc_feature (64)..(64): Xaa can be any naturally occurring amino acid
  misc_feature (70)..(70): Xaa can be any naturally occurring amino acid
  Homolog annotation: Hit_ID=NP_781232.1; Match level="QueryCoverage =82%, HitCoverage=59%, E-value=2e-28, Identity=57%"; Hit description =hypothetical protein CTC00549 [Clostridium tetani E88] ref|NP _780925.1| hypothetical protein CTC00214 [Cl
  Coding regions on vcDNA: vcDNA=SeqID_87387; Strand=-; Position=33-502
RPSQTTHHAMSRDRIXGPRLDVNDSKGGISRTTPPELAPRFHSLPPILHIRSLTPRRSYSKGSXGSFRLXREPRILTGNSISLSLCWRQWGSRYAIRAGRNLPDKEFRYLRTVIVTAAVYLGFSSELSLLPLTFRHRAGVRPYTSHCCFAEPLCFC

SEQ ID NO: 160965 - protein, 170 aa, Heterodera glycines
  Homolog annotation: Hit_ID=XP_236612.2; Match level="QueryCoverage =98%, HitCoverage=10%, E-value=3e-27, Identity=41%"; Hit description =similar to mKIAA0800 protein [Rattus norvegicus]
  Coding regions on vcDNA: vcDNA=SeqID_87388; Strand=+; Position=1-510
MCRVPVANCPPFSLFYPHRCPEPKMLYPAQANIVNRLLSRPSPSYRCTMDTLRRADRRLVFSRFRHWKSFSEESEALTCCAFSPTDNHAFLGTYAGDIFVFNIHTGTVETNYNAQHSAIRTIQPSKDRLMLTSSAYVKPYCILWKMDEKGISIHERLIDFNEEESVEFAN

SEQ ID NO: 160966 - protein, 163 aa, Heterodera glycines
  Homolog annotation: Hit_ID=NP_501856.1; Match level="QueryCoverage =31%, HitCoverage=33%, E-value=7e-13, Identity=53%"; Hit description =transthyretin-like family member (4K923) [Caenorhabditis elegans] pir||T24917 hypothetical protein T14G10
  Coding regions on vcDNA: vcDNA=SeqID_87389; Strand=+; Position=1-489
MNFLPGVPNLPDPFVRILHFCNSEEGETIELPEFRIFVPDTYDLGILVLDQKTLPNSTVNFPVPENPRRRLQQAKRPTEVGTLDESNGKKGAEDGFVTVDAPKSHNAKGLDDLLPPGKTVTKTNGDLLWETQSVEMEEVPAEYDTSIRQSQQHNWEEESNDGN

SEQ ID NO: 160967 - protein, 180 aa, Heterodera glycines
  Coding regions on vcDNA: vcDNA=SeqID_87390; Strand=+; Position=6-545
GRRCTKREHSEEGREIEQTQNTTGEEEEEDNETDDNVGMSSTESDGQDKMKANNGKGTCKNEDESKPSPTVETEQNKVHQSASETVISQKANANNSEECKESNGENGTRISMKRQRRSHSVDSSPQQKRVFSRKNFTAEDKPSTNKNSAEHSNSRDEPAKCDGDEQKCSVSDEQVAADNC

SEQ ID NO: 160968 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87391; Strand=+; Position=36-452

SEQ ID NO: 160969 - protein, 184 aa, Heterodera glycines
  misc_feature (19)..(19): Xaa can be any naturally occurring amino acid
  misc_feature (21)..(21): Xaa can be any naturally occurring amino acid
  Coding regions on vcDNA: vcDNA=SeqID_87392; Strand=-; Position=1-552
STDTVESASLFLRFSLFCXSXFVEFFSPKCAVVVVQLFPRFAFFVSLKGMDDALLLLLLVIFDDQLTVFSSPKCCRCFCFNNNNTFCPSSFLSVAFIFLKSAVSFASFCPFEVELDSAFKRTVWWWTIRAITALKITKLAQCKKIFSEFINLFEESANGGQRNKWTNQKKSGKRKKQRTTDATT

SEQ ID NO: 160970 - protein, 191 aa, Heterodera glycines
  Homolog annotation: Hit_ID=CAG12892.1; Match level="QueryCoverage =97%, HitCoverage=32%, E-value=5e-22, Identity=35%"; Hit description =unnamed protein product [Tetraodon nigroviridis]
  Coding regions on vcDNA: vcDNA=SeqID_87393; Strand=+; Position=3-575
FEPFRAYGLWDGRFLGVVLADSSQPKLWHNLTTAGTIDAIITDPPYGIRERGQRLGSDKRKTPKETEIENDLHKNGQTESAEKDKKGNPSESLTKSAIKKNVGNEDQIDHFGVGFPEKQKYAMSNVFLDLMDLSARLLRPGGRLAFWFPVCRSEYSERILPRMDCMRLVCNCEQTLAKDSSRRLLVYEKLR

SEQ ID NO: 160971 - protein, 223 aa, Heterodera glycines
  Homolog annotation: Hit_ID=NP_492457.1; Match level="QueryCoverage =93%, HitCoverage=24%, E-value=1e-100, Identity=84%"; Hit description= translation Elongation FacTor (94.8 kD) (eft-2) [Caenorhabditis elegans] emb|CAB02985.1| Hypothetical pr
  Gene Ontology: Mol. function=translation elongation factor activity; Biological process=protein biosynthesis
  Coding regions on vcDNA: vcDNA=SeqID_87394; Strand=+; Position=2-670
CASPIANNTPFVLKARPLPEGLPEAIERGDVNSTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASVLTAKPRLLEPVYLVEIQCPEAAVGGIYGVLNRRRGVVFEESQIAGTPMFIVKAHLPVNESFGFTADLRFNTGGQAFPQCVF

SEQ ID NO: 160972 - protein, 205 aa, Heterodera glycines
  misc_feature (58)..(58): Xaa can be any naturally occurring amino acid
  Homolog annotation: Hit_ID=XP_314000.1; Match level="QueryCoverage =100%, HitCoverage=26%, E-value=7e-25, Identity=34%"; Hit description= ENSANGP00000009919 [Anopheles gambiae]
  Gene Ontology: Mol. function=protein phosphatase activity; Cellular component=nucleus; Biological process=cell cycle
  Coding regions on vcDNA: vcDNA=SeqID_87395; Strand=+; Position=1-613
YRILSRDELLSSMHKTGNLKALFPCSEQLILMLDDRPDVWMHSDALIRVNPYRFFCGXIGDINAPPQELLDSVQASEEMENTQADKWTLKQKVKSKTEEDKKEGEKSLLTTKNGEENAQKKGETEEKERGDGGGNGEERTENALAEPIAAIVDDDNALEHVERVLAEVHSLFYQQYDKDKKIPDVKRILGCLRSKVLRGERIVFS

SEQ ID NO: 160973 - protein, 201 aa, Heterodera glycines
  Coding regions on vcDNA: vcDNA=SeqID_87396; Strand=+; Position=2-604
NLRNFLGLPSFDESLFPPKSIALLKVLDSEKNRLEAKREEIVGSQARLTGKYKALCDRVGTTARQIEGVHDRIMSEDELDKLKGEVDALQTFVNKRLEKALQLQAESKRIFETIRPSINSFNEDYLHFLRVDLDSQSTVLSSDFLKKMETLNERLKDHHDLWAKQVVFRYDELLVKLDELSAKCFQPSTEFPAKPNLKNLS

SEQ ID NO: 160974 - protein, 161 aa, Heterodera glycines
  Homolog annotation: Hit_ID=AAL78214.1; Match level="QueryCoverage =95%, HitCoverage=78%, E-value=1e-10, Identity=27%"; Hit description =putative esophageal gland cell protein Hgg-20 [Heterodera glycines]
  Coding regions on vcDNA: vcDNA=SeqID_87397; Strand=+; Position=75-557
MNRRLRKIWICGDVWMDILPSFERGELGLKIALLSYRYDVLVDTHFDGKKELTIWRTIKICDGIGPEPKLSVQIKDKWVEFPFPDCPLPNKIRFKHLWITYIDHSVIEFLRSNKQIWDRSGTDLLIQIESDTNVIKPIWDVFTSEIWPIFATSIRHLSIAN

SEQ ID NO: 160975 - protein, 134 aa, Heterodera glycines
  misc_feature (82)..(83): Xaa can be any naturally occurring amino acid
  Homolog annotation: Hit_ID=AAO33474.1; Match level="QueryCoverage =100%, HitCoverage=96%, E-value=2e-66, Identity=98%"; Hit description= gland-specific protein g4g12 [Heterodera glycines]
  Coding regions on vcDNA: vcDNA=SeqID_87398; Strand=+; Position=18-417
MPNIFKILLIVLLAVVSFRLSASTGDKKTANDGSGNNSSAGIGTKIKRIVTAGLLFTSLATGGAEAIGRSNAQGGNAAGLVXXSHVTNRSMAPPPPPVQFEMGANRLEKMRAHLRELAEKMPVNESKRLSPSGP

SEQ ID NO: 160976 - protein, 192 aa, Heterodera glycines
  misc_feature (14)..(14): Xaa can be any naturally occurring amino acid
  misc_feature (44)..(44): Xaa can be any naturally occurring amino acid
  Homolog annotation: Hit_ID=CAE75288.1; Match level="QueryCoverage =98%, HitCoverage=36%, E-value=9e-58, Identity=56%"; Hit description =Hypothetical protein CBG23256 [Caenorhabditis briggsae]
  Gene Ontology: Cellular component=mitochondrion; Biological process =electron transport
  Coding regions on vcDNA: vcDNA=SeqID_87399; Strand=+; Position=3-576
NFDDVFDEFDPRPXGAASLAQVHRAKLKSSDEYVAVKIQHLHVXDRSFVDMATMEFFVNVASFVFPELKLKWLVRETKLNLPQELDFLREAANADKVRRMFSHMRFVKIPKIHYNYSSDKVLTMEFCEGGQIDDLDYFQVHQLDRHKICRLLGALYSEMIFRRGYVHSDPHPGNVLVRRSANTGREEIVLLD

SEQ ID NO: 160977 - protein, 191 aa, Heterodera glycines
  misc_feature (171)..(171): Xaa can be any naturally occurring amino acid
  Coding regions on vcDNA: vcDNA=SeqID_87400; Strand=+; Position=11-583
LSGEFRPHSVVLTPPRVSHSALSVPSGANFGSDMVQFRQMAHSPPILSVPLATSVHQSSAGRLINSPQAENTTEESNGRLSGQLKHSPTVGSAATSPLASSSTIGVHEISLSYVRPNTFSPSAGDDRRSLPTYLSSPPARSSAFFPSGSVHMHFSAGKAEDARLLYTIGRXEAEWSFGAGESIQISDSETK

SEQ ID NO: 160978 - protein, 131 aa, Heterodera glycines
  Homolog annotation: Hit_ID=CAE57585.1; Match level="QueryCoverage =100%, HitCoverage=29%, E-value=5e-42, Identity=62%"; Hit description= Hypothetical protein CBG00564 [Caenorhabditis briggsae]
  Gene Ontology: Mol. function=ATP binding; Cellular component =intracellular; Biological process=protein folding
  Coding regions on vcDNA: vcDNA=SeqID_87401; Strand=+; Position=151-543
MSSTTFTLISVPSLIVLLVGYYVQRYGMPPPPPKIAGIDLGTTFSSVAIFQPQTGETIVLKDPLGKRSIPSVVGFLENGEIVVGTRAVEQQEMNPENTIYDAKRFIGRRFSSDDLQFESDRKRYPFTIKLD

SEQ ID NO: 160979 - protein, 181 aa, Heterodera glycines
  Homolog annotation: Hit_ID=NP_871644.1; Match level="QueryCoverage =75%, HitCoverage=15%, E-value=5e-17, Identity=34%"; Hit description =putative cytoplasmic protein of ancient origin (3H529) [Caenorhabditis elegans]
  Coding regions on vcDNA: vcDNA=SeqID_87402; Strand=+; Position=11-553
MAEEAERMSARELASHGVSIGIPAVHDRSIDFPRICKKEEKLSRGLVSNSVDVGISGFYDRFVAPRLRTGVDSVDNLAKWAENYLKRVLFNPESVGSAAERAAKIAAEHKRDGHIMCHFLDDWLTHSSEANTNFFSYVAMEKFHNGVAKAMKGACPDDVQRKLEDVRRRVLSAPMNVHFGG

SEQ ID NO: 160980 - protein, 118 aa, Heterodera glycines
  misc_feature (16)..(16): Xaa can be any naturally occurring amino acid
  Homolog annotation: Hit_ID=NP_495238.2; Match level="QueryCoverage =99%, HitCoverage=88%, E-value=1e-29, Identity=52%"; Hit description =vacuolar protein sorting 55 family member, possibly N-myristoylated (14.1 kD) (2G487) [Caenorhabditis ele
  Coding regions on vcDNA: vcDNA=SeqID_87403; Strand=+; Position=1-356
VTGLTLLVLSCALPSXSNWWPLFVLFFYFLAPLPISIAKHSRYESSGTSPAIEFAQFATAGIVLSAFALPFVLAHAGVIAFGAFVVASLGSLVIFCTIFAYFYLHQLEENGGWSASVI

SEQ ID NO: 160981 - protein, 92 aa, Heterodera glycines
  Coding regions on vcDNA: vcDNA=SeqID_87404; Strand=+; Position=15-290
QEPKWDQHNNDPALSTLKSCPRCWQAFLRFGYKYQNVRLFHRHLFRHKVDGHSLTTESSGPTDSLKRHTHVFLIALLEKANRWKKKKKKKKK

SEQ ID NO: 160982 - protein, 105 aa, Heterodera glycines
  Coding regions on vcDNA: vcDNA=SeqID_87405; Strand=+; Position=2-316
SRLRPAANRRRLRRRTSCERWNHQVLTVTTFLGLSPFLPPLSLWFFIYLCYWYFSDLDSVFVFFWIYPISFLDRVVVWICTVLLTILCSVIYKFCDKKKKKKKKK

SEQ ID NO: 160983 - protein, 94 aa, Heterodera glycines
  Coding regions on vcDNA: vcDNA=SeqID_87406; Strand=+; Position=113-394
KLGAATTFVVRLLADEFNCKSLSDHGPMRQSFARLRRSASHGPAETGEPPRLRKGAKKEFDLIRSLVNVLFKFVLILFSMRIKSYQKKKKTTNK

SEQ ID NO: 160984 - protein, 140 aa, Heterodera glycines
  misc_feature (127)..(127): Xaa can be any naturally occurring amino acid
  Homolog annotation: Hit_ID=NP_956157.1; Match level="QueryCoverage =91%, HitCoverage=75%, E-value=5e-29, Identity=47%"; Hit description =ubiquitin-conjugating enzyme E2G 1 [Danio rerio] gb|AAH45512.1| Ubiquitin-conjugating enzyme E2G 1 [Danio
  Gene Ontology: Mol. function=ubiquitin-protein ligase activity; Cellular component=endoplasmic reticulum; Biological process =conjugation with cellular fusion
  Coding regions on vcDNA: vcDNA=SeqID_87407; Strand=+; Position=84-503
MSSSHRETGRSPRSVLMRQYEMLLQNSNDNSGFRAWFDNNNLFKWRILIDGPPGTPYAGCKLTALLHFPASYPNDPPTMTFLTDILHPNIDQSGKVCISILHAPGIDPLGHEQPSERWNPNRSVESXLVSIQVLLAEPNL

SEQ ID NO: 160985 - protein, 161 aa, Heterodera glycines
  Homolog annotation: Hit_ID=CAA48632.1; Match level="QueryCoverage =66%, HitCoverage=62%, E-value=5e-11, Identity=35%"; Hit description =OV25-1 protein [Onchocerca volvulus] pir||S29692 OV25-1 protein - nematode (Onchocerca volvulus)
  Coding regions on vcDNA: vcDNA=SeqID_87408; Strand=+; Position=19-504
MLSPFSYDPFYRRSLWPMTTVGNVLSPFRQLERELDHFFDGMQPMLRDHAAQLNVTDKGELTYKVDVSGFRPEEINVEVIGNEIIVNGEHREQNDSESVHRQFSRRVLIPEGIQKESIKCELDGGRLCICGMKTAGEGGRTIPIEMKKKAAVEQQPQAEKK

SEQ ID NO: 160986 - protein, 215 aa, Heterodera glycines
  Homolog annotation: Hit_ID=AAC48174.4; Match level="QueryCoverage =99%, HitCoverage=46%, E-value=4e-69, Identity=56%"; Hit description =Nuclear hormone receptor family protein 1, isoform c [Caenorhabditis elegans] gb|AAO39168.1| nuclear recep
  Gene Ontology: Mol. function=ligand-dependent nuclear receptor activity; Cellular component=nucleus; Biological process =transcription from Pol II promoter
  Coding regions on vcDNA: vcDNA=SeqID_87409; Strand=+; Position=1-645
LGWQRCNGMQNILRRTIVSEHSFVCQYSGNCDVTKNVRCACRHCRFAKCAAVGMDAKAIQNDRDRIGPTKRVRLSPGPDGKRSSMDEDQLSLSSLSPQARYQDEKLVDHTMTVEALCNVLRKCVLVENKSVQEALAQPSLIFQARDLPIDERTEFKELYPASMNDIQMWNIRELRLCLEWAKTFEEFQRMTYSDQFALVRHFAFTFNILNRVFYS

SEQ ID NO: 160987 - protein, 107 aa, Heterodera glycines
  Coding regions on vcDNA: vcDNA=SeqID_87410; Strand=-; Position=2-322
FHCTFSINRLLFALFLCPSLFLFTLLSANVISSLRCLWSSSSRNGCSAGLWPKSPAKWLRVRRPRKTSGRRRANNRWRRNGDEKVKDVVPSGGIQSGTNLLALGKAR

SEQ ID NO: 160988 - protein, 165 aa, Heterodera glycines
  Homolog annotation: Hit_ID=CAE75409.1; Match level="QueryCoverage =95%, HitCoverage=28%, E-value=2e-77, Identity=85%"; Hit description =Hypothetical protein CBG23399 [Caenorhabditis briggsae]
  Gene Ontology: Mol. function=Pol II transcription elongation factor activity; Cellular component=nucleosome; Biological process =regulation of transcription from Pol II promoter
  Coding regions on vcDNA: vcDNA=SeqID_87411; Strand=+; Position=18-512
LGRCLLVKELLLPKLKAKPVRTASGIVIVAVMCKPHRCPHINFTGNICVYCPGGPDSDFEYSTQSYTGYEPTSMRAIRARYNPYLQAVGRISQLQSLGHSIDKVEFIVMGGTFVSLPEDYRDYFIRNLHDALSGHRSCNVKEAVAYGEHSRTKCIGITTETRPDY

SEQ ID NO: 160989 - protein, 177 aa, Heterodera glycines
  Homolog annotation: Hit_ID=CAE59860.1; Match level="QueryCoverage =88%, HitCoverage=45%, E-value=7e-29, Identity=40%"; Hit description =Hypothetical protein CBG03335 [Caenorhabditis briggsae]
  Gene Ontology: Mol. function=UDP-glycosyltransferase activity; Cellular component=membrane fraction; Biological process=steroid metabolism
  Coding regions on vcDNA: vcDNA=SeqID_87412; Strand=+; Position=48-578
MLTWPFVDAFVIAPKIALLTGRNDFSFDQLYYRSEIALVDSIDLPAFPQPRATDVLSAGAHCEVPTELPKDYRVFVEDPHSKGTVYVAFGTAVPWDYAPPHIANAFFDAFERLSDHRFIFSFRGTFPNRTLSSHIRLVSWAPQLEVLSHPKTKVFLTHSGLKSIKESLCSGTPMLTM

SEQ ID NO: 160990 - protein, 168 aa, Heterodera glycines
  Homolog annotation: Hit_ID=NP_990605.1; Match level="QueryCoverage =91%, HitCoverage=7%, E-value=3e-32, Identity=44%"; Hit description =MHC [Gallus gallus] emb|CAA29793.1| unnamed protein product [Gallus gallus] pir||S03166 myosin heavy chain
  Gene Ontology: Mol. function=ATP binding; Cellular component=myosin; Biological process=cytokinesis
  Coding regions on vcDNA: vcDNA=SeqID_87413; Strand=+; Position=36-542
TTNAGGYKQLEDLTNTKKTLQLELDEMLTNKDDVGKNTFELEKSKRAMEKEMEDLRMQVEELEEAVQLAEDQRLRMEVNIQAERNEFKQQLEQKDQEGENRRRLLQSQLREKEMQLEDELRARTRQRTVVTSLEVKVQQLQDQVDQLNTERATFQRRLRALANQFGRD

SEQ ID NO: 160991 - protein, 163 aa, Heterodera glycines
  Coding regions on vcDNA: vcDNA=SeqID_87414; Strand=-; Position=42-533
VPLLPFAPLFPDNGPLGGRHFRQTTVGGMAPIGRTGPAGGIGAMGDCPVAHTGKDSKFGCCCCWFVCCRFSRALPRIDESSEWFSSCAVPPPFGFAVVVDVPPPPCVVVVVVSLSLLPMPKMPKVPSTIRRKVKRAQKVLKFASWVILILCSLYGGLFLSFCE

SEQ ID NO: 160992 - protein, 187 aa, Heterodera glycines
  Homolog annotation: Hit_ID=NP_497551.1; Match level="QueryCoverage =100%, HitCoverage=56%, E-value=2e-34, Identity=43%"; Hit description= dependent protein phosphoinositide (37.0 kD) (3D502) [Caenorhabditis elegans] gb|AAC68917.1| Hypothetica
  Gene Ontology: Mol. function=3-phosphoinositide-dependent protein kinase activity; Cellular component=plasma membrane; Biological process=insulin receptor signaling pathway
  Coding regions on vcDNA: vcDNA=SeqID_87415; Strand=+; Position=2-632
KEKKVQQIFRERDILRLLSTPANACPFVVHLFCTFQDDESLFFVLSYAPKKDPMARLKKLQRFSVGQCQFAMAELFLALEHIHALDVIHRDVKPENILLREDGHILLSDFGCAKQIIAKRENVAEENAKKREEEEATKLALRRRCSFVGSGAYVSPEVLNGKEVTGACDWWAFGVTLFQLLVGRLPF

SEQ ID NO: 160993 - protein, 85 aa, Heterodera glycines
  Coding regions on vcDNA: vcDNA=SeqID_87416; Strand=+; Position=110-367
MTFHGVDYDIFVCEKTISGLKDDRSENVFNRRQGACASGDDRCDNVFNRGQVASARNGEGRDSILIQGLAFVIVKVVNAVYDMIV

SEQ ID NO: 160994 - protein, 87 aa, Heterodera glycines
  misc_feature (59)..(59): Xaa can be any naturally occurring amino acid
  Coding regions on vcDNA: vcDNA=SeqID_87417; Strand=+; Position=1-261
GNRRSFTPTEFDPIGTAKLLILKDLRRAIVNLNQFAEKALDSCSNPTIVCSPTIGAGGXAADRFHEDGNKKTSAMVMSTGGPHSNLG

SEQ ID NO: 160995 - protein, 75 aa, Heterodera glycines
  Coding regions on vcDNA: vcDNA=SeqID_87418; Strand=+; Position=10-237
KLFLTFLAVKKMNYAKICFIFLQLFPILFHSSEGRVELWQVSQGNPDYYTRGAILNEDAVPNENYNGGGQHYATF

SEQ ID NO: 160996 - protein, 142 aa, Heterodera glycines
  Coding regions on vcDNA: vcDNA=SeqID_87419; Strand=+; Position=150-575
MDDEELEDESESDEEEEQQMVKPKKAGTPTVAQTQQHQLVNAKSAVPPKKGQLANAKTAVPPKKEQLSTQTDKYKGIAAEEERRRAERDKVTLFLRCETLQKMTDGEIKALHPDALAVRTNNRAFCWMVFASEPTADKAFAV

SEQ ID NO: 160997 - protein, 89 aa, Heterodera glycines; identical to SEQ ID NO: 158809
  Homolog annotation: Hit_ID=AAM95699.1; Match level="QueryCoverage =100%, HitCoverage=100%, E-value=2e-45, Identity=100%"; Hit description=33A09 [Heterodera glycines]
  Coding regions on vcDNA: vcDNA=SeqID_87420; Strand=+; Position=12-281

SEQ ID NO: 160998 - protein, 187 aa, Heterodera glycines
  Homolog annotation: Hit_ID=NP_741623.1; Match level="QueryCoverage =97%, HitCoverage=37%, E-value=3e-30, Identity=37%"; Hit description =amiloride-sensitive channel like (5L55) [Caenorhabditis elegans] emb|CAD44144.1| Hypothetical protein T21
  Coding regions on vcDNA: vcDNA=SeqID_87421; Strand=+; Position=3-563
CFPKPAWSHFKTTNVSDSEIDDIVQKGLKKMRNKSDFLSSPWDDLMVVDAFQTISSLNSMEVETNPTVFAMTVQKIGQTQRMANVRKMWQKWNDAVAQRDVTFDEFRQKVGSETVKRSLKNFQRMGGGANWRPIQDVKITWISLRQMCFQPLYSPDEFKDIEEQDQFFKMLIVHGKEYESLDCMSID

SEQ ID NO: 160999 - protein, 200 aa, Heterodera glycines
  Homolog annotation: Hit_ID=AAR35032.1; Match level="QueryCoverage =66%, HitCoverage=68%, E-value=9e-35, Identity=55%"; Hit description =SXP/RAL-2 protein [Meloidogyne incognita]
  Coding regions on vcDNA: vcDNA=SeqID_87422; Strand=+; Position=2-604
LSSLLALFLLSLLCFVFCHFRPHFPPFLQKASVEQRRQYNRIVTSQNDTKAQINSNVQNWASNAGVASDYNNFTSEQQQRSQQFHDAVSGNLTGQALQLFNNLWSIRQNDQITRLAECQQIRAALNATGRDHVLHLLVPIPPPSIVGPPPSGCFPRPPYSKPFGGGFGPKSGGAAIPGRGGPQTPERRNNIGTEEGEEKK

SEQ ID NO: 161000 - protein, 46 aa, Heterodera glycines
  Coding regions on vcDNA: vcDNA=SeqID_87423; Strand=+; Position=1-138
SASTLTHFRVCRPLLNRPLTNWAKSRKALPQLNCSVPSRTVFLPNG

SEQ ID NO: 161001 - protein, 165 aa, Heterodera glycines
  Homolog annotation: Hit_ID=AAL78214.1; Match level="QueryCoverage =66%, HitCoverage=57%, E-value=1e-17, Identity=38%"; Hit description =putative esophageal gland cell protein Hgg-20 [Heterodera glycines]
  Coding regions on vcDNA: vcDNA=SeqID_87424; Strand=+; Position=39-533
MSSEILWSTVFLLLVDCATILFWFFFGHVKKRQRPHKNEIFICGDCWLLVFDFLAPSQLGLEIALINRRFNCIVDEHFKTRKWKLGCMRICHKIGENGTKQLQIVNSDAKPLPIPQNPLPNKVIGFRHIQIHYIDQNVIAFLRRFHRRIFDVCSMVLYIHTDNDR

SEQ ID NO: 161002 - protein, 157 aa, Heterodera glycines
  Homolog annotation: Hit_ID=CAE71764.1; Match level="QueryCoverage =99%, HitCoverage=16%, E-value=4e-52, Identity=57%"; Hit description =Hypothetical protein CBG18756 [Caenorhabditis briggsae]
  Gene Ontology: Mol. function=sodium:chloride/potassium:chloride symporter activity; Cellular component=integral to plasma membrane; Biological process=transport
  Coding regions on vcDNA: vcDNA=SeqID_87425; Strand=+; Position=2-472
MIGELNSIADLISNFFLAAFAITNFACFDASAAKSPGFRPGFRFYNKWLSLFGSALCVLIMFVLHWPTSLVTFFVFIVLFVFIKHNKSHINWGTSTEANRYRRALNSLLKISRTEDHVKNYRPQLLVLSGNPVARQALVDYAYCISNGRSLLLCGHI

SEQ ID NO: 161003 - protein, 51 aa, Heterodera glycines
  Coding regions on vcDNA: vcDNA=SeqID_87426; Strand=-; Position=2-154
SHQLINSFLLLSTWPGRSGVGKTVVESAISDPNVNWVLSSTQFFPHIFPFS

SEQ ID NO: 161004 - protein, 194 aa, Heterodera glycines
  Coding regions on vcDNA: vcDNA=SeqID_87427; Strand=+; Position=14-595
MSHMYKYMEKAGWQTENSELFNYQKQILDKGVPELFSAVINDKNVGKAGAYKEKHNESSDIFSKVYEIADQKFKDLFKNNAFPTLEKLFGDAKALFVNTTPLLDYDIGSLPKRVKFIGGIDLMQPDHKDALPQVFGQPKPVIVFSMSSLLEPSKMPLDKFKTVIQGLGMCEKEVIWKYAKQEDHGRMSLLKHAP

SEQ ID NO: 161005 - protein, 182 aa, Heterodera glycines
  misc_feature (8)..(8): Xaa can be any naturally occurring amino acid
  misc_feature (15)..(15): Xaa can be any naturally occurring amino acid
  Homolog annotation: Hit_ID=NP_507026.1; Match level="QueryCoverage =95%, HitCoverage=44%, E-value=1e-52, Identity=55%"; Hit description =transporter family member (5Q507) [Caenorhabditis elegans] emb|CAB60295.1| Hypothetical protein T10C6.6b
  Gene Ontology: Cellular component=mitochondrion
  Coding regions on vcDNA: vcDNA=SeqID_87428; Strand=+; Position=3-545
AFFFWLPXYLTYNIXWAESEANQLSIWYDIGGIVGSVLGGLASDRLGHRSPIILLMLVLSVPLLFIYSGLGSSRVEHVIGMSLLGVTISGPYNLIVGTIAIDLGSQQALANNAEALSTVTGLIDGIGSAGSALGQLFVPLIQNELGWIWVFHFFILMNFLSSMCLIRRFFHDARLISLSFAP

SEQ ID NO: 161006 - protein, 168 aa, Heterodera glycines
  misc_feature (20)..(20): Xaa can be any naturally occurring amino acid
  Homolog annotation: Hit_ID=CAE72182.1; Match level="QueryCoverage =98%, HitCoverage=30%, E-value=2e-38, Identity=49%"; Hit description =Hypothetical protein CBG19289 [Caenorhabditis briggsae]
  Gene Ontology: Cellular component=mitochondrion
  Coding regions on vcDNA: vcDNA=SeqID_87429; Strand=+; Position=3-505
IAPPFRARDEAELLLLPFFXCFGFTQLNMALLNGSTGVVLSKFEQNSFCRVVEQYRIRLLLLVPPILVFLAKSPLVANFDMSHVRAILSGAAPAGADLCEELKQRFPNLQHICQGYGMTEMCVAIALPILDKERHESSGKLLANLEMKVVDLLTRKEVELGMPGELFV

SEQ ID NO: 161007 - protein, 103 aa, Heterodera glycines
  Homolog annotation: Hit_ID=NP_509029.1; Match level="QueryCoverage =97%, HitCoverage=71%, E-value=2e-17, Identity=43%"; Hit description =putative membrane protein of bilaterial origin (14.5 kD) (XG746) [Caenorhabditis elegans] gb|AAB52666.1|
  Coding regions on vcDNA: vcDNA=SeqID_87430; Strand=+; Position=124-432
MVESRIKCYVCNSGTKGQADCTEDDHDKLKTFIKQCNPLTFGTFAGEEAKACRKVRQTVEDETTIVRECAYTGEELDGKRRTGNKGVTVLIDQCINDQNATFP

SEQ ID NO: 161008 - protein, 98 aa, Heterodera glycines
  Coding regions on vcDNA: vcDNA=SeqID_87431; Strand=+; Position=10-303
NTQIKMFFLCPPIVLLPSALFCVASHGLTNHSKAFGNESESNRTDFFGTEPMEIPCHKSADGFDPMVDDVFALLSAGEEGEEEGNGTKVGITVEEEEE

SEQ ID NO: 161009 - protein, 110 aa, Heterodera glycines
  Coding regions on vcDNA: vcDNA=SeqID_87432; Strand=-; Position=3-332
KTDKKLKLKYTKVEERRGKKERNGRHKEEKKGGQKGRKRWRTKRNNNNNTLIVRETQLLLALLYLGIYTFINPFSSAPRAIHRCFLCRGIIQRRADLHRLCTKSPSSSFS

SEQ ID NO: 161010 - protein, 35 aa, Heterodera glycines
  Coding regions on vcDNA: vcDNA=SeqID_87433; Strand=-; Position=1-105
SPPPPPPPTTCCCCCYLCCGCSSGRGSSTTAETSI

SEQ ID NO: 161011 - protein, 238 aa, Heterodera glycines
  misc_feature (7)..(7): Xaa can be any naturally occurring amino acid
  Homolog annotation: Hit_ID=CAE62153.1; Match level="QueryCoverage =100%, HitCoverage=44%, E-value=1e-101, Identity=70%"; Hit description=Hypothetical protein CBG06199 [Caenorhabditis briggsae]
  Gene Ontology: Cellular component=mitochondrion; Biological process =glutamate catabolism
  Coding regions on vcDNA: vcDNA=SeqID_87434; Strand=+; Position=1-713
VYGRVSXTGRGLWKGLAVFINDEKFMTKLGLTTGFKGKTFIVQGFGNVGLHSHRYLHRDGAICIGVQEYDCAIYNPNGIHPKELEDWKIANGSIRGFPGAKAFEPFTDLIFEKCDILVPAACEKAIHLGNAHRIQAKVIAEAANGPTTPAADAVLMNRGDCLIVPDMFINSGGVTVSYFEWLKNLNHVSFGRLTFKYERDSNYHLLESVQKSLERTFDRAVPVDPSEEFQLRIAGASE

SEQ ID NO: 161012 - protein, 167 aa, Heterodera glycines
  misc_feature (12)..(12): Xaa can be any naturally occurring amino acid
  misc_feature (31)..(31): Xaa can be any naturally occurring amino acid
  Homolog annotation: Hit_ID=NP_957220.1; Match level="QueryCoverage =95%, HitCoverage=23%, E-value=1e-49, Identity=58%"; Hit description =similar to excision repair cross-complementing rodent repair deficiency, complementation group 2 [Danio r
  Gene Ontology: Mol. function=ATP dependent DNA helicase activity; Cellular component=nucleus; Biological process=post-embryonic development
  Coding regions on vcDNA: vcDNA=SeqID_87435; Strand=+; Position=3-501
FPYEYVYPEHFXYMEQLKKVLDAPVSSWECXSGHCLLEMPSGTGKTVSLLALVVAYMRKYPERLHKLIYCSRTIPEIEKCVEELKRLFRYYTNVTGSAPDFLALTLSARKNLCINKSVVSFRYGSAVDGACQRLTASYVRAKRRLNPNLPCCSFFEKFDEKRDMTLP

SEQ ID NO: 161013 - protein, 159 aa, Heterodera glycines
  Coding regions on vcDNA: vcDNA=SeqID_87436; Strand=+; Position=2-478
GIKPASVAGILQRYEMQQFRLSCANFESESSCCSTSQQMEIIVDSESDSNLTRCPCCRCAQVNLICANCLNTNVVRIGKVREDKRRLLRSKSAICHLIQNALADEIKFEGEFHQLSRSIEEIRAKIAHKKDQVGRLRPRISHTESQSERNRQNVLLLEK

SEQ ID NO: 161014 - protein, 124 aa, Heterodera glycines
  Coding regions on vcDNA: vcDNA=SeqID_87437; Strand=+; Position=51-422
NGHLAIESMQKYNNTPFDYVGFSFPWFGIHFLEPFISWSGILRKDPLIILRKQLMDELKARKKLRESGEQQQQQRAKVDFIDLFLETEQNEQQQLTEQCQNEGEAMLSKTALQRVAKRCTLEEI

SEQ ID NO: 161015 - protein, 117 aa, Heterodera glycines
  Coding regions on vcDNA: vcDNA=SeqID_87438; Strand=+; Position=26-379
SLSTSNSMSDTYGFINNISDRISRRVRRKRPTESGVSGVSGAPPETRKDDKAKGGCCSKKCACIIVCSILTLIVLVIGGLVLAAVLTPETFKNAPLLSLIAGKKNGGADGEGEDTND

SEQ ID NO: 161016 - protein, 168 aa, Heterodera glycines
  misc_feature (19)..(19): Xaa can be any naturally occurring amino acid
  Homolog annotation: Hit_ID=NP_741153.1; Match level="QueryCoverage =100%, HitCoverage=31%, E-value=2e-67, Identity=75%"; Hit description= chaperonin Containing TCP-1 (58.9 kD) (cct-6) [Caenorhabditis elegans] gb|AAC46642.1| Chaperonin contain
  Gene Ontology: Mol. function=chaperone activity; Cellular component =actin filament; Biological process=protein folding
  Coding regions on vcDNA: vcDNA=SeqID_87439; Strand=+; Position=18-520
MEHEMETDTQLIRGLVLDXGGRHPDMPKSVRNVHILTCNVSLEFEKTEVNSGLFYKTAAERERLLQAEREYITRRVLKIVELKETVCAGGDQGFVVINQKGIDPPSLDLLVQHGILALRRAKRRNMERLQLACGGEAVNSVDDLTPDVLGWAGSVYEHVLGEDKYTFV

SEQ ID NO: 161017 - protein, 170 aa, Heterodera glycines
  Homolog annotation: Hit_ID=AAH73434.1; Match level="QueryCoverage =100%, HitCoverage=39%, E-value=2e-45, Identity=52%"; Hit description= MGC80921 protein [Xenopus laevis]
  Gene Ontology: Mol. function=dolichyl-diphospho-oligosaccharide -protein glycosyltransferase activity; Cellular component=endoplasmic reticulum; Biological process=protein modification
  Coding regions on vcDNA: vcDNA=SeqID_87440; Strand=+; Position=47-556
SGSRPGPPSYRHPTIRESHSVFIKSLEERGHSVIIAMADDPNLSLIKFGEFLYDHLIIFAPSVDDFGGNINVDEITKFIDGGGNVLVAADKNLGDAIRDLAAEVGFEFGEDQSMVIDHRNYDTVLDDGSHTTIAVPNAQLIKAPLITGESALLAPVLYRGIALVADELGP

SEQ ID NO: 161018 - protein, 194 aa, Heterodera glycines
  Homolog annotation: Hit_ID=AAB53231.1; Match level="QueryCoverage =99%, HitCoverage=70%, E-value=2e-91, Identity=87%"; Hit description =prohibitin-like molecule TC-PRO-1 [Toxocara canis]
  Gene Ontology: Cellular component=mitochondrial inner membrane; Biological process=proteolysis and peptidolysis
  Coding regions on vcDNA: vcDNA=SeqID_87441; Strand=+; Position=3-584
AGVLAKLTLHVDAGQRAVIFDRFTGVKPNVTGEGTHFLIPWVQRPIMFDIRSTPRAVNTITGSKDLQNVSITLRILHRPDPSKLPQIYLNIGTDYAERVLPSITNEILKAVVAQFDAHEMITQRESVSHRVSVELAERAKQFGFILDDISITHLSFGREFTEAVEMKQVAQREAEKARYLVEKAEQMKLAAITT

SEQ ID NO: 161019 - protein, 171 aa, Heterodera glycines
  Homolog annotation: Hit_ID=CAE67097.1; Match level="QueryCoverage =100%, HitCoverage=27%, E-value=3e-30, Identity=42%"; Hit description= Hypothetical protein CBG12508 [Caenorhabditis briggsae]
  Gene Ontology: Mol. function=ATP dependent RNA helicase activity; Cellular component=nucleolus; Biological process=ribosomal large subunit assembly and maintenance
  Coding regions on vcDNA: vcDNA=SeqID_87442; Strand=+; Position=3-515
APTGSGKTLSFAIPLIVRVLSARKERSPANGQQKCADIHSLCAVVIEPTKILAKQTYENFVRFCDGLDINCEYLRENGIGDKCDILVTTPNRFIFALEKLSDDGQKRAKLVENLQWLLLDECDRMFDRTEGEASFRVQLSKILRLCNGKETRRGFYSATFSYEVEEWCKEH

SEQ ID NO: 161020 - protein, 120 aa, Heterodera glycines
  Homolog annotation: Hit_ID=NP_353964.1; Match level="QueryCoverage =89%, HitCoverage=19%, E-value=9e-22, Identity=46%"; Hit description =hypothetical protein AGR_C_1721 [Agrobacterium tumefaciens str. C58] ref|NP_531642.1| sucrose hydrolase [
  Coding regions on vcDNA: vcDNA=SeqID_87443; Strand=+; Position=204-563
MDNVTLAKTDQFIEYEFHELALLLEGPANLEWAKEDTRVSYIYVFEPDTVLERGIRPAFISNAARFPDVREGYHFRPPLGWMNDPNGFSKFGDHFHLFYQHYPHALHWSAMFWGHAVSRD

SEQ ID NO: 161021 - protein, 179 aa, Heterodera glycines
  Coding regions on vcDNA: vcDNA=SeqID_87444; Strand=+; Position=3-539
RMNVQPPPTATHSQPTILPMPIQNWSHELGIEFGDVLIADLLRRMCSPDFSSPLAPSARWHDIPFFEQFRSDLQFQWTLLRSVLVGGNRGKLNAKLLSILFWTVSDREEWQKRTVARLIYAAKDDKELANLVSLVIAVLPQLCQHRQQSSGELGLMSAAILLALADARRFGTEWDQFVM

SEQ ID NO: 161022 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87445; Strand=+; Position=37-453

SEQ ID NO: 161023 - protein, 216 aa, Heterodera glycines
  misc_feature (200)..(200): Xaa can be any naturally occurring amino acid
  Coding regions on vcDNA: vcDNA=SeqID_87446; Strand=+; Position=10-657
AHINLFVYQKQQKKMIAPLITIIVITSLVIGGHAFSADLTEIVENANEYVEKLDQEFITALDVGPFDHYTGPLGTRPEPITAVMAGGYACGSDEAPGSKAGSIALGLLCFPLMGLFHKCCEDHDACYDKCGAVFGDCEGNFCECLTWSLLMGPHCIVVGLSHCTATTYGGRAAFDKAQNIACCKEKLSPCLDQQRTCYSXCGKTRQKCDDECNKCA

SEQ ID NO: 161024 - protein, 167 aa, Heterodera glycines
  Homolog annotation: Hit_ID=CAE68825.1; Match level="QueryCoverage =87%, HitCoverage=22%, E-value=1e-28, Identity=47%"; Hit description =Hypothetical protein CBG14784 [Caenorhabditis briggsae]
  Gene Ontology: Mol. function=uridine diphosphatase activity; Cellular component=integral to Golgi membrane; Biological process=UDP catabolism
  Coding regions on vcDNA: vcDNA=SeqID_87447; Strand=+; Position=33-533
TIQSESLEERSQPALSVEKKERPKTAGMIDMGGASAQIAYELPLGHSDAATGGQENVQLLNLGCRDDESRFRFRLFVTTFLGFGVNEGAKAYEKFLWKRLNNKRQAANSTETDNGKDGAKVPTVVDGCLPVNMLKLSHAEENYDQFVRKGNGDWDSCVSDIASLLFE

SEQ ID NO: 161025 - protein, 174 aa, Heterodera glycines
  Homolog annotation: Hit_ID=CAE68625.1; Match level="QueryCoverage =96%, HitCoverage=18%, E-value=8e-62, Identity=65%"; Hit description =Hypothetical protein CBG14512 [Caenorhabditis briggsae]
  Gene Ontology: Biological process=diacylglycerol catabolism
  Coding regions on vcDNA: vcDNA=SeqID_87448; Strand=+; Position=1-522
RRLRGRTSSKSHENYLRLWAKSLNCPIVSIDYSLAPEHPFPRPTEEVLYVYAWILNNPEKFGWTGSRICMVGDSAGGNLIVSVNLKLVELGVKRIPDGLVPIYTPFLFQYLPSPSRVLSFMDPLLHMGVVIRCAAAYSGSYSDEELDKNCSFHVKSDSAVGNGHLSLQDYVNRV

SEQ ID NO: 161026 - protein, 174 aa, Heterodera glycines
  Coding regions on vcDNA: vcDNA=SeqID_87449; Strand=+; Position=3-524
ADELKKFPSLTDAFKKKRGNILNFEEEEFDEIISNGTSKRDNSPYTDHDYAGTRQLATAKGATGKHQRQKGGGGTAKEPKKKTALVNGTDSVVRSSARPHRPTKRFVEETNESFIRGTSKVRRTSPRKHGKKSTAEGGSEGEESEDDGKEYSVEKVFKKRVKGGKMEYFVKWAG

SEQ ID NO: 161027 - protein, 69 aa, Heterodera glycines
  Coding regions on vcDNA: vcDNA=SeqID_87450; Strand=+; Position=299-505
MMDGRTADEAIVATVSKVGENIQLARASVISSSPANKLFGQTHPKEEFNGVQLGRFISLVSLGHKSDES

SEQ ID NO: 161028 - protein, 140 aa, Heterodera glycines
  Homolog annotation: Hit_ID=NP_501645.1; Match level="QueryCoverage =99%, HitCoverage=46%, E-value=2e-19, Identity=40%"; Hit description =phosphatidylinositol glycan class C like (4K106) [Caenorhabditis elegans] emb|CAA92490.2| Hypothetical pr
  Gene Ontology: Mol. function=catalytic activity; Cellular component =endoplasmic reticulum membrane; Biological process=GPI anchor biosynthesis
  Coding regions on vcDNA: vcDNA=SeqID_87451; Strand=+; Position=74-547
MAHFDLVVLFLCCFELVHSDVFGPFALFCLCSFASSATLLAHFALLRSSDLFQISSSDFVEYCRTFVTILAFGYAFTPVIRTLTTSISTDTIYACAILLFFASLFVHDYGINVPVVSLPLSANLCLAASVFLISRLQSDL

SEQ ID NO: 161029 - protein, 44 aa, Heterodera glycines
  Coding regions on vcDNA: vcDNA=SeqID_87452; Strand=+; Position=238-369
RIQAASLRSTHDQMRACINIDLLITCQREVNSSRMTDRKAPVLY

SEQ ID NO: 161030 - protein, 160 aa, Heterodera glycines
  misc_feature (10)..(10): Xaa can be any naturally occurring amino acid
  misc_feature (19)..(19): Xaa can be any naturally occurring amino acid
  Homolog annotation: Hit_ID=AAO85454.1; Match level="QueryCoverage =97%, HitCoverage=84%, E-value=9e-83, Identity=98%"; Hit description =putative gland protein G16B09 [Heterodera glycines]
  Coding regions on vcDNA: vcDNA=SeqID_87453; Strand=+; Position=1-481
STPSCCPGSXHVVSMMKDXTGTFSASMPKSSLCLSAERVAAAGENQLKTIWCPGNGGQTLINEINAAQSSSDECARSLGFVRAMFEIAASAASHVGANAELANLAVQFREQVGTIDTNCAALGIHVGQISLGTPKGDHPQVHDSESVLSNPGTSGSHKRI

SEQ ID NO: 161031 - protein, 138 aa, Heterodera glycines
  Coding regions on vcDNA: vcDNA=SeqID_87454; Strand=+; Position=14-430
MSFRLLGILCVLLFVAQLTNGDAAWNDANDVNPFKGHQERALAFNEKLKHAEENTPENVSPTPTPSINATETPDTNATMTTSEVTGTSTEGPTIKTTAKPAPPSTSSFQMTILNIVLTGLIAVILLVDIVLAVVKCKK

SEQ ID NO: 161032 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_87455; Strand=+; Position=39-455

SEQ ID NO: 161033 - protein, 62 aa, Heterodera glycines
  Homolog annotation: Hit_ID=AAB40622.1; Match level="QueryCoverage =91%, HitCoverage=9%, E-value=9e-20, Identity=84%"; Hit description =RNA polymerase II large subunit
  Gene Ontology: Mol. function=protein binding; Cellular component=DNA -directed RNA polymerase II, core complex; Biological process =regulation of transcription, DNA-dependent
  Coding regions on vcDNA: vcDNA=SeqID_87456; Strand=+; Position=2-187
SGRNFSTQAEWLLETDGTALLRVLSEPDVDFIRTHSNDICEIFEVLGIEAVRKAIEREMNHS

SEQ ID NO: 161034 - protein, 156 aa, Heterodera glycines
  Homolog annotation: Hit_ID=AAP30835.1; Match level="QueryCoverage =100%, HitCoverage=100%, E-value=3e-91, Identity=83%"; Hit description=putative gland protein G33E05; Hg-G33E05 [Heterodera glycines]
  Coding regions on vcDNA: vcDNA=SeqID_87457; Strand=+; Position=65-532
MRTFLFIAVVGLVLAVIMESVNATGNNSPTKGQTPPGSPKGGHGSNKSPTTPHSAGSPHGTQHGNQQNHAAGQTPPGSPKGGHGSNKSPTTPHSAGSPHGTQHGNQQKNATGQTPPGSPKGGHGSNKSPTTPHSAGSPHGTQHGNQQKNATGQTPP

SEQ ID NO: 161035 - protein, 90 aa, Heterodera glycines
  Homolog annotation: Hit_ID=CAA75581.1; Match level="QueryCoverage =100%, HitCoverage=67%, E-value=1e-30, Identity=73%"; Hit description= histone H2A [Aspergillus niger] sp|O13413|H2A_ASPNG Histone H2A
  Gene Ontology: Mol. function=DNA binding; Cellular component=nuclear nucleosome; Biological process=establishment and/or maintenance of chromatin architecture
  Coding regions on vcDNA: vcDNA=SeqID_87458; Strand=+; Position=1-273
QRIGAGAPVYMASVLEYLAAEVLELAGNAARENKKLRITPRHLQLAVRNDEELNKLLAEVTISRGGVLPNIHTELLSKMQQKKQQNDDSQ

SEQ ID NO: 161036 - protein, 172 aa, Heterodera glycines
  Homolog annotation: Hit_ID=NP_510484.1; Match level="QueryCoverage =91%, HitCoverage=92%, E-value=5e-56, Identity=66%"; Hit description =putative N-myristoylated protein, with a transmembrane domain, of bilaterial origin (17.6 kD) (XP588) [Ca
  Coding regions on vcDNA: vcDNA=SeqID_87459; Strand=+; Position=16-531
MQNLFPGKFGQAAQAANTAQMQMKAEHDPSAGFPWWVRFLAKGLGIVGGFVAIFFGVLALFTIHPMCMVAALLQLAAGFLTIALEAPFCCAFVDFIERIAQFSESRAYWQKAALYGGMGIVPILLCAGTETILGAGMICASGVAYGFMALGKKADRTTMLGGANTAGQDPAW

SEQ ID NO: 161037 - protein, 202 aa, Heterodera glycines
  Homolog annotation: Hit_ID=NP_495449.1; Match level="QueryCoverage =100%, HitCoverage=51%, E-value=7e-80, Identity=66%"; Hit description= cystathionine gamma-lyase (43.1 kD) (2H346) [Caenorhabditis elegans] gb|AAB93432.1| Hypothetical protein
  Gene Ontology: Biological process=sulfur amino acid metabolism
  Coding regions on vcDNA: vcDNA=SeqID_87460; Strand=+; Position=1-606
PEKWDMNTVVPPISLATTYKQQFAGMPKGHDYARGGNPTRDVLQQSIAALENARHCRVFSSGLSATAAMANWLHSGDHIIASDDGYGGTQRYFRQISVQHHGMELSFVDLTKLSNLEKEFKPNTKMVWFETPSNPLLKVIDIEAVCRAVQSRSKECIIVVDNTFMTPYFQRPLELGADVAMHSLTKYINGHTDVLMGAMVTN

SEQ ID NO: 161038 - protein, 148 aa, Heterodera glycines
  Homolog annotation: Hit_ID=EAA17393.1; Match level="QueryCoverage =81%, HitCoverage=4%, E-value=2e-13, Identity=32%"; Hit description =hypothetical protein [Plasmodium yoelii yoelii]
  Gene Ontology: Mol. function=cytoskeletal protein binding; Cellular component=cell-cell adherens junction; Biological process=axon guidance
  Coding regions on vcDNA: vcDNA=SeqID_87461; Strand=+; Position=2-445
WQFLRSVEYFAENEIDNFAILFVALFIAIAEADGNVRAKRHEERLKRQDNRADEENRQVDSADREKRQDNRADREKRQEDSADREKRQDNRADREKRQDNRADEENRQVDSADREKRQDNRADREKRQDNRTDREKRQDNRADREKRQ

SEQ ID NO: 161039 - protein, 128 aa, Heterodera glycines
  Coding regions on vcDNA: vcDNA=SeqID_87462; Strand=+; Position=2-385
QMSFRLLGILCVLLFVAQLTNGDAAWNDANDVNPFKGHQERALAFNEKLKHAEENTPENVSPTPTPSINATETPDTNATMTTSEVTGTSTEGPTIKTTAKPAPPSTSSFQMTILNIVLTGLIAVILLV

SEQ ID NO: 161040 - protein, 146 aa, Heterodera glycines
  Homolog annotation: Hit_ID=CAE62149.1; Match level="QueryCoverage =96%, HitCoverage=21%, E-value=3e-16, Identity=39%"; Hit description =Hypothetical protein CBG06195 [Caenorhabditis briggsae]
  Gene Ontology: Mol. function=sodium dependent multivitamin transporter activity; Cellular component=integral to plasma membrane; Biological process=transport
  Coding regions on vcDNA: vcDNA=SeqID_87463; Strand=+; Position=77-514
MFFALDFVLFGLFLLLSLLVGLWHNLPRFVRPSLAASSSNKSDPTGDPSTLKHSSANDFLDGGRRLPVLPVCLSLLTTFVSGIGLLSTPAEIYSRGSAFALFNLCGSFAFALIGIFFLPIFFKLKCLNAYEYFELRFQSQSLRRLA

SEQ ID NO: 161041 - protein, 178 aa, Heterodera glycines
  misc_feature (160)..(160): Xaa can be any naturally occurring amino acid
  Homolog annotation: Hit_ID=CAE68280.1; Match level="QueryCoverage =97%, HitCoverage=55%, E-value=2e-48, Identity=54%"; Hit description =Hypothetical protein CBG13964 [Caenorhabditis briggsae]
  Gene Ontology: Biological process=response to stress
  Coding regions on vcDNA: vcDNA=SeqID_87464; Strand=+; Position=14-550
KSTTGESEESGEEGEAFDLDEYIGRGGLEDEDPNRYIANTVAKVPKEAAENESDEIGILRTRTYDLHITYDKYHQVPRFWLIGYDENGTPLTVQQMKEDFSQDHKDRTITLESHPHVVNLCLATIHPCHHASVMKHLIEQYSESGKELNVLDYLFIFLKXVQAVIPTIEYDYTRSIHF

SEQ ID NO: 161042 - protein, 72 aa, Heterodera glycines
  Coding regions on vcDNA: vcDNA=SeqID_87465; Strand=+; Position=61-279
FFDDGSVPKPFGHFTVQSAFRKKIHIVFRDREESNDLSFVRFGEVQVSLNFNPNSFLRVIWNCLTSRFCTPT

SEQ ID NO: 161043 - protein, 186 aa, Heterodera glycines
  Coding regions on vcDNA: vcDNA=SeqID_87466; Strand=+; Position=1-558
DLVHPPNSSIASNFVTLSSTTDATIGGDLKRWSLLHGVDCSTNWPHFEEYSAELRHFSVSKSRRMQQKEQQKPETGVVLTKKVVKDEDESPQNGSRFRSYLGEGAEDAGTIASSGSGGNLLRSAAKHHSIDSQLSAISSSKSAWSKNEKTSQNNAIPTGNCQQRQKWTKNAETGMILVDNSNLTQQ

SEQ ID NO: 161044 - protein, 107 aa, Heterodera glycines
  Homolog annotation: Hit_ID=CAB03869.1; Match level="QueryCoverage =100%, HitCoverage=11%, E-value=2e-39, Identity=72%"; Hit description= Hypothetical protein C09H6.2a [Caenorhabditis elegans] pir||T19171 hypothetical protein lin-10 - Caenorha
  Gene Ontology: Mol. function=protein binding; Cellular component =synaptic vesicle; Biological process=synaptic vesicle docking
  Coding regions on vcDNA: vcDNA=SeqID_87467; Strand=+; Position=26-346
RISETDVRQDILMDHSLRSISYIADIGDLVVLMARRVPSQQEQTEDEAGGETIRKSPRVICHIFESEESAFIAQSIGQAFQVAYVEFLRANGIEDPNYLRDIDYQEV

SEQ ID NO: 161045 - protein, 152 aa, Heterodera glycines
  Homolog annotation: Hit_ID=CAE58634.1; Match level="QueryCoverage =86%, HitCoverage=95%, E-value=2e-51, Identity=68%"; Hit description =Hypothetical protein CBG01802 [Caenorhabditis briggsae]
  Coding regions on vcDNA: vcDNA=SeqID_87468; Strand=+; Position=58-516
MPLVHNCIARTRHSLLIVLGLIMIMANCGQAMRQQAVAVRGQLRCGNRPASGVKVKLWDEDDGPDPDDVLDEAFTDSSGSFQMRGSTRELTNIDPVLKIYHDCDDGIMPGQRKVKLRIPSQYITNGGLARRTFEVGVLNLETVFAGEERDFI

SEQ ID NO: 161046 - protein, 155 aa, Heterodera glycines
  Homolog annotation: Hit_ID=NP_498330.1; Match level="QueryCoverage =87%, HitCoverage=36%, E-value=8e-29, Identity=49%"; Hit description =leucine-rich repeat containing protein (42.3 kD) (3H237) [Caenorhabditis elegans] gb|AAF60555.1| Hypothet
  Gene Ontology: Mol. function=protein binding; Cellular component =lateral plasma membrane; Biological process=establishment and/or maintenance of epithelial cell polarity
  Coding regions on vcDNA: vcDNA=SeqID_87469; Strand=+; Position=56-520
VSFFRYIFQLALLTLDVLFLQEISSLKNLRELSLRNNLLENLPKEFQRLQCLRELNISGNLLEHFPRELLQIKSLRVLYLGANRLQSFPSDICRLSNLQVLYLGGNALVDVPDTIGQLSELTSLGLADNRLEQIPTAIASLRNLRNLALHNNRLK

SEQ ID NO: 161047 - protein, 140 aa, Heterodera glycines
  Homolog annotation: Hit_ID=NP_501562.1; Match level="QueryCoverage =90%, HitCoverage=39%, E-value=2e-19, Identity=38%"; Hit description =UDP n-acetylglucosamine transporter like (35.5 kD) (4J751) [Caenorhabditis elegans] emb|CAA92454.1| Hypot
  Coding regions on vcDNA: vcDNA=SeqID_87470; Strand=+; Position=59-478
MSSILWTLTSCSCSTIGVEMHSKQVIGSSFSLFSFASFVFMALVTLAEHPEFLRRRRIPLRTYLQIVGIFFVVSLLNNRVLGFGLPFPLIIVFRSSTLLANVLLSWLLQNRTFSPARLFSVLLVSVGIALFTPFSRKSAT

SEQ ID NO: 161048 - protein, 187 aa, Heterodera glycines
  Coding regions on vcDNA: vcDNA=SeqID_87471; Strand=+; Position=1-561
TFGPYSISRNASIHREKNRKRPFSPLENDLGSVCSIAKIKSPKTPRHAVKILKKIDYEDRASCYLVQWNCGSAEEKGPSTTWEWANKLSPNCRKLAKVFEQSIAKDAKKAWEFTDYEVEAILDRTVQGELRYLVKWVGWRVPTWEKVKYLLPDYSELVERFEQLNAKDIQFWTDTKNTGEGKRPMED

SEQ ID NO: 161049 - protein, 158 aa, Heterodera glycines
  Homolog annotation: Hit_ID=NP_498775.2; Match level="QueryCoverage =100%, HitCoverage=25%, E-value=8e-43, Identity=50%"; Hit description= protein disulfide isomerase (69.8 kD) (3J225) [Caenorhabditis elegans] gb|AAM22024.1| Hypothetical prote
  Gene Ontology: Mol. function=phospholipase C activity; Cellular component=mitochondrion; Biological process=protein-nucleus import
  Coding regions on vcDNA: vcDNA=SeqID_87472; Strand=+; Position=3-476
KVDSTIEKKLSDEYAVKGFPTLKILRNGRRFDYNGPREADGIVSYMLDQAKPAAKRLNSAKEVLKFMSPSDVTAVGFFSSESGAFYEAFADAAERTRGDFAVGYALGGAIAQHFGAKFGEVVLFWPEIFHSEYEPKRKIFPRETATSEELVSFWRDNA

SEQ ID NO: 161050 - protein, 161 aa, Heterodera glycines
  Homolog annotation: Hit_ID=NP_510638.2; Match level="QueryCoverage =95%, HitCoverage=50%, E-value=9e-32, Identity=44%"; Hit description =solute carrier family 25 member 21 (31.8 kD) (XQ807) [Caenorhabditis elegans] emb|CAB04651.3| Hypothetica
  Gene Ontology: Mol. function=intracellular transporter activity; Cellular component=mitochondrial inner membrane; Biological process =mitochondrial transport
  Coding regions on vcDNA: vcDNA=SeqID_87473; Strand=+; Position=2-487
TVAREIVHSNGWGTEGLYRGIGANLWRHGVWNSCYFGMYHNLRLFLCSIPSKNSQSSADRLETASLTVRLTIASLSAIVANLANIPFDVAKSRIQGPQPTTGRLYFSTWQSIGLLQRQHGFCSIYRMLFPFAFIFGPGGGMMLVIYEGIYEWLIRRSMALE

SEQ ID NO: 161051 - protein, 62 aa, Heterodera glycines
  Coding regions on vcDNA: vcDNA=SeqID_87474; Strand=+; Position=56-244
RIMSQYQNFNDANLCIAFKDSYLSCVFLNCLASLVCSSFASASSPGSISGVCAQNWVLDRRW

SEQ ID NO: 161052 - protein, 171 aa, Heterodera glycines
  Coding regions on vcDNA: vcDNA=SeqID_87475; Strand=+; Position=2-514
QEKASIVTESSFVTPGIFRRRKMLTGRQLNDEGNNEAKEKSADFKWSIDQIAKIQPIEFDETEEFSLPPENWDPCAKFKTPQFENIDHFWTHNNLIAPSPGLFATASALRRVQPSANSPTTSPFQLALSPFGSGPSCSSKCSLSDSTFMSPTMMLTHSQMSESTKAKMFTA

SEQ ID NO: 161053 - protein, 191 aa, Heterodera glycines
  Homolog annotation: Hit_ID=AAL78214.1; Match level="QueryCoverage =82%, HitCoverage=78%, E-value=2e-11, Identity=28%"; Hit description =putative esophageal gland cell protein Hgg-20 [Heterodera glycines]
  Coding regions on vcDNA: vcDNA=SeqID_87476; Strand=+; Position=55-627
MNRRWICNDVWMDMFPFFDRLQLGLKLALLSPRFEFLVDKHFDGTSELPILKNIVLCKNKATAVPELRVFIDNANYVPFPVPDHSLPKKIRFMHLRICYIDHSVIAFIRANQQMFDKGTNLEFFYVSWNETFFVQPIWNALIRHILPIFVPNIRQLKFPSADHLYCLLRFTSPKVLSDLNIHSIDADRLFP

SEQ ID NO: 161054 - protein, 196 aa, Heterodera glycines
  misc_feature (48)..(48): Xaa can be any naturally occurring amino acid
  Homolog annotation: Hit_ID=NP_506373.1; Match level="QueryCoverage =92%, HitCoverage=21%, E-value=8e-60, Identity=61%"; Hit description =p-type trefoil domain and Glycoside hydrolase, family 31 precursor (5O96) [Caenorhabditis elegans] emb|CA
  Gene Ontology: Mol. function=catalytic activity; Cellular component =brush border; Biological process=protein modification
  Coding regions on vcDNA: vcDNA=SeqID_87477; Strand=+; Position=1-587
PRRFVWEAQPVLARSTFVSSGHYGTHWTGDNSARWVDLRASIIGLIEXNIFGIPHVGADVCGFNLNSNEELCLRWQQLGAFYPFFRNHNSDGEPAQDPTQWQSVANASRVSNLFRYHLVPHLYTLHFLASLRGGTVVRPLFFEFPHDFLTHRLDTQFLWGSDLLVVPVLDPLVDSVRAYFPPDSEWYSISNAHKCA

SEQ ID NO: 161055 - protein, 78 aa, Heterodera glycines
  Coding regions on vcDNA: vcDNA=SeqID_87478; Strand=+; Position=85-318
LEEQMAQKSDLAEQMGTLQTKIDLLETEQRQRVELNACPNAHKHYWDNNCCYHDLKIIDCLTGHRESKRPGDRSLYAK

SEQ ID NO: 161056 - protein, 193 aa, Heterodera glycines
  Coding regions on vcDNA: vcDNA=SeqID_87479; Strand=+; Position=1-579
TSRLKPGIENSERRFDVHKFTCAALELPDFSDFARLRPLIDALIAELDLNDFLGCTAALEMLAETAATAPKCVPFFGQIGLLDKVYALFIRTKEEPDMGIIHIACIRFFAYLCTTDDNALTKFPKFTADVFDAVFRFDAFDVTRRQLAFETLAVISSTSGAKQIFSQNETLYNMQRAMSNLAVAVATAAEPSL

SEQ ID NO: 161057 - protein, 171 aa, Heterodera glycines
  Homolog annotation: Hit_ID=CAE71951.1; Match level="QueryCoverage =63%, HitCoverage=12%, E-value=1e-16, Identity=42%"; Hit description =Hypothetical protein CBG19019 [Caenorhabditis briggsae]
  Gene Ontology: Mol. function=ATP binding; Cellular component =cytoplasm; Biological process=protein kinase cascade
  Coding regions on vcDNA: vcDNA=SeqID_87480; Strand=+; Position=3-515
LDKLPQKLKPKALMSTLRMPETRDCYQCNVERSINDENLYLCCAVPHAVLLFQWYEPLPRFVHLKRVQLDKLSSPYTDLQHPHKPFNLVFRSGAANSDLPMVCIGISRALTSPVGTAQELLRELRTNLQKDKFELQLVDNGTDSTVNNMNDMYSAALFGDCSSDDEIIGSW

SEQ ID NO: 161058 - protein, 153 aa, Heterodera glycines
  Homolog annotation: Hit_ID=NP_501549.1; Match level="QueryCoverage =100%, HitCoverage=81%, E-value=4e-74, Identity=92%"; Hit description= vertebrate Rap GTPase homolog, RAS related protein (21.2 kD) (rap-1) [Caenorhabditis elegans] emb|CAA909
  Gene Ontology: Mol. function=RAS small monomeric GTPase activity; Cellular component=plasma membrane; Biological process=signal transduction
  Coding regions on vcDNA: vcDNA=SeqID_87481; Strand=+; Position=47-505
FKIVVLGSGGVGKSALTVQFVQGIFVEKYDPTIEDSYRKQLEFDGQQCMLEILDTAGTEQFTAMRDLYMKNGQGFVLVYSITAQSTFNDLMDLRDQILRVKDTDDVPMILVGNKYDLEDERVVAKEQGMNLARQFNSSFLETSAKHKINVHEV

SEQ ID NO: 161059 - protein, 198 aa, Heterodera glycines
  Homolog annotation: Hit_ID=EAA05539.2; Match level="QueryCoverage =82%, HitCoverage=47%, E-value=3e-17, Identity=33%"; Hit description =ENSANGP00000012626 [Anopheles gambiae str. PEST]
  Gene Ontology: Mol. function=transcription factor activity; Cellular component=nucleus; Biological process=transcription from Pol II promoter
  Coding regions on vcDNA: vcDNA=SeqID_87482; Strand=+; Position=53-646
NHHLEAQNGNSPEGEEESNCGGSASPSSLRDCHSRASTNEHTNISHHSLHDDNAPPSPSLANISTNIELHPHNNALGGSSSHKFIKRPLNAYMIWTRQERKRILTDDPKMKMNEVSKAIQMGEKWKKMSDKEKKPYFEMAKKFSEEHKLVLQEHPELQYAPSKKKVVKKLADGKQLSVVDSSSVKSCTITPDASRSTT

SEQ ID NO: 161060 - protein, 179 aa, Heterodera glycines
  Homolog annotation: Hit_ID=AAR35032.1; Match level="QueryCoverage =74%, HitCoverage=68%, E-value=7e-35, Identity=55%"; Hit description =SXP/RAL-2 protein [Meloidogyne incognita]
  Coding regions on vcDNA: vcDNA=SeqID_87483; Strand=+; Position=2-538
PSNGCFLVLRFVLPSPLFLLSLSSFVFCHFRPHFPPFLQKASVEQRRQYNRIVTSQNDTKAQINSNVQNWASNAGVASDYNNFTSEQQQRSQQFHDAVSGNLTGQALQLFNNLWSIRQNDQITRLAECQQIRAALNATGRDHVLHLLVPIPPPSIVGPPPSGCFPRPPYSKPFGGGFGP

SEQ ID NO: 161061 - protein, 173 aa, Heterodera glycines
  misc_feature (10)..(10): Xaa can be any naturally occurring amino acid
  Homolog annotation: Hit_ID=NP_508842.1; Match level="QueryCoverage =99%, HitCoverage=51%, E-value=1e-91, Identity=97%"; Hit description =actin (act-4) [Caenorhabditis elegans] gb|AAK77622.1| Actin protein 4, isoform b [Caenorhabditis elegans]
  Gene Ontology: Mol. function=structural constituent of cytoskeleton; Cellular component=cytoskeleton; Biological process=actin cytoskeleton organization and biogenesis
  Coding regions on vcDNA: vcDNA=SeqID_87484; Strand=+; Position=2-522
PAEREIVRDXKEKLCYVALDFEQEMATAASSSSLEKSYELPDGQVITVGNERFRCPEALFQPSFLGMESAGIHETSYNSIMKCDIDIRKDLYANTVLSGGSTMYPGIADRMQKEITALAPSAMKIKIIAPPERKYSVWIGGSILASLPTFQQMWISKSEYDESGPSIVHRKCF

SEQ ID NO: 161062 - protein, 197 aa, Heterodera glycines
  misc_feature (126)..(126): Xaa can be any naturally occurring amino acid
  Homolog annotation: Hit_ID=CAE71359.1; Match level="QueryCoverage =63%, HitCoverage=31%, E-value=8e-20, Identity=36%"; Hit description =Hypothetical protein CBG18262 [Caenorhabditis briggsae]
  Coding regions on vcDNA: vcDNA=SeqID_87485; Strand=+; Position=90-681
MQISTLELGPTTSLTLLMDTAPNLDLSSSIGHPSIDWPVGACSTGNDSADEEQWVKLSSDQFAENAVNFSDESAFSAFFVFCKSCVSLECAKLRAYCRTCESSAIIFLNEPQQWDDVKENNSIRIXCHYCDKESCVSFRFKCVKCGEPASPLQHISRNFSLPPSECVICGSNSFPLGVRLRDCTHLSCVQCFVAYAE

SEQ ID NO: 161063 - protein, 207 aa, Heterodera glycines
  misc_feature (9)..(9): Xaa can be any naturally occurring amino acid
  Homolog annotation: Hit_ID=CAE56992.1; Match level="QueryCoverage =100%, HitCoverage=53%, E-value=1e-78, Identity=66%"; Hit description= Hypothetical protein CBG24859 [Caenorhabditis briggsae]
  Gene Ontology: Mol. function=transcriptional activator activity; Cellular component=cytoplasm; Biological process=regulation of cholesterol biosynthesis
  Coding regions on vcDNA: vcDNA=SeqID_87486; Strand=+; Position=1-620
IRKDLVFRXSWGLDKIVNWEAPEILEKYCGYGFLSDHDGNPILMSLLGNTDVEGMLRSVQSKDYIKFSLAAIEKGITLCRERALQTGRPFEQMMLVFDLDHISSAHYSSKQFASSFTTLVLLFQEHFPLVLRKILVIRAPEMGRIAFNSMTPFLSNAIKSMIEMPSEEGWQSALSKYVNLDAWPVHWGGRMMDPNGDPKCPSKIRYG

SEQ ID NO: 161064 - protein, 120 aa, Heterodera glycines
  Homolog annotation: Hit_ID=CAA48632.1; Match level="QueryCoverage =89%, HitCoverage=62%, E-value=1e-10, Identity=34%"; Hit description =OV25-1 protein [Onchocerca volvulus] pir||S29692 OV25-1 protein - nematode (Onchocerca volvulus)
  Coding regions on vcDNA: vcDNA=SeqID_87487; Strand=+; Position=36-398
MQPMLRDHAAQLNVTDKGELTYKVDVSGFRPEEINVEVIGNEIIVNGEHREQNDSESVHRQFSRRVLIPEGIQKESIKCELDGGRLCICGMKTAGEGGRTIPIEMKKKAAVEQQPQVEKK

SEQ ID NO: 161065 - protein, 84 aa, Heterodera glycines
  Coding regions on vcDNA: vcDNA=SeqID_87488; Strand=+; Position=50-301
MKKVPAAKVVHFKSAQETAPPARICGDSIGSLSAAHRQRISICERNEKCCRHRDGENRKKIGCCPFEDGQCCAHSAHCCPAGFA

SEQ ID NO: 161066 - protein, 162 aa, Heterodera glycines
  Homolog annotation: Hit_ID=AAL78214.1; Match level="QueryCoverage =67%, HitCoverage=58%, E-value=9e-16, Identity=38%"; Hit description =putative esophageal gland cell protein Hgg-20 [Heterodera glycines]
  Coding regions on vcDNA: vcDNA=SeqID_87489; Strand=+; Position=35-520
MSSAEILLCALSLILLVEYAIILWIIFDHVKKRLRPHKEIFICGDCWLLVFDFLAPSQLGLGIALISRRFDFYVDEHFKTRKWTLGKMRICHKIEKNGTKKMQIVKSDGNPLPIPQNPLSNKVIGFRGIQINYIDQNAVAFLRRFRRIFAFSSIYLVITEKC

SEQ ID NO: 161067 - protein, 131 aa, Heterodera glycines
  Homolog annotation: Hit_ID=NP_506586.1; Match level="QueryCoverage =95%, HitCoverage=83%, E-value=8e-11, Identity=30%"; Hit description =alpha crystallin family member (5O946) [Caenorhabditis elegans] emb|CAB01147.1| Hypothetical protein F08H
  Coding regions on vcDNA: vcDNA=SeqID_87490; Strand=+; Position=60-452
MTTVGNVLSPLRQLERELDHFFDGMQPMLRDHAAQLNVTDKGELTYKVDVSGFRPEEINVEVIGNEIIVNGEHREQNDSESVHRQFSRRVLIPEGIQKESIKCELDGGRLCICGMKRAGEGGRTIPIEMKK

SEQ ID NO: 161068 - protein, 166 aa, Heterodera glycines
  Homolog annotation: Hit_ID=NP_503408.1; Match level="QueryCoverage =83%, HitCoverage=91%, E-value=9e-17, Identity=35%"; Hit description =putative secreted or extracellular protein precursor (5B870) [Caenorhabditis elegans] gb|AAF60880.2| Hypo
  Coding regions on vcDNA: vcDNA=SeqID_87491; Strand=+; Position=35-532
MYMNSMGSRGASSAAVVASAAALCLFSAMAVVVYGAESAGPKADQAMAAKQFNPSAFPAMPPELEKILPADVVQKLKAVHADMSLNIMQKQDKIDRIMSSLPGEVLDQIPAPPGFERLPDDVKNRLKQINRQTNKAWADKQKELQEYVKTLPHEQRAILMMGPMGG

SEQ ID NO: 161069 - protein, 109 aa, Heterodera glycines
  Coding regions on vcDNA: vcDNA=SeqID_87492; Strand=+; Position=57-386
LCPTRSPNGTAFLPFNALVDAHFDGKPELTLWKTTKIRKQIGVPKSVLANYADSVQFPLADHPLPNKIRFKDLRISYIDHSVIAFLRSNQQIFDNKGTNFGLFSHVNYV

SEQ ID NO: 161070 - protein, 196 aa, Heterodera glycines
  Coding regions on vcDNA: vcDNA=SeqID_87493; Strand=-; Position=1-588
RFDFAHRLTAVLLWWRRRHHLLGLLLLLVVHHHILIKWHSTTLPFVAARLHFWRCRRLLLLSLFGLHHQRIEQLTSQRFIRAQIKGRFDFAHRLSAVLLWRRRWHHPSAVCAGRSRQLGHVCCCCCSSPLLALAVVAVLSNWRSVACGGCCLLLLRLMLPNRCCCCFCWCCCDSSSAVCWSVCVRCLAQDGHVRRT

SEQ ID NO: 161071 - protein, 189 aa, Heterodera glycines
  Homolog annotation: Hit_ID=CAE73686.1; Match level="QueryCoverage =98%, HitCoverage=14%, E-value=6e-69, Identity=70%"; Hit description =Hypothetical protein CBG21197 [Caenorhabditis briggsae]
  Gene Ontology: Mol. function=copper-exporting ATPase activity; Cellular component=integral to membrane; Biological process =intracellular copper ion transport
  Coding regions on vcDNA: vcDNA=SeqID_87494; Strand=+; Position=6-572
DEPATQVHIFAPALSLDNLILFLLATPVQFFGGRNFYMQSWKALKHRTANMDVLVVLATSIAYAYSVSVLILAFLLQWSSSPMTFFDVPPMLFVFISLGRWLENKAKGKTSEALSKLMSMQAKVAILITRDEKTGQITSERGIDTELVQRGDLIKVMAGEKIPVDGIVVEGKSSADESLITGESMHVVK

SEQ ID NO: 161072 - protein, 140 aa, Heterodera glycines
  misc_feature (7)..(7): Xaa can be any naturally occurring amino acid
  Homolog annotation: Hit_ID=NP_495750.1; Match level="QueryCoverage =100%, HitCoverage=26%, E-value=3e-55, Identity=74%"; Hit description= chaperonin Containing TCP-1 (58.4 kD) (cct-4) [Caenorhabditis elegans] emb|CAA88861.1| Hypothetical prot
  Gene Ontology: Mol. function=chaperone activity; Cellular component =actin filament; Biological process=cytoskeleton organization and biogenesis
  Coding regions on vcDNA: vcDNA=SeqID_87495; Strand=+; Position=2-421
EMALHFXRKMKIMVIKDIERDDIEFYAKILGCRPVASVDHFVPESLGTADLVEEIETADGKVLKVTGLKQSGCAVSILVRGSSKLVLDEAERSLHDALCVIRCLVKKRALLPGGGAPEMEVSVRVRAAAHTKHGAEQYCW

SEQ ID NO: 161073 - protein, 157 aa, Heterodera glycines
  Homolog annotation: Hit_ID=CAE57319.1; Match level="QueryCoverage =100%, HitCoverage=23%, E-value=9e-55, Identity=60%"; Hit description= Hypothetical protein CBG00242 [Caenorhabditis briggsae]
  Gene Ontology: Mol. function=long-chain-fatty-acid-CoA-ligase activity; Cellular component=endoplasmic reticulum; Biological process=transport
  Coding regions on vcDNA: vcDNA=SeqID_87496; Strand=+; Position=1-471
SGTTGAPKAAIIRHYRYYLMSIGCGNAFGIVPSDRLYLTLPMYHTAGGILGTSQVVFKGCTACIRTKFSASNFWKDCIRFECTVSQYIGEICRYLLAQPPSPIDRKHPIRLLTGNGLRPQIWRAFVQRFGIAKIGEFYGSTECNSNLLNLDNRPGSC

SEQ ID NO: 161074 - protein, 89 aa, Heterodera glycines
  misc_feature (19)..(19): Xaa can be any naturally occurring amino acid
  misc_feature (29)..(29): Xaa can be any naturally occurring amino acid
  Homolog annotation: Hit_ID=AAO33474.1; Match level="QueryCoverage =98%, HitCoverage=63%, E-value=5e-37, Identity=94%"; Hit description =gland-specific protein g4g12 [Heterodera glycines]
  Coding regions on vcDNA: vcDNA=SeqID_87497; Strand=+; Position=3-269
FLLIVLWAVVSFRLSASTXVTKKTANDGXGNNSSAGIGTKIKRIVTAGLLFTSLATGGAEAIGRSNAQGGNAAGLVPSHVTNRSMAPPP

SEQ ID NO: 161075 - protein, 114 aa, Heterodera glycines
  misc_feature (19)..(19): Xaa can be any naturally occurring amino acid
  Coding regions on vcDNA: vcDNA=SeqID_87498; Strand=+; Position=3-344
RAFHFNRMEMLAFIACGRXSPTTTTSAVSSINCADIGTQTMKHQQQRHQLTNKMPTSMPATTTTRDKPSSSSSRRSSPLPVQVGQDYVSTIELSKRGGGAAAGGGDQRGWPLKS

SEQ ID NO: 161076 - protein, 57 aa, Heterodera glycines
  Homolog annotation: Hit_ID=NP_001006464.1; Match level="QueryCoverage= 91%, HitCoverage=65%, E-value=1e-14, Identity=69%"; Hit description =similar to chromosome 11 open reading frame 10 [Gallus gallus] ref|NP_055021.1| chromosome 11 open rea
  Coding regions on vcDNA: vcDNA=SeqID_87499; Strand=+; Position=1-174
TCFAFLGLIFTAWFFVHGVTSTKKTRNLVKELFIGTLASLFLGFGTLFLMLWVGIYV

SEQ ID NO: 161077 - protein, 172 aa, Heterodera glycines
  Homolog annotation: Hit_ID=NP_490760.2; Match level="QueryCoverage =93%, HitCoverage=54%, E-value=9e-13, Identity=30%"; Hit description =putative nuclear protein, with a coiled coil-4 domain (1B88) [Caenorhabditis elegans]
  Coding regions on vcDNA: vcDNA=SeqID_87500; Strand=+; Position=3-518
PVKETEEIGSGEGTSNNSQENTDKPKRKRRTKEEIEQEKLNKEVNRICRQIQSAKNSKCEQFLFCHFSSKILDLDDKLSDELRKRFEERGIEQQIVYDKSPKNPMQIFWRKKKLEAYLDGEQLHKTERMELQNVFCCVLSGETFSVLVKSRGNSMMDYLDEQMASIRKQIGG

SEQ ID NO: 161078 - protein, 129 aa, Heterodera glycines
  Homolog annotation: Hit_ID=XP_220212.2; Match level="QueryCoverage =96%, HitCoverage=29%, E-value=9e-14, Identity=32%"; Hit description =similar to NOD3 [Rattus norvegicus]
  Coding regions on vcDNA: vcDNA=SeqID_87501; Strand=+; Position=3-392
ALADTLKENSTFTDFGLEGNCFGNEGIKEFSKELEINDTITDIYLSSNYFKSEVVEELLKALEVNKTITNIDLSKNKIGIKGAIALARVLEKNKNIKYINLEDNVIGALGIEALTKVSRRKGIEIGLGS

SEQ ID NO: 161079 - protein, 138 aa, Heterodera glycines
  Homolog annotation: Hit_ID=AAP30776.1; Match level="QueryCoverage =100%, HitCoverage=56%, E-value=1e-78, Identity=100%"; Hit description=putative gland protein G34B08 [Heterodera glycines]
  Coding regions on vcDNA: vcDNA=SeqID_87502; Strand=+; Position=52-465
MRTFLFIAVVGLMLAVILENVNATGKNSPTKGQSPPGSPKHEKDRKNEHGNQQNHATGKSPPGSPRVQSPPGSPRGKSPPGSPRVQSPPGSPRGQSPPGSPKHEKDHKNEHGNQQNHATVPNVVQKVEVHNQPTPSAA

SEQ ID NO: 161080 - protein, 151 aa, Heterodera glycines
  Coding regions on vcDNA: vcDNA=SeqID_87503; Strand=-; Position=26-481
DNIHHWLLHTAAVVVEVALLPPSATLTYTVGCPFHRTRKGLFWHSIRYMPSSNICSILSMTPPSPPPAASFAPNGTVFGVVPILVACGRAGVVAVEPPPPPSFDNSNSLRLLVLFRCCALFAASLAIGWIGLNGFLDDAFAPSLPSTAPFS

SEQ ID NO: 161081 - protein, 143 aa, Heterodera glycines
  Homolog annotation: Hit_ID=NP_497925.1; Match level="QueryCoverage =92%, HitCoverage=20%, E-value=5e-13, Identity=37%"; Hit description =insulin-like growth factor binding protein acid labile, P-granule Associated Novel protein PAN-1 (66.4 kD
  Gene Ontology: Mol. function=calcium ion binding; Biological process =nuclear positioning
  Coding regions on vcDNA: vcDNA=SeqID_87504; Strand=+; Position=3-431
RLGFAWVGPSSSLVSLSLDGNNISRIGCHAFASVGRLSVLSLQHNRITSLSCAATHDPISLTVFLDQSFLQPLQRLSRLSLSHNALQLLGEDDLAGLGALRELLLDHNNISKIARNAFVDLQLRKLFLNNNQLYYLPRGVFSG

SEQ ID NO: 161082 - protein, 165 aa, Heterodera glycines
  misc_feature (19)..(19): Xaa can be any naturally occurring amino acid
  Homolog annotation: Hit_ID=NP_998142.1; Match level="QueryCoverage =93%, HitCoverage=36%, E-value=3e-70, Identity=83%"; Hit description =DEAD (Asp-Glu-Ala-Asp) box polypeptide 39 [Danio rerio] gb|AAH44169.1| DEAD (Asp-Glu-Ala-Asp) box polypep
  Gene Ontology: Mol. function=ATP dependent RNA helicase activity; Cellular component=nucleus; Biological process=RNA localization
  Coding regions on vcDNA: vcDNA=SeqID_87505; Strand=+; Position=1-497
GNEKNRKLLDLLDALEFNXVVIFLRSVSRCRALNQLLIEQNFPSIAIHRAMAQEERLARYQQFKDFQKRILVATNLFGRGMDIERVNIVFNYDMPEDTDTYLHRVARAGRFGTKGLAITFVSDETDAQTLNSVQDRFDVTISELPDQIDVGSYIETRTGNNAAAE

SEQ ID NO: 161083 - protein, 141 aa, Heterodera glycines
  Coding regions on vcDNA: vcDNA=SeqID_87506; Strand=+; Position=1-423
PSPKPAKFPKTPTTNNTKYLPPELLDEMTFYIYPNQNCSRILTSSWLLMEFLRPHIERWKKIFKILLNELIDLHKLCKEGIPWRTFTALAEKDKNCNAFVAALLELVKEDAYASIDGSGSNALFIRFRELYPSVIETLAWT

SEQ ID NO: 161084 - protein, 121 aa, Heterodera glycines
  Coding regions on vcDNA: vcDNA=SeqID_87507; Strand=-; Position=3-365
HAAHGNGDGTGQHFALLVKDELFSGVGRVSYGCKGTVDNAQLFRNEVPQLERNQAEIAENFLTKSGRPANGVDGPCSTCGRDGLGLVNGQVLDGDKFWRWRRFGGTAAHFFFVCLLKVSML

SEQ ID NO: 161085 - protein, 85 aa, Heterodera glycines
  Homolog annotation: Hit_ID=AAO33477.1; Match level="QueryCoverage =100%, HitCoverage=35%, E-value=6e-38, Identity=96%"; Hit description= gland-specific protein g4g05 [Heterodera glycines]
  Coding regions on vcDNA: vcDNA=SeqID_87508; Strand=+; Position=30-284
MSNFIFVAFLTAAFFSSGLALPAPYDAESVVSSELNVPLLSADANVEAAITNESDAAAAIQAPSIAVPIEHQTAADITHPTETGN

SEQ ID NO: 161086 - protein, 150 aa, Heterodera glycines
  Homolog annotation: Hit_ID=XP_415982.1; Match level="QueryCoverage =93%, HitCoverage=8%, E-value=2e-17, Identity=36%"; Hit description =PREDICTED: similar to MOV10-like 1; Mov10 (mouse)-like 1 [Gallus gallus]
  Gene Ontology: Mol. function=ATP dependent RNA helicase activity; Cellular component=intracellular; Biological process=germ-cell development
  Coding regions on vcDNA: vcDNA=SeqID_87509; Strand=+; Position=8-457
LWTSEPATEADTWIPIGGLVGPQTSVMFAGDPKQLGPVVRPENLKWFGFDNSLMKRIMYGDVYSQAGDRVFVTLKQTYRSHYAILRPCSYLFYDNILQVDDGQGDFHKLTEWEGLPTKGFPVIFHSSRGSKDEQGFNRSHHNLFEAELVR

SEQ ID NO: 161087 - protein, 76 aa, Heterodera glycines
  misc_feature (7)..(7): Xaa can be any naturally occurring amino acid
  Homolog annotation: Hit_ID=NP_498808.1; Match level="QueryCoverage =100%, HitCoverage=13%, E-value=4e-30, Identity=73%"; Hit description= GTP-binding protein like (3J337) [Caenorhabditis elegans] pir||S44605 C02F5.3 protein - Caenorhabditis e
  Gene Ontology: Mol. function=GTP binding; Biological process=signal transduction
  Coding regions on vcDNA: vcDNA=SeqID_87510; Strand=+; Position=3-229
QLARLPXSIVISCELSLNLDYMLEKLWEYLALLRIYTKKPGNAPDLGPEDGIILRGNSTVEHACHALYRTLAAQFR

SEQ ID NO: 161088 - protein, 120 aa, Heterodera glycines
  Homolog annotation: Hit_ID=CAE71188.1; Match level="QueryCoverage =98%, HitCoverage=71%, E-value=1e-40, Identity=66%"; Hit description =Hypothetical protein CBG18045 [Caenorhabditis briggsae]
  Coding regions on vcDNA: vcDNA=SeqID_87511; Strand=+; Position=2-364
HDIPDKKPSQPYGLQGTNHLLPGFGKIASKLPTKTILKKDKVYAWCNCGYSHSQPLCDGTHLSVRTPAWAGKLRPVRYIPDKDMEVWLCNCKQTKNRPFCDGSHKKFIEQEKKDVLADDY

SEQ ID NO: 161089 - protein, 103 aa, Heterodera glycines
  Coding regions on vcDNA: vcDNA=SeqID_87512; Strand=+; Position=123-431
SLLAPSFLTVSPLWPFPFRPNSASSHARVFDSEFPSSHSPKLRCVLSANNKTNSRARRYHHPRPQLVIFDKDGTLICFHSLWVPWVRSFAEKVEEAGIDGIAP

SEQ ID NO: 161090 - protein, 112 aa, Heterodera glycines
  Homolog annotation: Hit_ID=CAA70694.1; Match level="QueryCoverage =100%, HitCoverage=30%, E-value=1e-52, Identity=96%"; Hit description= cathepsin S-like cysteine proteinase [Heterodera glycines]
  Coding regions on vcDNA: vcDNA=SeqID_87513; Strand=+; Position=20-355
MAFLSRLSILPNSPISLLAVSLAVLAFVALASANPPTARETAPNAQQNNANSVATGEIAKNIAEKMERMNEFINYFRAKKFIDAHNLAFEKGEVSFKVAPNHLMHFTPAQYN

SEQ ID NO: 161091 - protein, 109 aa, Heterodera glycines
  Homolog annotation: Hit_ID=NP_492711.1; Match level="QueryCoverage =93%, HitCoverage=8%, E-value=5e-45, Identity=80%"; Hit description =glutamyl (E) tRNA Synthetase, glutaminyl (Q) tRNA Synthetase (125.2 kD) (ers-2) [Caenorhabditis elegans] e
  Gene Ontology: Mol. function=glutamine-tRNA ligase activity; Cellular component=mitochondrion; Biological process=protein complex assembly
  Coding regions on vcDNA: vcDNA=SeqID_87514; Strand=+; Position=3-329
LGLRKPCIWAFARLNMTHTVMSKRKLTWLVEQGFVSGWDDPRMPTVRGIIRRGLTVEGLKQFILAQGGSRSVVTMEWDKVWAFNRKVIDPVAPRYTALENASATLVPAT

SEQ ID NO: 161092 - protein, 161 aa, Heterodera glycines
  Homolog annotation: Hit_ID=AAN32888.1; Match level="QueryCoverage =100%, HitCoverage=47%, E-value=4e-83, Identity=97%"; Hit description= annexin 4C10 [Heterodera glycines]
  Gene Ontology: Mol. function=protein binding; Cellular component =nucleoplasm; Biological process=skeletal development
  Coding regions on vcDNA: vcDNA=SeqID_87515; Strand=+; Position=35-517
MLQNGLTILLLISVVIGHSLANLGPTIKHNPHFKAVQTAHHLHDAIAKRHEAEVTQIICSISNEQRQALALEFKKQFGTDLIAMLKKEFKSDFEELIISLMQTPAVYDANQMRAALSGSNEAVLIEILATRTNRQITALKQAYERLDRRHQHNQLEEDIKA

SEQ ID NO: 161093 - protein, 118 aa, Heterodera glycines
  Coding regions on vcDNA: vcDNA=SeqID_87516; Strand=+; Position=81-434
MDSFLVTITPNHQKPVLDISDYRQYYSKKSLFDEDRTVRTFLEMCLSQFSINRDIYSPAGAGKLYEVSPEERVSAGNGIILRPGVAKGVRVVRNYGELAPALVLDIKVSPFYESNGLV

SEQ ID NO: 161094 - protein, 61 aa, Heterodera glycines
  Homolog annotation: Hit_ID=AAL78213.1; Match level="QueryCoverage =100%, HitCoverage=24%, E-value=1e-27, Identity=100%"; Hit description=probable protein kinase Hgg-20 [Heterodera glycines]
  Coding regions on vcDNA: vcDNA=SeqID_87517; Strand=+; Position=56-238
MADELVALAPGTRVSGRWTILKKLGAGAFGAVYLCKDGKGTVAALKTEPIDTRQPLLVMEA

SEQ ID NO: 161095 - protein, 101 aa, Heterodera glycines
  Coding regions on vcDNA: vcDNA=SeqID_87518; Strand=+; Position=1-303
DSFCPPKIRIFLLVEARAIQYAMERIFEGKPKPKLVFLTLEEGIDRLKLNSDNSLILDGKFTVAVSMARNAVHDAYEAGMEVWKALKRSTSIHVFNTLFMS

SEQ ID NO: 161096 - protein, 103 aa, Heterodera glycines
  Homolog annotation: Hit_ID=NP_495324.2; Match level="QueryCoverage =74%, HitCoverage=7%, E-value=5e-17, Identity=53%"; Hit description =human WeRNer syndrome related (118.5 kD) (wrn-1) [Caenorhabditis elegans] gb|AAA68410.2| Human wrn (werner
  Gene Ontology: Mol. function=ATP dependent DNA helicase activity; Cellular component=nucleus; Biological process=aging
  Coding regions on vcDNA: vcDNA=SeqID_87519; Strand=+; Position=3-311
TVNSTLANEHSAVALSSAIPGNDENSSSPAVPSERSLELLKKYFGYSRFRPLQYEVIEAALSKRDQLVVMSTGYGKRVCYQLPSLIQNNLTLVVSPLISLMED

SEQ ID NO: 161097 - protein, 42 aa, Heterodera glycines
  misc_feature (9)..(9): Xaa can be any naturally occurring amino acid
  Homolog annotation: Hit_ID=XP_330536.1; Match level="QueryCoverage =100%, HitCoverage=8%, E-value=2e-10, Identity=69%"; Hit description =hypothetical protein [Neurospora crassa] gb|EAA35723.1| hypothetical protein [Neurospora crassa]
  Coding regions on vcDNA: vcDNA=SeqID_87520; Strand=+; Position=3-129
YFGAHTFQXQSRVANDKFKVGAYTHVNWTGRGGNVSASTYNA

SEQ ID NO: 161098 - protein, 105 aa, Heterodera glycines
  Coding regions on vcDNA: vcDNA=SeqID_87521; Strand=+; Position=1-318
AFLFPIFLFPFSLLSSNVPKLLLLRFTLFFFLCVLFSLVDSRPQLLNSVSTSGLLIGKGSEVKSASVPLLSEPMIEIHSHSAPVSPSELNFSRRRRKRISNNKSN

SEQ ID NO: 161099 - protein, 74 aa, Heterodera glycines
  Coding regions on vcDNA: vcDNA=SeqID_87522; Strand=+; Position=3-224
CIGLNHSTMGILRNRSINRIPIRVEKCAENENGFADDYANYLFDSDQSDSDNADEENEVAAQIQSQPIGGHRRI

SEQ ID NO: 161100 - protein, 109 aa, Heterodera glycines
  Homolog annotation: Hit_ID=CAE59572.1; Match level="QueryCoverage =100%, HitCoverage=22%, E-value=2e-50, Identity=86%"; Hit description= Hypothetical protein CBG02970 [Caenorhabditis briggsae]
  Gene Ontology: Mol. function=NADH dehydrogenase (ubiquinone) activity; Cellular component=mitochondrion; Biological process =energy pathways
  Coding regions on vcDNA: vcDNA=SeqID_87523; Strand=+; Position=3-329
NVETVAVAPAICRRGGAWFASFGRERNRGTKLYCISGHVNDPTTVEEEMSIPLRDLIERHSGGVIGGWDNLLAIIPGGSSVPLLPKSICDDVLMDFDALVQVNSGLGTA

SEQ ID NO: 161101 - protein, 163 aa, Heterodera glycines
  Homolog annotation: Hit_ID=NP_500401.1; Match level="QueryCoverage =91%, HitCoverage=38%, E-value=7e-30, Identity=45%"; Hit description =putative protein family member, with at least 5 transmembrane domains (4E479) [Caenorhabditis elegans] gb
  Coding regions on vcDNA: vcDNA=SeqID_87524; Strand=+; Position=5-493
IPPVLLEQLQLVHLYLSWLYHFKWLYLLGQIFKLSSVLCLIIASFERYLITSHWTFSGFEERTRWLLLTVVLFISIGIRFTTSVDVVILFNEQSVVPFRRYIPAQMTHREWLPNFFNLLTVIIPFGTLVFFNGGIVLMLRRQNVQQLRLLITELTMGYDYMKV

SEQ ID NO: 161102 - protein, 139 aa, Heterodera glycines
  Coding regions on vcDNA: vcDNA=SeqID_87525; Strand=+; Position=4-420
GNFFTLKLITMMLRNRDLNVQPAAGAGAPLPKRQSAHLVKVVGGASSRASSQSSAGSDRDSKYEPRPKRACSQKDKENSHYNNNNHNKSSHNKSKKNTSGGTVVPVTAFSRSLLIDSAKKDVTVVSTAVDAGGGGVLAA

SEQ ID NO: 161103 - protein, 117 aa, Heterodera glycines
  Coding regions on vcDNA: vcDNA=SeqID_87526; Strand=+; Position=1-351
CSLFLLLFSALLLIFLCPPTSAQGRPPPSKSGRPTQHGRVTTDGEEKDGTAEGGAADVESGEKEEPGLSQKLLNVLLNHLISHLPKISTESVVNWVQETFGLDRQTSRNYVRKAHEI

SEQ ID NO: 161104 - protein, 75 aa, Heterodera glycines
  Homolog annotation: Hit_ID=AAO33475.1; Match level="QueryCoverage =98%, HitCoverage=54%, E-value=8e-40, Identity=97%"; Hit description =gland-specific protein g5d08 [Heterodera glycines]
  Coding regions on vcDNA: vcDNA=SeqID_87527; Strand=+; Position=1-225
AKAPSGESKPNPGQKPIGERRKRDVLGHAGGYVGGWDHPIDSTLDWAKSQWNDANWLADVVNTNGWENTGTPTGG

SEQ ID NO: 161105 - protein, 125 aa, Heterodera glycines
  misc_feature (18)..(18): Xaa can be any naturally occurring amino acid
  Homolog annotation: Hit_ID=NP_498989.1; Match level="QueryCoverage =99%, HitCoverage=26%, E-value=4e-52, Identity=75%"; Hit description =amino acid transporter family member (51.3 kD) (3K84) [Caenorhabditis elegans] emb|CAA77582.1| Hypothetic
  Coding regions on vcDNA: vcDNA=SeqID_87528; Strand=+; Position=2-375
AAGDVISPHRAVLTLSKXMFNAGCFSLPYAWMLGGKWVSLALTFVIAGFNWYGNHILVRSSQHLAKKSGVASLDYGHFAKRVCDYSELPFLRRHSKRIMYVINITILFYQLAMCAVAILFIADNM

SEQ ID NO: 161106 - protein, 120 aa, Heterodera glycines
  Homolog annotation: Hit_ID=CAE64709.1; Match level="QueryCoverage =99%, HitCoverage=49%, E-value=5e-30, Identity=52%"; Hit description =Hypothetical protein CBG09495 [Caenorhabditis briggsae]
  Gene Ontology: Mol. function=translation initiation factor activity; Cellular component=eukaryotic translation initiation factor 3 complex; Biological process=translational initiation
  Coding regions on vcDNA: vcDNA=SeqID_87529; Strand=+; Position=3-362
PKHAPVLERAVDLMIKETKYDKDILMTLLKLYQLNPFLYNEKYVCLVLLKTMTNFPRNDFALAKYLVDAAKVNAPELRRVCQIGSLLESCNFALFWRLDDGRYKPRDSVDEPFKKPDEIC

SEQ ID NO: 161107 - protein, 191 aa, Heterodera glycines
  Homolog annotation: Hit_ID=AAH77639.1; Match level="QueryCoverage =95%, HitCoverage=44%, E-value=3e-56, Identity=52%"; Hit description =Acy1-prov protein [Xenopus laevis]
  Gene Ontology: Mol. function=aminoacylase activity; Cellular component=cytosol; Biological process=amino acid metabolism
  Coding regions on vcDNA: vcDNA=SeqID_87530; Strand=+; Position=3-575
KDGSILWGSDEEIGSHDGMEKFVHTDKFRSLNIGFALDEGLASETDTYSVFYGERCAWWLQITCPGAPGHGSRFVENTAGPKLTSILANFNAFRERQRHLLLADPNLRLGDVTSVNLTKIEGGVQTNVIPAQFVAYFDMRVTPTDDFQQMEAMIANWCKEAGPDVTFEFVQKGMCKSLTPTDASSPWWHAF

SEQ ID NO: 161108 - protein, 139 aa, Heterodera glycines
  Homolog annotation: Hit_ID=CAE68337.1; Match level="QueryCoverage =97%, HitCoverage=24%, E-value=4e-37, Identity=54%"; Hit description =Hypothetical protein CBG14058 [Caenorhabditis briggsae]
  Gene Ontology: Mol. function=beta-N-acetylhexosaminidase activity; Cellular component=lysosome
  Coding regions on vcDNA: vcDNA=SeqID_87531; Strand=+; Position=34-450
MAEGQKKAKQKKMIFWQEVFDNNKPDPSNTVVHNWYSRTTQERFLDTKRAVEKGFQVLVSSRRYLNYINYGPDWRDGTGTTRQIYYCDPRGFEGTYEQKQLVIGGIATMWGEYLDGTNLEPNLWSRASAVAERLWSPPE

SEQ ID NO: 161109 - protein, 85 aa, Heterodera glycines
  misc_feature (35)..(35): Xaa can be any naturally occurring amino acid
  misc_feature (75)..(75): Xaa can be any naturally occurring amino acid
  Homolog annotation: Hit_ID=AAM73861.1; Match level="QueryCoverage =81%, HitCoverage=6%, E-value=5e-29, Identity=79%"; Hit description =putative serine/threonine protein kinase; HcSTK [Haemonchus contortus]
  Gene Ontology: Mol. function=protein serine/threonine kinase activity; Cellular component=membrane; Biological process=asymmetric protein localization involved in cell fate commitment
  Coding regions on vcDNA: vcDNA=SeqID_87532; Strand=+; Position=8-262
MLRSLGTENCPCPLGIEEVKPRSLRFTWSMKTTSXLAPDEMMKEIRKVLDSDGCEYEQRERYLLLCAHGDPSKDXLIQWEMEVCK

SEQ ID NO: 161110 - protein, 104 aa, Heterodera glycines
  Coding regions on vcDNA: vcDNA=SeqID_87533; Strand=+; Position=11-322
INDKMFLLFQFIRQRVFSGDSAKGTGEKERSGNENKTGGSTNVPNAKPCSNSLRFLIHLRYTNFALIDAFDTVPICRLASDSSGKVYLHSDIRILFSNKSKDLE

SEQ ID NO: 161111 - protein, 68 aa, Heterodera glycines
  Homolog annotation: Hit_ID=CAE71149.1; Match level="QueryCoverage =86%, HitCoverage=20%, E-value=3e-09, Identity=47%"; Hit description =Hypothetical protein CBG18005 [Caenorhabditis briggsae]
  Coding regions on vcDNA: vcDNA=SeqID_87534; Strand=+; Position=3-206
PFAPERYIWRLFIGLHGTPRLVAAFAFKNFLVTSSLWPFPFRPWYRWASQFACSLNFGRNSVTDLALV

SEQ ID NO: 161112 - protein, 124 aa, Heterodera glycines
  Homolog annotation: Hit_ID=CAE72612.1; Match level="QueryCoverage =78%, HitCoverage=15%, E-value=9e-33, Identity=63%"; Hit description =Hypothetical protein CBG19804 [Caenorhabditis briggsae]
  Gene Ontology: Mol. function=beta-glucuronidase activity; Cellular component=lysosome; Biological process=glycosaminoglycan catabolism
  Coding regions on vcDNA: vcDNA=SeqID_87535; Strand=+; Position=2-373
TAEVRLESLSTSVPIFVVGCYRETFGFRTVTVDQNRIYINGRPFYRHGFGMHEDIGIHGRGFDRAAMVKDMNMFEWLNGNCYRTSHYPYAEERAYWADRRGIAVITEVPAVGIWKLNSSALLKL

SEQ ID NO: 161113 - protein, 152 aa, Heterodera glycines
  Homolog annotation: Hit_ID=NP_496457.1; Match level="QueryCoverage =96%, HitCoverage=73%, E-value=1e-30, Identity=45%"; Hit description =PRELI like (24.2 kD) (2L787) [Caenorhabditis elegans] emb|CAA91373.1| Hypothetical protein B0334.4 [Caeno
  Coding regions on vcDNA: vcDNA=SeqID_87536; Strand=+; Position=44-499
FDALATPRPIFDYSLADVVSVFYNRYPNSFARHNISEDVLWREITDDRIVTKKLIVKKGSSFLSKLPKWISGQAKMQFMPTLEESIYCRRTHKLVTYTRNIAGKHLLNISERSDFRELPNERSAVARHLEVAANCRLHSLVEKVLMMALRKS

SEQ ID NO: 161114 - protein, 168 aa, Heterodera glycines
  misc_feature (154)..(154): Xaa can be any naturally occurring amino acid
  Coding regions on vcDNA: vcDNA=SeqID_87537; Strand=+; Position=3-506
EMLARKITSENFEELAQNLRKNALKLAKESTGKFHFLTENHFYGQFINYLAKIAQLKVEEALKKRRENDNLDELSEKETNDFSEGWKSLQMFVEMYSFGSELFMQLAANYGGKFPKKTRKTMKQLVVKKIPQMDELCQQFVDYFQAKFMKSIPXKLSIEPMNAQKSST

SEQ ID NO: 161115 - protein, 118 aa, Heterodera glycines
  Coding regions on vcDNA: vcDNA=SeqID_87538; Strand=+; Position=3-359
VSNATTPSASYIIRLVSTEIDPVELIPFELMNERTNEMLTFEKEYDHENMEDDENMEDEDASDDWLLKRCQIGETATIQWVWDPSDWQNVSLTLDSVRKNCIGQLSPPKADQMNAKIV

SEQ ID NO: 161116 - protein, 135 aa, Heterodera glycines
  Homolog annotation: Hit_ID=AAN32888.1; Match level="QueryCoverage =97%, HitCoverage=38%, E-value=4e-67, Identity=97%"; Hit description =annexin 4C10 [Heterodera glycines]
  Gene Ontology: Mol. function=phospholipid binding; Cellular component= nucleoplasm; Biological process=skeletal development
  Coding regions on vcDNA: vcDNA=SeqID_87539; Strand=+; Position=1-405
NAPNGLTLLLLISVVIGHSLANLGPTIKHNPHFKAVQTAHHLHDAIAKKHEAEVTQIICSISNEQRQALALEFKKQFGTDLIAMLKKEFKSDFEELIISLMQTPAVYDANQMRAVLSGSNEAVLIEILATRTNRQ

SEQ ID NO: 161117 - protein, 139 aa, Heterodera glycines
  Homolog annotation: Hit_ID=AAP30757.1; Match level="QueryCoverage =96%, HitCoverage=56%, E-value=1e-63, Identity=94%"; Hit description =putative gland protein 30G12 [Heterodera glycines]
  Coding regions on vcDNA: vcDNA=SeqID_87540; Strand=+; Position=2-418
LCRLFTAAFFSSGLALPAPYDAESVVSSELNVPLLSADANVEAAITNESDAAAEIQAPSIPVPIEHQTAADITHPTETGNESSIASSSSTPKSEQTPKKVMNMKSALEGAAANVYGGLPLDKQPKTIAEAAAKAKQTPA

SEQ ID NO: 161118 - protein, 109 aa, Heterodera glycines
  Homolog annotation: Hit_ID=NP_505071.1; Match level="QueryCoverage =100%, HitCoverage=22%, E-value=4e-18, Identity=42%"; Hit description= mannosyltransferase (57.1 kD) (5I519) [Caenorhabditis elegans] gb|AAC48267.3| Hypothetical protein ZC513
  Coding regions on vcDNA: vcDNA=SeqID_87541; Strand=+; Position=3-329
LFFALVLEKARDSWFFRFCAFLVALHLLVNAIFSVSFVYASAQNYPGGVALLKLQHKHRFLRDKPIAAHIDQFSAETGISRFLHLYDAWEYNKTENLAQEEFGRFDYIL

SEQ ID NO: 161119 - protein, 132 aa, Heterodera glycines
  Homolog annotation: Hit_ID=AAO33474.1; Match level="QueryCoverage =100%, HitCoverage=95%, E-value=3e-67, Identity=97%"; Hit description= gland-specific protein g4g12 [Heterodera glycines]
  Coding regions on vcDNA: vcDNA=SeqID_87542; Strand=+; Position=5-403
ILLTVLLAVVSFRLPASTGDKKTANDGSGNNSSAGIGTKIKRIVTAGLLFTSLATDGAEAIGRSNAQGGNAAGLVPSHVTNRSMAPPPPPVQFEMGANRLEKMRAHLRELAEKMPVNESKRLSPSGPDPHHH

SEQ ID NO: 161120 - protein, 141 aa, Heterodera glycines
  misc_feature (10)..(10): Xaa can be any naturally occurring amino acid
  Homolog annotation: Hit_ID=CAE67904.1; Match level="QueryCoverage =100%, HitCoverage=46%, E-value=3e-43, Identity=59%"; Hit description= Hypothetical protein CBG13501 [Caenorhabditis briggsae]
  Gene Ontology: Mol. function=purine-nucleoside phosphorylase activity; Biological process=DNA modification
  Coding regions on vcDNA: vcDNA=SeqID_87543; Strand=+; Position=2-423
RLMASLGVRXMIGSNAAGALNGDFQTGDLMVIKDHIFLPGLSGYSPLLGITDPRCGSSTVSLHNAHDRELTKKAMSLGRQMKVPLREGIYVMNAGPQTETAGECSLIARMGGDAVGMSTCHEVTVARQCGMRVFGFSLITN

SEQ ID NO: 161121 - protein, 113 aa, Heterodera glycines
  Coding regions on vcDNA: vcDNA=SeqID_87544; Strand=+; Position=161-499
MHPKGSNESDGNDDTWKKWELADEFGNLFVRTFIKPISKEEDSQIFYGCVIDFPKHNEHFGFPKSVAIKQVFIRGDEYYKAKDMLIHEVEILKMAVQMEAIYVIKLIDYITVP

SEQ ID NO: 161122 - protein, 172 aa, Heterodera glycines
  Coding regions on vcDNA: vcDNA=SeqID_87545; Strand=+; Position=3-518
LRRTYLLGKCQFAPVLFGPVVYRPYQPNLLESGGNKLFGIGAGAYNTCVVLSPILVPYIAFSWTHSHHFSFLRFVLVFYVIAFSFRTIGRLTNVDYVRFIKLLGTVRKSPQNVTLLDTLKDYDFQVYAAPADFKASPGRTAKWHPPRERLPDLNPPLNFLRQAIAWTAANTF

SEQ ID NO: 161123 - protein, 164 aa, Heterodera glycines
  misc_feature (16)..(16): Xaa can be any naturally occurring amino acid
  misc_feature (36)..(36): Xaa can be any naturally occurring amino acid
  Homolog annotation: Hit_ID=CAE56122.1; Match level="QueryCoverage =84%, HitCoverage=56%, E-value=2e-27, Identity=42%"; Hit description =Hypothetical protein CBG23731 [Caenorhabditis briggsae]
  Coding regions on vcDNA: vcDNA=SeqID_87546; Strand=+; Position=2-493
DYPLDWYKSVVAGQLXSFGLFRDDLLTALIVAQRKXIFECEYEDRNLYKDPNASAIYILSLAVSDRYRRRGIGTLLLNHLITNYSVPLASKLIFLHVLSDNHSAIVFYRKNGFRHHMTLPKYYLIDGQYRDGQTFVLFTSQGVFGEFVSSVGDWCAMAMSFLTS

SEQ ID NO: 161124 - protein, 88 aa, Heterodera glycines
  Coding regions on vcDNA: vcDNA=SeqID_87547; Strand=+; Position=1-267
RYCGRCARAKDRQNFQFLLEDYIKALNEANERNKQLVVSVKRRIGRLDEEKQELARHIESLPDLTEMFGSEPATTNLPSLGELFTPTS

SEQ ID NO: 161125 - protein, 124 aa, Heterodera glycines
  Coding regions on vcDNA: vcDNA=SeqID_87548; Strand=+; Position=84-455
MEVEVEAVAKAEAEEELDPKGRVQQLLEMGKSLEWEMAVQSDDEQILDLDDDLEMFPRLIFLQLAKFLKNAPDGLNEQQKKELKKVLANWMEEQKQPFTVDEEMAQVDETVQSLSTFCDQIGKS

SEQ ID NO: 161126 - protein, 47 aa, Heterodera glycines
  Coding regions on vcDNA: vcDNA=SeqID_87549; Strand=+; Position=4-147
FFLYCLNIEFAFDEIIFQFAFVPISFIRSNSLQINQNYNLKLTILNG

SEQ ID NO: 161127 - protein, 144 aa, Heterodera glycines
  Coding regions on vcDNA: vcDNA=SeqID_87550; Strand=+; Position=36-467
MMMDTSENDEHHQHQPGEEGEMPPPPPTPSLIELLDVETNEKMLFPLDMDEEVTVQWPDNATIGTSVTDGDVPAAPIILKLCWDRAVRTRFESMEIGHLMEREVNMMASLKQSYTLKECIDMYTQQEQLNEEDSWYCPNCKTHR

SEQ ID NO: 161128 - protein, 48 aa, Heterodera glycines
  misc_feature (25)..(25): Xaa can be any naturally occurring amino acid
  Coding regions on vcDNA: vcDNA=SeqID_87551; Strand=-; Position=189-335
FFIFFFFQFFFFFFVFFCCFFFFFXRMDSFYYAWRVSFCVVKQIKVVN

SEQ ID NO: 161129 - protein, 86 aa, Heterodera glycines
  misc_feature (33)..(33): Xaa can be any naturally occurring amino acid
  misc_feature (41)..(41): Xaa can be any naturally occurring amino acid
  misc_feature (65)..(65): Xaa can be any naturally occurring amino acid
  misc_feature (69)..(69): Xaa can be any naturally occurring amino acid
  Homolog annotation: Hit_ID=CAE57872.1; Match level="QueryCoverage =100%, HitCoverage=19%, E-value=2e-18, Identity=50%"; Hit description= Hypothetical protein CBG00912 [Caenorhabditis briggsae]
  Coding regions on vcDNA: vcDNA=SeqID_87552; Strand=+; Position=3-259
DLSSAVGEEIFVRHRLILCRNIEAFERMLTQDXNGDKKELXLTDDPQCRPMFGPLLLFLYCHHIXVECXNALPALISADKYNVTGL

SEQ ID NO: 161130 - protein, 182 aa, Heterodera glycines
  Homolog annotation: Hit_ID=AAP30768.1; Match level="QueryCoverage =100%, HitCoverage=100%, E-value=1e-100, Identity=98%"; Hit description=putative gland protein G22C12 [Heterodera glycines]
  Coding regions on vcDNA: vcDNA=SeqID_87553; Strand=+; Position=32-580
MASSFCSSIISIVAIVCLLCKCCFSAPHPCCPGSQHVVSMMKDHTGTFSASMPKSSLCMSAERVAAAVENQLKTIWCPGNGSQTLINEINATQSSSDECARSLGFVRAMFEIAASAASHAGANADLAVQFREQVGTIDSNCAALGIHVGQISLDAPRGDHPQVHDSESVLSNPGTSGSHKRF

SEQ ID NO: 161131 - protein, 217 aa, Heterodera glycines
  Homolog annotation: Hit_ID=CAE69683.1; Match level="QueryCoverage =99%, HitCoverage=46%, E-value=1e-37, Identity=43%"; Hit description =Hypothetical protein CBG15936 [Caenorhabditis briggsae]
  Gene Ontology: Cellular component=mitochondrion
  Coding regions on vcDNA: vcDNA=SeqID_87554; Strand=+; Position=2-652
LTYATEERGKGMALIGGSFSLAFLIGPSIGAFFSIGARESGEFDPSPALPAIALTLAELALLVFFLPETLAKAKNDDCHKQSGHSLRHLLSPRALFSFDFLSPASASSPPVSVPLLQKYSRVYFLFMLLFSAMEFTLGFLTHLRFNYSSMQQGRLYLFSGFCMLVIHGFVVRRIPSTLKAQSHGALVGLVSIVPAYFVIAFAHCQNALFMGLLLFSV

SEQ ID NO: 161132 - protein, 229 aa, Heterodera glycines
  misc_feature (202)..(202): Xaa can be any naturally occurring amino acid
  Homolog annotation: Hit_ID=NP_741756.1; Match level="QueryCoverage =96%, HitCoverage=65%, E-value=2e-41, Identity=42%"; Hit description =endophilin B2 (40.8 kD) (XE420) [Caenorhabditis elegans] gb|AAB52640.1| Endophilin-related protein protei
  Gene Ontology: Mol. function=protein binding; Cellular component =cytoplasm; Biological process=signal transduction
  Coding regions on vcDNA: vcDNA=SeqID_87555; Strand=+; Position=104-789
MDALKRLASRARQKSAEIILSAEKTEIGAELEQLLTKTDKTEEHMKKLVHAIEVYLQPNPAVRALDPRKDKSGRQNTLDGLGEAMKEAASKAVGAESTFGAILLKVSQTESKMAAGERQLIQSVTTQTLASLRHLLENELRTVQKERSVLNKKRLDLDATKSRWKRASDDKKPSVEAELRKAQDEFDTQLETISTALEALQXAVDRQAEQLVQFVAAQIVCHSSSLKLL

SEQ ID NO: 161133 - protein, 172 aa, Heterodera glycines
  Homolog annotation: Hit_ID=NP_497420.1; Match level="QueryCoverage =88%, HitCoverage=20%, E-value=5e-51, Identity=58%"; Hit description =rna helicase (3C636) [Caenorhabditis elegans] gb|AAK27888.1| Hypothetical protein Y67D2.6 [Caenorhabditis
  Gene Ontology: Mol. function=pre-mRNA splicing factor activity; Cellular component=spliceosome complex; Biological process=cell cycle
  Coding regions on vcDNA: vcDNA=SeqID_87556; Strand=+; Position=108-623
AAQFGRRGRRGGRCVRRVPNPFLAMSLQQQRQRLPIAKCRNHLLYLCEHFQTVVVVGETGSGKSTQLPQYLTEFGWAENGRRICITQPRRVAAISLASRVADEMMCRLGDAVGYSVRFDECISARTHIKFVTDGILLRELMSDPLLQAYSVVIVDEAHKRSVNTDLIIGSLR

SEQ ID NO: 161134 - protein, 173 aa, Heterodera glycines
  Homolog annotation: Hit_ID=CAC21848.1; Match level="QueryCoverage =75%, HitCoverage=63%, E-value=4e-12, Identity=30%"; Hit description =hypothetical protein [Globodera rostochiensis]
  Gene Ontology: Biological process=signal transduction
  Coding regions on vcDNA: vcDNA=SeqID_87557; Strand=+; Position=103-624
MQMDGLLAISRRVWRLNENLASVQNYLSLMLVTQKINCWDIQHCHRDLFIHDGALLVEHAGNGHFLSVRSLSAANETHGVFYFEVTVLRMQSDLGVGFLSDFIGMHEMVGHCESSFGYWSYGSLHCDCSTADAHLDGFPQFTTGDVIGCGLNAFNRHVFFTLNGEKLDMDSCC

SEQ ID NO: 161135 - protein, 241 aa, Heterodera glycines
  misc_feature (227)..(227): Xaa can be any naturally occurring amino acid
  Coding regions on vcDNA: vcDNA=SeqID_87558; Strand=+; Position=2-724
RNIHTQLLMSANRRLYELIDLHRKCKEDLPWKYWIALAEKDKNCNDFVATLQELVKEDAYASIDGSGSNALLIRLRELYPSVNETLAWTELQKFSEQFPSTQRMVQALHELIETPGLYCGPVPKSSSSEEHFYHSVACVGPPPVKIDAGVQSTSSSTAPIPKPLDKSMKPPPQRPPDDFSEHLYDVPPTIDAHPPPQLKQQNIVPPIRQPTSSASAAVPLPSQKLVXVFSLWFAVCLCRPR

SEQ ID NO: 161136 - protein, 227 aa, Heterodera glycines
  misc_feature (145)..(145): Xaa can be any naturally occurring amino acid
  misc_feature (149)..(149): Xaa can be any naturally occurring amino acid
  Homolog annotation: Hit_ID=CAE61648.1; Match level="QueryCoverage =77%, HitCoverage=16%, E-value=2e-38, Identity=40%"; Hit description =Hypothetical protein CBG05582 [Caenorhabditis briggsae]
  Gene Ontology: Mol. function=transcription factor activity; Biological process=regulation of transcription, DNA-dependent
  Coding regions on vcDNA: vcDNA=SeqID_87559; Strand=+; Position=21-702
LQLPTTDEENEELGYRTPDDLLLWKVLRRSSAAPTYFDIMDDKYIDGGIIANNPSLELLQQIQYWNIFNKHKKFPNAVNVGCFLSIGTGVIPTTPLERTHLEVSPNWITQPITSIKAALTIGEILVDQATAAEGVPVQRTGAFCXNNGXPFFRLSAPLFRKIRLDETNDADIVQMMWDCMGVHVQASGLCGGCARCCDGLAMRSTGAVCSKPMGRHVFCSCWTKRRR

SEQ ID NO: 161137 - protein, 257 aa, Heterodera glycines
  Homolog annotation: Hit_ID=NP_741090.1; Match level="QueryCoverage =100%, HitCoverage=25%, E-value=7e-67, Identity=54%"; Hit description= ZYG homolog (3B500) [Caenorhabditis elegans] pir||T33672 hypothetical protein T24C4.6 - Caenorhabditis e
  Coding regions on vcDNA: vcDNA=SeqID_87560; Strand=+; Position=3-773
EDETRHAFLARILAELKHLRTLDLSEWLLTDFTVLQKLENLTSLILYDIHNLEGSIDTLCKFCKLTGLDLSQSDRSSSGLYAQPVTALHKLVSSLPKLKYLDISGTNLTTLPSENDRPFRGAGTIDSDIPGLSYLKKPLKYLGIFNCESSSQYKNIPAEKISGDHGEDQVLTAMEMYLERPKTMQAVLNESYHLYRFGTNLSRQVEALHLVLKSMSLHLNNSNLQIAGSASMFYIIRSVKMNWSTRRRVIFALIDGM

SEQ ID NO: 161138 - protein, 133 aa, Heterodera glycines
  Coding regions on vcDNA: vcDNA=SeqID_87561; Strand=+; Position=307-705
IANKDVEVVQIANKDVEVAQIAKTAEPAEFKPTVEPDAEVLKTLNTVEPVGFKPTTEPTPAVTTAVSVAPLSGTLTFTASSIPISGSLFGGACRPGTNTLSNLAANVTAKTTEPVGFKPTVEPLLPAVTTTAV

SEQ ID NO: 161139 - protein, 82 aa, Heterodera glycines
  misc_feature (17)..(17): Xaa can be any naturally occurring amino acid
  misc_feature (29)..(29): Xaa can be any naturally occurring amino acid
  Homolog annotation: Hit_ID=NP_502737.1; Match level="QueryCoverage =73%, HitCoverage=3%, E-value=1e-11, Identity=43%"; Hit description =MEGF6 (4P83) [Caenorhabditis elegans] emb|CAB60454.1| Hypothetical protein Y64G10A.7 [Caenorhabditis elega
  Coding regions on vcDNA: vcDNA=SeqID_87562; Strand=+; Position=1-249
CAFSCRRNCRDGRCDSXLGLCLCPAGLFXRIATMPCPLWSHWSNCRLECQCSREGTSKCDAKGNAFESRTSKANFANGVFAT

SEQ ID NO: 161140 - protein, 86 aa, Heterodera glycines
  Coding regions on vcDNA: vcDNA=SeqID_87563; Strand=+; Position=63-323
SAFGNWSTRRKPKCRWTVSDQRHGLNCAADQHMNAGGRRSRTNAIVLIKLEQYTPTTPSSFAVRRVIDPLISNHSLAHHLIDLIPT

SEQ ID NO: 161141 - protein, 196 aa, Heterodera glycines
  Homolog annotation: Hit_ID=EAA58591.1; Match level="QueryCoverage =95%, HitCoverage=42%, E-value=1e-28, Identity=40%"; Hit description =hypothetical protein AN6773.2 [Aspergillus nidulans FGSC A4] ref|XP _410910.1| hypothetical protein AN6773.
  Coding regions on vcDNA: vcDNA=SeqID_87564; Strand=+; Position=1-588
TLQALLTVTTFLVPSHAHRDRVVTISSPENSNFIQCAPSYAFRKTGVLEIANFEPRWEQMLYTLFLAEGWIVNAPDHEGPESAFSAGRFGGHMVLDSMRAANNFKPLQLSKRPMHIGHGYSGGSTPNGWAASLHETYANELNVVGWSLGGSMTDPLYTLNSLDGKPTSSLAVAGAIGLMDAYRDEVRNLLDDEVWT

SEQ ID NO: 161142 - protein, 193 aa, Heterodera glycines
  Homolog annotation: Hit_ID=NP_499776.1; Match level="QueryCoverage =87%, HitCoverage=78%, E-value=8e-35, Identity=44%"; Hit description =cell division protein (3O526) [Caenorhabditis elegans] emb|CAB07618.1| Hypothetical protein F45G2.9 [Caen
  Gene Ontology: Mol. function=tRNA methyltransferase activity; Cellular component=cytoplasm; Biological process=tRNA methylation
  Coding regions on vcDNA: vcDNA=SeqID_87565; Strand=+; Position=4-785
MNFACCCIFKSCQRYFSSSRKQTEQYLERQANDQYSRRAREHSYRARSAFKLMQINDKMHFIRPAPGSWCQVLSETDECPFDGTEQRQGYILGVDLFTISPIENVDLLCKADFTRRATQTEIRRRLNGRRVDLLLSDMAPNPTGESYMDHLRIIKLCRDLFMFGTVPDPEPILAPNGILLCKVSIHYSIKKKS

SEQ ID NO: 161143 - protein, 257 aa, Heterodera glycines
  Coding regions on vcDNA: vcDNA=SeqID_87566; Strand=+; Position=3-776
DSPPMPTHSFKDLRINCIDHSVIAFLRANQLIFQKGSNLRLSLPFGPFNIDDVQSIWDDFARQIWPIFAPTIRHFGVPDGHLLDTLLRLVSPTILTDDLINIHSINSGRQFPEAIGDDHFEGPTTATLDRSTTNYDGSIATSAAAGQALSKWLHISRKDGQPKQLRFRNFANPPNMEWQNNFKEKFLRAITSASYKIYFKTDASFEPFELVNERTQEKLTLIFASETIWAKRWIMKRCPIGETAAPIHWERQILTTI

SEQ ID NO: 161144 - protein, 217 aa, Heterodera glycines
  Homolog annotation: Hit_ID=CAE62116.1; Match level="QueryCoverage =95%, HitCoverage=13%, E-value=2e-54, Identity=54%"; Hit description =Hypothetical protein CBG06155 [Caenorhabditis briggsae]
  Gene Ontology: Mol. function=microtubule binding; Cellular component =microtubule cytoskeleton; Biological process=gametogenesis
  Coding regions on vcDNA: vcDNA=SeqID_87567; Strand=+; Position=3-656
GAPSAHPSSPCSSSLLPPPVSSLSVPLHHRSSISGGGSRPIVIRKGPQGFGFSIRSVRVYLSEMSEYYSIEHIVAAVREGSPAWEAGLRTNDLITRVHTQSVHNMTHPEMMRRLLSCGDELTVHVVPLSSTSIKEGEPRRNIGKPLRKKPRRPPTAQQKNKQQSRKGSALLRRLSGKRTVGDIVPGTSSQKQMFIPRSVSSQEGRAQLFNSSTSKLE

SEQ ID NO: 161145 - protein, 250 aa, Heterodera glycines
  Homolog annotation: Hit_ID=BAC40360.1; Match level="QueryCoverage =40%, HitCoverage=98%, E-value=5e-16, Identity=52%"; Hit description =unnamed protein product [Mus musculus]
  Coding regions on vcDNA: vcDNA=SeqID_87568; Strand=+; Position=16-768
MKLLLFFCLLLAKFEFIWQMKKPLVINDNDKAEGSTGPSAANHQQNVSEQYLTKLELENRLLKAELKQREMMEELKELKDANIEQQKKENAFIGQIQELKDEQQKCLDKYEALEKELARKYICIGQFAKLLTRIDGMEAQINGLKEKDEEGSLSSSVPVEKQINEDPNSTNRHGMGIVIRTLTGSRHILKVHPSDTIEEIKAKIQNIERTPIDKQRLIFAGKQLENGFTLEYYGIGNGANIDVVLRLCGC

SEQ ID NO: 161146 - protein, 19 aa, Heterodera glycines
  Coding regions on vcDNA: vcDNA=SeqID_87569; Strand=+; Position=109-165
LHLISNKFGYQKKKKKKKK

SEQ ID NO: 161147 - protein, 176 aa, Heterodera glycines
  Coding regions on vcDNA: vcDNA=SeqID_87570; Strand=+; Position=1-531
SELNAQIGMEWAKAAIAKALAEAANISLIRIVDLNLDELNDGTLYAFFAIGAPSGAIQAQTIYLLKEITVAEAVQLLNTSVVSGKFAVRIPLATEAETNTELVFSGTQFGKQSSPLPHPCPPPGPSPPPQFVGFSGSTLAIVAIFCFISGAFFIAGAYIVHQKRQYIRGMAYQVFE

SEQ ID NO: 161148 - protein, 221 aa, Heterodera glycines
  Homolog annotation: Hit_ID=AAH60773.1; Match level="QueryCoverage =85%, HitCoverage=31%, E-value=1e-16, Identity=27%"; Hit description =SOX5 protein [Homo sapiens]
  Gene Ontology: Mol. function=transcription factor activity; Cellular component=nucleus; Biological process=transcription from Pol II promoter
  Coding regions on vcDNA: vcDNA=SeqID_87571; Strand=+; Position=69-731
MIASENNHLEAQNGNSPEGEEESNCGGSASPSSLRDCHSRASTNEHTNISHHSLHDDNAPPSPSLANISTNIELHPHNNALGGSSSHKFIKRPLNAYMIWTRQERKRILTDDPKMKMNEVSKAIQMGEKWKKMSDKEKKPYFEMAKKFSEEHKLVLQEHPELQYAPSKKKVVKKLADGKQLSVVDSSSVKSCTITPDASRSTTPRGSSNLITPQPVSQSQM

SEQ ID NO: 161149 - protein, 51 aa, Heterodera glycines
  Coding regions on vcDNA: vcDNA=SeqID_87572; Strand=+; Position=2-154
YALNDPNRLLAVVPFLVRTNFNGARVVQRALISLVQCCIVRQVDSQPSMVT

SEQ ID NO: 161150 - protein, 42 aa, Heterodera glycines
  Coding regions on vcDNA: vcDNA=SeqID_87573; Strand=+; Position=2-127
EVIESATILQLKEGESDRKRRNLLITPLNWQMPSLRFPPPPL

SEQ ID NO: 161151 - protein, 128 aa, Heterodera glycines
  Homolog annotation: Hit_ID=NP_741153.1; Match level="QueryCoverage =100%, HitCoverage=24%, E-value=2e-36, Identity=63%"; Hit description= chaperonin Containing TCP-1 (58.9 kD) (cct-6) [Caenorhabditis elegans] gb|AAC46642.1| Chaperonin contain
  Gene Ontology: Mol. function=chaperone activity; Cellular component =actin filament; Biological process=protein folding
  Coding regions on vcDNA: vcDNA=SeqID_87574; Strand=+; Position=3-389
DGAVLPGAGAFEIAGYCALKKLADNVKGRAKLGVLAFAEALLVIPKTLAVNAGFDAQEAIVKLVETFSAAGELVGLDLESGEPCVPQSVWDNVCVKQASLNACQNIASNLLEVDEVMRAGMRDLKGGQ

SEQ ID NO: 161152 - protein, 254 aa, Heterodera glycines
  misc_feature (250)..(250): Xaa can be any naturally occurring amino acid
  Coding regions on vcDNA: vcDNA=SeqID_87575; Strand=+; Position=1-762
ASVRKALVFALFDYVRENGGEKRPKAEEHKEFANVTKTYFASLHAFVLLTDLNYEEFALKLHFQIQNSQEKFAEYYTNLKSKCDNWTVDKWQNKMERIGEKIVDKSSKEKCREFAVKLDEQRNRSQNEQSENIEPPKQTSFHRTSFKRSVKTSKIFADQRILRNRPISPLDAQFRAELFQFLDSLFLPNLLPFPNKFVAGPGDLALLDPSLSVEFDRCFSDCEQSDEIKQLDIVNVYSVLVSHDSLYYTXPLST

SEQ ID NO: 161153 - protein, 227 aa, Heterodera glycines
  misc_feature (31)..(31): Xaa can be any naturally occurring amino acid
  Homolog annotation: Hit_ID=XP_219265.2; Match level="QueryCoverage =98%, HitCoverage=21%, E-value=5e-25, Identity=31%"; Hit description =similar to importin 7 [Rattus norvegicus]
  Gene Ontology: Mol. function=RAN protein binding; Cellular component =cell cortex; Biological process=signal transduction
  Coding regions on vcDNA: vcDNA=SeqID_87576; Strand=+; Position=3-682
CETYFEEALYLTHSLVLVHISPEMWTVFDLXYKAFLEEGTSFFSDCAPVLHAFLTNDTDNFLSVFDRVQHFLAMCEKTLNDEGEDGCDESTKAHAAKMLEVFVLQCQGRASHFIPDILRLVFNQLQKESADLKLGQLKPQLLIILIAALYSDFQLCSNLFGQLQFKTEIGTFEWLIRELYSNRKDFEGVHDRKMLIWLLCRILADGNLPALFINQPEKFMEWLLTLF

SEQ ID NO: 161154 - protein, 233 aa, Heterodera glycines
  Homolog annotation: Hit_ID=NP_505989.1; Match level="QueryCoverage =75%, HitCoverage=23%, E-value=2e-36, Identity=46%"; Hit description =prestin family member (84.4 kD) (5M359) [Caenorhabditis elegans] emb|CAB04606.1| Hypothetical protein K12
  Gene Ontology: Mol. function=formate transporter activity; Cellular component=integral to plasma membrane; Biological process =reproduction
  Coding regions on vcDNA: vcDNA=SeqID_87577; Strand=+; Position=25-723
MRALCEGLRKSVKVHPSGKNETLAGTATAAEESDCQFTVSSTSSGTSTSGHNASAHSRHNAAEKMSQDAEDGPEVLYHDERCQHTHAHLYNAARPPMNQDEFDHRFAYRGPEQFSDERDMCRQTGKFFRQYYRPCLSPEAFWHFILRFVPILNWLPAYQWRQCLLADAIGGLTVGIMHVPQGIAYALLARLHPVVGLYTPFFPPLFYMLFGTSRHNSIGSFAVVSLMAGMAVE

SEQ ID NO: 161155 - protein, 263 aa, Heterodera glycines
  misc_feature (239)..(239): Xaa can be any naturally occurring amino acid
  Coding regions on vcDNA: vcDNA=SeqID_87578; Strand=+; Position=3-794
NPPYYPPNPPYYPEYRQPYEYTSDGYYDSRQNRHGAADRRDFYDNHRDDYYDNRRDYFDNRRDDNYDNRRDNYGGTSFGFGSGFAGRSLPPVLNENNFDPGHAQGRLVGATIVPPEEQSHLPPVFYGSSRRFRRSAAGDAVGSGFLNSYLYPVPQSPGRKRVQNRRNGGRRTKRRTMLCFVPSPATRQSGNMEFWRHNLLKYSPNQFQRHFPYRTNGEMNSQDQSRKSKRQTDFPRGAXFPNNRRGHYGDGGGRYDAGETIRR

SEQ ID NO: 161156 - protein, 257 aa, Heterodera glycines
  misc_feature (13)..(13): Xaa can be any naturally occurring amino acid
  Homolog annotation: Hit_ID=NP_504291.1; Match level="QueryCoverage =96%, HitCoverage=37%, E-value=1e-100, Identity=72%"; Hit description= heat shock protein (70.8 kD) (hsp-6) [Caenorhabditis elegans] gb|AAB42371.1| Heat shock protein protein
  Gene Ontology: Mol. function=enzyme regulator activity; Cellular component=mitochondrial inner membrane; Biological process=protein -mitochondrial targeting
  Coding regions on vcDNA: vcDNA=SeqID_87579; Strand=+; Position=2-771
HPDEAVAIGAAIXGGVLAGHVTDLLLLDVTPLSLGIETLGGVFTKLITRNTTIPTKKSQVFSTAADGQTQVEIKVFQGERDMALDNKMLGQFSLVGIPPAPRGVPQIEVAFDIDANGIVNVSARDRGTGKEQQIIIQSSGGLNKDQIENMVREAERHAAADAEKKEMIEAINHAESVLHDTESKITEYAEHLNADEVNVVKEKLEELKKKLANREGLKSAEVKESVNELQQKSLKLFEVAYRKMAEKNQQHQSSSTE

SEQ ID NO: 161157 - protein, 127 aa, Heterodera glycines
  Coding regions on vcDNA: vcDNA=SeqID_87580; Strand=-; Position=51-434
LNIKEIERKLIILEKAIQITRNSATLLSFFDEFCKPSLHVKLLLRTLCLSGGVGLLHLSFDECGLFMHSHGAVVFGPLGTVVRLSSLRINRRSARRRNCAHSGGNSLLRLSNGRLLLLMDLLLLHLG

SEQ ID NO: 161158 - protein, 223 aa, Heterodera glycines
  Homolog annotation: Hit_ID=NP_491515.2; Match level="QueryCoverage =100%, HitCoverage=64%, E-value=1e-112, Identity=88%"; Hit description=atpase (39.9 kD) (1F648) [Caenorhabditis elegans] gb|AAK85455.2| Vacuolar h atpase protein 16 [Caenorha
  Gene Ontology: Mol. function=hydrogen-transporting ATPase activity, rotational mechanism; Cellular component=hydrogen-transporting ATPase V0 domain; Biological process=hydrogen transport
  Coding regions on vcDNA: vcDNA=SeqID_87581; Strand=+; Position=14-682
MGEFFFNLDHGYLEALIRGFKSGLLTSTDYSNLVQCETLEDLKLHIQSTDYGNFLANEPGNITVQVIDERLKEKLVTEFTHLRNNSLEPLATFLDYITYSYMIDNIILLITGTLHQRPINELISKCHPLGSFEQMEAIHIASNPAELYNAVLVDTPLAPYFVDCISEQDLDELNVEIIRNTLYKAYIEDFYNLCKKMGGKTAEVMCEILAFEADRRAIIITIN

SEQ ID NO: 161159 - protein, 37 aa, Heterodera glycines
  Coding regions on vcDNA: vcDNA=SeqID_87582; Strand=+; Position=394-504
SLGCLISDLTHITCVALTVRFPNGKPVMPAVLMNWPT

SEQ ID NO: 161160 - protein, 240 aa, Heterodera glycines
  misc_feature (144)..(144): Xaa can be any naturally occurring amino acid
  Homolog annotation: Hit_ID=NP_490840.1; Match level="QueryCoverage =99%, HitCoverage=16%, E-value=6e-80, Identity=60%"; Hit description =death-associated protein kinase 1 (1B801) [Caenorhabditis elegans] gb|AAK18971.1| Temporarily assigned ge
  Gene Ontology: Mol. function=calmodulin-dependent protein kinase I activity; Biological process=induction of apoptosis by extracellular signals
  Coding regions on vcDNA: vcDNA=SeqID_87583; Strand=+; Position=3-723
KPTRGMEQTMQSIFPRIQVALRRSMQTFQDSIEAELAQWRYCSKMQSSKMEALIRLVGESVEVQIRGPPEKATACIYFLEDLSTLVELTSAEVAPGISTERHFLSPAHLREHRTTPAIFTPETIMEMQQNESLVIVNSDGEEEXEFTDVVCFGSKEAAGLLTLGVDISVSQLQLSARSELAALLDAPNTLGMDWSILAVKLNLTEQIPEVDSSGQSLSRTDQLLTEWALHSPDSASVGKL

SEQ ID NO: 161161 - protein, 69 aa, Heterodera glycines
  Coding regions on vcDNA: vcDNA=SeqID_87584; Strand=+; Position=2-211
ERATLCVLKWCCVNAVVYNIIHHIIIILCVCRVSVCWLLSHSFIIISLLLDLNFKMIINLFYCANLLIE

SEQ ID NO: 161162 - protein, 223 aa, Heterodera glycines
  Coding regions on vcDNA: vcDNA=SeqID_87585; Strand=+; Position=30-698
CIIYGHCSDFGSVPVAPLHLSSVHCCLCHPNVFSPNDFACAKKNAIFHDGLFALTEDNRLRIDPSKQKTNDTGTQLDALLLNPIKERLVFSLIFIKGGENCKQFFMKHAERPSCCLFSDEMELHKHPYAKGECQAQKCTYVDMTCSVLPMDPVEGLKDSYHFKASSWNTASGTDEMQQCDWIAFADGIRILQKKAGNDTKALEEKCWKKVADGSSAIRVALLD

SEQ ID NO: 161163 - protein, 142 aa, Heterodera glycines
  Coding regions on vcDNA: vcDNA=SeqID_87586; Strand=-; Position=117-545
WITKKGKVRQKTKNIRLIILFLSVFVLLVPIFFPCFVLLIRHLLVPIGRSIPLFYVFLLYLCHSFNVFAYNFPELGEIIRRTQKTFFNFTVIIRSIPWLPESICSITFSCGSFRMLLSHITSDDNSGNSTDRSSRLRRRTFL

SEQ ID NO: 161164 - protein, 97 aa, Heterodera glycines
  misc_feature (78)..(78): Xaa can be any naturally occurring amino acid
  Homolog annotation: Hit_ID=XP_527636.1; Match level="QueryCoverage =100%, HitCoverage=20%, E-value=3e-12, Identity=39%"; Hit description= PREDICTED: similar to hypothetical protein [Pan troglodytes]
  Coding regions on vcDNA: vcDNA=SeqID_87587; Strand=+; Position=198-488
SETHSRHRGETHSRHRSETHSRHRCETHSRHRNETHSLHRCETHSRHRSETHSQHIIETLSRHISEKYSRHRSETHSXHRSETHSRHRSETHSRHRS

SEQ ID NO: 161165 - protein, 58 aa, Heterodera glycines
  Coding regions on vcDNA: vcDNA=SeqID_87588; Strand=-; Position=2-175
QVSNEPVQIAKESTILFTRAQLSENVQKSDVFLRSTTVCAKQKNGAVESLGKMKRCVS

SEQ ID NO: 161166 - protein, 176 aa, Heterodera glycines
  misc_feature (79)..(79): Xaa can be any naturally occurring amino acid
  misc_feature (103)..(103): Xaa can be any naturally occurring amino acid
  misc_feature (111)..(111): Xaa can be any naturally occurring amino acid
  misc_feature (158)..(158): Xaa can be any naturally occurring amino acid
  Homolog annotation: Hit_ID=AAQ62633.1; Match level="QueryCoverage =100%, HitCoverage=47%, E-value=1e-70, Identity=73%"; Hit description= beta actin [Aiptasia pulchella]
  Gene Ontology: Biological process=reproduction
  Coding regions on vcDNA: vcDNA=SeqID_87589; Strand=+; Position=3-531
GLCNDGTAGYNSPPAEIPSIVRRTHYHRVMVGLGQKDSYLGYEAHYKRGILTLKHPIEHGIFTNWDDLEKIWHHTFYNXLHRVPEDHPVLLTEAPLNPNANIXNMTQILFXTFNTPAMYVAIHAVLSLYSFGRTTGIAYDSGDGVTHTVPIYEGFALXHAILRLDLAGPYLPDYLM

SEQ ID NO: 161167 - protein, 83 aa, Heterodera glycines
  Coding regions on vcDNA: vcDNA=SeqID_87590; Strand=-; Position=2-250
VKIEKRIVWPKMPFNLSLCHSLYINRLGRSVETVARFAFERPGQIKGAQRKHFFGHGSISDITGGKVDGNFFVAHFLQRVKTL

SEQ ID NO: 161168 - protein, 130 aa, Heterodera glycines
  Coding regions on vcDNA: vcDNA=SeqID_87591; Strand=+; Position=30-419
RGHGMSGHFACPLLRRRNGMRRARKDSSPTLRLRTTMAMCTTLRLQNGVTWLNNLRAHYSANLLLTVTTMPTNRIMQMPIIQTTLCLYGQSNYIRNEQEQRREYGTDMGLIQFLTVAHPIMLTIRLTCQA

SEQ ID NO: 161169 - protein, 42 aa, Heterodera glycines
  Coding regions on vcDNA: vcDNA=SeqID_87592; Strand=-; Position=34-162
KWTLSRMFHNQPPVTLLQRSGCYCCVSPPITSGDHHHREGSE

SEQ ID NO: 161170 - protein, 63 aa, Heterodera glycines
  Coding regions on vcDNA: vcDNA=SeqID_87593; Strand=+; Position=2-193
AQRMVKWWSVPQGVGESNYYFGWARCVRFRQIGGTLRLLPLFIIVEQDWLAVGELLDGLHRRP

SEQ ID NO: 161171 - protein, 92 aa, Heterodera glycines
  misc_feature (48)..(48): Xaa can be any naturally occurring amino acid
  Homolog annotation: Hit_ID=BAC87222.1; Match level="QueryCoverage =91%, HitCoverage=62%, E-value=1e-09, Identity=43%"; Hit description =unnamed protein product [Homo sapiens]
  Coding regions on vcDNA: vcDNA=SeqID_87594; Strand=+; Position=25-299
MFNLFLIIVKIESEKKKYNKSHLAKYLEKNGKKKKKKKEMNSKKEKKXAKYYKIKEKIKQKGRKHSTKEWNKIEEKITKKLGTNRKKKKKKK

SEQ ID NO: 161172 - protein, 112 aa, Heterodera glycines
  Coding regions on vcDNA: vcDNA=SeqID_87595; Strand=+; Position=16-354
TDFCSFYVQNLQAKSGGSLKLTNGATDGHALCTLGMEELTLNGGHDWLVLLNLHRFCFWPPIDGSGRMRIGWLSLTEPLLHVSSEYGTVSILSARICPLWANRVAFPTDEFQ

SEQ ID NO: 161173 - protein, 204 aa, Heterodera glycines
  misc_feature (173)..(173): Xaa can be any naturally occurring amino acid
  Homolog annotation: Hit_ID=XP_420517.1; Match level="QueryCoverage =66%, HitCoverage=20%, E-value=2e-43, Identity=58%"; Hit description =PREDICTED: similar to Deoxycytidylate deaminase (dCMP deaminase) [Gallus gallus]
  Gene Ontology: Mol. function=dCMP deaminase activity; Biological process=pyrimidine nucleotide metabolism
  Coding regions on vcDNA: vcDNA=SeqID_87596; Strand=+; Position=48-659
MIPSVGQPQPQQHGLLLTVSPKKSTAVVTDAENASAIVPNGDDEQAMTNSANKKRTDYLSWDEFFMGVALMAAQRSKDPITQVGACIVKENSIIGIGYNGMPIGCNDDEMPWGKGDANPLNNKYLYVCHAEMNAILNKNSASVDGATLYTTLFPCAECAKMIIQSRISRVVYXERQNTVQMEASRRLFTSQASNSADTNPLVPE

SEQ ID NO: 161174 - protein, 218 aa, Heterodera glycines
  Homolog annotation: Hit_ID=NP_504592.2; Match level="QueryCoverage =100%, HitCoverage=37%, E-value=1e-109, Identity=88%"; Hit description=receptor Mediated Endocytosis RME-1, required for endocytic recycling (65.2 kD) (rme-1) [Caenorhabditis
  Gene Ontology: Mol. function=protein binding; Cellular component =endomembrane system; Biological process=receptor mediated endocytosis
  Coding regions on vcDNA: vcDNA=SeqID_87597; Strand=+; Position=1-654
QKLYHLEDFYRFHEFHSPALDDPDFNAKPMILLVGQYSTGKTTFIRYLLEQNFPGIRIGPEPTTDRFIVVMYGEEEAVIPGNALVVDSTKQFRALTKFGNAFLNRFQCSMLKNEVLNGVTIIDTPGILSGEKQRIDRGYDFSGVLEWFAERVDRIILLFDAHKLDISDEFKRCIEALSGNEDKIRIVLNKSDMVDHQQLMRVYGALMWSLGKVFKTPE

SEQ ID NO: 161175 - protein, 190 aa, Heterodera glycines
  Homolog annotation: Hit_ID=CAE73080.1; Match level="QueryCoverage =94%, HitCoverage=82%, E-value=4e-47, Identity=48%"; Hit description =Hypothetical protein CBG20456 [Caenorhabditis briggsae]
  Coding regions on vcDNA: vcDNA=SeqID_87598; Strand=+; Position=74-646
MDKLVLKIRELLDENEVNFGEVQRILEEYKSEPKDWRHFTHFDEHKYTRNLVDAGNGKYNLMILCWGPGMGSSIHDHSAAQCFVKVLDGQLLETRFAWPKKEKEEKEEEKEEEKEEEEEEEKEEEEGPMRATGTELFKTNGVSYISDKIGIYRMENPSHVDPTVTLHLYIPPYSQCYSFDQVMVPIIFSI

SEQ ID NO: 161176 - protein, 190 aa, Heterodera glycines
  Homolog annotation: Hit_ID=CAE73080.1; Match level="QueryCoverage =94%, HitCoverage=82%, E-value=3e-47, Identity=48%"; Hit description =Hypothetical protein CBG20456 [Caenorhabditis briggsae]
  Coding regions on vcDNA: vcDNA=SeqID_87599; Strand=+; Position=99-671
MDKLVLKIRELLDENEVNFGEVQRILEEYKSEPKDWRQFTHFDEHKYTRNLVDAGNGKYNLMILCWGPGMGSSIHDHSAAQCFVKVLDGQLLETRFAWPKKEKEEKEEEKEEEKEEEEEEEKEEEEGPMRATGTELFKTNGVSYISDKIGIYRMENPSHVDPTVTLHLYIPPYSQCYSFDQVMVPIIFSI

SEQ ID NO: 161177 - protein, 218 aa, Heterodera glycines
  Homolog annotation: Hit_ID=CAE60769.1; Match level="QueryCoverage =100%, HitCoverage=68%, E-value=5e-83, Identity=64%"; Hit description= Hypothetical protein CBG04457 [Caenorhabditis briggsae]
  Gene Ontology: Mol. function=protein binding; Cellular component =cytoplasm; Biological process=protein folding
  Coding regions on vcDNA: vcDNA=SeqID_87600; Strand=+; Position=1-654
IVFYSNKAAVFFEEGKYDECIEMCGKAVEVGRENRADYALVAKAYARMANSYKMKDDPKKALHFYEKALSEHRDPDIVKKHKELAKEVKEMEQKAYIDPELSDKEKNLGNQLFKKGDYPGAMRHYNEAIKRNPDNAVLYSNRAACFTKLMEFQRAVDDCDLCLKKDPSFVKAYIRKGAALSAMREFGRAQKAYEDALQMDPSNHEAMEGLRTCMQSNE

SEQ ID NO: 161178 - protein, 142 aa, Heterodera glycines
  Coding regions on vcDNA: vcDNA=SeqID_87601; Strand=+; Position=3-428
LRFTADSMTASFVEWFADTLSYKSCLQPEITRGINGKLKWPHGTQLIVEISLKNVFYVEWLLDDRPLNSCEELFRDGRLLKGGGDGVQIIDSLYSYGEWLSRLVLPAALQNNCGRASLALLTVRATNKLGNSCESSVRILPT

SEQ ID NO: 161179 - protein, 63 aa, Heterodera glycines
  misc_feature (29)..(29): Xaa can be any naturally occurring amino acid
  misc_feature (54)..(54): Xaa can be any naturally occurring amino acid
  misc_feature (57)..(58): Xaa can be any naturally occurring amino acid
  Coding regions on vcDNA: vcDNA=SeqID_87602; Strand=-; Position=0-188
SSPRSSRFRSARSFRYKKRMSVRGPCSAXAAFAFCSSAARPPGPCPLPRLLLSXARXXVRFLP

SEQ ID NO: 161180 - protein, 77 aa, Heterodera glycines
  misc_feature (61)..(61): Xaa can be any naturally occurring amino acid
  Coding regions on vcDNA: vcDNA=SeqID_87603; Strand=+; Position=2-235
YALLLLSVGLCFAQFDQSPSAALNHVRAKRGYKPWKKQSFSSSSSEMYRRRRPSGNGHYWXITATVAMDTIDENPAF

SEQ ID NO: 161181 - protein, 178 aa, Heterodera glycines
  misc_feature (59)..(59): Xaa can be any naturally occurring amino acid
  Homolog annotation: Hit_ID=CAE59760.1; Match level="QueryCoverage =100%, HitCoverage=36%, E-value=2e-59, Identity=65%"; Hit description= Hypothetical protein CBG03212 [Caenorhabditis briggsae]
  Gene Ontology: Mol. function=chaperone activity; Cellular component =actin filament; Biological process=regulation of cell cycle
  Coding regions on vcDNA: vcDNA=SeqID_87604; Strand=+; Position=2-535
TTSVTVFAAELLREAEVMIGQRIHPQVIVSGYRKAARVAKDALENAAQASGEHLREYAXKIAKTSLGSKILSQHSNHFAKLAVDAVLRLGPNGALDSVQVIKKLGGSMEDSYLDEGFLLEKKAGMYQPQRIEDAKILIANSPMDHDRIKVLGSRIRVDPVAKIAELEQAANKNKPPKK

SEQ ID NO: 161182 - protein, 204 aa, Heterodera glycines
  misc_feature (51)..(52): Xaa can be any naturally occurring amino acid
  Homolog annotation: Hit_ID=NP_491212.1; Match level="QueryCoverage =100%, HitCoverage=48%, E-value=5e-27, Identity=32%"; Hit description= innexin, putative gap junction protein, OPUs gap junctional protein (45.1 kD) (inx-13) [Caenorhabditis e
  Coding regions on vcDNA: vcDNA=SeqID_87605; Strand=+; Position=5-616
CWAPNEFKGQWMRYAEGYCFVENTYYVSMRERFPMREIDREQREIIYYQWXXFLLLGQALLLMAPKFLWNAFNWKSGLNINLLVQKAHKQCKAGTRKDKEEASRQIGVRIHCVLQHNMLAKLDIVDHDGSGRTMPDHVDWKSVKPTHSSVSFFYILFKLFNLGSALVQLCLINYFMVPANYTYWGFDVLADLVAGRDWSRSGLF

SEQ ID NO: 161183 - protein, 183 aa, Heterodera glycines
  misc_feature (170)..(170): Xaa can be any naturally occurring amino acid
  Coding regions on vcDNA: vcDNA=SeqID_87606; Strand=+; Position=30-578
NSTMAEEAVVASEMESLALTSSSPCSPVLSLLSEEMLQKEVPCVCCDGDKVVVRLSILSQRGFFAKMLPDLNVEANGLSEDFLFDMTKAEIPADTFIKIVSWMEEHMGHPVPAFDADPITFERKWLTQSDCQTNSSNCEFAEAAALLNAACFLDLQLLSRHSSQAVARRXKDRSPEEIRDMLH

SEQ ID NO: 161184 - protein, 51 aa, Heterodera glycines
  Coding regions on vcDNA: vcDNA=SeqID_87607; Strand=+; Position=3-155
YALNAPNRLLAVVPFLVRTNFNGARVVQRALISLVQCCIVRQVDSQPSMVT

SEQ ID NO: 161185 - protein, 51 aa, Heterodera glycines
  Coding regions on vcDNA: vcDNA=SeqID_87608; Strand=+; Position=85-240
IRPLQHLWESSNRRSNVRSYSPNSWRNMVKLFLWKCIRSQSPQHTSRKHKV

SEQ ID NO: 161186 - protein, 46 aa, Heterodera glycines
  misc_feature (15)..(15): Xaa can be any naturally occurring amino acid
  misc_feature (25)..(25): Xaa can be any naturally occurring amino acid
  misc_feature (35)..(35): Xaa can be any naturally occurring amino acid
  misc_feature (39)..(40): Xaa can be any naturally occurring amino acid
  Coding regions on vcDNA: vcDNA=SeqID_87609; Strand=-; Position=0-137
GASEKDVSCVGRHIXIDLGRGIFLXRPHRWVFPSXHLLXXKKGGGG

SEQ ID NO: 161187 - protein, 209 aa, Heterodera glycines
  Homolog annotation: Hit_ID=NP_496722.1; Match level="QueryCoverage =73%, HitCoverage=40%, E-value=1e-21, Identity=37%"; Hit description =putative nuclear protein (43.0 kD) (2N92) [Caenorhabditis elegans] emb|CAB60360.1| Hypothetical protein Y
  Coding regions on vcDNA: vcDNA=SeqID_87610; Strand=+; Position=71-697
MGILRNRSINRIPIRIEECAENENGFADDYANYLFDSDQSDSDNAEEENEVSVQIQSQPIGGHRRKKTKSYRPIEIVDGFPLKRNMGAQKWRRVENTRLLTSFADTQDICFDGSDLIPETISAFSRLLRDEAKMKVWNDFLEKDESGQKKMLSQFEYEILMARDASKAQHSQQSVKNTDIKKSESQPHNKNGQPSSGGGKSSSDCFQRL

SEQ ID NO: 161188 - protein, 154 aa, Heterodera glycines
  Homolog annotation: Hit_ID=CAE63439.1; Match level="QueryCoverage =49%, HitCoverage=21%, E-value=2e-16, Identity=50%"; Hit description =Hypothetical protein CBG07887 [Caenorhabditis briggsae]
  Coding regions on vcDNA: vcDNA=SeqID_87611; Strand=+; Position=180-641
ENEVSVQIQSQPIGGHRRKKTKSYRPIEIVDGFPLKRNMGAQKWRRVENTRLLTSFADTQDICFDGSDLIPETISAFSRLLRDEAKMKVWNDFLEKDESGQKKMLSQFEYEILMARDASKAQHSQQSVKNTDIKKSESQPHNKNGQPSSGGGKS

SEQ ID NO: 161189 - protein, 233 aa, Heterodera glycines
  Coding regions on vcDNA: vcDNA=SeqID_87612; Strand=+; Position=25-723
QCTRVKRSIDKVFCALSASTNVFSHTSTRKPFFALSQPGGHPRNWHSLRDVAIAHVRNVRNIFQIATHCKILVHSPGVGSASITKSLADASVFDKSEEIDEDNANKSLVNRNGSLLLNSSTGSTGVLNELYEAKHSFFVPPSLNPRSADAFLSERVHCRRRLIVVPLFCDFIVNRCKELLFAPAPIVSFYDTLCTLYAIKALSKVISHSLHEDEFGVVQNDMSKSLSELTRLS

SEQ ID NO: 161190 - protein, 214 aa, Heterodera glycines
  misc_feature (184)..(184): Xaa can be any naturally occurring amino acid
  Homolog annotation: Hit_ID=NP_501860.1; Match level="QueryCoverage =94%, HitCoverage=60%, E-value=2e-24, Identity=34%"; Hit description =no mitochondrial derivative (37.7 kD) (4K943) [Caenorhabditis elegans] emb|CAA93516.2| Hypothetical prote
  Gene Ontology: Mol. function=endopeptidase activity; Cellular component=proteasome regulatory particle (sensu Eukarya); Biological process=mitochondrial translocation
  Coding regions on vcDNA: vcDNA=SeqID_87613; Strand=+; Position=40-681
MTSEKNLPLTIGVCASSVALGCIAYKLLQRKGSQQELLDEMTLRKKKDEAHFMDSLKLDPNTPLNSHELALASLISFSEDAASFEKVGGCSSILELLRQKVVVPLQLASNRTTLPSLLYSAPKGILLYGPNGCGKTLIARAIAKEVDAYFINFGTSLVDFVNGSSVTMKSLFTLAEKIQPCVIXIDEIDLLFHRNRNDFQLLKTQFLAQWDEFL

SEQ ID NO: 161191 - protein, 188 aa, Heterodera glycines; identical to SEQ ID NO: 159813
  Homolog annotation: Hit_ID=NP_491710.2; Match level="QueryCoverage =99%, HitCoverage=43%, E-value=1e-19, Identity=30%"; Hit description =prion-like Q/N-rich domain protein PQN-19, Prion-like Q/N-rich domain protein, EAST-like signal transduci
  Gene Ontology: Mol. function=SH3/SH2 adaptor protein activity; Biological process=regulation of protein activity, epigenetic
  Coding regions on vcDNA: vcDNA=SeqID_87614; Strand=+; Position=1-567

SEQ ID NO: 161192 - protein, 143 aa, Heterodera glycines
  misc_feature (33)..(33): Xaa can be any naturally occurring amino acid
  Homolog annotation: Hit_ID=AAO33474.1; Match level="QueryCoverage =94%, HitCoverage=97%, E-value=7e-68, Identity=97%"; Hit description =gland-specific protein g4g12 [Heterodera glycines]
  Coding regions on vcDNA: vcDNA=SeqID_87615; Strand=+; Position=3-432
KDPKKCQHFQILLIVLLAVVSFRLSASTGDKKXTANDGSGNNSSAGIGTKIKRIVTAGLLFTSLATGGAEAIGRSNAQGGNAAGLVPSHVTNRSMAPPPPPVQFEMGANRLEKMRAHLRELAEKMPRNESKRLSPSGPDPHHH

SEQ ID NO: 161193 - protein, 51 aa, Heterodera glycines
  Coding regions on vcDNA: vcDNA=SeqID_87616; Strand=-; Position=0-152
TDNFNRAVNAVAGPGGAPVCAVNVDAVTSNDDPACVPLNIFGQGKVSAEAR

SEQ ID NO: 161194 - protein, 131 aa, Heterodera glycines
  Coding regions on vcDNA: vcDNA=SeqID_87617; Strand=+; Position=168-563
PIPKESRFFNSACCPNIRLVHLFRNWLSPDRPLLAFVAISEIGVGEELTHYYGDRWFLDKLSVRPKCVCRCASPFCVWPPKAKRRDDFFSRPKDRQLKANKVRAELTQRRSGQEEETKKKRNTEEKEKMEG

SEQ ID NO: 161195 - protein, 180 aa, Heterodera glycines
  Homolog annotation: Hit_ID=CAG88258.1; Match level="QueryCoverage =73%, HitCoverage=32%, E-value=2e-09, Identity=32%"; Hit description =unnamed protein product [Debaryomyces hansenii CBS767] ref|XP _460005.1| unnamed protein product [Debaryomy
  Coding regions on vcDNA: vcDNA=SeqID_87618; Strand=+; Position=231-773
MNANSARTTGGGALLHLSPEEALYLSHDLNVLTLSSQQNDKATLADYSPEQFFADLCAFHPNFASILYRYLVYRYFRRLCWVVRDGISFGVDFLLYKCSVDEYHSSAGVRIVHSAHEPIAAETSIGALQRELANCKKRLLLANVVGLPGKLQNLRLTQLWSGQCSGAFYVDLECEQKSYF

SEQ ID NO: 161196 - protein, 218 aa, Heterodera glycines
  misc_feature (7)..(7): Xaa can be any naturally occurring amino acid
  Homolog annotation: Hit_ID=EAL48061.1; Match level="QueryCoverage =96%, HitCoverage=11%, E-value=3e-11, Identity=25%"; Hit description =Viral A-type inclusion protein repeat, putative [Entamoeba histolytica HM-1:IMSS]
  Coding regions on vcDNA: vcDNA=SeqID_87619; Strand=+; Position=2-655
GGESRIXNQVEALTAEKRRMEKTLQTTSREREELAQENKKLAAKLMNRKAQDRIIGERERGLEEELRQERLKSESANARIRELEQRIECIQDMNRDIAVEISNANSPLLITISSLEEKLLGLERENDILTRSTRQMSAELGAMKRRHEAEMGTIERSLEEEKQQNAQKTEELAKAFSERANIQTRIEKLEDELLQSKREHSERVNRMEKRMEQLETDI

SEQ ID NO: 161197 - protein, 87 aa, Heterodera glycines
  misc_feature (41)..(41): Xaa can be any naturally occurring amino acid
  Homolog annotation: Hit_ID=CAE75230.1; Match level="QueryCoverage =98%, HitCoverage=85%, E-value=8e-10, Identity=42%"; Hit description =Hypothetical protein CBG23181 [Caenorhabditis briggsae]
  Coding regions on vcDNA: vcDNA=SeqID_87620; Strand=+; Position=86-348
LSKLNQKRKSYNKSHLAKYLEKNGKKKKKKKEVNSKKEKKXAKYYKIKEKIKQKGRKHSTKEWNKIEEKITKKLGTNRKKKKKKKEL

SEQ ID NO: 161198 - protein, 212 aa, Heterodera glycines
  Homolog annotation: Hit_ID=NP_610618.1; Match level="QueryCoverage =96%, HitCoverage=21%, E-value=8e-27, Identity=32%"; Hit description =CG12325-PA [Drosophila melanogaster] gb|AAF58744.1| CG12325-PA [Drosophila melanogaster] gb|AAV36999.1| L
  Gene Ontology: Mol. function=snoRNA binding; Cellular component =cytoplasm; Biological process=establishment of cell polarity (sensu Saccharomyces)
  Coding regions on vcDNA: vcDNA=SeqID_87621; Strand=+; Position=40-675
MNINYQFSDIIGTVYKNGQVKFMPDGNVLLSPVGNRIKTLDLKLFSSCSLATQLRSNITHFDINFAGTHAFVMTETGHGFYLNLFSDTVLHQQLFSERVRALKFSPDGRFIAIGVAGFVHVYSIVPFHRVQFNPFIRVNKFKHSADRINSLDWSDDGRLIIAAGENRVVKVFAAFKSTFANVGVYVLNERASVVGARFFDEYNLFCVDKIGS

SEQ ID NO: 161199 - protein, 129 aa, Heterodera glycines
  Homolog annotation: Hit_ID=BAC87222.1; Match level="QueryCoverage =86%, HitCoverage=81%, E-value=6e-10, Identity=28%"; Hit description =unnamed protein product [Homo sapiens]
  Coding regions on vcDNA: vcDNA=SeqID_87622; Strand=+; Position=300-686
SHRAKEPARTTEKAKETRTWKRDQPKRRKRSLELNLQQLFWAWQCRWSKTKKSRKRTTRVATKPRRRKKRTRRQRTNNRKKAPRRQRKRRKVRQRRRRPRTRRRPRKDRPQRLPTAAPARDRLQHRALR

SEQ ID NO: 161200 - protein, 71 aa, Heterodera glycines
  Coding regions on vcDNA: vcDNA=SeqID_87623; Strand=+; Position=2-217
RPQQTSKYLTNTPMNSVESPTPMHQTLSTRCVYPGLVLLICPHDGSLATDYWCIAANKNPDAHKKHSDSDR

SEQ ID NO: 161201 - protein, 133 aa, Heterodera glycines
  Coding regions on vcDNA: vcDNA=SeqID_87624; Strand=+; Position=3-401
FLSLFSSSLLPLSVALPFAPPANFVSAVCFFSLFNYSFSPSPFSACIGDQCPPTCPGVCTCVGRRDCCTDRNAGGGGDGIAGGLISGGGASLPRLLLALLLGTGRPGLPSLQLALCRDNALNCPLFLSYCQLP

SEQ ID NO: 161202 - protein, 153 aa, Heterodera glycines
  Coding regions on vcDNA: vcDNA=SeqID_87625; Strand=+; Position=32-493
SEHKMRMTQDANLGTFCALFTFLLIVEGTFGIFGIGSSDNDTTTTITQGGGGTSTTTAKPKGGGTAHDENHSDDSSIRGKAREKRQQTNQQQQQPNLESLPVCATGQSPIAPIPPAGPVLPIGAIPPTVVCLKCRPPNGPLSGNNGANGNNGT

SEQ ID NO: 161203 - protein, 65 aa, Heterodera glycines
  misc_feature (11)..(11): Xaa can be any naturally occurring amino acid
  misc_feature (44)..(44): Xaa can be any naturally occurring amino acid
  misc_feature (49)..(49): Xaa can be any naturally occurring amino acid
  misc_feature (53)..(53): Xaa can be any naturally occurring amino acid
  Coding regions on vcDNA: vcDNA=SeqID_87626; Strand=+; Position=3-200
RHSRIQHGIVXVADRRPLRVLTERRNILGPLVRTYESLLSVDMXTRNHXSDPXGALHTAYRANLP

SEQ ID NO: 161204 - protein, 71 aa, Heterodera glycines
  Coding regions on vcDNA: vcDNA=SeqID_87627; Strand=+; Position=2-217
KSKNVYALDHNINNRSRPPLLGRPVTTFSRSSLVASSWRSALAHFVMLDSILFSSNFARIVFQFSQELFFN

SEQ ID NO: 161205 - protein, 166 aa, Heterodera glycines
  Coding regions on vcDNA: vcDNA=SeqID_87628; Strand=+; Position=137-637
CAAANEWPQLNEFLSIYAASALQQQQQKSADPQQQQLAAQQAAAADSWLYNWEWMTAAAAATSKPTQQQKPVNSLNLTPGGTTPTKVNKGTPNERRTAVRGSSNSNNGNALNMLMSAGLPLLSTLSLSGIGTGNNGTAEVAQRNCEEMKPQQQQQQTNLNKQQTKR

SEQ ID NO: 161206 - protein, 245 aa, Heterodera glycines
  Homolog annotation: Hit_ID=NP_494753.2; Match level="QueryCoverage =84%, HitCoverage=42%, E-value=2e-44, Identity=45%"; Hit description =ankyrin (2E574) [Caenorhabditis elegans] gb|AAB00714.3| Hypothetical protein C01F1.6 [Caenorhabditis eleg
  Coding regions on vcDNA: vcDNA=SeqID_87629; Strand=+; Position=1-735
FPSPTFLFYSSNVLPNGTDSSLLDDGQWLDGHFPLHHAVFDNDVPRLGQLLKEAAAAAAESSVIDREDTHGNTAVHIGCMLGHRECVKLLLEHGASVQSGNNLGWCSFHEAISYGDRKTIRMMLIALKKQSSGQLKSRLPLLGEHFSKLADFYMETKWEFSSWIPLLSRILPSDTFKIYKKGHRLRFDFSLVDFNNNGPLPKWERGDVSLLLDILSTDGRKAVLMDNRKKVYQVLREKDQNLSDE

SEQ ID NO: 161207 - protein, 131 aa, Heterodera glycines
  misc_feature (68)..(68): Xaa can be any naturally occurring amino acid
  misc_feature (86)..(86): Xaa can be any naturally occurring amino acid
  misc_feature (100)..(100): Xaa can be any naturally occurring amino acid
  misc_feature (118)..(118): Xaa can be any naturally occurring amino acid
  Homolog annotation: Hit_ID=AAL31950.1; Match level="QueryCoverage =99%, HitCoverage=29%, E-value=2e-25, Identity=56%"; Hit description =CDH1-D [Gallus gallus]
  Coding regions on vcDNA: vcDNA=SeqID_87630; Strand=-; Position=1-391
RCVQRAGTYSERVDDSPLQGIPRSRTIIAMSDPNHGKFSPVYQPLSGKDKHADFASVARVQPRTSKGXHRPVKKQFRAAEHRKSLXEVVPTEAMSQLFSXARVSLVIGINQTNRSTNXERPCTTIHRIIKS

SEQ ID NO: 161208 - protein, 205 aa, Heterodera glycines
  Homolog annotation: Hit_ID=NP_496723.2; Match level="QueryCoverage =100%, HitCoverage=65%, E-value=3e-72, Identity=62%"; Hit description= spermidine synthase (35.0 kD) (2N99) [Caenorhabditis elegans] emb|CAB60361.2| Hypothetical protein Y46G5
  Gene Ontology: Mol. function=spermine synthase activity; Biological process=pantothenate biosynthesis
  Coding regions on vcDNA: vcDNA=SeqID_87631; Strand=+; Position=1-615
HPDPKQVLIIGGGDGGILREVLKHPSVERAVMCEIDEMVVQVAKKFLHGLATSFDSPKLQLHIGDGFEFLKGHEAEFDVIITDSSDPIGPAESLFGKSYYQLVRNALNEDGVLASQAESIWLHLPLISKLMNCARDLFPSVAYASATVPTYPSGTIGYLLASKRQMHVLSVPLRPLNDSECQSMGLKFYNRLLHSASFVLPNFAE

SEQ ID NO: 161209 - protein, 214 aa, Heterodera glycines
  Coding regions on vcDNA: vcDNA=SeqID_87632; Strand=+; Position=65-706
MSSSKRKHQWHLLANVSDYSKSEKGFQSDEKLDDNDLEVAMINESCLFGDTVFQQQSAAFFALPSLLPFNNQTNIVSSFVSPFNEEQNSDESDAAAKSIAYDVVSSLFDGEPLYSSESFSDDEGSMVVNASILQVLQDDETESELEQENTEATKENETAKSVSEESESIEFQPTVPTCNNSMPTLLSQMYAADEQTLPVFDSWEELGDSPVAAE

SEQ ID NO: 161210 - protein, 100 aa, Heterodera glycines
  misc_feature (100)..(100): Xaa can be any naturally occurring amino acid
  Coding regions on vcDNA: vcDNA=SeqID_87633; Strand=-; Position=25-327
YAKKRDVFFSALSIYWFMSRFLKRCVYPLVHHTKGPAHCCCRRWTIVCLLFRCPLTIPCPFQVSNLPYPAAPHFHLKADYEWHHSVAAVVGVGALRSEVX

SEQ ID NO: 161211 - protein, 188 aa, Heterodera glycines
  Coding regions on vcDNA: vcDNA=SeqID_87634; Strand=+; Position=154-717
TRSPTRAHPPTCRHILFGVNGAKKLPRRDKQQGADMDVDEHQPPWKKLSVNTVDNLTLPSCKVQMDWERGHGQALSTANDSTQNQSSSTTRQASDMENSVSDQFSHSQSESEASTSNIDADDEQSDWPGNELARHPQLSSSSSVIVPFQLAPPQQRVASSTNKQQKDAAPLSAEAIKRIECFLQSADD

SEQ ID NO: 161212 - protein, 94 aa, Heterodera glycines
  Coding regions on vcDNA: vcDNA=SeqID_87635; Strand=+; Position=1-285
TAANRRTSAERLQPPRASIGRVALSLAEKIFCGRRRNWAGEVRHLALETCQFTVDKANVRGKRPHGRHMRRTNRQKTKSLPPTHSFALECQRAD

SEQ ID NO: 161213 - protein, 227 aa, Heterodera glycines
  misc_feature (201)..(201): Xaa can be any naturally occurring amino acid
  Coding regions on vcDNA: vcDNA=SeqID_87636; Strand=+; Position=2-682
CNGPFVPLNLGNFCGGEEQTKNVDRNSGDHGEEKSHQPSGAVSALCAAVRSSSHLLDNSPSVPTTSSAVAFPPFGSSPTNGGVVGVSAVSVAQTSLSFVPSFGLLQQQSPIKQLLYTSSQNRHNQLVPSALPSASPGGLMPNQQNGIKSAASAVGGGHSAGVLPAEMNTHNQQQQREENGNNTLALLLQSLQTSILLEQQXKAFLSNSGTTHNNLGTLLNRLPSLNG

SEQ ID NO: 161214 - protein, 222 aa, Heterodera glycines
  misc_feature (208)..(208): Xaa can be any naturally occurring amino acid
  Homolog annotation: Hit_ID=NP_504248.1; Match level="QueryCoverage =49%, HitCoverage=25%, E-value=3e-12, Identity=39%"; Hit description =phosphoethanolamine N-methyltransferase (49.8 kD) (5F113) [Caenorhabditis elegans] gb|AAB04824.1| Hypothe
  Coding regions on vcDNA: vcDNA=SeqID_87637; Strand=+; Position=11-677
MSAISRELANALHNNPNAPPPGGRILLCLSESDVTKKDLKANLDDFFDGNLKIEEMGAEELIEEAEKEAKAANCQQQFDGIICSNVFTGQKMVENRRKMAAVLGVFLRMLRGEGAVLILRENLEDFSAKLIADLTKFVDVFAAKWQNHTFGFRLYGMCQVQNSIFSHSNFLDVHWTLTKSEENRLSDDKLPTFREFLDKTHYTEDNVXSSKWIFGKDFISPG

SEQ ID NO: 161215 - protein, 166 aa, Heterodera glycines
  misc_feature (11)..(11): Xaa can be any naturally occurring amino acid
  Homolog annotation: Hit_ID=AAN32890.1; Match level="QueryCoverage =100%, HitCoverage=100%, E-value=1e-75, Identity=86%"; Hit description=secretory protein 4D09 [Heterodera glycines]
  Coding regions on vcDNA: vcDNA=SeqID_87638; Strand=+; Position=12-513
MAKLVAVALLXLTIAAMALAKTGKSQTADEAEGLRNMNLGDNNTVDAGKEPAADIVTKKGKAQKAGTKSAAATNEPAAAKGTKNGKAPKTKANQEEATNAPAGANEWNDQLMGMSAEKSNEELAVLLPKAHTFMENALSLINEQMEKNGVATGAAGDSSSTGIPAN

SEQ ID NO: 161216 - protein, 136 aa, Heterodera glycines
  misc_feature (6)..(6): Xaa can be any naturally occurring amino acid
  Homolog annotation: Hit_ID=AAO33475.1; Match level="QueryCoverage =100%, HitCoverage=100%, E-value=2e-74, Identity=98%"; Hit description=gland-specific protein g5d08 [Heterodera glycines]
  Coding regions on vcDNA: vcDNA=SeqID_87639; Strand=+; Position=19-428
MFSSSXLSALFLASSVLAVLIIGIKMDGPTEAKAAAPPNAAGPMGLLLLLNGKQSAANEKGKAPSGESKPNPGQKPSGERRKRDVLGHAGGYVGGWDHPIDSTLDWAKSQWNDANWLADVVNRNGWENTGTPTGGR

SEQ ID NO: 161217 - protein, 236 aa, Heterodera glycines
  Coding regions on vcDNA: vcDNA=SeqID_87640; Strand=+; Position=3-710
SFRFVQKKNMKLAFVRLNVLTVLCLFCSMGHSYGNPSDESDDEICEEEENEAQSEAEEAFYFFHNFNGTIQSEREEKRTVVEIFCRNTNDKFQFSTDDEGNFKIQMEAKIKWKFHKCTTGLRMAFYKKKVMENKVPKCLPIILRSPKRKLKNAKRLDICVVPIRIKWLKFGPKINAEEAETEENDEILRNEFALDFDVEKNAQMNGQIRNCSDLHSAEHNFEMIFNKYFDDGKSVD

SEQ ID NO: 161218 - protein, 190 aa, Heterodera glycines
  Homolog annotation: Hit_ID=NP_496431.1; Match level="QueryCoverage =78%, HitCoverage=14%, E-value=1e-11, Identity=31%"; Hit description =ankyrin and PDZ/DHR/GLGF domain and sterile alpha motif SAM (122.6 kD) (2L676) [Caenorhabditis elegans] e
  Coding regions on vcDNA: vcDNA=SeqID_87641; Strand=+; Position=115-687
MEAAASAVQSPVSLRGLSAPPAESQPQPMPLSMPNDSPSPSRRAPLLLENAVKIPAVDYDDQQPTTSCGQGTKSCSSDSGQGSSAGSEDSAEGIVVVSAVCSSPSPSFNGNSPLSAGTFKKKLVENWDFEDVAEWLASLGMGEYSKAFGRTTGRELLRFDRTRFTALGVTRIGHRQTMERSLQSFSRRSD

SEQ ID NO: 161219 - protein, 226 aa, Heterodera glycines
  misc_feature (9)..(9): Xaa can be any naturally occurring amino acid
  Homolog annotation: Hit_ID=CAE70385.1; Match level="QueryCoverage =99%, HitCoverage=40%, E-value=6e-97, Identity=81%"; Hit description =Hypothetical protein CBG16947 [Caenorhabditis briggsae]
  Gene Ontology: Mol. function=pyruvate kinase activity; Cellular component=cytosol; Biological process=glycolysis
  Coding regions on vcDNA: vcDNA=SeqID_87642; Strand=+; Position=1-677
VRTGLLDGXGSAEILLEKDASIRLTTDSAFEKSGTAINLYVDYKNITKVVTKGSRVYIDDGLLSLIVEEIFDDAILCKVENGGKLGSRKGVNLPGTPVDLPAVSEKDIKDLRFGVEQGVDIIFASFIRNANGIQTIREVLGEAGKNIKIIAKIENQEGVGNVDEIIAASDGVMVARGDLGIEIPAHKVFLAQKMMIAKCNMAGKPVITATQMLESMVNKPRPTRAR

SEQ ID NO: 161220 - protein, 60 aa, Heterodera glycines
  Coding regions on vcDNA: vcDNA=SeqID_87643; Strand=-; Position=3-182
KESNAHETRPSCEGILISFEAGNRNSTCHDAALELPSSSQSNPKNNDSRSYLSLSSSSKI

SEQ ID NO: 161221 - protein, 60 aa, Heterodera glycines
  Coding regions on vcDNA: vcDNA=SeqID_87644; Strand=+; Position=1-180
RFPDASLHFAETFDRAISLLRADCRTSEKHVTFLHILRQLGASEENGGLLGNLNGLILIL

SEQ ID NO: 161222 - protein, 71 aa, Heterodera glycines
  Coding regions on vcDNA: vcDNA=SeqID_87645; Strand=-; Position=3-215
QVSNEPVQIAKESTILFTRAQLSENVQKSDVFLRSTTVCAKQRNGAVESLGKMKRCVRETLGSSVKKEGNV

SEQ ID NO: 161223 - protein, 207 aa, Heterodera glycines
  misc_feature (24)..(24): Xaa can be any naturally occurring amino acid
  misc_feature (55)..(56): Xaa can be any naturally occurring amino acid
  misc_feature (59)..(59): Xaa can be any naturally occurring amino acid
  Homolog annotation: Hit_ID=NP_608458.1; Match level="QueryCoverage =88%, HitCoverage=49%, E-value=5e-37, Identity=40%"; Hit description =CG14621-PA [Drosophila melanogaster] gb|AAF50956.1| CG14621-PA [Drosophila melanogaster] gb|AAO39543.1| R
  Gene Ontology: Biological process=transport
  Coding regions on vcDNA: vcDNA=SeqID_87646; Strand=+; Position=2-621
CNKLTLQRHPFPLTIALSSCLTMXLYSLPLLRFLSISSVSVPTDYLLRIVLPIFXXRAXATVSAYFALWKISVSYTQTIKSTMPLFTVLISRLLLGERQPMRIYLSLLPIITGVFITTATELQFDSFGLCFSLLSTGILAFLNVLAKKVLDEARMHPINLLSLNSQLASLLLFPFWLFTDALKMWSNIHSTNRHNQSPDPRFLFMLL

SEQ ID NO: 161224 - protein, 99 aa, Heterodera glycines
  Coding regions on vcDNA: vcDNA=SeqID_87647; Strand=-; Position=30-329
PLLLFFRFLLWLLLLIFLLLLLFVLLVCQLLLLVVLLLFFLLLLVSLVLVFVFRHLLIFFPLLLLLLILFFHEMLYLFFVFLFKSSAYILDVFVVGSVL

SEQ ID NO: 161225 - protein, 164 aa, Heterodera glycines
  Homolog annotation: Hit_ID=NP_496220.1; Match level="QueryCoverage =87%, HitCoverage=97%, E-value=2e-20, Identity=37%"; Hit description =brugia malayi antigen like (2K603) [Caenorhabditis elegans] emb|CAA88891.1| Hypothetical protein ZK970.7
  Coding regions on vcDNA: vcDNA=SeqID_87648; Strand=+; Position=18-512
MSSSSIFLSFASFSLIILALCRAQNESAAQGDAQPPPFLTEASQEKINEFYHYVTSLGHLKETEIAEKVKEWVDKQSEEIQKKYVEFEQERERAKAEGEAAHEEAVRKFSEAAKKADKELTEIANNPNLSANDKAEMISRKVQSLPKKVRDEIGGAMGGGGGGQ

SEQ ID NO: 161226 - protein, 34 aa, Heterodera glycines
  Homolog annotation: Hit_ID=NP_763331.1; Match level="QueryCoverage =100%, HitCoverage=23%, E-value=4e-10, Identity=85%"; Hit description= Cell wall-associated hydrolase [Vibrio vulnificus CMCP6] ref|NP _760406.1| Cell wall-associated hydrolase
  Coding regions on vcDNA: vcDNA=SeqID_87649; Strand=-; Position=2-103
SVERWPFHTEPPDHYDLLSHLLDLSVSQLSTLMP

SEQ ID NO: 161227 - protein, 185 aa, Heterodera glycines
  misc_feature (9)..(9): Xaa can be any naturally occurring amino acid
  Homolog annotation: Hit_ID=AAP30775.1; Match level="QueryCoverage =100%, HitCoverage=100%, E-value=8e-93, Identity=91%"; Hit description=putative gland protein G32E03 [Heterodera glycines]
  Coding regions on vcDNA: vcDNA=SeqID_87650; Strand=+; Position=6-562
MRAILFLAXVCLVMAVILETANSKAVKKDNKKGAITTPAKGKAAPKGAAKGGIKKDAKSKGKGKKDAKGKKDKKAKPAKGKGVPKNDKKSPAAKANDKKSPTKPMAAVKAVPKAAENAQKGPSSAEVVAEENNLDTEAVDDLGAEESDFDQLAEDELLEDDAMDGEADEWEGMGEETEMDSQMAL

SEQ ID NO: 161228 - protein, 83 aa, Heterodera glycines
  Homolog annotation: Hit_ID=ZP_00215664.1; Match level="QueryCoverage =100%, HitCoverage=7%, E-value=6e-42, Identity=97%"; Hit description =COG0841: Cation/multidrug efflux pump [Burkholderia cepacia R18194]
  Coding regions on vcDNA: vcDNA=SeqID_87651; Strand=-; Position=2-250
FFGWFNRTFNNSRDKYHVGVHHVIKRSGRWLIIYLVVIVAVGLLFVRLPKSFLPDEDQGLMFVIVQTPSGSTQETTAKTLANI

SEQ ID NO: 161229 - protein, 51 aa, Heterodera glycines
  Coding regions on vcDNA: vcDNA=SeqID_87652; Strand=+; Position=2-157
DLLQMPIQLSRTTLAERVYHPACGLYCYSNVWLIKVPFTFNSPISDHNDLA

SEQ ID NO: 161230 - protein, 63 aa, Heterodera glycines
  Coding regions on vcDNA: vcDNA=SeqID_87653; Strand=-; Position=1-189
ILIVLINTVCANQSIVNDIIKRLLQLFTQILVITDRTVECEWHFDQPKCRVTNQAKAGDEPAH

SEQ ID NO: 161231 - protein, 37 aa, Heterodera glycines
  Coding regions on vcDNA: vcDNA=SeqID_87654; Strand=-; Position=3-113
MDDVIASSVSMNQLSLQLVINLTNELPSFPFEHIVPS

SEQ ID NO: 161232 - protein, 57 aa, Heterodera glycines
  Homolog annotation: Hit_ID=ZP_00340573.1; Match level="QueryCoverage =78%, HitCoverage=28%, E-value=5e-12, Identity=73%"; Hit description =hypothetical protein RakaH01001082 [Rickettsia akari str. Hartford]
  Coding regions on vcDNA: vcDNA=SeqID_87655; Strand=+; Position=3-176
RPLSLVATQEHSKETAGDKPEEGGDDVKSSWPLWVGLHTSYNGRNRGLPTREGELIP

SEQ ID NO: 161233 - protein, 58 aa, Heterodera glycines
  Homolog annotation: Hit_ID=ZP_00244991.1; Match level="QueryCoverage =100%, HitCoverage=6%, E-value=3e-26, Identity=96%"; Hit description =COG1049: Aconitase B [Rubrivivax gelatinosus PM1]
  Coding regions on vcDNA: vcDNA=SeqID_87656; Strand=+; Position=2-175
KDLACLGFSADLVMQSFCTTAAYPKPVDVKMHRELPAFISNRGGVALRPGDGVIHSWL

SEQ ID NO: 161234 - protein, 128 aa, Heterodera glycines
  Coding regions on vcDNA: vcDNA=SeqID_87657; Strand=+; Position=22-408
MVYVEYCFDVRLDDFNEEYCFEVSNADIVHNSCLYVEQTNPNYMTFHGVFYYIFVCEKTISGLKDDRSENVFNRRQGACASGDDRCDNVFNRGQVASARNGEGRDSILIQGLAFVIVKVVNAVYDMIV

SEQ ID NO: 161235 - protein, 124 aa, Heterodera glycines
  Coding regions on vcDNA: vcDNA=SeqID_87658; Strand=+; Position=42-413
VADIDRERVLSLDDDLGKVKTELTVHARENRQLNLFFSDWRRVRENTRWNSKTGGSTMERAKRYIDQENRPEKDARSTLLKLADMFESPIPTTSNVARLRIQFDDDDNDADDNHRPDTASIDSP

SEQ ID NO: 161236 - protein, 94 aa, Heterodera glycines
  misc_feature (72)..(72): Xaa can be any naturally occurring amino acid
  misc_feature (82)..(82): Xaa can be any naturally occurring amino acid
  Homolog annotation: Hit_ID=AAO33474.1; Match level="QueryCoverage =82%, HitCoverage=55%, E-value=4e-15, Identity=60%"; Hit description =gland-specific protein g4g12 [Heterodera glycines]
  Coding regions on vcDNA: vcDNA=SeqID_87659; Strand=+; Position=5-288
WECHTHYHLALVQHRLVVTAARASYLPDTVGAVATDRINAHGRNACGQWPSHGTHRSMAPPPSSVQFPMGAXNQLKKMTAHXHQLAEKMPVNES

SEQ ID NO: 161237 - protein, 148 aa, Heterodera glycines
  Homolog annotation: Hit_ID=NP_491690.2; Match level="QueryCoverage =93%, HitCoverage=27%, E-value=3e-40, Identity=59%"; Hit description =aminotransferase, class I and II family member (55.8 kD) (1G400) [Caenorhabditis elegans] gb|AAC24265.2|
  Gene Ontology: Mol. function=transaminase activity; Biological process=nitrogen metabolism
  Coding regions on vcDNA: vcDNA=SeqID_87660; Strand=+; Position=140-583
MSSSDKLQQQKVLTVDTINPNVITMEYAVRGPIVIRAVELEKQLAKESLPFPSAIRANIGDAHAMGQTPITFIRQVIAGITEPALIKQQPNLFPEDVQRKVASLLRACGGGSAGAYTQSTGIDLIRQHVAQFVERRDGFPCDPESVCI

SEQ ID NO: 161238 - protein, 196 aa, Heterodera glycines
  misc_feature (63)..(63): Xaa can be any naturally occurring amino acid
  Homolog annotation: Hit_ID=CAE62200.1; Match level="QueryCoverage =99%, HitCoverage=97%, E-value=1e-52, Identity=55%"; Hit description =Hypothetical protein CBG06250 [Caenorhabditis briggsae]
  Coding regions on vcDNA: vcDNA=SeqID_87661; Strand=+; Position=6-594
MTAARLLKMVPSESALLVCDMQEKFREHIKFFPQILQVTCRLIEAAKLLDMKILATEQNPNGXGHTVPEIVLKKHDIPFSEKTKFSMCVPDLQRELGLSPAVRSLLLCGIEAHVCVYQSAIDFQQQGFNVHVVVDASSSRSMVDRIYAYKQLEKVGINLITSECAILGLVGDSAHPKFREVQKLIRESAPDTGLIS

SEQ ID NO: 161239 - protein, 206 aa, Heterodera glycines
  Homolog annotation: Hit_ID=YP_037029.1; Match level="QueryCoverage =84%, HitCoverage=54%, E-value=4e-16, Identity=37%"; Hit description =hypothetical protein BT9727_2705 [Bacillus thuringiensis serovar konkukian str. 97-27] gb|AAT61780.1| con
  Gene Ontology: Mol. function=ribosome receptor activity; Cellular component=integral to endoplasmic reticulum membrane; Biological process=protein biosynthesis
  Coding regions on vcDNA: vcDNA=SeqID_87662; Strand=+; Position=37-654
TQSAKASEPAQQNAKASEPAIQQQNAKASEAAEQNAKASELAQQSAKASEPVQQNAKASEPAIQQQKANAQQNAKASEPAIQQQKANAQQNAKASEPAIQQQNAKASEAAEQNAKASELAQQSAKASEPVQQNAKASEPAIQQQNANAQQNAKMENITSKDAPNVKSDNSINKQSMNGSDTNEKNAMETKFVVPSSIESRVIEPVR

SEQ ID NO: 161240 - protein, 158 aa, Heterodera glycines
  misc_feature (71)..(71): Xaa can be any naturally occurring amino acid
  misc_feature (112)..(112): Xaa can be any naturally occurring amino acid
  Homolog annotation: Hit_ID=AAO85454.1; Match level="QueryCoverage =99%, HitCoverage=84%, E-value=7e-74, Identity=90%"; Hit description =putative gland protein G16B09 [Heterodera glycines]
  Coding regions on vcDNA: vcDNA=SeqID_87663; Strand=+; Position=88-559
MASSFCSSLISIAVIVCLLRKCCFSAPHPCCPGSQHVVSMMKDHTGSFSASMPKSSLCLSAERVAAAVENXQLKTIWCPGNGGQTLINEINAAQSSSDECARSLGFVRAMFXIVASAASHVRANAELANLAVQFPEQRCTIDTYCAALGLYVGQIPLC

SEQ ID NO: 161241 - protein, 238 aa, Heterodera glycines
  misc_feature (24)..(24): Xaa can be any naturally occurring amino acid
  Homolog annotation: Hit_ID=EAK87097.1; Match level="QueryCoverage =92%, HitCoverage=53%, E-value=8e-69, Identity=44%"; Hit description =hypothetical protein UM06193.1 [Ustilago maydis 521] ref|XP _403808.1| hypothetical protein UM06193.1 [Usti
  Gene Ontology: Mol. function=RNA binding; Cellular component =nucleolus; Biological process=nucleobase, nucleoside, nucleotide and nucleic acid metabolism
  Coding regions on vcDNA: vcDNA=SeqID_87664; Strand=+; Position=1-716
QVDTSEDTGIKTLWVGQLSWNVDXDWLKSEFEQYGTVLDARVQYDRDSGRSRGFGYVDFASSAEALRASKEAHGKELDGRALRVDLQPPRGPQERVESRAKHFKDELSAPSNTLFIGGLAWALTEDDVWNAFAEFGEVAGVRLPKEIESGRPKGFGYVEFTSEENAAKALEAMNGQALGGRPIRIDFAGKRDNSNSSRGAPRGGNTGRPRDSGWGGRAGGARSASGSARSGAIAPSTG

SEQ ID NO: 161242 - protein, 158 aa, Heterodera glycines
  Coding regions on vcDNA: vcDNA=SeqID_87665; Strand=+; Position=82-555
RKSLWGIVTRENERSNDLTDQLKPWDVPIFQVPSIQKQGSFSCRSSLSGYDSAQWVDSTDAAISHRPPPRPPPPKLCQTTSEVTSPRRHFHQSHRHSVELVDENLQLVKSVGRGVLPDSVNPQLMQNAASVSKTDFKQKVVLDLLNTERAYLFDLNTW

SEQ ID NO: 161243 - protein, 69 aa, Heterodera glycines
  Coding regions on vcDNA: vcDNA=SeqID_87666; Strand=-; Position=2-208
LSQQGRRGELGKASNSQNSVARRVSLKQMRKGHCSCSSSSPPSSPSASSSSSSPIHHHRHRLFIVFLII

SEQ ID NO: 161244 - protein, 71 aa, Heterodera glycines; identical to SEQ ID NO: 161222
  Coding regions on vcDNA: vcDNA=SeqID_87667; Strand=-; Position=3-215

SEQ ID NO: 161245 - protein, 120 aa, Heterodera glycines
  Coding regions on vcDNA: vcDNA=SeqID_87668; Strand=+; Position=3-365
LFVYLHGSPEHFYVQNSAGKEWRSTKLFDGATDGHAICTFGMEEFALSGVHELVVFVNMHGVSSRPPISVSGRSRIVGLSLKEPFLHVLSEDGTVSIFSTVDAHLVQSLAFPTDEVQEVR

SEQ ID NO: 161246 - protein, 146 aa, Heterodera glycines
  Homolog annotation: Hit_ID=P02251; Match level="QueryCoverage=86%, HitCoverage=54%, E-value=4e-13, Identity=45%"; Hit description =Histone H1.3 pir||HSRB13 histone H1.3 - rabbit
  Gene Ontology: Mol. function=DNA binding; Cellular component =nucleosome; Biological process=nucleosome assembly
  Coding regions on vcDNA: vcDNA=SeqID_87669; Strand=+; Position=22-462
IEASKGIGASGSFRLGGSGTPKTSDVKKSPKKRIAAKKPSVMKATPKKAKKAVPKKSPAAKKAKPTAAAKPEVPLPVSPAVTKSKTAKALKKDVPKKSKMAKRSPKIAKKSKTPKKATGGAKTSRKVKKVAASKSAKKDVGVDGAS

SEQ ID NO: 161247 - protein, 139 aa, Heterodera glycines
  Homolog annotation: Hit_ID=AAO33474.1; Match level="QueryCoverage =96%, HitCoverage=97%, E-value=3e-69, Identity=98%"; Hit description =gland-specific protein g4g12 [Heterodera glycines]
  Coding regions on vcDNA: vcDNA=SeqID_87670; Strand=+; Position=2-421
KKCQPFQIPLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 161248 - protein, 61 aa, Heterodera glycines
  misc_feature (39)..(39): Xaa can be any naturally occurring amino acid
  Coding regions on vcDNA: vcDNA=SeqID_87671; Strand=+; Position=2-187
RVKDLLRKLCRSKNRPLRLFIKNTALCVVTTSFNRIPPXPGPPPHWDRARENLRRRAQFAL

SEQ ID NO: 161249 - protein, 211 aa, Heterodera glycines
  Homolog annotation: Hit_ID=AAB05072.1; Match level="QueryCoverage =90%, HitCoverage=34%, E-value=7e-76, Identity=74%"; Hit description =CCT-1 pir||JC4083 chaperonin - Caenorhabditis elegans sp|P41988|TCPA_ CAEEL T-complex protein 1, alpha subu
  Gene Ontology: Mol. function=chaperone activity; Cellular component =actin filament; Biological process=protein folding
  Coding regions on vcDNA: vcDNA=SeqID_87672; Strand=+; Position=4-639
MTALHCHVVKSSLGPVGLDKMLVDDVGDVTVTNDGATILKLLEVEHPAGKILVDLAQLQDEEVGDGTTTVVIIAAELLKAADELVRKKIHPTNIINGYRLACKEAVRYMTENLSFPVEELDRASLIRAAKTSMSSKLIGSESDFFAELCVDATVAVKRTDKAGRVSYPINSVNVLKAHGKSSKESQLISGYALNCSAVLTKSYRLAFQTTN

SEQ ID NO: 161250 - protein, 224 aa, Heterodera glycines
  misc_feature (187)..(187): Xaa can be any naturally occurring amino acid
  misc_feature (203)..(203): Xaa can be any naturally occurring amino acid
  Homolog annotation: Hit_ID=NP_502165.2; Match level="QueryCoverage =96%, HitCoverage=17%, E-value=5e-45, Identity=50%"; Hit description =cation-transporting atpase (132.0 kD) (4M238) [Caenorhabditis elegans] emb|CAB05683.2| Hypothetical prote
  Gene Ontology: Mol. function=ATPase activity, coupled to transmembrane movement of ions, phosphorylative mechanism; Cellular component=membrane; Biological process=calcium ion homeostasis
  Coding regions on vcDNA: vcDNA=SeqID_87673; Strand=+; Position=7-678
MDSLKGRSLRLVLKNVRVYARMSPKQKERAINALKAMGLTTLMCGDGTNDVGALKHAEVGVALLTHPLKPEEATAATSAGSGTPTQSTSGTSGRQQQNEGGGGEQTRRYNNREPTSADANGQRQQQQQLAMTTAGGGGTSSRQQQMQGRLNQMMRDLEDQEEQAKVRLGDASYAAPFTSKSTSIQSXCNIIKQGRCTLVTTLXMFKILALNALVLAYSQSVLYL

SEQ ID NO: 161251 - protein, 218 aa, Heterodera glycines
  Homolog annotation: Hit_ID=CAE74248.1; Match level="QueryCoverage =91%, HitCoverage=45%, E-value=2e-56, Identity=53%"; Hit description =Hypothetical protein CBG21934 [Caenorhabditis briggsae]
  Gene Ontology: Cellular component=extracellular space
  Coding regions on vcDNA: vcDNA=SeqID_87674; Strand=+; Position=53-706
MLFSPSTVLLLLLIVLPFSLSFILIPQNVRQISPALSSRPFRRFGHFSVIAKRNPIVLIPGDGGSRLKANLTGKPSVVHYFCQRQTNDFFALWLDLQQFGPFVIDCWADNMRLNFNRTSGRAQDLEGVKVRVPGFGHTRTVEWIDSSKRSPSRYFAPIVASLAKLGYQRGIDVIGAPYDWRRAPEELLHYFVKLRSLIEQLYHANGNRKVIVLAHSMG

SEQ ID NO: 161252 - protein, 237 aa, Heterodera glycines
  Homolog annotation: Hit_ID=AAB40605.1; Match level="QueryCoverage =100%, HitCoverage=59%, E-value=1e-101, Identity=66%"; Hit description=cathepsin B-like cysteine proteinase [Ascaris suum]
  Gene Ontology: Mol. function=peroxidase activity; Cellular component =extracellular space; Biological process=protein targeting
  Coding regions on vcDNA: vcDNA=SeqID_87675; Strand=+; Position=1-711
VNRRQRLWRAELSPKFQSYDEAIKWRMMGVNHVRHSTKAKKVLGKTRFLDLDLPESFDARQRWNFCPSISLIRDQSSCGSCWAFGAVEAMSDRTCIASGGNIRIALSADDLLSCCHKCGFGCDGGEPLQAWRYWVKEGIVTGSNFTAHGGCRPYPFPPCEHHSNKTHYEPCKHELYPTPKCERKCQTSYNKREYKEDKFYGKSAYAIDNSVKAIQNELFVNGPIEVAFEVYEDFLNY

SEQ ID NO: 161253 - protein, 155 aa, Heterodera glycines
  Homolog annotation: Hit_ID=CAE64449.1; Match level="QueryCoverage =80%, HitCoverage=90%, E-value=3e-32, Identity=50%"; Hit description =Hypothetical protein CBG09156 [Caenorhabditis briggsae]
  Coding regions on vcDNA: vcDNA=SeqID_87676; Strand=+; Position=22-489
MKSFHLSIVVTLCLLISCLTPSSFGYDDDDLFDIGTAQSVAVTGILTCNGRPSGGTKVKLYDVDTFDPDDLMAEGFTDEKGHFLLEGFETEISDIDPKLNIYHNCNDEHFPCLQKFSIEVPDNYITEGKRPQKIFDIGKLNLEGKFSGQHRDCIN

SEQ ID NO: 161254 - protein, 110 aa, Heterodera glycines
  misc_feature (47)..(47): Xaa can be any naturally occurring amino acid
  Homolog annotation: Hit_ID=XP_474218.1; Match level="QueryCoverage =93%, HitCoverage=15%, E-value=3e-25, Identity=54%"; Hit description =OSJNBa0015K02.22 [Oryza sativa (japonica cultivar-group)] emb|CAE04830.1| OSJNBa0084K01.2 [Oryza sativa (
  Gene Ontology: Biological process=establishment of synaptic specificity at neuromuscular junction
  Coding regions on vcDNA: vcDNA=SeqID_87677; Strand=+; Position=25-358
IFHKVDCILTSGGTGFSKRDVTPEATKEVIERECPGIAVALLKKGLXITPFAALTRLTAGIAANCLIINLPGSPKAVREGFEVIEPILSHAIAIVKGDESETSVLHKRTA

SEQ ID NO: 161255 - protein, 36 aa, Heterodera glycines
  Coding regions on vcDNA: vcDNA=SeqID_87678; Strand=-; Position=1-108
DCIPTNHMSVEVYNDDVPSGAFALLYIILGRGGRYP

SEQ ID NO: 161256 - protein, 167 aa, Heterodera glycines
  Coding regions on vcDNA: vcDNA=SeqID_87679; Strand=+; Position=65-568
KGAAWLSTVRYDCASTSDSSGSYSQCGTPPMADAMQQQRTALTTERGGLNYVIWWHRWRTGACPLPPPLPLHPDIILTDHPKLLITSQMPSHNNHQGPPVLRWRSNAGKMAKTAAERDSTSAHAGSVVRLHRPPQASPHDPRPISLTPPTTNCLRALSFRFGRAFST

SEQ ID NO: 161257 - protein, 169 aa, Heterodera glycines
  Homolog annotation: Hit_ID=NP_492427.2; Match level="QueryCoverage =100%, HitCoverage=21%, E-value=3e-72, Identity=76%"; Hit description= abnormal ThermoTaXis TAX-2, cyclic nucleotide-gated channel (92.4 kD) (tax-2) [Caenorhabditis elegans] g
  Gene Ontology: Mol. function=3',5'-cGMP binding; Cellular component =plasma membrane; Biological process=cyclic nucleotide metabolism
  Coding regions on vcDNA: vcDNA=SeqID_87680; Strand=+; Position=151-657
VVEYLYMTFSWMMGVFVFALLLGQIRDIVSNANKNNEEFRTTMDKALSECKRLDLPEHLTARVRSWFLYTWERQRTLEEKKLVEKLPLKLQTDLALSVHYSTLGKVKLFQDADRAFLRDLVLRLRPAIFLPGDMICRKGDVGKEMYIVNNGILEVVGGEHNELVFATLA

SEQ ID NO: 161258 - protein, 260 aa, Heterodera glycines
  Homolog annotation: Hit_ID=AAC72366.2; Match level="QueryCoverage =99%, HitCoverage=21%, E-value=1e-127, Identity=86%"; Hit description= guanylyl cyclase [Heterodera glycines]
  Gene Ontology: Mol. function=protein tyrosine kinase activity; Cellular component=integral to membrane; Biological process=transport
  Coding regions on vcDNA: vcDNA=SeqID_87681; Strand=+; Position=2-781
WWTAPELLRENNRTGTKEGDVFSFTIIYVEMVNRETVWNGTERDDDVDEILYRLKRTNNTIPHRPQLRPREDTNQSLVHLIRDYWAEVPAERPRMDMVRTMLKQMVQDGNQNLMDYVFGMLEQYASSLEQEVEERTKELVEERTKELVEEKRKSDILLNRMLPRQVADKLKLGEAVEPESFQMATIFFSDVVSFTTLAGKCTPLQVVNLLNGLYTAFDGIIDTHDCYKIETIGDGYLVCSGIPKRNGDQHAKEIAELSFA

SEQ ID NO: 161259 - protein, 156 aa, Heterodera glycines
  misc_feature (59)..(59): Xaa can be any naturally occurring amino acid
  Homolog annotation: Hit_ID=CAE64528.1; Match level="QueryCoverage =100%, HitCoverage=35%, E-value=1e-71, Identity=85%"; Hit description= Hypothetical protein CBG09267 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Coding regions on vcDNA: vcDNA=SeqID_87682; Strand=+; Position=2-471
IDEIDAIGTKRYDSNSGGEREIQRTMLELLNQLDGFDSRGDVKVLMATNRIDSLDPVLXRPGRIDRKIEFPLPDEKTKRRIFHIHTARMQLENVDLEEFIAAKDDLSGADIKAMCTEAGLLALRERRMKVTMDDMRKAKENVLYRKKDNAPETMYL

SEQ ID NO: 161260 - protein, 37 aa, Heterodera glycines
  Coding regions on vcDNA: vcDNA=SeqID_87683; Strand=+; Position=8-118
SDPTSSAITHLFAKLFDDTIHPGIRDTQIEDALLRKR

SEQ ID NO: 161261 - protein, 179 aa, Heterodera glycines
  Homolog annotation: Hit_ID=NP_741269.1; Match level="QueryCoverage =63%, HitCoverage=20%, E-value=2e-10, Identity=37%"; Hit description =coronin (67.1 kD) (cor-1) [Caenorhabditis elegans] emb|CAA83461.1| Hypothetical protein R01H10.3a [Caenor
  Coding regions on vcDNA: vcDNA=SeqID_87684; Strand=+; Position=78-617
MAMETLGGGEERNKMETEMDVSVGEESPHQQRFLEECLNLSQKFLKEMSKDEEQQQNVINGEANDGKSDVAKELLICHSSSPTASPQPSGCFLTSANVVAESDGILREQNRSGEADGQSTAATTPNASRRPSNSSAAAVSGSVEDELAKIKVVLRQHERRIRLLEDQLADANMANAYGL

SEQ ID NO: 161262 - protein, 206 aa, Heterodera glycines
  misc_feature (206)..(206): Xaa can be any naturally occurring amino acid
  Homolog annotation: Hit_ID=EAL27334.1; Match level="QueryCoverage =21%, HitCoverage=6%, E-value=3e-11, Identity=68%"; Hit description =GA17887-PA [Drosophila pseudoobscura]
  Gene Ontology: Cellular component=nucleolus; Biological process =neuroblast cell fate determination
  Coding regions on vcDNA: vcDNA=SeqID_87685; Strand=+; Position=87-704
MYEQYGGQKQMRRTENDKNTEQCQRNAQRNIGERMPTMDDNNDQQPSMLRRMPLQSMENASLLKSSEFSSSEHFSACKKEPIEQSEVIAPKNRLGPPAHWRVEETEKRQKRSAKRAPLPRQTTYQIDEHGRQVVVVRNDDSYRSNDEDDERTENAERGVPPIARNGFVKPAYSYSCLIGLSLKNSDTGELTVSEIYAFLCYHFPYX

SEQ ID NO: 161263 - protein, 43 aa, Heterodera glycines
  Coding regions on vcDNA: vcDNA=SeqID_87686; Strand=+; Position=4-135
RTGCLSPYDELAVTRPGRVKFEKGEPFCLSIWSSTRRSSSSSR

SEQ ID NO: 161264 - protein, 66 aa, Heterodera glycines
  Homolog annotation: Hit_ID=ZP_00340573.1; Match level="QueryCoverage =69%, HitCoverage=29%, E-value=4e-12, Identity=71%"; Hit description =hypothetical protein RakaH01001082 [Rickettsia akari str. Hartford]
  Coding regions on vcDNA: vcDNA=SeqID_87687; Strand=+; Position=2-202
VPQRAQPLSLVATQEHSKETAGDKPEEGGDDVKSSWPLWVGLHTSYNGRNRGLPTREGELIPENRS

SEQ ID NO: 161265 - protein, 222 aa, Heterodera glycines
  Coding regions on vcDNA: vcDNA=SeqID_87688; Strand=+; Position=3-668
LLMLFPRPSAGVGMDFGPYLKLTAIFIVLSTFGLGLSLAHMKKMLQIGKELAKQNETTKTASATFVGQDNLRTLRAFTGCQAGLSVLSIYVAASLAFMKFWYVRTHLVQEFSCSLMAITLAVVQFFVLRMANGGGLLLIKGIVLANACQIVQELNMSLSAFYTFFYAGRIYDAVEERTSFFTGPESAHVRFALSRVQHAKTFLFLSLLFHVGRMLFNAFVLW

SEQ ID NO: 161266 - protein, 106 aa, Heterodera glycines; identical to SEQ ID NO: 160287
  Homolog annotation: Hit_ID=NP_490685.1; Match level="QueryCoverage =85%, HitCoverage=91%, E-value=2e-11, Identity=37%"; Hit description =transposase (1A616) [Caenorhabditis elegans] gb|AAB54166.1| Hypothetical protein F53G12.11 [Caenorhabditi
  Coding regions on vcDNA: vcDNA=SeqID_87689; Strand=+; Position=209-529

SEQ ID NO: 161267 - protein, 44 aa, Heterodera glycines; identical to SEQ ID NO: 160340
  Homolog annotation: Hit_ID=AAO85458.1; Match level="QueryCoverage =100%, HitCoverage=39%, E-value=1e-17, Identity=100%"; Hit description=putative gland protein G19C07 [Heterodera glycines]
  Coding regions on vcDNA: vcDNA=SeqID_87690; Strand=+; Position=1-135

SEQ ID NO: 161268 - protein, 229 aa, Heterodera glycines
  misc_feature (7)..(7): Xaa can be any naturally occurring amino acid
  Homolog annotation: Hit_ID=XP_314537.1; Match level="QueryCoverage =83%, HitCoverage=71%, E-value=2e-26, Identity=31%"; Hit description =ENSANGP00000016990 [Anopheles gambiae]
  Coding regions on vcDNA: vcDNA=SeqID_87691; Strand=+; Position=1-689
YRGRYVXLAEVAMNGRKNRLFMSMRICKNIKELLGKFEGHVPASEEVNGKAENVTIQSESIVTERLLYYIDLRENRRGSFLRITQLETHSGIRNSVALPFEGIGQLHDALDSILEEYGEGFIEEEAELPHSQMIRTDGKSFFFDPGHNSRGDFLKITELKSFMGVRNSVVLSIRAIPQFTQVLSKLYDDFQELRAVEEVNVNNVLKKEAEEAITDSNEESPKKETKSTD

SEQ ID NO: 161269 - protein, 193 aa, Heterodera glycines
  misc_feature (26)..(26): Xaa can be any naturally occurring amino acid
  Homolog annotation: Hit_ID=NP_625385.1; Match level="QueryCoverage =51%, HitCoverage=51%, E-value=6e-12, Identity=45%"; Hit description =putative acetyltransferase [Streptomyces coelicolor A3(2)] emb|CAB95978.1| putative acetyltransferase [St
  Coding regions on vcDNA: vcDNA=SeqID_87692; Strand=+; Position=14-591
SPALTVPTSRAAAYFGMFAVHPFFQXSGLGKRLLTVAERYARIVWGSDEMHLDVGWSLAELKLGMGRLQRYYKRRGFLSTGILRPFNGAVARFITVDRNDLWIELMVKDIRGALDDIGGDPEKRMKRVNSRGRLAREADKDDGGRDPQKRMERVRSFGRLTIEADRDDIGRDAQKKMERVRSLGRLAREADKS

SEQ ID NO: 161270 - protein, 161 aa, Heterodera glycines
  misc_feature (46)..(46): Xaa can be any naturally occurring amino acid
  misc_feature (55)..(55): Xaa can be any naturally occurring amino acid
  Coding regions on vcDNA: vcDNA=SeqID_87693; Strand=+; Position=23-505
RRRKPWQTDGTIGAQKAVPKTVSATPNSGLGHKIDSQDAKRWRHKXESCNWATGXRYQRKHFGPGQKRRVSFGPQSESNDSATRKHKMPKVEVSTEQMTTPKAGQQKCQTKMNGSASSGKAINGPQKKLAEEQNRAPPQRSNMPKSGGNANIGGGADPTPI

SEQ ID NO: 161271 - protein, 104 aa, Heterodera glycines
  misc_feature (49)..(49): Xaa can be any naturally occurring amino acid
  Coding regions on vcDNA: vcDNA=SeqID_87694; Strand=-; Position=3-314
VPLELYKVSLANKSKHPIGVVAGGEMGKRNTQTENNRFDQAEKAKAKAXLKGFTPKGQGNAHLLGLAQHSVNRPFRRVAFPLPQQTWQSALFALYLARVPIMRQ

SEQ ID NO: 161272 - protein, 213 aa, Heterodera glycines
  Homolog annotation: Hit_ID=AAC38987.1; Match level="QueryCoverage =80%, HitCoverage=13%, E-value=4e-47, Identity=54%"; Hit description =P-glycoprotein [Haemonchus contortus] pir||T31073 multidrug resistance p-glycoprotein - nematode (Haemonch
  Gene Ontology: Mol. function=ATP-binding cassette (ABC) transporter activity; Cellular component=mitochondrion; Biological process =embryogenesis and morphogenesis
  Coding regions on vcDNA: vcDNA=SeqID_87695; Strand=+; Position=63-701
MAIPLLGEGSVGSAKSSPRKAKAAEGGGTLWRKHSPAMVLRRRKTSSASLRTSASTDVLQISQMQKELDESEVRPSSIGKIFRFNTGNWHLAFVGLIGCSISGLAVPFFALVYAQIFSVFSEPLDQLQSDALFWAAMFLLVGFLNAFGFFISANMLGRSGEALTKKLRTEAFRNLMRQDTAFFDDERHSTGKLCTRFATDTPNVRYVFTRLMV

SEQ ID NO: 161273 - protein, 233 aa, Heterodera glycines
  misc_feature (163)..(163): Xaa can be any naturally occurring amino acid
  misc_feature (181)..(181): Xaa can be any naturally occurring amino acid
  Homolog annotation: Hit_ID=AAN32888.1; Match level="QueryCoverage =99%, HitCoverage=68%, E-value=1e-119, Identity=96%"; Hit description= annexin 4C10 [Heterodera glycines]
  Gene Ontology: Mol. function=diphosphoinositol-polyphosphate diphosphatase activity; Cellular component=cytoplasm; Biological process=skeletal development
  Coding regions on vcDNA: vcDNA=SeqID_87696; Strand=+; Position=2-700
PNGLTILLLISVVIGHSLANLGPTIKHNPHFKAVQTAHHLHDAIAKKHEAEVTQIICFFSNEQRQALALEFKKQFGTDLIAMLKKEFKSDFEELIISLMQTPAVYDANQMRAALSGSNEAVLIEILATRTNRQITALKQAYERLDRRHQHNQLEEDIKAKTKXTLPKSVGVFAQLLSRRKXPASIVLAHDEAMKLFREGEGRRGVNAVVFNQVLATRSFAQLRETFEFYRQAT

SEQ ID NO: 161274 - protein, 105 aa, Heterodera glycines
  Coding regions on vcDNA: vcDNA=SeqID_87697; Strand=-; Position=1-315
TECMSCSMISAAVTRYRALVGSSTSSIKCSPACRSSVWSASRSSACPVASPLGCAAWPRSASCFARRPGRCKKKKLVSLLWAGLSAGLAGVALFFCGAGVMFGAV

SEQ ID NO: 161275 - protein, 105 aa, Heterodera glycines
  Coding regions on vcDNA: vcDNA=SeqID_87698; Strand=+; Position=23-340
MKCRRMEEQPDEIRQQAITEFIGGCPPEFTQILAHIDGLQLEDRPNYEMIETMLREHLTRSRVPEHPYDWEVGRRNAMAQAQSEAARRKKDNTKEGGGGKNNTQG

SEQ ID NO: 161276 - protein, 60 aa, Heterodera glycines
  Homolog annotation: Hit_ID=NP_508272.1; Match level="QueryCoverage =96%, HitCoverage=41%, E-value=2e-16, Identity=67%"; Hit description =spondyloepiphyseal dysplasia late (XC58) [Caenorhabditis elegans] gb|AAB52862.1| Hypothetical protein W05
  Gene Ontology: Cellular component=TRAPP; Biological process=ER to Golgi transport
  Coding regions on vcDNA: vcDNA=SeqID_87699; Strand=+; Position=5-187
IRFSMLHTQKNEDGIKQFFQEIYEMYIKFSMNPFYRQDTPIRSPSFEQKAAMYGRKFLGV

SEQ ID NO: 161277 - protein, 195 aa, Heterodera glycines
  misc_feature (11)..(11): Xaa can be any naturally occurring amino acid
  misc_feature (19)..(19): Xaa can be any naturally occurring amino acid
  misc_feature (36)..(36): Xaa can be any naturally occurring amino acid
  misc_feature (43)..(43): Xaa can be any naturally occurring amino acid
  misc_feature (58)..(58): Xaa can be any naturally occurring amino acid
  misc_feature (105)..(105): Xaa can be any naturally occurring amino acid
  misc_feature (119)..(119): Xaa can be any naturally occurring amino acid
  Homolog annotation: Hit_ID=AAL78227.1; Match level="QueryCoverage =99%, HitCoverage=76%, E-value=5e-89, Identity=82%"; Hit description =hypothetical protein Hgg-18 [Heterodera glycines]
  Coding regions on vcDNA: vcDNA=SeqID_87700; Strand=+; Position=1-582
SENGRGTKGRXQSPVPRPXLTEAADNVNKAVDDLSXLNRQKHXKNAAEATAEKTPEEXGKSIERSGRKRRKRTAEDGCQQNFGGKSEKRRGIGKRSENENGNTFXGQQKGQRRVDFDNXRQKDDFGREGEADGRADSQNVGQHEEGAESEQQCRRRRLRQVVLRRRRAGGGHGGQSMINQSDRRIRHCCVMKCSQ

SEQ ID NO: 161278 - protein, 238 aa, Heterodera glycines
  misc_feature (58)..(58): Xaa can be any naturally occurring amino acid
  misc_feature (195)..(195): Xaa can be any naturally occurring amino acid
  Homolog annotation: Hit_ID=AAH73457.1; Match level="QueryCoverage =96%, HitCoverage=41%, E-value=7e-35, Identity=36%"; Hit description =LOC398050 protein [Xenopus laevis]
  Gene Ontology: Mol. function=RNA binding; Cellular component =polysome; Biological process=apoptosis
  Coding regions on vcDNA: vcDNA=SeqID_87701; Strand=+; Position=3-717
VKSFFAGALKKVQILKDTFLLHSRQKMLLLNRHEETMKMLAAQEPPDEFFEEFEVQTXMMGLAIGSQGANISSVRKLEGVKEILVDDSQRAQGFCKIKIYAINPEIAEQARNMLEFLQKHVKVPHDKVGQMIGKQGKSIQDIVDKSGVVRVQIGEENPEHGLVDFTFTGTRESIGNAELMVEFLLKHIKEMDEIXEEEEECKRKLFNSRHSPFTYPNSGWQSHQQLNASQRASINGGG

SEQ ID NO: 161279 - protein, 96 aa, Heterodera glycines
  Coding regions on vcDNA: vcDNA=SeqID_87702; Strand=-; Position=85-375
KWLNWLLLIQLSRVSWVFISTDFSHGSLLVGCPSRAFGVVRWWLRSAQMRAATPLLGRTSVGLRWPISWWFRQSGVMTQFERQLKRCSAQWGSPSQ

SEQ ID NO: 161280 - protein, 231 aa, Heterodera glycines
  Coding regions on vcDNA: vcDNA=SeqID_87703; Strand=+; Position=3-695
LSRPLLFIAALLFLFGCCRADGNVVHLSSLNCATKDGGIDGFKAVDDGLILDSSSVTADSSDLPLIGFQKNGKEDLIFKLFVRDGGCVSKANFFTNGQPCTLGESEDVTESDKCPGEGGTSSCTSHEVTCTGIGMAKVAEESNGHAFKANLDNLTKLTNPCAQWKAHFGGVHQVLNGSSSGEKCASARFPVWIIAEIVIIALFVIGGAVTAEVVIRQRQAAAQPTLETPAP

SEQ ID NO: 161281 - protein, 200 aa, Heterodera glycines
  Homolog annotation: Hit_ID=AAL78226.1; Match level="QueryCoverage =54%, HitCoverage=90%, E-value=6e-49, Identity=95%"; Hit description =hypothetical protein Hgg-17 [Heterodera glycines]
  Coding regions on vcDNA: vcDNA=SeqID_87704; Strand=+; Position=137-736
MNFLNEQIREYSERTKDREEFKGIIEARNKLETAIKPLHGVMESDMASSSLETSMTNSANIARQALEELPVKQVRQMEQIAEEGKSKTVEEQERALREYAEKNSESVKKAVDQVSVAKDRADIALETYLRSHADTFSQEARKANDQMLFVMKDKKLNSEDKVRLEEWANTLPENVRGELRVRDLRELKQLVHLYNGLTPL

SEQ ID NO: 161282 - protein, 96 aa, Heterodera glycines; identical to SEQ ID NO: 160378
  Coding regions on vcDNA: vcDNA=SeqID_87705; Strand=+; Position=39-326

SEQ ID NO: 161283 - protein, 94 aa, Heterodera glycines
  Homolog annotation: Hit_ID=CAE63747.1; Match level="QueryCoverage =97%, HitCoverage=14%, E-value=2e-31, Identity=61%"; Hit description =Hypothetical protein CBG08279 [Caenorhabditis briggsae]
  Gene Ontology: Mol. function=phosphoenolpyruvate carboxykinase activity; Cellular component=mitochondrion; Biological process =glucose metabolism
  Coding regions on vcDNA: vcDNA=SeqID_87706; Strand=+; Position=3-287
DCENIRVIDWIVRRLDNTANIGIESAIGTIPTRESMHLEGLGNIDWDQLMSLPADYWHEDAKEVRKFLEEQVGTDLPEQILSELEQQEKRIMAL

SEQ ID NO: 161284 - protein, 252 aa, Heterodera glycines
  Coding regions on vcDNA: vcDNA=SeqID_87707; Strand=+; Position=2-760
QNPLPTKYSDYDAFISFTSIKMSSLFSAFLPFFRLFLIFLFITENVRILDCVLLNILPMFRDSIDVLFLNTIAFRRLRQLAPSLLSDCPSLRSVSFNDAILPAFPPDDSANASDGQAVAKWLFTPRPDGLPKELQCSANAPVGQWSSTMEQIKAAFSNASSPVPFCIHFWSSSPPDSVVLFDRINEVTGEELALQQDNAHDCCLFRLPIGWGTRKWDNVWEEMIARQNPIDIRIKDGGFDGRSSGRPFSRAN

SEQ ID NO: 161285 - protein, 248 aa, Heterodera glycines
  Homolog annotation: Hit_ID=NP_056155.1; Match level="QueryCoverage =75%, HitCoverage=20%, E-value=1e-43, Identity=46%"; Hit description =leucyl-tRNA synthetase 2, mitochondrial precursor [Homo sapiens] gb|AAH25989.1| Leucyl-tRNA synthetase 2,
  Gene Ontology: Mol. function=leucine-tRNA ligase activity; Cellular component=mitochondrion; Biological process=RNA splicing
  Coding regions on vcDNA: vcDNA=SeqID_87708; Strand=+; Position=50-793
MLADEDGAGDSSSAVAPVAEQQLPVLIGMRGQRMETDSFPSGWGRVETDTLDTFFDSSWYYLRYLDPHNSNAPFDPDIVSKHMPVDIYIGGMEHAKVHLFYARFIYHFLHELGMVPSREPFAHFIQLGVVRAPTYKLPDGRYVPDSEVDGNKKLPNSRLVHKGSGQAVQKEFEKMSKSKHNGVDPMGVIDSYGLDETRMQLLIEARPNYQIDWPYPYPTFQLKTINRWVACANSGGQLCDRTPTGIVN

SEQ ID NO: 161286 - protein, 240 aa, Heterodera glycines
  misc_feature (219)..(219): Xaa can be any naturally occurring amino acid
  Coding regions on vcDNA: vcDNA=SeqID_87709; Strand=+; Position=77-796
MITPDFGCSGWTFSQNLDRKQQIFQWKSRRIANWSVKIIPTVIAHDSSACVTFNPAKLPGALGLRPMMVGGFPIDIKIAPWTVLFKGFKFKGIRKGKSVELYGTCASTFISPEFVLLAAHCFDNVTEGNPFYLVHNSNASNLSSSKKSKKVITSHRHDQKNVFLHPKYDPVSDQSESQFHDMALIKLSRPMARVQPICFHCAKVDRFRNGTAYVMGWGXETNDCVGLTRPAKMLNGRPVK

SEQ ID NO: 161287 - protein, 148 aa, Heterodera glycines
  Coding regions on vcDNA: vcDNA=SeqID_87710; Strand=+; Position=208-651
TIMIISNSYNYYDAFLPPNVDNQIAFFNEHGMSINPLLQQQLSVENESSGTCLAKSSNMMGHQQQRLATHANSLTLAKLATNANQMMGSQHGLTTHAENKSGQSNRRKATACAYNSAAQKVEMKRQSARKPKKSRKPPPFVVPVDKTN

SEQ ID NO: 161288 - protein, 41 aa, Heterodera glycines
  Coding regions on vcDNA: vcDNA=SeqID_87711; Strand=-; Position=1-123
AGGKRGFPCRNHRRKDVRTFVEPSNVILFKTRVNANGRANH

SEQ ID NO: 161289 - protein, 260 aa, Heterodera glycines
  Homolog annotation: Hit_ID=NP_497289.1; Match level="QueryCoverage =91%, HitCoverage=23%, E-value=8e-31, Identity=32%"; Hit description =RhoGAP domain containing protein (113.1 kD) (3B520) [Caenorhabditis elegans] gb|AAC71136.1| Hypothetical
  Coding regions on vcDNA: vcDNA=SeqID_87712; Strand=+; Position=1-793
PLRNFPFLPAEKKSTAYRERIESLPKVHQSTLKKLLGHLQEIVSHEDRNLASLENISKVFGPTLFNVSNAEEEISLELYNTATKQAIVTRDLIFYYCDIFGVDAEQLLAKCRMDVVREQKTSKNPANGLLIPVHLFERDNKCFNVQSEWTASQVVQFKVQKLAFVSPCENYALFEMIKKGQLERRIGANESLRSIVLGRWMTDGQKDNFLLLKKDPHPFQPQSGRAFAEDLKLAEPGSRTFKTASLRIEDGVHVCHHSRM

SEQ ID NO: 161290 - protein, 192 aa, Heterodera glycines
  misc_feature (158)..(158): Xaa can be any naturally occurring amino acid
  misc_feature (163)..(163): Xaa can be any naturally occurring amino acid
  misc_feature (172)..(172): Xaa can be any naturally occurring amino acid
  Homolog annotation: Hit_ID=AAL78214.1; Match level="QueryCoverage =94%, HitCoverage=93%, E-value=8e-94, Identity=87%"; Hit description =putative esophageal gland cell protein Hgg-20 [Heterodera glycines]
  Coding regions on vcDNA: vcDNA=SeqID_87713; Strand=+; Position=133-705
MGQINLCDDVWLDTLAWINRGEVGMKFALVNARFNTLVDRHFEQRKWCFGEFHICERMTEESGAEIMTSIDGTDFSTLPLPTTPLPDSVVGFQSISIWYINEEVINFLCTIRRLLAEDIALEFSTYFTEYRSWKVMARHIWPLLRDGISTLFLKKCDXGHAPXNTCRPPCCXDCAGLHRIHTQMLPECPSAD

SEQ ID NO: 161291 - protein, 232 aa, Heterodera glycines
  Homolog annotation: Hit_ID=NP_492588.1; Match level="QueryCoverage =95%, HitCoverage=37%, E-value=4e-36, Identity=45%"; Hit description =protein phosphatase 1 regulatory, GEI-4(Four) Interacting protein GFI-2 (53.7 kD) (gfi-2) [Caenorhabditis
  Coding regions on vcDNA: vcDNA=SeqID_87714; Strand=+; Position=1-699
GGPNGGPANALVLRTIAQTEARRKRIGHFGVRDSRRQSRKRKKFESPQAVPPAANTDFIQTARGAIRRQSLRDRSGMTLARLDSQREGSDLIRSWSKEDVSNEEMSAHHFGNGGPSTSHQPTANQQRRDSPPKRMPKQSQQKQKQMSPDEWLKKLEAESGGLRDEEEEQAEKDVLKGSAGESMRKGAKAQKGNGVIRRDQQQQQQHDMNGMNLKGSLGGQNRRRKKSCCCII

SEQ ID NO: 161292 - protein, 32 aa, Heterodera glycines
  Coding regions on vcDNA: vcDNA=SeqID_87715; Strand=-; Position=29-127
ATPPGGFGRKHVFIKLFPLSIDLCVTEKKVAS

SEQ ID NO: 161293 - protein, 104 aa, Heterodera glycines
  Coding regions on vcDNA: vcDNA=SeqID_87716; Strand=+; Position=171-485
RRMELFMLCSRLFRQFYEIDHKISAEDRKKFFEKYCEVTTWMEHNAGAPSVEVTQKKEAFEHLYQSIIDGAVGQRLCRDNGLCGKDVIRQRSCYNRLCAWKFEE

SEQ ID NO: 161294 - protein, 44 aa, Heterodera glycines
  Coding regions on vcDNA: vcDNA=SeqID_87717; Strand=+; Position=3-134
RASESVDENRSVIVLHPSVPPRTELNSHSREKGCLQPTSAPAWA

SEQ ID NO: 161295 - protein, 179 aa, Heterodera glycines
  Homolog annotation: Hit_ID=NP_499756.1; Match level="QueryCoverage =63%, HitCoverage=55%, E-value=4e-16, Identity=36%"; Hit description =polyposis locus protein 1 family member (3O468) [Caenorhabditis elegans]
  Coding regions on vcDNA: vcDNA=SeqID_87718; Strand=+; Position=10-549
MSSDESTTSSASVVSVQLREVPITDFKDVLPVLHKTLNELEHPFIKKAEEICGMEREKLFYITSSLVLLVLMLCPGNMLLSTVITVAYPMYASLLTLNTQNTSEYTQWLVYWCVCAEFCQFDYLFGSINGLLLLYVPLKTGFLLYLALPQTYGAHNLYVKHIRKVLAVTNVLDKMKKMF

SEQ ID NO: 161296 - protein, 141 aa, Heterodera glycines
  Homolog annotation: Hit_ID=AAR35032.1; Match level="QueryCoverage =53%, HitCoverage=39%, E-value=3e-13, Identity=51%"; Hit description =SXP/RAL-2 protein [Meloidogyne incognita]
  Coding regions on vcDNA: vcDNA=SeqID_87719; Strand=+; Position=225-650
LGLKCWSCERCNYFHLSRTCGYQQFHDVVSGHLTGQALELFNNLWSIRHNDQDTRLDECQESRAALNATGRDHVLDLLVPIPPPSIVGPPPSGCFPRPPYSKPFGGGFGPKSGGATIPGRGGPQTPERRNNIGTEEGEEKK

SEQ ID NO: 161297 - protein, 289 aa, Heterodera glycines
  Coding regions on vcDNA: vcDNA=SeqID_87720; Strand=+; Position=1-867
RSDDLAHRQRRSTIDDHSTRWSKSARRLLPIHERGSPCDAPESVQKAQSSDNKSDQSENNSNDKQQHVDEQLEKLPRMDEQQKDDEIVLVGSANVCVVLPEEAGNEHNCQKTAEQPNDALENDIDKKVTDFQTMVETTEEDNRSGTATFESFGNSAEPTPMETTIYHSAKESSEIGTDNGLLSKMAESPPKVPPLTPPSILRKVNSPGGNGVKKIRRVQFKEDELGPGRIRFGRSFSASPYPKQLLEHLDQSTSEGAASPSAGHESPAKRPMKAFRQNLPIASAGRPST

SEQ ID NO: 161298 - protein, 104 aa, Heterodera glycines
  Coding regions on vcDNA: vcDNA=SeqID_87721; Strand=-; Position=302-616
LPVRSDKYSAITRSRALCLDSSTNVPMLMFGESHITFSDSFLYRFITFSRRLFCYLLHFSLQMPTLQHPKQMVIPKQAAPNCRQCPIALGRELQRIGYPLSGGR

SEQ ID NO: 161299 - protein, 86 aa, Heterodera glycines
  misc_feature (61)..(61): Xaa can be any naturally occurring amino acid
  Homolog annotation: Hit_ID=XP_223980.2; Match level="QueryCoverage =97%, HitCoverage=6%, E-value=4e-14, Identity=43%"; Hit description =similar to RPGR-interacting protein [Rattus norvegicus]
  Gene Ontology: Biological process=N-linked glycosylation
  Coding regions on vcDNA: vcDNA=SeqID_87722; Strand=+; Position=2-259
AAEKEEKKSESKEAEKKENEEQKPAGKKEKRAAEKEEKKSESKEAEKKENEEQKPAGKNEXLAAEKEEKKSESKEAGKKKKKKKKK

SEQ ID NO: 161300 - protein, 253 aa, Heterodera glycines
  Coding regions on vcDNA: vcDNA=SeqID_87723; Strand=+; Position=1-762
MLQTHKRAPPALAHIMAHHSPHLPVGSELSPAKSLDSHHQRQMPLFAEKKYGQNHQSPHMSPIKLSNGNVSPPQSPSHRLQQIIKRHSQTKDLSREKVQRQQQSPLLQHPSIRALIGLPNSPADDQNPPPPFTPEQHALLMDTVLRPPSGLPFESPRSAPSPLELSEEQRDKLIDAIQGRPQPGLPFEDEAEHEGLHPAHRVNSAHLEHVLDAIFRKPPGLPFEDDEEEEHSSTNMHHSIAGYETKLFKKDEC

SEQ ID NO: 161301 - protein, 138 aa, Heterodera glycines
  Homolog annotation: Hit_ID=AAO33474.1; Match level="QueryCoverage =100%, HitCoverage=100%, E-value=9e-73, Identity=99%"; Hit description=gland-specific protein g4g12 [Heterodera glycines]
  Coding regions on vcDNA: vcDNA=SeqID_87724; Strand=+; Position=37-453
MPNIFKILLIVLLAVVSFRLSASTGDKKTANDGSGNNSSAGIGTRIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 161302 - protein, 78 aa, Heterodera glycines
  Coding regions on vcDNA: vcDNA=SeqID_87725; Strand=-; Position=289-525
LLHRIDQCRVHAGRKAFVQTTASCMESHVIQLGNCLLQNSLTMFGSPQYDERIAYSFPNIVPCNNSKSSSSRTLCIHS

SEQ ID NO: 161303 - protein, 168 aa, Heterodera glycines
  misc_feature (30)..(31): Xaa can be any naturally occurring amino acid
  misc_feature (37)..(37): Xaa can be any naturally occurring amino acid
  misc_feature (92)..(93): Xaa can be any naturally occurring amino acid
  misc_feature (114)..(114): Xaa can be any naturally occurring amino acid
  misc_feature (121)..(121): Xaa can be any naturally occurring amino acid
  misc_feature (126)..(128): Xaa can be any naturally occurring amino acid
  misc_feature (133)..(133): Xaa can be any naturally occurring amino acid
  misc_feature (140)..(140): Xaa can be any naturally occurring amino acid
  misc_feature (146)..(147): Xaa can be any naturally occurring amino acid
  misc_feature (152)..(152): Xaa can be any naturally occurring amino acid
  misc_feature (154)..(156): Xaa can be any naturally occurring amino acid
  misc_feature (160)..(162): Xaa can be any naturally occurring amino acid
  misc_feature (168)..(168): Xaa can be any naturally occurring amino acid
  Coding regions on vcDNA: vcDNA=SeqID_87726; Strand=-; Position=1-504
SLFSFFFFFFCFWVGGAPPSPLFLLFIKKXXGGGGGXPPPPPNTRRGVFFSPPRVFFIFGGAPLFLFFFFFFFGPPFWGPPPPLFFFYLIFXXPLFPPPPLFLCFSPPKGEARXPPLPTPXKFFLXXXFRPFXLSHFFSXGRVLFXXCLFFXFXXXPFWXXXPQPPQX

SEQ ID NO: 161304 - protein, 235 aa, Heterodera glycines
  Homolog annotation: Hit_ID=CAE67139.1; Match level="QueryCoverage =99%, HitCoverage=30%, E-value=2e-60, Identity=51%"; Hit description =Hypothetical protein CBG12562 [Caenorhabditis briggsae]
  Gene Ontology: Mol. function=enoyl-CoA hydratase activity; Cellular component=mitochondrion; Biological process=growth
  Coding regions on vcDNA: vcDNA=SeqID_87727; Strand=+; Position=2-706
WKMGLVDHLLALGPGLSDPISGTHRYLEEVAISACEQLAAGTLKINRERPLMERIQNALLTRKPLLDAVVMRMARDKVMKQTHGNYPAPLRILDVVRTGLVDGQQEGYEEETKEFGYLTQTTQSEALIGLFKGQTECKKNKHGEARKTERLGVIGAGLMGAGIANVSIDKGIHTTLVDTKQEALDRGLKQITAQMEGQLKRRKINAAEHAICLSKLKPVVDDYEQLRDSDVVIEA

SEQ ID NO: 161305 - protein, 110 aa, Heterodera glycines
  Homolog annotation: Hit_ID=NP_989598.1; Match level="QueryCoverage =100%, HitCoverage=70%, E-value=1e-20, Identity=44%"; Hit description= lipopolysaccharide-induced TNF factor [Gallus gallus] gb|AAU95774.1| TNF-alpha factor [Gallus gallus] db
  Gene Ontology: Mol. function=protein binding
  Coding regions on vcDNA: vcDNA=SeqID_87728; Strand=+; Position=37-369
MNNPQHAPPQPSPGAAPAGNTTTTYVYMADGGQPHWGPRPQNVFCSNCRQQVLTKVKYSAGLLTWLLFGGCLLFGCWLGCCLLPFCMDDCQDCEHYCTNCKAYMGQYKRL

SEQ ID NO: 161306 - protein, 85 aa, Heterodera glycines
  Coding regions on vcDNA: vcDNA=SeqID_87729; Strand=+; Position=2-259
LDDMCNDADTPVLLNDDIFRLSKYCSTEATLQISRATHVSLQNTHPTNALLMNENHSMALVNSIKHRMEMHTLGPSQHLYSCEAP

SEQ ID NO: 161307 - protein, 124 aa, Heterodera glycines
  Homolog annotation: Hit_ID=NP_036369.2; Match level="QueryCoverage =85%, HitCoverage=27%, E-value=6e-27, Identity=51%"; Hit description =sirtuin 2 isoform 1 [Homo sapiens] gb|AAD40850.2| sirtuin type 2 [Homo sapiens] sp|Q8IXJ6|SIR2_HUMAN NAD-
  Gene Ontology: Mol. function=DNA binding; Cellular component=nucleus; Biological process=gene silencing
  Coding regions on vcDNA: vcDNA=SeqID_87730; Strand=+; Position=268-639
PASRASSTVWSQNHFADDVATRPQQKLPSLDLEGVAAFIREERPEIVFMVGAGVSTSAGIPDFRTPGTGLYDNLKQYDIPNPQAIFDINYFRRNPEPFFVLANALFHESIMPTSAHHFIRLVAD

SEQ ID NO: 161308 - protein, 30 aa, Heterodera glycines
  Coding regions on vcDNA: vcDNA=SeqID_87731; Strand=-; Position=1-90
LSVERWPFHTEPPDHYDLLSHLLDLSVSQL

SEQ ID NO: 161309 - protein, 33 aa, Heterodera glycines
  Coding regions on vcDNA: vcDNA=SeqID_87732; Strand=-; Position=2-100
FYTPTCFQRFVHYHLGNQSPQEVMVTPIMYHSN

SEQ ID NO: 161310 - protein, 104 aa, Heterodera glycines
  Coding regions on vcDNA: vcDNA=SeqID_87733; Strand=+; Position=2-316
LFAVFVLLMFAVSLAVVNSDLAINGQKYNRRKQQMEKQMDNNNNNNRKRRKKKLIRVQERHFFSRSFQSWMLNNWTNHGQAFSKTEQMEKDGEMRKGLFFDLNL

SEQ ID NO: 161311 - protein, 100 aa, Heterodera glycines
  Homolog annotation: Hit_ID=NP_611665.1; Match level="QueryCoverage =91%, HitCoverage=11%, E-value=9e-14, Identity=46%"; Hit description =CG10955-PA [Drosophila melanogaster] gb|AAF46837.1| CG10955-PA [Drosophila melanogaster]
  Coding regions on vcDNA: vcDNA=SeqID_87734; Strand=+; Position=8-310
MKTNKRQKVSSSEEEFDPNQKDEDYDLLMDDEEREKFDKMTEKEREIEIYKRLEQREIMKTREKIKKKLEMAAGKKADGEVAARQKKAKAKNVRRIKRRR

SEQ ID NO: 161312 - protein, 227 aa, Heterodera glycines
  misc_feature (20)..(20): Xaa can be any naturally occurring amino acid
  Homolog annotation: Hit_ID=AAP30770.1; Match level="QueryCoverage =91%, HitCoverage=89%, E-value=1e-16, Identity=30%"; Hit description =putative gland protein G17G01 [Heterodera glycines]
  Coding regions on vcDNA: vcDNA=SeqID_87735; Strand=+; Position=3-682
TVLLPSLHYEEILLFKLFQXVLAFVIVWQILSIEKLCGKFAEPKCFYPTEACDNFTIFKQNAETTELNADNETKWIQLNDLPTGEGCLPINISIVSTLRNGYNCGVSNQLKDTADALARVLYLCLLFLFALVFHTLAQQPSEEYDLFGYLCAAYSVLVLGFSTVTTILESVNWTTLWECTNFRPYQSFLLFLLLPSVILFCSVIYETFSNCSLLKESDAENAQKQTV

SEQ ID NO: 161313 - protein, 39 aa, Heterodera glycines
  Coding regions on vcDNA: vcDNA=SeqID_87736; Strand=+; Position=33-149
EARHFLQLKEGESDRKRRNLLITPLNWQMPSLRFPPPPL

SEQ ID NO: 161314 - protein, 184 aa, Heterodera glycines
  Coding regions on vcDNA: vcDNA=SeqID_87737; Strand=+; Position=113-667
MASSLTIEKRCKLFNTKQMECQFDGTEAGKCAFCVKLPCKFGAVNCAEEVSTSCVNPQELEKCCKARDNECCVCVLCEKNKVMKVLVECCGKRTETSAEAGKALCICVPKIGGGKCGGQVQVKQCDAKLVDECCAANTESGDCCCVCLSCNDQKCVVTVRCPAGEAKSTGPTCTASKCESVKCC

SEQ ID NO: 161315 - protein, 236 aa, Heterodera glycines
  Homolog annotation: Hit_ID=AAH68705.1; Match level="QueryCoverage =97%, HitCoverage=55%, E-value=7e-84, Identity=65%"; Hit description =LOC414700 protein [Xenopus laevis]
  Gene Ontology: Mol. function=pre-mRNA splicing factor activity; Cellular component=small nucleolar ribonucleoprotein complex; Biological process=embryogenesis and morphogenesis
  Coding regions on vcDNA: vcDNA=SeqID_87738; Strand=+; Position=1-708
LPSGSAAFLRSLEHHCDWVNDIVLCSDGTRLISASSDTTVKVWHTRRNGACLSTLKTHKDCVRCLAYARWPTELVASAGLDKCIYLWDVNTLTKVTATNNTVTTSSLRGTKNSIYSLAMNECGTVIIAGSTENLLRVWDPRTCQKVAKLRGHNENIRAISVNRDGTLCLSGSSDGTVKLWSIGQQRCIGTIRCHSDSVWALQTDSVFATVFSGGRDHRVFRTPLRNLNDSELLFTE

SEQ ID NO: 161316 - protein, 157 aa, Heterodera glycines
  misc_feature (86)..(86): Xaa can be any naturally occurring amino acid
  Homolog annotation: Hit_ID=AAG34526.1; Match level="QueryCoverage =100%, HitCoverage=79%, E-value=1e-71, Identity=89%"; Hit description= beta-galactosidase [Cloning vector pUG26]
  Coding regions on vcDNA: vcDNA=SeqID_87739; Strand=+; Position=3-475
PFAAIESIPAAAWRPGACDVGPNSPYSESYYNSLAVVLQRRDWENPGVTQLNRLAAHPPFASWRNSEEARTDRPSQQLRSLNGEWXAPCSGALSAAGVVVTRSVTATLASALAPAPFAFFPSFLATFAGFPRQALNRGLPLGFRFSALRHLDPKKLD

SEQ ID NO: 161317 - protein, 60 aa, Heterodera glycines
  Coding regions on vcDNA: vcDNA=SeqID_87740; Strand=-; Position=2-181
QVSNEPVQIAKESTILFTRAQLSENVQKSDVFLRSTTVCAKQRNGAVESLGKMKRCVRET

SEQ ID NO: 161318 - protein, 67 aa, Heterodera glycines
  Coding regions on vcDNA: vcDNA=SeqID_87741; Strand=-; Position=118-321
PVFLRIHDKTESISSAVNPVYVLRMSISSDGKAVPQFSMHSSRIRSFNRGVVTLSYGRTVYICVVRA

SEQ ID NO: 161319 - protein, 57 aa, Heterodera glycines
  Coding regions on vcDNA: vcDNA=SeqID_87742; Strand=-; Position=63-236
ELIETSSLNHLKQERRCSSVTDFLLVYVACPLLVRIWLLWPRALAHQDCAGSKRKEQ

SEQ ID NO: 161320 - protein, 271 aa, Heterodera glycines
  misc_feature (13)..(13): Xaa can be any naturally occurring amino acid
  Homolog annotation: Hit_ID=NP_502553.2; Match level="QueryCoverage =76%, HitCoverage=27%, E-value=1e-38, Identity=40%"; Hit description =beta-lactamase-like (79.3 kD) (4O40) [Caenorhabditis elegans] emb|CAC44310.2| Hypothetical protein Y67H2A
  Gene Ontology: Biological process=growth
  Coding regions on vcDNA: vcDNA=SeqID_87743; Strand=+; Position=15-826
GVNPRNTESVQYXFRGQKTAKVVGQLAINVPEDGSIVSGILVRRNFNYHLLHPNELSAYTDLANSRLSQRESVFYDGSFPLLLHNLRLLSSDAIVSNSDEASTSDKQQKESKNGGTPTYVVKMFRDEITINFYSVQHIVIVEWMSNPVNDLFADATLSAILHAQTNPILDKNVPKDFGAKAQQIEQNLESILVGTLCELCGDKSFVEVKEEENQGEKDAAAEESDKKEGKRRRVIQLELDGKEACICPVSLQITECEDQLLHHLFVFAHSK

SEQ ID NO: 161321 - protein, 224 aa, Heterodera glycines
  Homolog annotation: Hit_ID=AAK96839.1; Match level="QueryCoverage =97%, HitCoverage=65%, E-value=1e-11, Identity=30%"; Hit description =periaxin-like protein [Arabidopsis thaliana]
  Coding regions on vcDNA: vcDNA=SeqID_87744; Strand=+; Position=58-729
MQGHADEMPKIPPMNAVLPNAEEILKSAEEMPEIEETPKKSVEEILFNLSEMPKGCLQKMQSLPKDMPGNTDEEPIVPPMNAVPPSAEEIPESVEEVPKKSAEEMLSNLDEMPNGSLQKMQSLPKYMPGNTDEVPKDLLQKMRSLPLNMQRHADEMPKIPPMNAALPNAEETLKSTEEMPESVEKTPKKSVEEILSNLSEMPKGSLQKMQSLPKDMPGNTDEVP

SEQ ID NO: 161322 - protein, 185 aa, Heterodera glycines
  misc_feature (32)..(32): Xaa can be any naturally occurring amino acid
  misc_feature (72)..(72): Xaa can be any naturally occurring amino acid
  misc_feature (127)..(127): Xaa can be any naturally occurring amino acid
  Homolog annotation: Hit_ID=NP_740995.1; Match level="QueryCoverage =97%, HitCoverage=33%, E-value=5e-61, Identity=67%"; Hit description =DeHydrogenase, Short chain (dhs-6C) [Caenorhabditis elegans] gb|AAK68188.1| Hypothetical protein C17G10.9
  Coding regions on vcDNA: vcDNA=SeqID_87745; Strand=+; Position=14-571
MSTLFHLLTICLSLQSQRIDESIQSQLQDKYXGKELLRMANGDIDEFRNAFHAGCPKFLSPTTVVYDREQSXKEPLLRQCNAFLEGIESQITLPILRGYLKLYTTLPVQKLASFMDIPDSEIGLFHXKLLTYKMIVTELGKETIDQTEGADETTELDFYVDKDMILIADTKVARRVSEYFIRQIG

SEQ ID NO: 161323 - protein, 85 aa, Heterodera glycines
  Homolog annotation: Hit_ID=ZP_00215664.1; Match level="QueryCoverage =100%, HitCoverage=7%, E-value=4e-43, Identity=97%"; Hit description =COG0841: Cation/multidrug efflux pump [Burkholderia cepacia R18194]
  Coding regions on vcDNA: vcDNA=SeqID_87746; Strand=-; Position=1-258
FFGWFNRTFNNSRDKYHVGVHHVIKRSGRWLIIYLVVIVAVGLLFVRLPKSFLPDEDQGLMFVIVQTPSGSTQETTAKTLANISD

SEQ ID NO: 161324 - protein, 203 aa, Heterodera glycines
  Homolog annotation: Hit_ID=AAL78214.1; Match level="QueryCoverage =88%, HitCoverage=93%, E-value=2e-57, Identity=59%"; Hit description =putative esophageal gland cell protein Hgg-20 [Heterodera glycines]
  Coding regions on vcDNA: vcDNA=SeqID_87747; Strand=+; Position=114-722
TLDISHNHHHHHQQQQKQRTTKRMDQNRLSDFAWMETLAWLGRAEVGMKMALVNTRFNMLVDKQFMLRQWRFGEFHICGREGAQRGGAEIMTSEDGTNFITLPLPTTPMPSSVVGFQSLSIWFINADVIKFLRRIRRLFAEDIALEFSTRHTEFRSWQVIARHVWPLLRDGISMVCLRKCDLAMLRKHVSPTVLFDCPDLHRI

SEQ ID NO: 161325 - protein, 217 aa, Heterodera glycines
  Homolog annotation: Hit_ID=CAE66017.1; Match level="QueryCoverage =97%, HitCoverage=19%, E-value=1e-52, Identity=51%"; Hit description =Hypothetical protein CBG11210 [Caenorhabditis briggsae]
  Gene Ontology: Mol. function=transcription co-activator activity; Cellular component=nucleus; Biological process=transcription from Pol II promoter
  Coding regions on vcDNA: vcDNA=SeqID_87748; Strand=+; Position=32-682
MSVGGKDKSRPVSSTAVAGTPWCVVWTGDNRVFFYNPSTRTSVWERPPELYNRPDVDLLVSKPPPSKEQKGAGKSKKRQKFESDNEEEEEGAVEEGESDTSETEQSPELQPTKKKSRKEKKAEKEREKLKLEQQQQQQLQQKQPKQPLPIQVEKPIDPAIQAELDAQKEREKVPLEERIKQFRQLLEDKKVSATSSWEKELSKIVFDQRYLLLSTVE

SEQ ID NO: 161326 - protein, 87 aa, Heterodera glycines
  Coding regions on vcDNA: vcDNA=SeqID_87749; Strand=+; Position=1-264
LLLLSVGLCFAQFDQSPSAALNHVRAKRGYKPWKKQSFSSSSSEMYRRRRPSGNGHYRDYNGYGSFGYYRRKPGILERALGKITRSY

SEQ ID NO: 161327 - protein, 255 aa, Heterodera glycines
  Coding regions on vcDNA: vcDNA=SeqID_87750; Strand=+; Position=2-766
LFAVYVLISVIFTCHLCKRRNPITFESIDHLEAHFAQQHFQCLPYVCEQCPQFASGLYPTEGAIIEHMKLVHGSESEFEFKIIIREDTEEKRAKVRAALEHCVRNSGDVATSSSAATTTSNNDSTAIELPQTQQQVQTTHQPRVVQVVPAPTVVVRTEVVQQTAEKHSGANNTSNGAALAEGGGSGTTTTNTSRTNRTSSGGNKRNASEAVGAGKGPPVWKIPKKSTSKKGSDGAGKPSRESHNNRESHTTNSRI

SEQ ID NO: 161328 - protein, 130 aa, Heterodera glycines
  Homolog annotation: Hit_ID=XP_226262.2; Match level="QueryCoverage =92%, HitCoverage=21%, E-value=3e-09, Identity=35%"; Hit description =similar to mKIAA1612 protein [Rattus norvegicus]
  Coding regions on vcDNA: vcDNA=SeqID_87751; Strand=+; Position=1-390
QLVAFCVEVLVNEKRLSLNGWFHYAPGTANVAQTGPNCAVEEPICRVEPSMNITLAEVNEWLSPNYIRPGQHRQIKRIFAYKSELSLQQFLNNERYNKALDELEKAQFESVGPPHKRNVWRLVESSLGQN

SEQ ID NO: 161329 - protein, 127 aa, Heterodera glycines
  misc_feature (5)..(5): Xaa can be any naturally occurring amino acid
  misc_feature (9)..(9): Xaa can be any naturally occurring amino acid
  misc_feature (33)..(33): Xaa can be any naturally occurring amino acid
  Coding regions on vcDNA: vcDNA=SeqID_87752; Strand=+; Position=2-386
PPPPXPPFXTPVGGKQTHFLGPRKNTPKEPTQXPPQKKTPPGKGPLREPLPPSSPKLSIRSFDANTNIQLGIIMAIPPTNRDRPLFSVVSNACPTVRSAQLTNFSGAALKKPRPPLSRAESTVHILI

SEQ ID NO: 161330 - protein, 70 aa, Heterodera glycines
  Coding regions on vcDNA: vcDNA=SeqID_87753; Strand=-; Position=2-211
STHLIYPLALSMTLKTAGLRPWLSRSHPGWAKLVQVSFVRLSPYRFLCISRPFFQSSQFPSVQSRHCSFN

SEQ ID NO: 161331 - protein, 44 aa, Heterodera glycines
  Coding regions on vcDNA: vcDNA=SeqID_87754; Strand=+; Position=1-132
TADASPAHASAESTANAMLTNSDTLPIRPIVHSLAFHFPFFHCP

SEQ ID NO: 161332 - protein, 185 aa, Heterodera glycines; identical to SEQ ID NO: 158767
  Homolog annotation: Hit_ID=AAO85454.1; Match level="QueryCoverage =100%, HitCoverage=100%, E-value=1e-103, Identity=100%"; Hit description=putative gland protein G16B09 [Heterodera glycines]
  Coding regions on vcDNA: vcDNA=SeqID_87755; Strand=+; Position=17-574

SEQ ID NO: 161333 - protein, 52 aa, Heterodera glycines; identical to SEQ ID NO: 160771
  Coding regions on vcDNA: vcDNA=SeqID_87756; Strand=-; Position=83-241

SEQ ID NO: 161334 - protein, 78 aa, Heterodera glycines
  Coding regions on vcDNA: vcDNA=SeqID_87757; Strand=-; Position=2-235
WETLHYDWSDCARPIRRISCSELMQVVSSAAVPGVTFAELFAPIDVEDQFRAVPVSGSERHGQRVLDQAVSACGLHAP

SEQ ID NO: 161335 - protein, 85 aa, Heterodera glycines
  misc_feature (1)..(1): Xaa can be any naturally occurring amino acid
  misc_feature (20)..(20): Xaa can be any naturally occurring amino acid
  Homolog annotation: Hit_ID=XP_227769.1; Match level="QueryCoverage =83%, HitCoverage=55%, E-value=5e-16, Identity=63%"; Hit description =similar to Ac1147 [Rattus norvegicus]
  Coding regions on vcDNA: vcDNA=SeqID_87758; Strand=+; Position=2-260
XVMPLHVRSCTRATLAKSAXCPSPKGVGKPVKICRDWDRTLQLLSVNEEFLVGASHQLALNTSLPFVHTARRCPGLSHFEKFGDG

SEQ ID NO: 161336 - protein, 27 aa, Heterodera glycines
  misc_feature (19)..(19): Xaa can be any naturally occurring amino acid
  Coding regions on vcDNA: vcDNA=SeqID_87759; Strand=-; Position=0-80
NTHLAHQCRFAVRSSIAEXLVAFPEAG

SEQ ID NO: 161337 - protein, 257 aa, Heterodera glycines
  misc_feature (34)..(34): Xaa can be any naturally occurring amino acid
  Homolog annotation: Hit_ID=NP_496067.1; Match level="QueryCoverage =78%, HitCoverage=35%, E-value=7e-13, Identity=29%"; Hit description =poly polymerase   family member (2J898) [Caenorhabditis elegans] emb|CAA87419.1| Hypothetical protein T15
  Gene Ontology: Biological process=reproduction
  Coding regions on vcDNA: vcDNA=SeqID_87760; Strand=+; Position=1-851
IFCESLGYLSEQFFCNAHKVFLLFPNSSMPFLVXKFFLIFSKWKWPMPVQLTPIDHKFFGTFLKQQNEIEKAMKSIRKELAMAVIMPTIGGRNLAEKVNISSAKVVKNELKRACDKLRSKMETKDEAIAFTEKYEHFIVIECKGSSHNVDKFCDFVGKRLRYELLEFVENPLAIWVDFCHVRPKMIGPTECPSADLEKNGNSIGLRHWLVGIQMAAEQKANSAFKRLRGHLREELDVKIKGDFEKGSHNVQLKSEFA

SEQ ID NO: 161338 - protein, 252 aa, Heterodera glycines
  Homolog annotation: Hit_ID=CAE56905.1; Match level="QueryCoverage =96%, HitCoverage=62%, E-value=3e-88, Identity=61%"; Hit description =Hypothetical protein CBG24746 [Caenorhabditis briggsae]
  Gene Ontology: Biological process=cysteine metabolism
  Coding regions on vcDNA: vcDNA=SeqID_87761; Strand=+; Position=2-757
GLPIGNPAGNTPEKWDMNQVVPPISLSTTYKQNWPGMPKGHDYIREGNPTRDVLQESIATLESARHCRIFSSGLAAIAAVSHLLNSGQHVIVSGDCNGGTKNYFDKICVPHHGLELSFVDLTRLENLENEFKPNTKMVLFETPSNPLLKIVDIEAVCRMVRARSKDCVVVVDNTFMTPYFQRPLELGADVTVQSLTKYINGHTDVLMGTVVTNKEQLDQHIYAQQIYAGAVPSAFDAFLVLRGIKTLPLRMR

SEQ ID NO: 161339 - protein, 255 aa, Heterodera glycines
  misc_feature (247)..(247): Xaa can be any naturally occurring amino acid
  Coding regions on vcDNA: vcDNA=SeqID_87762; Strand=+; Position=1-768
PKTKMAHKRKRQTGCAVFITNSDLVDQCSFPLDQLPLNTLVIIASQLPFKDFKRVGMISKQFNRAQRMTRFSRKHVSVDLLRKLFPDEVPDTDVDNSNNDGTERSVGMLEVMDPLRQHLRSSPPRNIREVDMSKFSTFRESHFVELFRSISNGRELFTEVRRLNVQKCVIELRDMEFLAQLMPKVWYIRCSAQTLVIPEDIDQSKLALSVEQMRQLHAKLDKFDYVARKCTKKHLWFISKLTELFAXARIIQLDK

SEQ ID NO: 161340 - protein, 183 aa, Heterodera glycines
  Coding regions on vcDNA: vcDNA=SeqID_87763; Strand=+; Position=54-605
MTSPIAYDQLREMTRNFLSKGVSAVETNAIFQGKFGTENSPTLCTIYKWRREHRGGMGEREANDQNLEENEKEKERAADDGGEKGAKPYKKDCDKYCVPCNRELSSRHYYELHMLKIHNIFVGDSKALYELLESFGPKREKKIIYRCDECFGGELDYELLEDLRRHRLLEHGKKMREKFDSPA

SEQ ID NO: 161341 - protein, 244 aa, Heterodera glycines
  misc_feature (229)..(230): Xaa can be any naturally occurring amino acid
  misc_feature (234)..(234): Xaa can be any naturally occurring amino acid
  Homolog annotation: Hit_ID=NP_495983.1; Match level="QueryCoverage =95%, HitCoverage=54%, E-value=1e-52, Identity=43%"; Hit description =WD40- FYVE-domain containing protein 2 (46.2 kD) (2J611) [Caenorhabditis elegans] emb|CAA87770.1| Hypothe
  Coding regions on vcDNA: vcDNA=SeqID_87764; Strand=+; Position=36-767
MTRSLGENARMELAQKIEGQLTGRIAGIHLLEREDGLLVVNEDRTLRVLLRRESGMFWPSIIHDLPHIPTKLSCSEQKNTIFVGFANGQIHEYSIENDFNSISFKRQWNSHTNSISGLGFSERLEQMVSCSKDKTVVWHCTSTTRKIASYCTGSPCTTLQFDGDASFVFVGDYSGNISVLRLVVGTQQQPQLISKLSAHTGAITDLCWDLSHQLLFSASTDSLVIVWDXXRQRXHCYELNVTMP

SEQ ID NO: 161342 - protein, 169 aa, Heterodera glycines
  Coding regions on vcDNA: vcDNA=SeqID_87765; Strand=-; Position=123-632
PSLFVRFISFPSIILILFPFKILILSLPSLTRLSSLTLTLSPLFFSTKNIIIALFLQNFTSSITISSKMSSFPFFWNGTKFGPFRPNPSPSLSLIHPFPFVYHWSVVCFCSVIVCQLSLLPPSVALFHKSLLFSPFLFLMLPIKFSLRYDNIILLYICVSFLLFGSNSS

SEQ ID NO: 161343 - protein, 216 aa, Heterodera glycines
  Homolog annotation: Hit_ID=NP_505498.1; Match level="QueryCoverage =81%, HitCoverage=43%, E-value=4e-38, Identity=45%"; Hit description =putative mitochondrial protein (42.9 kD) (5K173) [Caenorhabditis elegans] emb|CAA94803.2| Hypothetical pr
  Coding regions on vcDNA: vcDNA=SeqID_87766; Strand=+; Position=83-730
MDLFNGAKKDDSVTLEDAIPHLKEIFHEPKLHFCTGLKRWVSGPVVLPCSEKAFKNIGHSLFQGESISHSNEHWTAQHMHRALAICISRPPRDEGAVDGYATFQDTSRANEYIFVPSVKIRRRARYGKFAVQGELFYRVLDSQCGLSLLDIHFSKFSRHFPRLILSHLGCPIFGDWIYEQRLLNVDGHPICAEPDVWRAEAKKFEPSAFLNKIGIG

SEQ ID NO: 161344 - protein, 212 aa, Heterodera glycines
  Homolog annotation: Hit_ID=NP_741465.1; Match level="QueryCoverage =92%, HitCoverage=46%, E-value=1e-40, Identity=39%"; Hit description =prosaposin precursor (48.5 kD) (4J243) [Caenorhabditis elegans] gb|AAB37549.2| Saposin-like protein famil
  Coding regions on vcDNA: vcDNA=SeqID_87767; Strand=+; Position=1-639
PWEDACDECQLIIKRVVNVATDPEKVAELKILLSALCQETSYVEECRLFVSKLDLFLGRLLPFLRDAHHVCKELRICNNGRLQQFHVLGLHFARVNASFQRKDLICEECQLAARELAREVSEPKFQQYVEEWLQGNVCVHLGTLKSSCEQMLDEFLPEMWRELEDILSDQKKFCQDLELCPAGISSPSSARRPTAQSKARKVSRHLLAPRRE

SEQ ID NO: 161345 - protein, 201 aa, Heterodera glycines
  Coding regions on vcDNA: vcDNA=SeqID_87768; Strand=+; Position=34-636
MDLLTALADKMKNEEQDEVGEEEEEDEFPHIANGTAAHLPAIIEDEAEDELNAMLAKARRLKQTETDKMHFVKSEQYNNDGTSSDDEETTPATLAGGHSTSVVFDSTSEKYKSIGGSFGLFTTSKHQVKMETGIGFDESEAVPKRSGTEQRKKAKEILRTATISSVGGSDNEMDIGTDFDGFGPIATGNGKSTVSESDEEE

SEQ ID NO: 161346 - protein, 168 aa, Heterodera glycines
  Coding regions on vcDNA: vcDNA=SeqID_87769; Strand=+; Position=155-658
MAPKFLPPELLFEIVAFMPARGAVPNALTSCWLLHSLLLQRVTKWKQQMAEDRQIKLLMEKMDEKFAEMKAELKAEISGKFAEIDGKFAEIQDQIQDLKAEINQKAAKISIEVPAQGLTIQQATKAGLLDLESGQLTIMCDTATNLSLAKAIEIGMLDPHSMTACDSS

SEQ ID NO: 161347 - protein, 166 aa, Heterodera glycines
  Coding regions on vcDNA: vcDNA=SeqID_87770; Strand=+; Position=182-679
WQTENSELFNYQKQILDKGVPELFSAVINDKNVGKAGAYKEKHNESSDIFSKVYEIADQKFKDLFKNNAFPTLEKLFGDAKALFVNTTPLLDYDIGSLPKRVKFIGGIDLMQPDHKDALPQVFGQPKPVIVFSMSSLLEPSKMPLDKFKTVIQGLGMCEKEVIWKY

SEQ ID NO: 161348 - protein, 185 aa, Heterodera glycines
  Homolog annotation: Hit_ID=NP_598280.1; Match level="QueryCoverage =100%, HitCoverage=11%, E-value=1e-76, Identity=72%"; Hit description= UDP-glucose ceramide glucosyltransferase-like 1 [Rattus norvegicus] gb|AAF67072.1| UDP-glucose glycoprot
  Gene Ontology: Mol. function=UDP-glucose:glycoprotein glucosyltransferase activity; Cellular component=rough endoplasmic reticulum; Biological process=protein modification
  Coding regions on vcDNA: vcDNA=SeqID_87771; Strand=+; Position=1-558
QLMEHDLEGAPYGYTPFCDSRKSMDGFRFWRSGYWAQHLAGRKYHISALYVVDLVKFRQIAAGDRLRGQYQGLSSDPNSLSNLDQDLPNNMIHQVRIHSLPQEWLWCETWCDGVSKDSAKTIDLCNNPLTKEPKLDSAVRIVSEWTELDNEIKRLLTSSSNNRSAVGKPQDDETAFDDDEKHEEL

SEQ ID NO: 161349 - protein, 222 aa, Heterodera glycines
  misc_feature (53)..(53): Xaa can be any naturally occurring amino acid
  misc_feature (61)..(61): Xaa can be any naturally occurring amino acid
  Homolog annotation: Hit_ID=E86336; Match level="QueryCoverage=57%, HitCoverage=33%, E-value=8e-30, Identity=49%"; Hit description =hypothetical protein F14O10.11 - Arabidopsis thaliana gb|AAF88160.1| Contains weak similarity to an unknown pr
  Gene Ontology: Mol. function=protein binding; Cellular component =axoneme; Biological process=N-linked glycosylation
  Coding regions on vcDNA: vcDNA=SeqID_87772; Strand=+; Position=19-684
KEDDKEKEEKAEEEKEDEKEEEEKEEEKEEEEKEEEKEEEEKEDEEEKDDEEXRRKEKRNXEEDKKESEEDKEHEEEAATRAPSAKKEKSVSESVEESDGDPVEQEPEEEEEEEEEEEEPYHPLKSDEIIGGCEDSTDDCAAKKMRLYCSDEDYEEDMHIRCPLTCRFCKRGEPWHYNYEATYEKLGCKDTHPSDCRREKEWCRRGTYKSFMAEKCALSCRR

SEQ ID NO: 161350 - protein, 180 aa, Heterodera glycines
  Homolog annotation: Hit_ID=NP_499756.1; Match level="QueryCoverage =80%, HitCoverage=71%, E-value=5e-17, Identity=35%"; Hit description =polyposis locus protein 1 family member (3O468) [Caenorhabditis elegans]
  Coding regions on vcDNA: vcDNA=SeqID_87773; Strand=+; Position=31-573
MSSDESTTSSASAVSVQLREVPIKDFNDVLPVLQKTLNQLEHPFIKKAEEISGMEREKLFYITSSLVLLVLMYCPGNLFLSTLITVAYPMYASLLTLNTQNTSEYTQWLVYWCVFAEFCQLDLLFGSINGCLLLLYVPLKTVFLLYLALPQTYGAHNMYVKHIRKWIAMTNVLDKMKKML

SEQ ID NO: 161351 - protein, 53 aa, Heterodera glycines
  Coding regions on vcDNA: vcDNA=SeqID_87774; Strand=+; Position=56-214
MNELTHINCVALTARFSLGKPVVPTALFNLPTRRETRVAYWALFRFLPHSTHA

SEQ ID NO: 161352 - protein, 131 aa, Heterodera glycines
  misc_feature (40)..(40): Xaa can be any naturally occurring amino acid
  Coding regions on vcDNA: vcDNA=SeqID_87775; Strand=+; Position=1-396
LWPPFCWPKRLCGSFPPFPPAPLARPLCPLSDANSKNSPXWFVYMHSLALSLAFSVQMYTKSLSDSMGYSAERNTPNSPKNIGTTATERRHGHWKSIVPMPSSPLPRPFAVVSPSDSRPLSFSFGFAPLVK

SEQ ID NO: 161353 - protein, 62 aa, Heterodera glycines
  misc_feature (23)..(23): Xaa can be any naturally occurring amino acid
  Homolog annotation: Hit_ID=ZP_00244991.1; Match level="QueryCoverage =95%, HitCoverage=6%, E-value=4e-24, Identity=88%"; Hit description =COG1049: Aconitase B [Rubrivivax gelatinosus PM1]
  Coding regions on vcDNA: vcDNA=SeqID_87776; Strand=+; Position=12-195
MGSKDMACLGFSADLVMHRSAHXAAYPKPVDVKMHRELPAFISNRGGVALRPGDGVIHSWLN

SEQ ID NO: 161354 - protein, 225 aa, Heterodera glycines
  misc_feature (19)..(19): Xaa can be any naturally occurring amino acid
  Homolog annotation: Hit_ID=NP_499385.2; Match level="QueryCoverage =100%, HitCoverage=20%, E-value=1e-83, Identity=70%"; Hit description= membrane Calcium ATPase, Sarco-Endoplasmic Reticulum Calcium ATPase (115.5 kD) (sca-1) [Caenorhabditis e
  Gene Ontology: Mol. function=calcium-transporting ATPase activity; Cellular component=integral to plasma membrane; Biological process =calcium ion homeostasis
  Coding regions on vcDNA: vcDNA=SeqID_87777; Strand=+; Position=1-674
QMFVVEHAHGDQITFGELXISGSTYEPTGQIMYNGVQINCATDQHKALTELATICSLFIDSSVDYNEMKHAYEKVGEATETALVVLAEKMNVYDTPKHNGLSPRELGSVCNRVIQLKWKKEFTLEFSRDRKAMSVYCKPPADRTGAGAKMFVKGAPEGVLSRCTHVRIGDQKVPLTQAMTQRIVQQCVKYGTGRDTLRCLPLGTIDEPPSPENMNLEDSTKFGEY

SEQ ID NO: 161355 - protein, 74 aa, Heterodera glycines
  Coding regions on vcDNA: vcDNA=SeqID_87778; Strand=-; Position=289-513
SINAFRINPSAAFGQRFALSAMLSHLLLIIMLSIGAFRVLPIVRRRSSNNGHHLGMSGQFQYILRSNAVACPVG

SEQ ID NO: 161356 - protein, 196 aa, Heterodera glycines
  misc_feature (1)..(1): Xaa can be any naturally occurring amino acid
  Coding regions on vcDNA: vcDNA=SeqID_87779; Strand=+; Position=2-592
XRWKSQRRRWGSDCTDEEDDDQLDTGFGFLNNITLSEIKQIHYQTNLNVAKVKKAMLRVISSHKKCAPPAVDFVMGLDDEADAEDHLSSCPSQDNDSEQIESDVESMAAISDDGTPTAEGVQNTAAKARGINSRELFANVPRFLNGMTKRNLTVTNSFAVLLHLCNDKQFTLAQMEGENKLVEGHSMAEFFVKFPN

SEQ ID NO: 161357 - protein, 196 aa, Heterodera glycines
  misc_feature (25)..(25): Xaa can be any naturally occurring amino acid
  misc_feature (78)..(78): Xaa can be any naturally occurring amino acid
  Homolog annotation: Hit_ID=CAE74915.1; Match level="QueryCoverage =99%, HitCoverage=30%, E-value=4e-88, Identity=81%"; Hit description =Hypothetical protein CBG22795 [Caenorhabditis briggsae]
  Gene Ontology: Mol. function=succinate dehydrogenase (ubiquinone) activity; Cellular component=mitochondrial inner membrane; Biological process=tricarboxylic acid cycle
  Coding regions on vcDNA: vcDNA=SeqID_87780; Strand=+; Position=1-586
FYGAGCLITEGCRGEGGFLIITTGXRFMERYAPVAKDLASRDVVSRSMTIEIMEGRGVGPLKDHIFLQLHHLPPEQLXQRLPGISETAKIFSGVDVTKEPIPVLPTVHYNMGGTPTNYKGQVIRFSNEKGDQVVPGLWAAGECAAHSVHGANRLGANSLLDLVIFGRACAINILSANKPGDSLPPLETDAGESSIA

SEQ ID NO: 161358 - protein, 232 aa, Heterodera glycines
  misc_feature (20)..(20): Xaa can be any naturally occurring amino acid
  misc_feature (215)..(215): Xaa can be any naturally occurring amino acid
  misc_feature (225)..(225): Xaa can be any naturally occurring amino acid
  Homolog annotation: Hit_ID=CAE72182.1; Match level="QueryCoverage =99%, HitCoverage=42%, E-value=1e-59, Identity=52%"; Hit description =Hypothetical protein CBG19289 [Caenorhabditis briggsae]
  Gene Ontology: Cellular component=mitochondrion
  Coding regions on vcDNA: vcDNA=SeqID_87781; Strand=+; Position=3-696
IAPPFRARDEAELLLLPFFXCFGFTQLNMALLNGSTGVVLSKFEQNSFCRVVEQYRIRLLLLVPPILVFLAKSPLVANFDMSHVRAILSGAAPAGADLCEELKQRFPNLQHICQGYGMTEMCVAIALPILDKERHESSGKLLANLEMKVVDLLTRKEVELGMPGELFVRGPTRMVGYLGRPSETAKVIDGEGWLRTGDIVLVDKYGFITVVDRLXELIKVNGLQXAPSELED

SEQ ID NO: 161359 - protein, 100 aa, Heterodera glycines
  misc_feature (34)..(34): Xaa can be any naturally occurring amino acid
  misc_feature (54)..(54): Xaa can be any naturally occurring amino acid
  Homolog annotation: Hit_ID=EAA21331.1; Match level="QueryCoverage =95%, HitCoverage=90%, E-value=1e-16, Identity=53%"; Hit description =hypothetical protein [Plasmodium yoelii yoelii]
  Coding regions on vcDNA: vcDNA=SeqID_87782; Strand=-; Position=311-642
STDPATSFLTAAIILCILRAGITAAAGTRLALSXYSLKGLNCTHSDDRPHKRSXLVISRHYLLALRVDVVAISQAPSPESNPYPPLPVITMVVRYTTIES

SEQ ID NO: 161360 - protein, 170 aa, Heterodera glycines
  misc_feature (137)..(137): Xaa can be any naturally occurring amino acid
  Homolog annotation: Hit_ID=NP_496147.1; Match level="QueryCoverage =94%, HitCoverage=18%, E-value=2e-15, Identity=34%"; Hit description =phospholipase protein (93.6 kD) (2K235C) [Caenorhabditis elegans] emb|CAA88206.1| Hypothetical protein C0
  Coding regions on vcDNA: vcDNA=SeqID_87783; Strand=+; Position=260-769
MPGCNNGVTTAQQNTKRSPIVPLPDNFCTFGLDGVSKKVIERLREMNLLQPKALQLNDDEFASAEVILSQADFAINECQIVALEKGILWSPETIVPALDLFRIALLHPKLNEIFCSLESVLGNPPKGVPTVRRLVEXAHLAHGSEPVRILACRSLANASAHDFGRSMLMA

SEQ ID NO: 161361 - protein, 248 aa, Heterodera glycines
  Homolog annotation: Hit_ID=A43427; Match level="QueryCoverage=98%, HitCoverage=50%, E-value=1e-11, Identity=27%"; Hit description =neurofilament triplet H1 protein - rabbit (fragment) gb|AAA57152.1| neurofilament-H
  Coding regions on vcDNA: vcDNA=SeqID_87784; Strand=+; Position=3-746
KAKPGSPKSPSKAKPGSPKSPSKAKPGSPKSPYKAKPGSPKSPSKAKPGSPKSSPSKKGNVSPNVSPSKGKSPQKLLSPKAMLQTHKSAPPALAHILAHHSPHLPVGSELSPAKSLDSHHQRQMPLFAEKKYGQNHQSPYMSPTKLSNGNVSPPQSPSHRLQQIIKRHSQTKDLSREKVQRQQQSPLLQHPSIRALIGLPNSPADDQNPPPPFTPEQHALLMDTVLRPPSGLPFESPRSAPSPLELSE

SEQ ID NO: 161362 - protein, 147 aa, Heterodera glycines
  misc_feature (108)..(108): Xaa can be any naturally occurring amino acid
  Homolog annotation: Hit_ID=AAN32888.1; Match level="QueryCoverage =91%, HitCoverage=34%, E-value=7e-57, Identity=86%"; Hit description =annexin 4C10 [Heterodera glycines]
  Coding regions on vcDNA: vcDNA=SeqID_87785; Strand=+; Position=3-446
IPFPFLYSLINAPNGLTILLLISVVIGHSLANLGPTIKHNPHFKAVQTAHHLHDAIAKKHEAEVTQIICSISNEQRQALALEFKKQFGTDLIAMLKKEFKSDFEELMXIIKCKNSHLNLNLQSISLMQTPAVYDANQMRAALSGSNE

SEQ ID NO: 161363 - protein, 77 aa, Heterodera glycines
  misc_feature (16)..(16): Xaa can be any naturally occurring amino acid
  Coding regions on vcDNA: vcDNA=SeqID_87786; Strand=-; Position=0-230
LYLSALCPLDSKIELXIFVAFHLPISHNFQLHVVAKSAMLHFVCVEQLAKSCAVFGMQFVTSSSLGAETFSTSIGAT

SEQ ID NO: 161364 - protein, 198 aa, Heterodera glycines
  Coding regions on vcDNA: vcDNA=SeqID_87787; Strand=+; Position=3-599
TTTEGQLAKGTTPPIPQTSQQQQIQQPMTISKPNQHHNANTGGHRANASLSPALGSSGFGSSASSNASAQVERDLIDLFDEQCSIGPPLKWTPSPPPLQQHQFSGVMYPHTGVIASMDLKSRGYYVYSNEFDNELYLLTEELLEKGSWIKFNILDDYYRLTIGQYALLKKSPFDVRVERNTIYVGFFTGSWVKFVYIY

SEQ ID NO: 161365 - protein, 100 aa, Heterodera glycines
  Coding regions on vcDNA: vcDNA=SeqID_87788; Strand=+; Position=320-622
ESTHCLCKMRKDGRRRNFLFSSIKWHNLFTKEKVIIIRKFPIGTDNRHFLTFLILHFDSHCAELMKRESNCFLQKKNPPHFPVPPLTPPTLPLHFPCPLG

SEQ ID NO: 161366 - protein, 123 aa, Heterodera glycines
  misc_feature (26)..(26): Xaa can be any naturally occurring amino acid
  misc_feature (45)..(45): Xaa can be any naturally occurring amino acid
  Homolog annotation: Hit_ID=NP_505733.1; Match level="QueryCoverage =99%, HitCoverage=36%, E-value=8e-48, Identity=76%"; Hit description =yeast Glc Seven-like Phosphatase (37.2 kD) (gsp-1) [Caenorhabditis elegans] emb|CAA98273.1| Hypothetical
  Gene Ontology: Mol. function=protein phosphatase type 1 intrinsic catalyst activity; Cellular component=cytoplasm; Biological process =adult locomotory behavior
  Coding regions on vcDNA: vcDNA=SeqID_87789; Strand=+; Position=156-522
RTFSIKLWNTFTDCCNCLPIAALIHXKIFCCRGGLSPDLQNMEQXILRIMRPTDVPDTRLLCDLLWPDPDKYGHGWRENDRGWSFTFCPHMVPNFLNRHYLDSICHAHHAVEDCYELFSKRQS

SEQ ID NO: 161367 - protein, 46 aa, Heterodera glycines
  Coding regions on vcDNA: vcDNA=SeqID_87790; Strand=-; Position=34-174
FFFFFFFFWRKRGFMCNNNSENEANTEHREKTTTRVDFVSFHRQFY

SEQ ID NO: 161368 - protein, 190 aa, Heterodera glycines
  Homolog annotation: Hit_ID=CAE73080.1; Match level="QueryCoverage =94%, HitCoverage=82%, E-value=6e-48, Identity=49%"; Hit description =Hypothetical protein CBG20456 [Caenorhabditis briggsae]
  Coding regions on vcDNA: vcDNA=SeqID_87791; Strand=+; Position=100-672
MDKLVLKIRELLDENEVNFGEVQRILEEYKSEPKDWRQFTHFDEHKYTRNLVDAGNGKYNLMILCWGPGMGSSIHDHSAAQCFVKVLDGQLLETRFAWPKKEKEEKEEEKEEEKEEEEEEEKEEEEGPMRATGTELFKTNGVSYISDKIGIHRMENPSHVDPTVTLHLYIPPYSQCYSFDQVMVPIIFSI

SEQ ID NO: 161369 - protein, 243 aa, Heterodera glycines
  Homolog annotation: Hit_ID=CAE66320.1; Match level="QueryCoverage =100%, HitCoverage=69%, E-value=1e-55, Identity=46%"; Hit description= Hypothetical protein CBG11571 [Caenorhabditis briggsae]
  Gene Ontology: Biological process=protein folding
  Coding regions on vcDNA: vcDNA=SeqID_87792; Strand=+; Position=11-739
IFRLKKLEGEATANNRKAKLIFFFEWSIDVNFIATVSGSETEYKGSVEILNLSDENEAHEIEISVHIETAGPHENEIRHILSTDGLSFVRSKVGTYVRELKEEFSKGIILPVDSKGAIRPQAVATQGKTVVDKRRFQNDIIQKTEEKVTTAETQNALKTGGFELTETFKVPPERLFEILTASELVSVWSPNSSIDAREGGQFSLLGGVMSGHFTKLANAALISMAWRLKSYPSGHFADVTFTL

SEQ ID NO: 161370 - protein, 226 aa, Heterodera glycines
  Coding regions on vcDNA: vcDNA=SeqID_87793; Strand=+; Position=119-796
RNNRAFDMEKFDIIQRTMRMYFESEDSSDVFEGFLNVVKYVKSLTTEQLDISLVKLALLAFYEFQKLGIAQGQQIPFDLHIDKTLLLDALVPCFRLKTKYIEAISSVFHLKDREMVEVAIAQIKTLLENEVPKAVFWMDHLNLRDHFPFNTIVCKLILENQTALIYPFVGESQFRRNKLIHYLDNLLGLVLRNRRAGDEYEREIMKNQKQLEKLTRKFVKNFELTE

SEQ ID NO: 161371 - protein, 71 aa, Heterodera glycines
  misc_feature (59)..(59): Xaa can be any naturally occurring amino acid
  Coding regions on vcDNA: vcDNA=SeqID_87794; Strand=+; Position=3-215
KIVRGFYGWLLRSLDWINRQILHRLSLSAHNREDMIIKSFRRSYPGLLQRLNELKRSGXPVLQRRSVHLVT

SEQ ID NO: 161372 - protein, 83 aa, Heterodera glycines
  Coding regions on vcDNA: vcDNA=SeqID_87795; Strand=+; Position=57-308
MKPSFNFKLFASVFLVLCVASLVLCQHKPAAACKPPKNVGRGNLALTRWWWDGRSCKQFIYKGQGGNTNNFPSNKLCDQVCKP

SEQ ID NO: 161373 - protein, 164 aa, Heterodera glycines
  Coding regions on vcDNA: vcDNA=SeqID_87796; Strand=+; Position=2-496
KESRALSDRIVRIISSLAQAVPSDFHEKLSDESKLWLGMRLKSFTNALMSSCAGEALRDGRSMLAEMFRAIPTESSAILRAIYESVTNHGNQLNAQLVLIRLAAESGDGQQSLLHVLKEVSGRESVPGKFLKSLETFQYLCNQLKKVEEQRKTAQLTQQNDDTC

SEQ ID NO: 161374 - protein, 50 aa, Heterodera glycines
  Coding regions on vcDNA: vcDNA=SeqID_87797; Strand=-; Position=136-288
PNCLPRGETFYWLRAVGSSLCIKIFASGNHGSVLCQSNFLSCATTRLEVL

SEQ ID NO: 161375 - protein, 65 aa, Heterodera glycines
  misc_feature (25)..(25): Xaa can be any naturally occurring amino acid
  Homolog annotation: Hit_ID=ZP_00244991.1; Match level="QueryCoverage =100%, HitCoverage=7%, E-value=1e-30, Identity=96%"; Hit description =COG1049: Aconitase B [Rubrivivax gelatinosus PM1]
  Coding regions on vcDNA: vcDNA=SeqID_87798; Strand=+; Position=3-196
MTRDELKDLACLGFSADLVMQSFCXTAAYPKPVDVKMHRELPAFISNRGGVALRPGDGVIHSWLN

SEQ ID NO: 161376 - protein, 80 aa, Heterodera glycines
  Coding regions on vcDNA: vcDNA=SeqID_87799; Strand=-; Position=1-240
PRRGMDNPNQANHRSQVISSRPVIPVLLWALLRWRQVRLRLFPSSPRSAVLRWALIRWRQVSLRMFPSSPRSAAPLSQLA

SEQ ID NO: 161377 - protein, 54 aa, Heterodera glycines
  Coding regions on vcDNA: vcDNA=SeqID_87800; Strand=-; Position=0-161
FFFFFFFFFFSTSINQLAKRSASSKNNNYPIRSNPHNISTMRKQHKCKKQLSSP

SEQ ID NO: 161378 - protein, 261 aa, Heterodera glycines
  Homolog annotation: Hit_ID=AAR82779.1; Match level="QueryCoverage =88%, HitCoverage=72%, E-value=1e-25, Identity=31%"; Hit description =LD31436p [Drosophila melanogaster]
  Gene Ontology: Cellular component=synaptic junction; Biological process=protein targeting
  Coding regions on vcDNA: vcDNA=SeqID_87801; Strand=+; Position=2-787
KGADPNEPVVGRENDINTNLTPLFVAALHAHFPLCRVLVDRGANVDLGSDCPTPLMMACKRSQMEIVAFLIENGADINLQNGDGETALMIACSRANVDIVRLLLSHGANVEQTDYEGFRFALKNAANEGHLEVCRLLVEEWAADVNQQTIQDRTTALICAASRGDLAIVNFLIEHGADLQHVDVVGNNALMWAVISRKTEMARHLVAIGADINQRDTAGNRAQDIAVLTGHAEMMAIFRTTATDNGHAEGTDGQQNDQQQM

SEQ ID NO: 161379 - protein, 105 aa, Heterodera glycines
  Coding regions on vcDNA: vcDNA=SeqID_87802; Strand=-; Position=3-317
MSDQPHNYSYSSPKPPITRLMVASGVTVDREGWYSLMFSIIATAACADVRHIVSDRFVDRAFLAHLRRQGQMTVTAPGLFVLRHNRSHYHFLSVCCPPPQRPSPP

SEQ ID NO: 161380 - protein, 46 aa, Heterodera glycines
  Homolog annotation: Hit_ID=ZP_00357698.1; Match level="QueryCoverage =84%, HitCoverage=22%, E-value=2e-10, Identity=77%"; Hit description =hypothetical protein Chlo02002738 [Chloroflexus aurantiacus]
  Coding regions on vcDNA: vcDNA=SeqID_87803; Strand=-; Position=189-329
TGGTNQRTFFFFFFFFLVFFFFFFFFFFFFFFFFFFLYGESFLILS

SEQ ID NO: 161381 - protein, 184 aa, Heterodera glycines
  misc_feature (27)..(27): Xaa can be any naturally occurring amino acid
  Homolog annotation: Hit_ID=XP_428292.1; Match level="QueryCoverage =97%, HitCoverage=35%, E-value=3e-51, Identity=55%"; Hit description =PREDICTED: similar to vacuolar protein sorting 45A; leucocyte vacuolar protein sorting 45; vacuolar prote
  Gene Ontology: Mol. function=chaperone activity; Cellular component =extrinsic to membrane; Biological process=reproduction
  Coding regions on vcDNA: vcDNA=SeqID_87804; Strand=+; Position=5-554
MDTLFKCCKTNSALVILDRSDDPVLPXLLNQWTYDAMVHELIGLNNHRVTLKNTGNDGLKNIVLNAQYDEFYSKNMYLNFGDIGQNIKGLMNEYERKAKTHQQLESIADMKKVVEQYPQFKKISGTVAKHVQLVGELSRMVTDGNLLEISELEQNIAVANGDYSACLDSLRRLMQRPKTTDLNA

SEQ ID NO: 161382 - protein, 152 aa, Heterodera glycines
  misc_feature (4)..(4): Xaa can be any naturally occurring amino acid
  Coding regions on vcDNA: vcDNA=SeqID_87805; Strand=+; Position=3-458
FNNXRNQHQSAEEQKANEGCDPGEKERMERESLIEEAYALSQEANISLEQIIKRYTKCRNQFLERVTDQISDQLQQDHSDSTDDISTNKHERKKRPIVFISPQLRKRVKIQQQLAEADSANDGDDDSEQKQQKEKSPFTIPGGAEDDEMTDV

SEQ ID NO: 161383 - protein, 53 aa, Heterodera glycines
  Coding regions on vcDNA: vcDNA=SeqID_87806; Strand=-; Position=30-191
NTGLSLEDQSANVGPSLFGPASSHNSGLIRPALEELSFMLSYVIQNPNSLPQH

SEQ ID NO: 161384 - protein, 51 aa, Heterodera glycines
  Coding regions on vcDNA: vcDNA=SeqID_87807; Strand=+; Position=2-154
YALNDPNRLLAVVPFLVRTYFNGARVVQRALISLVQCCIVRQVDSQPSMVT

SEQ ID NO: 161385 - protein, 38 aa, Heterodera glycines
  Homolog annotation: Hit_ID=ZP_00357698.1; Match level="QueryCoverage =73%, HitCoverage=14%, E-value=1e-09, Identity=95%"; Hit description =hypothetical protein Chlo02002738 [Chloroflexus aurantiacus]
  Coding regions on vcDNA: vcDNA=SeqID_87808; Strand=-; Position=95-211
FFFFFFFFFPFFFFFFFFFFFFFFFFFNKTNQDFNVKN

SEQ ID NO: 161386 - protein, 223 aa, Heterodera glycines
  Homolog annotation: Hit_ID=AAK38746.1; Match level="QueryCoverage =97%, HitCoverage=15%, E-value=1e-25, Identity=27%"; Hit description =WD repeat membrane protein [Mus musculus] ref|NP_700440.1| WD repeat membrane protein PWDMP [Mus musculus]
  Coding regions on vcDNA: vcDNA=SeqID_87809; Strand=+; Position=34-702
HLPDGEIQPSQNLNIKIEPSLIAVGAKHIAIVLNSKAWFYEIKRNGTSFMYEHDYMTTIVKMKLNRDFVMAQLDNRVHLHKIIRSQSDHSDPSDNYMTNDVLFPNSNETNPRDVILDADLSEKFFIYSTRSRFLNYYSLAHGRFVSDFKHSSEIRKLFSEPDGIRTIFYDDAHDLHIYSPADDQLSKIPREGSSMSNQKYDGCLWEAFTVDKDTFLVHDQHTI

SEQ ID NO: 161387 - protein, 89 aa, Heterodera glycines
  Coding regions on vcDNA: vcDNA=SeqID_87810; Strand=+; Position=253-522
MIEFYKWSANYIHSFGAFQLCPPPPPKLIGDLIFSDWSDLIWLRQGVKKSIVRINFIINEILILIYCTKRKTIFSPNNKIFKAFLSLQK

SEQ ID NO: 161388 - protein, 96 aa, Heterodera glycines
  Coding regions on vcDNA: vcDNA=SeqID_87811; Strand=+; Position=1-288
KMVFWKDNNVWYATTPEGVRRWSISTSTRGLRKSNVAQRHSIFFGRHSLPQDTLPIFLQTLPLIAPWKGFTALIEADKMVNFGCQSHRWLAHSMAI

SEQ ID NO: 161389 - protein, 57 aa, Heterodera glycines
  Coding regions on vcDNA: vcDNA=SeqID_87812; Strand=-; Position=3-173
VLCQYLCPPFSCHPVSNSPMAEPLHPVIHFSCPHKLLLAALISAIYHACYFLDWSMP

SEQ ID NO: 161390 - protein, 71 aa, Heterodera glycines
  Coding regions on vcDNA: vcDNA=SeqID_87813; Strand=+; Position=38-253
LIFLLLWARTTAEKNTRRNNGGREKGKVGSNRPNERRITSYDGLEDYKRRNRENPFESQLKFFAAHASCCK

SEQ ID NO: 161391 - protein, 138 aa, Heterodera glycines
  Homolog annotation: Hit_ID=NP_501480.2; Match level="QueryCoverage =91%, HitCoverage=24%, E-value=2e-13, Identity=33%"; Hit description =cytochrome p450 2A15 family member (57.7 kD) (4J410) [Caenorhabditis elegans] gb|AAB03125.2| Hypothetical
  Coding regions on vcDNA: vcDNA=SeqID_87814; Strand=+; Position=2-415
SGGEVNGVIRTEGEQWKQLRKFTLKALRDYGLEKGATEAMVLEAIFTLIDEVEGEVNSGNSELSFYRKVDLMTGSVINRMLFGFSFYGDRYKTFTFLKDALDVEQEYFISLISQMIEARPWLRHLPYFSKKKKKKKKK

SEQ ID NO: 161392 - protein, 108 aa, Heterodera glycines
  Coding regions on vcDNA: vcDNA=SeqID_87815; Strand=+; Position=3-326
THPCKLEVAMATPAELDLMPVILEINKDTFSVGVTPTTLTSVGKGPCFSCQQSEEVNRQSMAAASEGPCNFACQFPRQVAAAVELMGPIEGRLSDDAKDGPTKDPFST

SEQ ID NO: 161393 - protein, 231 aa, Heterodera glycines
  Homolog annotation: Hit_ID=CAE64130.1; Match level="QueryCoverage =38%, HitCoverage=9%, E-value=6e-20, Identity=54%"; Hit description =Hypothetical protein CBG08746 [Caenorhabditis briggsae]
  Coding regions on vcDNA: vcDNA=SeqID_87816; Strand=+; Position=34-729
MRRFGKTYLCSYSRLCIDAKLRCNGEDNCGENDDSDEAHCSRIEALASPTTIVVAYIVSGIIFFFILSLFCFLFKSKLEKKNNAKGEEKRSRREREKRKRAQRKRREGRKSGRKAEGEAQRQTARQPSRQPRPRRTVADGHKLSGIYGGVGGTQSVFGRRGTMRRMAEEESEEEGATATAGHQEDAQHHHHKQHHHDYSQQFSQHGQTDQFELESQKRPKANENNVRIFYG

SEQ ID NO: 161394 - protein, 71 aa, Heterodera glycines
  Coding regions on vcDNA: vcDNA=SeqID_87817; Strand=-; Position=119-334
TSFSSGYLCTGRSSYSKFRYGCTIVGEVYAQLSIGRCSKCSVGSRLAAHCFTVCVGSPKCVQPCPMGSRLC

SEQ ID NO: 161395 - protein, 54 aa, Heterodera glycines
  Coding regions on vcDNA: vcDNA=SeqID_87818; Strand=-; Position=3-164
NVVGNMARSILMEIVKGGIGPDSHMFPPDIEAVGENHKGLFQRRVYKKRKKKKK

SEQ ID NO: 161396 - protein, 86 aa, Heterodera glycines
  misc_feature (8)..(9): Xaa can be any naturally occurring amino acid
  Coding regions on vcDNA: vcDNA=SeqID_87819; Strand=-; Position=324-584
FFFFFFFXXTSPAPLLRHRRPTDGAPFGWMSADDMLSMPVPESCPPPAPPLSASSASFSTSSTSISTSSKSSSSSASLPPCQCLRC

SEQ ID NO: 161397 - protein, 59 aa, Heterodera glycines
  Coding regions on vcDNA: vcDNA=SeqID_87820; Strand=+; Position=1-180
DATATKTDGSRAAANATGTATAQEGYRGRTTVTGHSVAAAASEVQVRATVDEKISERFV

SEQ ID NO: 161398 - protein, 61 aa, Heterodera glycines
  Coding regions on vcDNA: vcDNA=SeqID_87821; Strand=+; Position=167-352
MRLISVTILALCMALFTIHYDCPSHMVSHLIKHMLNHTTKKMDELHMEELAIITSPPNILQ

SEQ ID NO: 161399 - protein, 94 aa, Heterodera glycines
  Homolog annotation: Hit_ID=CAE71896.1; Match level="QueryCoverage =84%, HitCoverage=33%, E-value=3e-16, Identity=51%"; Hit description =Hypothetical protein CBG18954 [Caenorhabditis briggsae]
  Coding regions on vcDNA: vcDNA=SeqID_87822; Strand=+; Position=4-285
GVPEWLLHEAENTNACGTFALFHALTNNTDRIDIGNGVFYDWFKAAKQLNVEQRSDLLANDSELAHLHEHCALRESETDVPRNVAHHFISYFTH

SEQ ID NO: 161400 - protein, 57 aa, Heterodera glycines
  Coding regions on vcDNA: vcDNA=SeqID_87823; Strand=-; Position=2-172
TVHQLKLSHVAMRWRRCAMSVAVPKDGLLRRDSQLVPVPSMVKGEGIGTGKSWRASL

SEQ ID NO: 161401 - protein, 127 aa, Heterodera glycines
  Homolog annotation: Hit_ID=AAO33474.1; Match level="QueryCoverage =100%, HitCoverage=92%, E-value=1e-61, Identity=96%"; Hit description= gland-specific protein g4g12 [Heterodera glycines]
  Coding regions on vcDNA: vcDNA=SeqID_87824; Strand=+; Position=18-398
MPNIFKILLIVLLAVVSFRLSASTGDKKTANDGSGNNSSAGIGTKIKRIVTVVLLFTSLATGGAEAIGRSNAQGGNAAGLAPSHVTNRSMAPPPPPVQCEMGANRLEKMRAHLRELAEKMPVNESNR

SEQ ID NO: 161402 - protein, 98 aa, Heterodera glycines
  Coding regions on vcDNA: vcDNA=SeqID_87825; Strand=-; Position=2-295
LTLVGQFESASAISLYPAVFVSSIRFQCVYISLLFFSHMYCCCIINHLRYICNETVLINLNTLSVGRSHGLSFECPFSVLHFHPTHFRPNLTWLAHCP

SEQ ID NO: 161403 - protein, 215 aa, Heterodera glycines
  misc_feature (173)..(173): Xaa can be any naturally occurring amino acid
  Homolog annotation: Hit_ID=NP_502793.1; Match level="QueryCoverage =100%, HitCoverage=45%, E-value=1e-102, Identity=88%"; Hit description=sec61 (52.2 kD) (4P588) [Caenorhabditis elegans] emb|CAB16516.1| Hypothetical protein Y57G11C.15 [Caeno
  Gene Ontology: Mol. function=protein transporter activity; Cellular component=endoplasmic reticulum membrane; Biological process =reproduction
  Coding regions on vcDNA: vcDNA=SeqID_87826; Strand=+; Position=2-644
LAGAKIIEVGDTPKERALFNGAQKLFGMVITIGQAIVYVASGMYGNPHEIGAFICLLIVIQLVVAGLIVLLLDELLQKGYGLGSGISLFIATNICETIVWKAFSPATMNTGRGTEFEGAIIALFHLLATRNDKVRALREAFYRQNVPNLMNLLATVLVFAADIYFQGYSCRLXPIKSARYRGQHRSYPIKLFYTSNMPIILQSALVSNLYVISQM

SEQ ID NO: 161404 - protein, 28 aa, Heterodera glycines
  Coding regions on vcDNA: vcDNA=SeqID_87827; Strand=-; Position=261-347
LIFFFFFFFFFFFFFFFFFFFFFFFLIN

SEQ ID NO: 161405 - protein, 62 aa, Heterodera glycines
  Coding regions on vcDNA: vcDNA=SeqID_87828; Strand=-; Position=2-187
FFFFFFFLHRSFYWINKPNKTNGTVINNNHYCMGSLGCWCALLYSLNRSVCHSEKRVANFSL

SEQ ID NO: 161406 - protein, 80 aa, Heterodera glycines
  Coding regions on vcDNA: vcDNA=SeqID_87829; Strand=+; Position=39-278
THEKNSICNACLVLLTNIISLTKTFSQTKHSVLSANHPLEPASFGTAFPLLWSPGDGDNGPRHSMPRITKRPIEFPRASW

SEQ ID NO: 161407 - protein, 65 aa, Heterodera glycines
  Coding regions on vcDNA: vcDNA=SeqID_87830; Strand=+; Position=1-195
SGVDFASLSCLSTITQSTSDELGKKSKGSPTIELLRAESDCLPPEWLLPNSSTYFEAADSMAEHS

SEQ ID NO: 161408 - protein, 150 aa, Heterodera glycines
  Coding regions on vcDNA: vcDNA=SeqID_87831; Strand=+; Position=3-452
NLCRKNNHNIINSSNNMLLVEVVVVVSSHNNNLQRRKRRSNRLAVMSNHNRNNTFRPTWLTVVVVEQHNSIRWMPKKNIWRRSRTNWATSLALARALFQLHSIQHLLQLLPMFVVQSSSNNIHGLRQQQSQDITAAQPEHHYHSIPIGHR

SEQ ID NO: 161409 - protein, 108 aa, Heterodera glycines
  Coding regions on vcDNA: vcDNA=SeqID_87832; Strand=+; Position=114-437
YRITLRCNGQSKGTLCTNPRHSEIFAENSVSIDGMRGLNDPYDGKQFATFIGLTQIWENFLNLCSNAGGELTWNDQLISRLEAEHCDVGMCELYDICRFAMFHRIAAN

SEQ ID NO: 161410 - protein, 187 aa, Heterodera glycines
  misc_feature (10)..(10): Xaa can be any naturally occurring amino acid
  Homolog annotation: Hit_ID=NP_499522.1; Match level="QueryCoverage =89%, HitCoverage=8%, E-value=4e-33, Identity=47%"; Hit description =golgi-specific brefeldin A-resistance guanine nucleotide exchange factor 1 (3M842) [Caenorhabditis elegans
  Gene Ontology: Mol. function=ARF guanyl-nucleotide exchange factor activity; Cellular component=mitochondrion; Biological process =retrograde (Golgi to ER) transport
  Coding regions on vcDNA: vcDNA=SeqID_87833; Strand=+; Position=3-565
WTVYWRPLLXAMARLSCDCRRLIRAQSLDALGNSFRVPALSELMQPADWEDCFAELLFPLLTKLLAISPPISPMDPIGMEEAQILSIQFICKILLGNLTQISRLDSFADLLSHLFELMDQFLEGSSCIDLLAEVIQESLKNCALVCENFGVFRDNLAELHGQLQERLNALAKKHEIASSVGTIKLST

SEQ ID NO: 161411 - protein, 216 aa, Heterodera glycines
  Coding regions on vcDNA: vcDNA=SeqID_87834; Strand=+; Position=3-650
RTKMEIQPQPFVDEAANVQNIVNAIGKCPLAIAVPQEGSETVPISPSFTGNINMFSSIPISQELPFTSPANELGVSAPLSRLRSVTDFDDQNQAESPRASNSFPQNLASHNKNRMRNNSFPFASLLLESQSSSSQTLPGVPENDTVSGKTGESDNLSKRGANFLHTKVHSAQELTMRRNSSLSMDTFGDLSTKIASTQSAEKVHFACGEQDQRLEN

SEQ ID NO: 161412 - protein, 214 aa, Heterodera glycines
  Coding regions on vcDNA: vcDNA=SeqID_87835; Strand=+; Position=38-682
RKGRVCRRRALPFSAHCGPSAFFTPGELREQLSQLVQRFPHNIPILQAPLRVGSDFHRRRFLAQHPGTDDRSRLIRTCGRIFAAHHHYLAEHKRYYEQKFDNQAFRTLLYQYVHLLRKAAEENCGSALPDDYIWVFLMQHITSERTMLPRRVIDEVFTIGQGRCPWSKQFLMESLRGCCDRTDPSVAMVNATMKTHGISVYCTDPEVQLLLENV

SEQ ID NO: 161413 - protein, 57 aa, Heterodera glycines
  Coding regions on vcDNA: vcDNA=SeqID_87836; Strand=-; Position=1-171
NHPPPGRHQIINTQRETDSAAVKGTYTHHQLSLIGSPLSPPPLTPTANPTPSPSGPS

SEQ ID NO: 161414 - protein, 215 aa, Heterodera glycines
  Homolog annotation: Hit_ID=AAL78214.1; Match level="QueryCoverage =86%, HitCoverage=94%, E-value=4e-34, Identity=42%"; Hit description =putative esophageal gland cell protein Hgg-20 [Heterodera glycines]
  Coding regions on vcDNA: vcDNA=SeqID_87837; Strand=+; Position=49-693
MSDHPNVALADLSRVANDVWLDTLFWIDRAEVGMKFALIDARFGRLVATHFNLRKWWLGELGVHRAPRRWQCGGTAAVSAMDDYAMSNRLPLATCPAPNGVIGFRAIYIWYVDLEVIAFLQCLQRVINRGIAVQFTIHSTDVRCWALMAQRIWPLIAHGIIALNDMKAINLALLCRHVSPNVLFDCANLRAITNTHMFPIRPPHSAVHINELLQP

SEQ ID NO: 161415 - protein, 30 aa, Heterodera glycines
  misc_feature (30)..(30): Xaa can be any naturally occurring amino acid
  Coding regions on vcDNA: vcDNA=SeqID_87838; Strand=-; Position=1-90
TLSMVIYHSAVFARDSANSTAQMVAYEPFX

SEQ ID NO: 161416 - protein, 47 aa, Heterodera glycines
  Coding regions on vcDNA: vcDNA=SeqID_87839; Strand=+; Position=115-255
SKKVVQSEANTKYKLVRVKSQDMGCIMEGVNKQSVRCSHWLVWRGVN

SEQ ID NO: 161417 - protein, 195 aa, Heterodera glycines
  misc_feature (165)..(165): Xaa can be any naturally occurring amino acid
  Homolog annotation: Hit_ID=NP_493947.1; Match level="QueryCoverage =97%, HitCoverage=19%, E-value=1e-39, Identity=42%"; Hit description =antennal specific membrane protein AMP like (108.5 kD) (2B609) [Caenorhabditis elegans] gb|AAD47126.1| Hy
  Coding regions on vcDNA: vcDNA=SeqID_87840; Strand=+; Position=101-688
MAVVDYSSNFWGDKHIGYSVLYENMKKGEESVHELLTFLKERVNMEDDLFKSLGKSLHRVNGYISNKSGFVDAWKLAKETLELWTEIQSSTLRNLNDLLKEVARYQEELARMRKRAKDADTLETINLMQTTTTCLQKARDTFNQRSTDVVSLKQSNKEWTAAITXEYLRARNILNNAHDEYKPYMDKYSQIRDTF

SEQ ID NO: 161418 - protein, 212 aa, Heterodera glycines
  Coding regions on vcDNA: vcDNA=SeqID_87841; Strand=+; Position=1-636
QQTVGLAAQKVVVMKISSEPIPTSADGVKRRHQKRKGGRASEERTDATLVKQMKGTNTVVMGTMKEEREEQLYQREGKPEAKEEDKLKTAPAEAEKKTEKTGKDGKRGRKKKRDKQQREEGGGTKFNWFAEFPFDTAATSISEEQSAPAATDGGIPAKVFASPTRSFVLPAHERHLLLLPYMDIGLPDWRVHDFPQPDRFLFPEPSEWHKKP

SEQ ID NO: 161419 - protein, 33 aa, Heterodera glycines
  Coding regions on vcDNA: vcDNA=SeqID_87842; Strand=-; Position=0-98
RTTMHFLGLAPPRGLATLCMHHCMTCEALPIRA

SEQ ID NO: 161420 - protein, 230 aa, Heterodera glycines
  Homolog annotation: Hit_ID=NP_647640.1; Match level="QueryCoverage =92%, HitCoverage=64%, E-value=1e-37, Identity=39%"; Hit description =CG7967-PA [Drosophila melanogaster] gb|AAF47540.1| CG7967-PA [Drosophila melanogaster] gb|AAM11307.1| RH7
  Coding regions on vcDNA: vcDNA=SeqID_87843; Strand=+; Position=1-690
HFVKIANEYATRDVVIQYWCLLKALEDGVKLSGNEPNTKKFLLDLMTVLENMKQSHKENDAVMQEIVGQSHIEDQAQRLFQFAYGLDQHSQFGQKLIKAFYTAGYLFDVLTCFGQLDDNIQSARKYAKWRAIDVHNCLKNGEQPKPATNPTAQQQKELSDQDDIAAQINDKLSAELNDLNASLAKSPQSPAVPQQQFFNPMLTHPSQQRQIPSNYGQSDAINGGHSTGHF

SEQ ID NO: 161421 - protein, 40 aa, Heterodera glycines
  misc_feature (4)..(4): Xaa can be any naturally occurring amino acid
  Coding regions on vcDNA: vcDNA=SeqID_87844; Strand=+; Position=33-152
EARXYLQLKEGESDRKRRNLLITPLNWQMPSLRFPPPPLS

SEQ ID NO: 161422 - protein, 106 aa, Heterodera glycines
  Homolog annotation: Hit_ID=NP_493307.1; Match level="QueryCoverage =90%, HitCoverage=4%, E-value=5e-16, Identity=41%"; Hit description =cdc42 guanine nucleotide exchange factor zizimin 1 (1N773) [Caenorhabditis elegans] emb|CAB07369.1| Hypoth
  Coding regions on vcDNA: vcDNA=SeqID_87845; Strand=+; Position=2-319
DKSVLKRVDVKQLQLFLQGAVMPTVNAGLLAYAETFTAPAQQKRYGNKGLLRLWNALKTLLDELDEAMRVNEATMGNERREYQQMLRNAYENTVEKLNRAFARGRE

SEQ ID NO: 161423 - protein, 145 aa, Heterodera glycines
  Coding regions on vcDNA: vcDNA=SeqID_87846; Strand=+; Position=1-435
IILFHSILLFLQNVTFFSPFLFFIFTFVILLLICAFLPQISEVENEIAEFIHRNPLAIDHRIALVQLIFEHQTELILANEQISFPKNISLDDLAFPYEMLVSKITSENFEELAQNLRKNALKLAKESTGKFHFLTENHFYGQFIN

SEQ ID NO: 161424 - protein, 68 aa, Heterodera glycines
  Coding regions on vcDNA: vcDNA=SeqID_87847; Strand=-; Position=54-260
KIGNILPKNKIFNKYCLALLSLIHAAFSTSFLPSFSMKNSMENVFGSRFCAFRQSVHIFHDLFKFSAE

SEQ ID NO: 161425 - protein, 117 aa, Heterodera glycines
  Homolog annotation: Hit_ID=CAE68824.1; Match level="QueryCoverage =98%, HitCoverage=15%, E-value=2e-30, Identity=53%"; Hit description =Hypothetical protein CBG14783 [Caenorhabditis briggsae]
  Gene Ontology: Mol. function=long-chain-fatty-acid-CoA-ligase activity; Biological process=gametogenesis
  Coding regions on vcDNA: vcDNA=SeqID_87848; Strand=+; Position=2-355
HPNVDTFAFMGNPQKDYLIALVVPNRKNLQALAEKNAVNESSWEAICANKEMAKLLEKELQNFVFWKLRREEIPRKVIICAEPWTADSGMLTEALKLKRKNIERKFAEEIRQLYEGK

SEQ ID NO: 161426 - protein, 63 aa, Heterodera glycines
  misc_feature (42)..(42): Xaa can be any naturally occurring amino acid
  Homolog annotation: Hit_ID=CAE68824.1; Match level="QueryCoverage =95%, HitCoverage=8%, E-value=4e-14, Identity=61%"; Hit description =Hypothetical protein CBG14783 [Caenorhabditis briggsae]
  Coding regions on vcDNA: vcDNA=SeqID_87849; Strand=+; Position=43-235
LLEKELQNFVSWKLRRDEIPRKVIICAEPWTADSGMLTEALXLNRKNIERKFAEEIRQLYEGK

SEQ ID NO: 161427 - protein, 53 aa, Heterodera glycines
  Coding regions on vcDNA: vcDNA=SeqID_87850; Strand=+; Position=2-163
DGNGTHAQPRESKCSPSWTALTLPNSLRIGNQSGCSQNRCPPLIAGHILTTAI

SEQ ID NO: 161428 - protein, 61 aa, Heterodera glycines
  Coding regions on vcDNA: vcDNA=SeqID_87851; Strand=+; Position=3-185
NNRKETFGLIEYPSMAALTKYRILCANIGNYSFPTEICASAFVVHELLCMRMNRAPRARYD

SEQ ID NO: 161429 - protein, 150 aa, Heterodera glycines
  misc_feature (43)..(43): Xaa can be any naturally occurring amino acid
  misc_feature (143)..(143): Xaa can be any naturally occurring amino acid
  Homolog annotation: Hit_ID=CAD38524.1; Match level="QueryCoverage =99%, HitCoverage=83%, E-value=3e-64, Identity=81%"; Hit description =putative glutathione peroxidase [Globodera rostochiensis]
  Gene Ontology: Mol. function=glutathione peroxidase activity; Cellular component=cytosol; Biological process=establishment and/or maintenance of chromatin architecture
  Coding regions on vcDNA: vcDNA=SeqID_87852; Strand=+; Position=8-454
MSSSSSAAPSDPQQKSIYEFSAKDIDGNETSFGKYRGKVLLVXNVASNCGFTDSNYSQLKQLLDKYKSKGLEIAAFPCNQFNNQESGCAIDIKDFVTKKYNFEPDLYDKIDVNGPNEHPIYAYLKSVQGGILGFDAIKWNFTXKFLIDKN

SEQ ID NO: 161430 - protein, 52 aa, Heterodera glycines
  Coding regions on vcDNA: vcDNA=SeqID_87853; Strand=-; Position=309-467
NGHCYASEAWGDIPYGSLEGACTFISGSAVVTTHTTSFRCSSVTRMPSQVHA

SEQ ID NO: 161431 - protein, 121 aa, Heterodera glycines
  Coding regions on vcDNA: vcDNA=SeqID_87854; Strand=-; Position=269-634
LCIINTAIKYEIHPISSISMPSSSVRPRRSVQCLCVSMAYLLSGIVDEDLSFVFDDDALGGCMSDLRLSGILVLVEEDDDFHKGSLDINPLGFDEYPPPFDFSVSLSDEEGPSVAERRTYR

SEQ ID NO: 161432 - protein, 76 aa, Heterodera glycines
  Coding regions on vcDNA: vcDNA=SeqID_87855; Strand=+; Position=108-338
SGLLILIYSHLESASSSSSTVPYVCTYFSIYLCRTSILAPTQYRLTFYFTLIWTVMKYKNKSHFHPQKVPICTITA

SEQ ID NO: 161433 - protein, 106 aa, Heterodera glycines
  misc_feature (105)..(105): Xaa can be any naturally occurring amino acid
  Coding regions on vcDNA: vcDNA=SeqID_87856; Strand=+; Position=394-711
RIEFGILLATPNALFSITTSMPNSIKELFSARNNEIINSANDGSDLFGHFTASATKQLRYLETTELRLELVKIQPELSHSFIESLIQLLPDPECLVNVQIVHQNXM

SEQ ID NO: 161434 - protein, 228 aa, Heterodera glycines
  Homolog annotation: Hit_ID=NP_505995.1; Match level="QueryCoverage =96%, HitCoverage=18%, E-value=3e-36, Identity=39%"; Hit description =alpha-mannosidase ii (5M408) [Caenorhabditis elegans] emb|CAB00104.1| Hypothetical protein F58H1.1 [Caeno
  Gene Ontology: Cellular component=Golgi stack
  Coding regions on vcDNA: vcDNA=SeqID_87857; Strand=+; Position=2-716
QPCPKDLSGDSRSGAYLFLPDGPAKPLSADGNSFLVVSGPVRQYVHVKGPVEVGIRHQIALDVHAGHLAILNNVNLATDTRANIELAMRLRVPFMRQDNFFTDLNGFQMIRRRRQPQLPLQAHFYPMPGAAFVEDADIRLSLMGRQALGVANLEKGEMQVMLDRRLVQDDDRGLGQGVEDNLLTESRLHLLLEHFDRFCYTPASSSADGTIALHSLAVHHSSLRLHYP

SEQ ID NO: 161435 - protein, 140 aa, Heterodera glycines
  misc_feature (24)..(24): Xaa can be any naturally occurring amino acid
  Homolog annotation: Hit_ID=AAO33474.1; Match level="QueryCoverage =95%, HitCoverage=96%, E-value=4e-66, Identity=95%"; Hit description =gland-specific protein g4g12 [Heterodera glycines]
  Coding regions on vcDNA: vcDNA=SeqID_87858; Strand=+; Position=1-421
KILLIVLLAVISFRLSASTGDKKXTANDGSGNNSSAGIGTKIKRIVPAGLLFTSLSTGGAEAIGRSNAHGGNAAGLVPSHVTNRSMAPPPPPVQFEMGANRLEKMRAHLHELAEKMPVNESKRLSPSGPDPHHHYGHGWI

SEQ ID NO: 161436 - protein, 143 aa, Heterodera glycines
  misc_feature (33)..(33): Xaa can be any naturally occurring amino acid
  Homolog annotation: Hit_ID=AAO33474.1; Match level="QueryCoverage =94%, HitCoverage=97%, E-value=1e-68, Identity=98%"; Hit description =gland-specific protein g4g12 [Heterodera glycines]
  Coding regions on vcDNA: vcDNA=SeqID_87859; Strand=+; Position=3-432
KDPKKCQHFQILLIVLLAVVSFRLSASTGDKKXTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 161437 - protein, 148 aa, Heterodera glycines
  Coding regions on vcDNA: vcDNA=SeqID_87860; Strand=-; Position=2-448
ASKVISRPICPFNILQNSRSFLIFFAALTRRWWRKRPKGFVVATQTNADIIKVVPTRMFSVAAQIKNAGIVQIVRLFVLPLNHLPNLASLHHPIGILFAHCHRFIASVVDQFKWNNCFVDEQIKLNSVADRRKSMARRNASFKVLTQS

SEQ ID NO: 161438 - protein, 64 aa, Heterodera glycines
  misc_feature (43)..(43): Xaa can be any naturally occurring amino acid
  Homolog annotation: Hit_ID=AAO33474.1; Match level="QueryCoverage =100%, HitCoverage=46%, E-value=2e-16, Identity=71%"; Hit description= gland-specific protein g4g12 [Heterodera glycines]
  Coding regions on vcDNA: vcDNA=SeqID_87861; Strand=+; Position=3-194
IKIIENTGLLFTTLATAGAEAIGRSNAQGRNAARLGPSYVTIXSMAPPPPTVQFAMWAKRVKKM

SEQ ID NO: 161439 - protein, 149 aa, Heterodera glycines
  misc_feature (40)..(40): Xaa can be any naturally occurring amino acid
  Homolog annotation: Hit_ID=AAM50038.1; Match level="QueryCoverage =100%, HitCoverage=63%, E-value=2e-81, Identity=98%"; Hit description= putative gland protein G27D09 [Heterodera glycines]
  Coding regions on vcDNA: vcDNA=SeqID_87862; Strand=+; Position=2-450
QKLAIAKTAAQVKEIKSPAKPMVLKAVPPHQMHLMNEKVXTAVSPPAHARSLATVPYSTPMAADRNSLPSYTSDGTNLDMAHENDDYQNYYYGTEDSSREFDASAEEEDELYEEGDGAMSWQTDDYGIGIGQEYGHQSVEVPPKSVMLD

SEQ ID NO: 161440 - protein, 231 aa, Heterodera glycines
  misc_feature (26)..(26): Xaa can be any naturally occurring amino acid
  Homolog annotation: Hit_ID=NP_505818.1; Match level="QueryCoverage =98%, HitCoverage=60%, E-value=1e-123, Identity=98%"; Hit description= actin (41.8 kD) (act-2) [Caenorhabditis elegans] emb|CAB04675.1| Hypothetical protein T04C12.5 [Caenorha
  Gene Ontology: Mol. function=structural constituent of cytoskeleton; Cellular component=cytoskeleton; Biological process=reproduction
  Coding regions on vcDNA: vcDNA=SeqID_87863; Strand=+; Position=3-694
SGVATYAPLNPKANREKMTQIMFETXNTPAMYVAIQAVLSLYASGRTTGIVLDSGDGVTHTVPIYEGYALPHAILRLDLAGRDLTDYLMKILTERGYSFTTTAEREIVRDIKEKLCYVALDFEQEMATAASSSSLEKSYELPDGQVITVGNERFRCPEALFQPSFLGMESAGIHETSYNSIMKCDIDIRKDLYANTVLSGGSTMYPGIADRMQKEITALAPSTMKIKIIAP

SEQ ID NO: 161441 - protein, 160 aa, Heterodera glycines
  Homolog annotation: Hit_ID=NP_506352.1; Match level="QueryCoverage =93%, HitCoverage=95%, E-value=3e-47, Identity=60%"; Hit description =transthyretin-like protein precursor family member (17.8 kD) (5O10) [Caenorhabditis elegans] emb|CAB01136
  Coding regions on vcDNA: vcDNA=SeqID_87864; Strand=+; Position=27-509
MLLLRQLCLLLFAVFYLIDARTQSVAVKGRLLCGTAPARNVRVKLYDEDAGVDPDDQLDAGYSDPNGNFQLSGHTSELTNIDVVFKVYHDCDDGIKPGSRKLKFKIPNSYVTDSATPKKTFDIGVLNLETVFKDEERELIVTMKKKRRSHRYQDFLDILP

SEQ ID NO: 161442 - protein, 56 aa, Heterodera glycines
  Coding regions on vcDNA: vcDNA=SeqID_87865; Strand=-; Position=59-229
NSIPGCPLSSFIRAEMRTFRRQSVRIIISLKRHSAAISMFVVDEWCPYCASLQACV

SEQ ID NO: 161443 - protein, 56 aa, Heterodera glycines
  Coding regions on vcDNA: vcDNA=SeqID_87866; Strand=-; Position=2-169
VCPHFNSASSPAGFIANRCRWWYALRTESQSTAPIRRHYHTLSVAMSARIPRHPVG

SEQ ID NO: 161444 - protein, 111 aa, Heterodera glycines
  Coding regions on vcDNA: vcDNA=SeqID_87867; Strand=-; Position=42-377
MLNQPIGEVVATIDHPASAKCFYVRISIEQKVEQFIREDRPVRFVHNFRLEMFQIELDVQLVKWLIIAAAKRFASEAENLVQFVEVKPFQKARTKFGHSSNFFFEKHFRYL

SEQ ID NO: 161445 - protein, 105 aa, Heterodera glycines
  misc_feature (19)..(19): Xaa can be any naturally occurring amino acid
  misc_feature (65)..(65): Xaa can be any naturally occurring amino acid
  Homolog annotation: Hit_ID=NP_495449.1; Match level="QueryCoverage =97%, HitCoverage=25%, E-value=9e-12, Identity=40%"; Hit description =cystathionine gamma-lyase (43.1 kD) (2H346) [Caenorhabditis elegans] gb|AAB93432.1| Hypothetical protein
  Coding regions on vcDNA: vcDNA=SeqID_87868; Strand=+; Position=3-318
LTTYIHNWPVMPKAHDYIXEGNSTTDVLQENLGTLNSASYCQIVRSRLARIVHSDTIMLNSGQHXILIGDYYGSTNHNLYIINEPHHVLELTFVYLTLLQNSENE

SEQ ID NO: 161446 - protein, 125 aa, Heterodera glycines
  misc_feature (53)..(54): Xaa can be any naturally occurring amino acid
  Homolog annotation: Hit_ID=CAG06903.1; Match level="QueryCoverage =86%, HitCoverage=25%, E-value=3e-19, Identity=46%"; Hit description =unnamed protein product [Tetraodon nigroviridis]
  Gene Ontology: Mol. function=aminoacylase activity; Cellular component=cytosol; Biological process=amino acid metabolism
  Coding regions on vcDNA: vcDNA=SeqID_87869; Strand=+; Position=2-379
GVQTKGNPAQYVEYRDMRVTPTDDQQQMEAMIANRCKEAGPDDTYEHGPKGMXXELTPTDASCPRRHAHWSALSEQKCAFSKEIFIGGTDTHRLREKGMPAIGKSPTKNTPILLHDHNEFRNEGG

SEQ ID NO: 161447 - protein, 179 aa, Heterodera glycines
  Homolog annotation: Hit_ID=NP_499756.1; Match level="QueryCoverage =75%, HitCoverage=67%, E-value=8e-18, Identity=35%"; Hit description =polyposis locus protein 1 family member (3O468) [Caenorhabditis elegans]
  Gene Ontology: Cellular component=membrane; Biological process =membrane organization and biogenesis
  Coding regions on vcDNA: vcDNA=SeqID_87870; Strand=+; Position=13-552
MSSDESTTSSASVVSVPLREVPIKDFKDVLPVLQKTLNELEHPFIKKAEEISGMEREKLFYITSSLVLLVLMLCPGNMLLSTLITVAYPMYASLLTLNTQNTSEYTQWLVYWCVFAEFCQFDYLFGSINGLLLLYVPLKTVFLLYLALPQTYGAHNLYVKHIRKVLAVTNVLDKMKKMF

SEQ ID NO: 161448 - protein, 138 aa, Heterodera glycines
  misc_feature (44)..(44): Xaa can be any naturally occurring amino acid
  misc_feature (47)..(47): Xaa can be any naturally occurring amino acid
  Homolog annotation: Hit_ID=XP_415880.1; Match level="QueryCoverage =70%, HitCoverage=23%, E-value=1e-21, Identity=56%"; Hit description =PREDICTED: similar to hypothetical protein DKFZp566I133 [Gallus gallus]
  Coding regions on vcDNA: vcDNA=SeqID_87871; Strand=+; Position=12-425
TPPAPHPQTTAPARTARRGTRRNAVGVHTGTARAPPPHRTGTGXHTXLPEEGPHIARETLAAYECKTMDPPEPPYTDEDTGPTEATGHPTTVTLWTIIAKERTETHMRGAGTAPGEAPPSYKARAARPSGHQPDSEEQ

SEQ ID NO: 161449 - protein, 257 aa, Heterodera glycines
  misc_feature (213)..(214): Xaa can be any naturally occurring amino acid
  misc_feature (236)..(236): Xaa can be any naturally occurring amino acid
  misc_feature (257)..(257): Xaa can be any naturally occurring amino acid
  Homolog annotation: Hit_ID=CAE63458.1; Match level="QueryCoverage =99%, HitCoverage=28%, E-value=4e-85, Identity=63%"; Hit description =Hypothetical protein CBG07921 [Caenorhabditis briggsae]
  Gene Ontology: Mol. function=calcium-transporting ATPase activity; Cellular component=integral to membrane; Biological process=calcium ion transport
  Coding regions on vcDNA: vcDNA=SeqID_87872; Strand=+; Position=40-809
MLKGAIDRVLGMCVGYLDNGVAHRPLDVQRREHILHLATGLGQSGLRVIAMACGKDMNSLYYVGLVGIMDPPRPGCRQSIETVQNAGVSVKMVTGDALETAISIGTRLNIFNSGDNTLSGAQIDELTDMDLERLIRGVSIFYRSSPRHKLRIVKALQNIGEVVAMTGDGVNDAVALKKSDIGVAMGNGTDVSKEAADMVLINDDFSTIKAAIXXRGKGIYHNITNFVKFQLSTSVXAISLIAISTLFHFENPLNAMX

SEQ ID NO: 161450 - protein, 153 aa, Heterodera glycines
  Coding regions on vcDNA: vcDNA=SeqID_87873; Strand=+; Position=69-530
MDGTFSLGGILRQRECGGFFGIGGGREGNFQSLMLELLHTCGRKKAMLLKVRLPKLDISAINARGKMAELRGISIDLDISKGGWDMQWVDYEKVRPKQTVPEQPQDEDGTFGGRRTMETQTEPPEQKAAQRGEKAEEKPRGQWQEDNRPHAVI

SEQ ID NO: 161451 - protein, 153 aa, Heterodera glycines
  Coding regions on vcDNA: vcDNA=SeqID_87874; Strand=-; Position=2-460
TKIVRARRRPMAFSLAIPALPRRSFRPPFPFCYRQPNAWATRPGRGRMPRCSSRRLSLRVGFCRGECRFVPFCPQFPSSPCHPLLLPSLSTVRPPPPFVALSHFRWPPSKGRRLLRCNWPCIGRTFRKVVLSSSFTDKSSKVTSSWRRTESAP

SEQ ID NO: 161452 - protein, 142 aa, Heterodera glycines; identical to SEQ ID NO: 160068
  Homolog annotation: Hit_ID=AAO33474.1; Match level="QueryCoverage =94%, HitCoverage=97%, E-value=1e-70, Identity=100%"; Hit description= gland-specific protein g4g12 [Heterodera glycines]
  Coding regions on vcDNA: vcDNA=SeqID_87875; Strand=+; Position=3-431

SEQ ID NO: 161453 - protein, 201 aa, Heterodera glycines
  Coding regions on vcDNA: vcDNA=SeqID_87876; Strand=+; Position=1-606
QLLEECGGWTEPNRYKIYFSYRNIEHEHISHENVAELASGSTIGNYFGSIEDVENISATVVRPKFHTVQTQTEDTNNNEMLSNSSFCAEPGADNDMDGSKTEGMTAQELRMIDYERDIERLEIQCSKQHEQLIILSERAKHVELLEEQKVDLQTQTDILRRQNAQLIRDHEELKCLFGGGSISRNGLEELVRSAGQLREKT

SEQ ID NO: 161454 - protein, 60 aa, Heterodera glycines
  Coding regions on vcDNA: vcDNA=SeqID_87877; Strand=+; Position=54-233
CVWMMTQTVGQPTFDHDHDFTPPINHTTNFTLYSLFRLYIITGRQKKTIIHTNYKSKTKK

SEQ ID NO: 161455 - protein, 178 aa, Heterodera glycines
  Homolog annotation: Hit_ID=NP_492582.1; Match level="QueryCoverage =92%, HitCoverage=36%, E-value=1e-39, Identity=47%"; Hit description =zinc metalloproteinase (50.7 kD) (1K288) [Caenorhabditis elegans] emb|CAB03839.1| Hypothetical protein C0
  Gene Ontology: Mol. function=metalloexopeptidase activity; Cellular component=membrane fraction; Biological process=proteolysis and peptidolysis
  Coding regions on vcDNA: vcDNA=SeqID_87878; Strand=+; Position=61-597
MEEEEEGQKSDDGKAEEGQQTKRQIGMDDDEVVAVLGHELGHWKLGHTMLLLTCTEVNLLLMLVIFSLFHQQESLFTAFGFPPAQQQPILIGLLIIGRFVMAPYTELLSVLMNVITRKCEFSADRFSAQLGHASQLCSGLKKMCKDNLSLPIDDVLYSWCNHSHPPIPERIEALKKYE

SEQ ID NO: 161456 - protein, 241 aa, Heterodera glycines
  Coding regions on vcDNA: vcDNA=SeqID_87879; Strand=+; Position=1-723
KKAENYLLKRKSAKSSSSKNRKRPKVTHSHKALVPQAKANGNSIDGTNTEKRGSACASSTAAAKNDGSIPMEDFVLPAQIKEIVPKTDAAEAPLLISEVDDGGTAIEEGPKNDGPSEGSGADETEEKRRSAPPQLTKECLPTMVTGRYREDLIFYTPKARAKIREKEMQRLSSGSSRRKQIFSSLELTESDAISLVGSSTSSSKDQQKMDSDDKSVPPPPKPKDLGQVPVYLTEHQRDLFF

SEQ ID NO: 161457 - protein, 97 aa, Heterodera glycines
  Coding regions on vcDNA: vcDNA=SeqID_87880; Strand=+; Position=1-294
FTKKFCEICRSWIDLFEDKIQVEKLMMHKRCFVCAICDCPLEPGNCSRDDGIIYCQFMCNDRVPVRFCSAHMMLGSGEKCQLLKEKWMKENEEKQEI

SEQ ID NO: 161458 - protein, 175 aa, Heterodera glycines
  Homolog annotation: Hit_ID=CAD38524.1; Match level="QueryCoverage =99%, HitCoverage=98%, E-value=1e-77, Identity=81%"; Hit description =putative glutathione peroxidase [Globodera rostochiensis]
  Gene Ontology: Mol. function=glutathione peroxidase activity; Cellular component=nucleus; Biological process=establishment and/or maintenance of chromatin architecture
  Coding regions on vcDNA: vcDNA=SeqID_87881; Strand=+; Position=4-531
MSSSSSAAPSDPQQKSIYEFSAKDIDGNETSFGKYRGKVLLVVNVASNCGFTDSNYSQLKQLLDKYKSKGLEIAAFPCNQFNNQESGCAIDIKDFVTKKYNFEPDLYDKIDVNGPNEHPIYAYLKSVQGGILGFDAIKWNFTKFLIDKNGKVVERYAPTKEPKNIEKEIEKLLEA

SEQ ID NO: 161459 - protein, 35 aa, Heterodera glycines
  Coding regions on vcDNA: vcDNA=SeqID_87882; Strand=-; Position=2-106
VSPNLSSFFMRYLKINKTKNWDKIKRNEVRKRFQL

SEQ ID NO: 161460 - protein, 122 aa, Heterodera glycines
  misc_feature (97)..(97): Xaa can be any naturally occurring amino acid
  Homolog annotation: Hit_ID=CAE72788.1; Match level="QueryCoverage =99%, HitCoverage=24%, E-value=4e-33, Identity=57%"; Hit description =Hypothetical protein CBG20050 [Caenorhabditis briggsae]
  Gene Ontology: Mol. function=cystine/glutamate antiporter activity; Cellular component=integral to membrane; Biological process=protein complex assembly
  Coding regions on vcDNA: vcDNA=SeqID_87883; Strand=+; Position=3-370
DLAFGDMRYSDTYIAISYWLAIGLAIASLFYFRMKMPNAPRPIKVNLIFPAIFLLGCVALVVIPLVGKPKDTAIGIAIMLTSVPVYLVFICWKERPXLFNKASASITIFCQKLFLVSNEAEK

SEQ ID NO: 161461 - protein, 103 aa, Heterodera glycines
  Coding regions on vcDNA: vcDNA=SeqID_87884; Strand=+; Position=134-442
LLTFFLTEFSRVQKPLMPGGYSRYDQEIFQKETVADFEIETDLSFHGNAALNQRIGAAHPQNTPTALTSNGVQKADPRRPITAGVAPSVMRQQHGPGQKRASR

SEQ ID NO: 161462 - protein, 90 aa, Heterodera glycines
  Coding regions on vcDNA: vcDNA=SeqID_87885; Strand=+; Position=3-275
DREKDAQITLWVDKYAPSTFLDLLTKDETNRIVLLWLRLWDECVFEKRGGKKWEGNHRRIFQRNNANATSLWDNLEERDRTLRNVTAKGH

SEQ ID NO: 161463 - protein, 142 aa, Heterodera glycines
  Homolog annotation: Hit_ID=AAO33474.1; Match level="QueryCoverage =94%, HitCoverage=97%, E-value=9e-70, Identity=99%"; Hit description =gland-specific protein g4g12 [Heterodera glycines]
  Coding regions on vcDNA: vcDNA=SeqID_87886; Strand=+; Position=3-431
KDPKKCQHFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRPSPSGPDPHHH

SEQ ID NO: 161464 - protein, 153 aa, Heterodera glycines
  Coding regions on vcDNA: vcDNA=SeqID_87887; Strand=+; Position=2-460
ALTPSTIRPAPISLAFRPFPHQFFSLTGLRPGGPRRLHPNKRSACFQPYCGASQLSLHSREQFPILSGASSSTAQQQQNNIWGQKATTDLFKNKPEQLPTKKEEPKRSKVISPPDIWPEGMPEQLKARELGLPDPHPIVPPHWLNPPKKKKKK

SEQ ID NO: 161465 - protein, 178 aa, Heterodera glycines
  Homolog annotation: Hit_ID=NP_503408.1; Match level="QueryCoverage =85%, HitCoverage=94%, E-value=8e-20, Identity=36%"; Hit description =putative secreted or extracellular protein precursor (5B870) [Caenorhabditis elegans] gb|AAF60880.2| Hypo
  Coding regions on vcDNA: vcDNA=SeqID_87888; Strand=+; Position=31-567
MYMNSMGSRGASSAAVVASAAALCLFSAMAVVVYGAESAGPKADQAMAAKQFNPSAFPAMPPELEKILPADVVQKLKAVHADMSLNIMQKQDKIDRIMSSLPGEVLDQIPAPPGFERLPDDVKNRLKQINRQTNKAWADKQKELQEYVKTLPQEQRAILMMGPMGGSPPPPPSFGRRR

SEQ ID NO: 161466 - protein, 110 aa, Heterodera glycines
  Homolog annotation: Hit_ID=NP_699259.1; Match level="QueryCoverage =100%, HitCoverage=30%, E-value=4e-33, Identity=64%"; Hit description= threonine aldolase, low-specificity, putative [Brucella suis 1330] gb|AAN33264.1| threonine aldolase, lo
  Coding regions on vcDNA: vcDNA=SeqID_87889; Strand=+; Position=29-358
DPKIERTFNELFERDVAGVLFVGTGTAANALSMAHVNRAGGIIFAHRHAHLIEDECGAPEYFTGGARLVGVSGAEGRIDPEALKEAIQRSPPNPVSMHTGRPMAVPITQS

SEQ ID NO: 161467 - protein, 57 aa, Heterodera glycines
  Coding regions on vcDNA: vcDNA=SeqID_87890; Strand=-; Position=3-173
WPGCAIKNRLAVGHRVKAISPRVHNILYEIVLRACIMVHILMSFRRKGHHQRAENFL

SEQ ID NO: 161468 - protein, 116 aa, Heterodera glycines
  Coding regions on vcDNA: vcDNA=SeqID_87891; Strand=-; Position=59-409
QRRRATPLGRPTRCLKRLPQTVPHDQAQSFAVRGPPPPPLQPPQCGRWIVPGTTTESRDEDVRRSSRGQPSLRMTPPPTAHIAAPRADKSSVQRQSQSSALPPSRQFRRLSPTHKP

SEQ ID NO: 161469 - protein, 230 aa, Heterodera glycines
  misc_feature (30)..(30): Xaa can be any naturally occurring amino acid
  Homolog annotation: Hit_ID=CAE70223.1; Match level="QueryCoverage =74%, HitCoverage=10%, E-value=6e-45, Identity=52%"; Hit description =Hypothetical protein CBG16703 [Caenorhabditis briggsae]
  Gene Ontology: Mol. function=UDP-glucose:glycoprotein glucosyltransferase activity; Cellular component=endoplasmic reticulum; Biological process=protein modification
  Coding regions on vcDNA: vcDNA=SeqID_87892; Strand=+; Position=1-692
ANLIVPDPWMVQPVRAVHDLDNIRVASASXDIVAVFQLRHILLDGHCFEDPSGNPPRGLQFVLGTRVEPALFDTIVMANLGYFQLKAGPGAWILRLRDGRSKQIYALKSSVDAENIGIFGQTEAGANGGEGGGEGDVEELHVLVDSFSGRTIRVRVEKRKGMERKSLLSEEKDQKQQQATGAEDGTDAVDELDEEEAEEDNSIWSNLAPKKVVKKIVQQIDGHRSIVRSD

SEQ ID NO: 161470 - protein, 139 aa, Heterodera glycines
  Coding regions on vcDNA: vcDNA=SeqID_87893; Strand=+; Position=1-420
DLVLSDAPSRIGTDGKGKANVGGRARSVRRVLRLLLRRLRRPPLARTHFGRARIPKLPSHRHLLSLKLKYQMQFNRQQKKCSKYFTSIFISDWTIKRKLNFFSNKNYNYYFRLLNYIRILINFKMTNPLVFKIFIFCFR

SEQ ID NO: 161471 - protein, 32 aa, Heterodera glycines
  Coding regions on vcDNA: vcDNA=SeqID_87894; Strand=-; Position=1-96
LGGHGGLVQVVPLVRRESEIIHRRELSSTPLV

SEQ ID NO: 161472 - protein, 246 aa, Heterodera glycines
  Homolog annotation: Hit_ID=NP_957199.2; Match level="QueryCoverage =96%, HitCoverage=22%, E-value=2e-38, Identity=36%"; Hit description =importin 7 [Danio rerio] gb|AAH66524.1| Importin 7 [Danio rerio]
  Gene Ontology: Mol. function=RAN protein binding; Cellular component =cell cortex; Biological process=signal transduction
  Coding regions on vcDNA: vcDNA=SeqID_87895; Strand=+; Position=4-741
MWADDVEEFLRFKYDVYEDLHHPSSAASTLLQMLCKRQGIMDSLLVFIIENLSSTSDVRQADGALHMVAIVSSQLLKLKKYRKDVEKLLDAHVIPRTAHQNRFVRLRACYVLHYASETPFKNSRILDRAIHSLVKCLKDDTELPVRVQAAIAIQSLINDHSQKGTVVQIVRPHISDLLINVLKLVKETRVEDLPAVVDALIENFEEDVIPIAYDVTVQLVQTFHAMVVGQEDGNEEDRIAEDYSVG

SEQ ID NO: 161473 - protein, 80 aa, Heterodera glycines
  Coding regions on vcDNA: vcDNA=SeqID_87896; Strand=-; Position=2-241
SSNELFDRGYKEQRIQLKVKGHFTFCWGTFLRRLRKQQHLKQSFTSLCSSSCYDLGLGASRFPPSLLRLSLPPAGTEARP

SEQ ID NO: 161474 - protein, 126 aa, Heterodera glycines
  misc_feature (25)..(25): Xaa can be any naturally occurring amino acid
  Coding regions on vcDNA: vcDNA=SeqID_87897; Strand=-; Position=226-606
FFFFFFFWVFFFFFFFFFFFFFFFXEQGEYFTDEYYTYCTYRVHIRTYIPLYKYIRITEQWDTNMITQMTSYGDHNTWHLTAVGYAHRAEWCGRSCSGTRGNWCGSGSSDTSSGDGTDGCSRASSA

SEQ ID NO: 161475 - protein, 173 aa, Heterodera glycines
  Homolog annotation: Hit_ID=NP_508181.1; Match level="QueryCoverage =60%, HitCoverage=18%, E-value=3e-28, Identity=55%"; Hit description =glucose transporter 1A (XB557) [Caenorhabditis elegans] gb|AAA82340.1| Hypothetical protein F53H8.3 [Caen
  Coding regions on vcDNA: vcDNA=SeqID_87898; Strand=+; Position=3-524
QNFAVTPHRRSDRYMCAYGVGCAIPWLISSEIFPTKFRAAAVTVAVTVAWSLSFVVSTCYLPFQQIVGTSFSFVPFILVSAGGAVFVYCLLPETRGKRATDIVREIRQRVKSISHGQSPFAEGSAEAATTTAQPNGQMSELTALLRLQRQKTLQKQQQKNSWHDGYMSMDNNA

SEQ ID NO: 161476 - protein, 232 aa, Heterodera glycines
  misc_feature (175)..(175): Xaa can be any naturally occurring amino acid
  Homolog annotation: Hit_ID=AAH74569.1; Match level="QueryCoverage =100%, HitCoverage=54%, E-value=4e-56, Identity=49%"; Hit description= MGC69518 protein [Xenopus tropicalis] ref|NP_001004807.1| MGC69518 protein [Xenopus tropicalis]
  Gene Ontology: Mol. function=heat shock protein activity; Cellular component=cytosol; Biological process=G1 phase of mitotic cell cycle
  Coding regions on vcDNA: vcDNA=SeqID_87899; Strand=+; Position=5-703
CSGEGVMVDEKDRCKKCVGRKTVQEQKIIEVKITPGMRDNQKIVFYGEGDQEPGIEPGDVVLVIKTKSHEQFERKGDDLFMKKTVSLADALCGFTTTIKHLDGRQITLTTMPGDIIKPESIRGAIQEGMPKPNSPERGNLYIIFEVKFPKKHFLDSESKYNKLLSLLPPRPDQPXIAPNSEVEEVTLTEFDPRRYDRSSGGGGGREAYHDDSSDDEVPTGPGGAQHVQCQQQ

SEQ ID NO: 161477 - protein, 246 aa, Heterodera glycines
  misc_feature (223)..(223): Xaa can be any naturally occurring amino acid
  Coding regions on vcDNA: vcDNA=SeqID_87900; Strand=+; Position=56-793
SCPFIPAFPIKMSQFGPAFAVNANNPYAHFKCCCATFNIKDHAQFCGVLSFALFLCLVLISMMLFGSLSLFYIFVGVVVYILLMKTLFGVVNKLSLLFYIFFEAIQIGFYLALMLYIIVPLLFLEIPRRNCRNVEINSEICDEPRNRSEDYVELLLFVSLLASIKLHFARVFAHFYRYLTWNEQCSVHRAQYINGRGIHITMDQPQFAASFSPYYGWDTHTVXGCDRRGQQNETNNPNQLPITELP

SEQ ID NO: 161478 - protein, 85 aa, Heterodera glycines
  Coding regions on vcDNA: vcDNA=SeqID_87901; Strand=-; Position=126-383
DSVVQQRRHSTCPSSQVGQFAPSHQLRCCYCCCSCHCPSAHHFEIGPMGKAPLQTACQLWHRFCGNNRSSPSKTNPSSSLWHFRR

SEQ ID NO: 161479 - protein, 97 aa, Heterodera glycines
  Coding regions on vcDNA: vcDNA=SeqID_87902; Strand=+; Position=27-317
LRIRTSRIRQHIVDSGFSRWGHASERPGLHPQHNERDIGCVGPPRKEMHPLSEQIPIKRAQLRQFQPSQGPEEAWSHLGIMPTMREELWNNPMTSIY

SEQ ID NO: 161480 - protein, 97 aa, Heterodera glycines
  Homolog annotation: Hit_ID=CAE67866.1; Match level="QueryCoverage =100%, HitCoverage=61%, E-value=3e-30, Identity=63%"; Hit description= Hypothetical protein CBG13458 [Caenorhabditis briggsae]
  Coding regions on vcDNA: vcDNA=SeqID_87903; Strand=+; Position=1-291
PKLVNPDELTKRTGALYYKLDLEDQVALSKRIAIMKLERNFTKEDTYTLDAQTTNDFKEKIAELFEETESDEDQARMVLEGSAYYDVEAKDGVWIRI

SEQ ID NO: 161481 - protein, 160 aa, Heterodera glycines
  misc_feature (95)..(95): Xaa can be any naturally occurring amino acid
  Homolog annotation: Hit_ID=CAE74055.1; Match level="QueryCoverage =90%, HitCoverage=34%, E-value=6e-34, Identity=51%"; Hit description =Hypothetical protein CBG21707 [Caenorhabditis briggsae]
  Gene Ontology: Mol. function=ATPase activity; Cellular component=26S proteasome; Biological process=ATP-dependent proteolysis
  Coding regions on vcDNA: vcDNA=SeqID_87904; Strand=+; Position=12-491
MFPNQFGNCSKWIVHCQGGDWDRKNRLRSYEALYKMAIREMRGAALLFLLVVSTFDAYELMSYEDLTFYTVICCVDALDRPDSKEKVVNCSEIQXQLNAEPTDKNRHLPLAKQLLTTFYRSESAQFFTALVELDQYMKQDRYLRPHYQFYSRAMRVRAYQ

SEQ ID NO: 161482 - protein, 158 aa, Heterodera glycines
  misc_feature (18)..(18): Xaa can be any naturally occurring amino acid
  Homolog annotation: Hit_ID=AAH78488.1; Match level="QueryCoverage =56%, HitCoverage=20%, E-value=8e-11, Identity=40%"; Hit description =LOC446918 protein [Xenopus laevis]
  Coding regions on vcDNA: vcDNA=SeqID_87905; Strand=+; Position=2-477
QGNAKKLDARKMVLYSSXDSTLLGLLSVLNVKVPSNALDLPPYSACAMIELYEERQNARGNKNFFVKLFYRRNQILEPMAIAGCEAKCDLINFLQILEPRSIRGGEEELKILCDEKVPNSAARRMGNIPGFAKSLIIAIFISIAAINHGTQSTVINVR

SEQ ID NO: 161483 - protein, 195 aa, Heterodera glycines
  misc_feature (17)..(17): Xaa can be any naturally occurring amino acid
  Homolog annotation: Hit_ID=ZP_00195010.1; Match level="QueryCoverage =97%, HitCoverage=53%, E-value=3e-70, Identity=66%"; Hit description =COG2008: Threonine aldolase [Mesorhizobium sp. BNC1]
  Coding regions on vcDNA: vcDNA=SeqID_87906; Strand=+; Position=2-585
PAYGASVLDRKIERTFXQVFERDVAVFFVGTGTAANALSMAYVNRAGGIIFAHRHAHLIEDECGAPEYFTGGARLVGVSGAEGRIEPEALEEAIQRYPPNPVSVHAGRPMAVSITQSTESGTLYSLAQIRRIANIAHSHGIPLHMDGARFANAMAALGCTAAEMSWKSGVDILSFGASKNGCWCAEAILVFNDLA

SEQ ID NO: 161484 - protein, 150 aa, Heterodera glycines; identical to SEQ ID NO: 159235
  Homolog annotation: Hit_ID=CAE70434.1; Match level="QueryCoverage =99%, HitCoverage=33%, E-value=9e-33, Identity=47%"; Hit description =Hypothetical protein CBG17010 [Caenorhabditis briggsae]
  Gene Ontology: Mol. function=cytochrome P450 activity; Cellular component=endoplasmic reticulum; Biological process=electron transport
  Coding regions on vcDNA: vcDNA=SeqID_87907; Strand=+; Position=14-466

SEQ ID NO: 161485 - protein, 194 aa, Heterodera glycines
  Coding regions on vcDNA: vcDNA=SeqID_87908; Strand=+; Position=3-587
PPIWEEEELSTAVSEEHIEDSEHAHSVEPTELQFLDESVADEEAVLGSEITLHQHKMEKEEETTFEEHDDMTAPKSVFGSSSFGCNKREHCKSDDEDYCHSACEEGPTEETKNHSPPEESSKEKEGEQAEDTGTGMTDIVEAEALTEPGTPLRQMDETTNSQRNEEETCPIREEEQQTKTEENSTEATEEGRRS

SEQ ID NO: 161486 - protein, 233 aa, Heterodera glycines
  misc_feature (220)..(220): Xaa can be any naturally occurring amino acid
  Coding regions on vcDNA: vcDNA=SeqID_87909; Strand=+; Position=24-722
MEAEFHNRRRHWLKVEKLYKGIFVAQLWKELEVQEGHTSFEHPEDIASLPTTLLTDLLTKQLTAVEECKSVTSMPIQLCEHGRIKPGPFIRGEIKAVNTSAARRLIREFNVNTTLYTGANICINCCSRLRDHQETRRRGRTEAILYYPEGATLFIKLNGDENDGNTTKGKKTTTGPSAAVTRRAASKGLIKIRICSDETINALKLRIYEKIDQSPVDQLXYMGGQVLDGNTLE

SEQ ID NO: 161487 - protein, 102 aa, Heterodera glycines
  Coding regions on vcDNA: vcDNA=SeqID_87910; Strand=+; Position=115-423
TPANRKRSISCIFFTPIGCTVKNHQKPPLRKRSVADGSGDRENGTAATINWAKADLSVWLNAYKNVSSPADSFAAVINSVKALAPDQWLLFKVHNTSSDNRQ

SEQ ID NO: 161488 - protein, 150 aa, Heterodera glycines
  Homolog annotation: Hit_ID=CAE63460.1; Match level="QueryCoverage =56%, HitCoverage=82%, E-value=9e-14, Identity=46%"; Hit description =Hypothetical protein CBG07924 [Caenorhabditis briggsae]
  Coding regions on vcDNA: vcDNA=SeqID_87911; Strand=+; Position=52-504
MVVAKNICRTKRPFSDLNLLLFLSFVLCSEFIPATNANENGRSAPWGRRGAFKVIAFRPRRALDILESDGFGGFRKRALDVMDGDGFGSFQKRALDSLEGDDFMGLKKKKALTTADGDDFTDLGKRALDVLDGDDFVGFRKRSEMQKIKT

SEQ ID NO: 161489 - protein, 137 aa, Heterodera glycines
  Coding regions on vcDNA: vcDNA=SeqID_87912; Strand=+; Position=52-465
WTFDNGAVPELIKLYFDGGPEDNERQLTLRMCAAPCLCDGLPCECKLTVCYVGLMDPATEAIQSQFFLENFEKDNEIANDCKQAQKKWKAFNGQVLHGFRLEYDADLHTLKVSTSINSTRKVRSNAQANDVKRANLL

SEQ ID NO: 161490 - protein, 154 aa, Heterodera glycines
  misc_feature (135)..(135): Xaa can be any naturally occurring amino acid
  Coding regions on vcDNA: vcDNA=SeqID_87913; Strand=+; Position=240-701
FGTTKKRNNAINSSGNYPIGGVELCFYFVVWLSHSLLAFLLATNASRSVGHWLDHWLEPSSYSRALRMDNSDIELKLFRQSLPNVLGAFAINSVVFRLIFRLGMSKNGRSLLLISVWFALNAYLASVRCLLLVIXATFVLLSVTLLSNCQLFAW

SEQ ID NO: 161491 - protein, 235 aa, Heterodera glycines
  Homolog annotation: Hit_ID=AAM50038.1; Match level="QueryCoverage =100%, HitCoverage=100%, E-value=1e-127, Identity=97%"; Hit description=putative gland protein G27D09 [Heterodera glycines]
  Coding regions on vcDNA: vcDNA=SeqID_87914; Strand=+; Position=48-755
MVCLVMAVLMEMANSKAVKKYNKKGAVAASPAKGKASPKGGKSPAKGKAAKKLKPKKDAKGIKAKKAKPAKKSKAAKAVKGAPKTVKKLAFAKTAAQVKEIKSPAKPMVLKAVPPHQMHLMNEKVQTAVSPPAHARSLATVPYSTPVAADRNSLPSYTSDGTNLDMAHENDDYQNYYYGTEDSSREFDASAEEEDELYEEGDGAMSGQTDDYGIGIGQEYGHQSVEVPPKSVMLD

SEQ ID NO: 161492 - protein, 239 aa, Heterodera glycines
  misc_feature (225)..(225): Xaa can be any naturally occurring amino acid
  Homolog annotation: Hit_ID=NP_510091.1; Match level="QueryCoverage =92%, HitCoverage=50%, E-value=3e-61, Identity=55%"; Hit description =zinc transporter ZnT-8 family member (XN84) [Caenorhabditis elegans] emb|CAA92193.1| Hypothetical protein
  Gene Ontology: Mol. function=zinc porter activity; Cellular component= synaptic vesicle; Biological process=transport
  Coding regions on vcDNA: vcDNA=SeqID_87915; Strand=+; Position=9-728
MCVFWVEMRKILDTNVSYLSMGLLLYLGGHSHSHSHHGHGTHSQRQTDRTNFAEHEWGTVDGRPGQNGGNRQTHGTRRQTNINVRAAFVHVLGDLIQSVGVLFAGLLIYWKPNWHILDPICTLLFSAIVLSTTIYIIRDALVVLLEGRPSTIDFRHVFDALEHIEGVKKVHDLRIWALTMDKVAISVHLEVESAADSQQILRATTLMLRRDFNVHESTIQIEGYXPETANCGQCVVPTK

SEQ ID NO: 161493 - protein, 224 aa, Heterodera glycines
  misc_feature (200)..(201): Xaa can be any naturally occurring amino acid
  Homolog annotation: Hit_ID=AAP30757.1; Match level="QueryCoverage =100%, HitCoverage=94%, E-value=1e-112, Identity=92%"; Hit description=putative gland protein 30G12 [Heterodera glycines]
  Coding regions on vcDNA: vcDNA=SeqID_87916; Strand=+; Position=49-720
MSNFIFVAFLTAAFFSSGLALPAPYDAESVVSSELNVSLLSADANVEAAITNESDAAAEIQAPSIPVPIEHQTAADITHPTETGNESSIASSSSTPKSEQTPKKVMNMKSAMEGAAANVYGWLPLDQQPKTIAEAAAKAKQTPAKLPADYDVNRVAERAAARVYGWLPEDKQPKAIYDAAEKAKNTPKPPGDYDVERVAXXAARLVYGVLPIGMQPSFAGPSTD

SEQ ID NO: 161494 - protein, 225 aa, Heterodera glycines
  Homolog annotation: Hit_ID=CAE59495.1; Match level="QueryCoverage =88%, HitCoverage=55%, E-value=6e-45, Identity=46%"; Hit description =Hypothetical protein CBG02880 [Caenorhabditis briggsae]
  Gene Ontology: Mol. function=protein tyrosine kinase activity; Cellular component=membrane; Biological process=protein amino acid phosphorylation
  Coding regions on vcDNA: vcDNA=SeqID_87917; Strand=+; Position=59-733
MLQAHQYQLRQGHRRVSARSILAHFGFEFSNDYRLGCGHYSKVYKGYFKEAQRTFAIKVTDLESVSEKFKQKFLPRELEVWRELDHPNLVYLYKDFQWNNYQFAVMELVVGGDLFLQKCGHVSETTCHNWMLQIVAALDYLHRKGIAHRDLKLENVLLCENGVIKVTDYGFSKQSSDLSSTFCGSRSYSSPENLLGIAYDMFKSDIWSLGVTAFIMITNTMPFHE

SEQ ID NO: 161495 - protein, 174 aa, Heterodera glycines
  Coding regions on vcDNA: vcDNA=SeqID_87918; Strand=-; Position=2-523
FTHKRRERKGRNHYRNKTKGVQIRRQKSVKFPSLFTHCAPTHCSLPLLFLPPHHHPLLFSFVISLVPSVALRRLRPSTTASTSTMFLPTAPAFAAPIVRHGLARHRLNSFDPFGALNPAIRHTTTTPIDGCSLTGVQLLMGLPPIVRVSEGRVPRVEQFSLALLLLLSNFVHFF

SEQ ID NO: 161496 - protein, 96 aa, Heterodera glycines
  misc_feature (84)..(85): Xaa can be any naturally occurring amino acid
  Coding regions on vcDNA: vcDNA=SeqID_87919; Strand=+; Position=251-538
PGRTFIWLDVPFCFLSIVILNPFVLSFLPYLLQHLHLHSFINVILNLFNNYFQLMIIYGVDYFCVCHCLSVILSENTNKSRCRXXKKKTKKKKNKT

SEQ ID NO: 161497 - protein, 228 aa, Heterodera glycines
  misc_feature (217)..(217): Xaa can be any naturally occurring amino acid
  Homolog annotation: Hit_ID=AAM97979.1; Match level="QueryCoverage =99%, HitCoverage=19%, E-value=1e-108, Identity=85%"; Hit description= Membrane calcium atpase protein 3, isoform c [Caenorhabditis elegans]
  Gene Ontology: Mol. function=calcium-transporting ATPase activity; Cellular component=integral to membrane; Biological process=transport
  Coding regions on vcDNA: vcDNA=SeqID_87920; Strand=+; Position=2-686
LTGDGTNDGPALKKADVGFAMGITGTDVAKEASDIILTDDNFASIVKAVMWGRNVYDSIAKFLQFQLTVNVVAVVVSFVGACAIQDTPLKAVQMLWVNLIMDTLASLSLATELPTEDLLKRKPYGRTSPLISRTMMKNIIGHAVYQLTVLFTLIFAGASLFGITTGLYAPLYAPPSQHFTIVFNTFVMMTLFNEINARKIHGERNVFQGMFNNPIYXPFWVFTLILQF

SEQ ID NO: 161498 - protein, 176 aa, Heterodera glycines
  Coding regions on vcDNA: vcDNA=SeqID_87921; Strand=-; Position=2-529
VIINNWWYESCKFVVFPFLKIGKKSEKRVAGGSFKIELVRLFFSVPSSKGSVPSDQFVPPRVFPSVPSDQSVPRGFRSVRSVYSPGLFRPFCFRLSPAAQNGIIACHSAFSPPSSALLNVALKSADSASTVKCPIGSLRFTPSWLNSTTLRTMVVAPHPRPFRHFRAAQTQANPRH

SEQ ID NO: 161499 - protein, 119 aa, Heterodera glycines
  Coding regions on vcDNA: vcDNA=SeqID_87922; Strand=-; Position=1-357
FFFFFFFVDAEFFSLSVLIRFFSIIRDKEIVRQNKNVFFCALPIYWFISRFLKRSVYWSSICSFSVFVLLRLLLLLLLVSLFVFDRLHIVRKPKCPSANVAKILASLRPLLLLLLRLSP

SEQ ID NO: 161500 - protein, 109 aa, Heterodera glycines
  Homolog annotation: Hit_ID=NP_499173.1; Match level="QueryCoverage =99%, HitCoverage=21%, E-value=2e-21, Identity=48%"; Hit description =suppressor of bimD6 (58.6 kD) (3K892) [Caenorhabditis elegans] emb|CAA80180.1| Hypothetical protein ZK632
  Coding regions on vcDNA: vcDNA=SeqID_87923; Strand=+; Position=2-331
TVYVIDLAQAMDISHPSSLRFLHRDITNVLNFFGRIGCEPLPTPHAFFHEVTDIEFDPNKNLYVQVESFERENRNMDLKGAKASPANYELHLHQQESTGRADSPSRPYN

SEQ ID NO: 161501 - protein, 149 aa, Heterodera glycines
  Homolog annotation: Hit_ID=CAE69300.1; Match level="QueryCoverage =97%, HitCoverage=59%, E-value=2e-41, Identity=55%"; Hit description =Hypothetical protein CBG15355 [Caenorhabditis briggsae]
  Gene Ontology: Cellular component=integral to plasma membrane; Biological process=mitochondrial translocation
  Coding regions on vcDNA: vcDNA=SeqID_87924; Strand=+; Position=27-476
MPEGYESGRGKFEFALGYIGCSVIGGFGVGSVRGMFGELGNPQNRTLAWNPWYTRMLNAATKHGSGYAQTAGTAMFLYSVTELGLKLSRADDLLNSFIAGPIAGGLFHGLPHGLRAGGVGALAGLGLVTVWNLCDRDSRRELREILRLS

SEQ ID NO: 161502 - protein, 40 aa, Heterodera glycines
  misc_feature (4)..(4): Xaa can be any naturally occurring amino acid
  Coding regions on vcDNA: vcDNA=SeqID_87925; Strand=+; Position=33-152
EARXFLQLKEGESDRKRRNLLITPLNWQMPSLRFPPPPLS

SEQ ID NO: 161503 - protein, 227 aa, Heterodera glycines
  misc_feature (16)..(16): Xaa can be any naturally occurring amino acid
  Homolog annotation: Hit_ID=CAE63259.1; Match level="QueryCoverage =93%, HitCoverage=73%, E-value=1e-64, Identity=55%"; Hit description =Hypothetical protein CBG07631 [Caenorhabditis briggsae]
  Gene Ontology: Cellular component=membrane; Biological process=lipid metabolism
  Coding regions on vcDNA: vcDNA=SeqID_87926; Strand=+; Position=2-684
TSRPNVYLNALMMLKXGPNSQRNVLPSVVKRDFHFCHLCQSNSPPRSFHCPVCNFCVFRRDHHCSFTGSCVGHFNQRYFVAAVFNLWPVVFSCCVWNWHALLLAFSPISLSDFLKWVFPHMALLFRFVSFHQFFVILAFAFSFITLLFTTYLIFAQIFCFWHGQTRVEYLMDVHAYNLSFRENLSACLGSRWPFIFISPFIPSQLETDGTFFRTREREEIGKSTKYF

SEQ ID NO: 161504 - protein, 232 aa, Heterodera glycines
  misc_feature (61)..(61): Xaa can be any naturally occurring amino acid
  misc_feature (219)..(219): Xaa can be any naturally occurring amino acid
  Homolog annotation: Hit_ID=BAD17922.1; Match level="QueryCoverage =99%, HitCoverage=59%, E-value=1e-84, Identity=67%"; Hit description =phosphoglycerate kinase [Acipenser baerii]
  Gene Ontology: Mol. function=phosphoglycerate kinase activity; Cellular component=cytosol; Biological process=glycolysis
  Coding regions on vcDNA: vcDNA=SeqID_87927; Strand=+; Position=3-699
GFLMKKELEYFAKALESPTRPFLAILGGAKVADKIQLINNLLDKVDEMVICGGMAFTFTKXLTGKSIGKSLFDEEGSKIINDLMAKAKDKNVKIHQPVDFVVGDEFKEGTPFANVDAKDGIPNGKMGLDIGQETLKQFAEVIGRAKTVVWNGPAGVFEWPNFAHGTKGMLEAVIGATKSGATTIIGGGDTATAAEKWGAEDKVSHVSTGGGASLELLEXKVLPGVPALSDAP

SEQ ID NO: 161505 - protein, 215 aa, Heterodera glycines
  Homolog annotation: Hit_ID=S25548; Match level="QueryCoverage=92%, HitCoverage=92%, E-value=2e-40, Identity=38%"; Hit description =surface-associated glycoprotein gp15/400 - nematode (Brugia pahangi) (fragment)
  Coding regions on vcDNA: vcDNA=SeqID_87928; Strand=+; Position=2-646
NFRSVPGRSEALPRNSPRGCESIFKRIFGEYNAEEIIQMRDEGASNVEIEEKITEALNQIRSPQKRQEAGRFAMSCRRIFAMIERRRRSADNAEHSLDQLFKSHLIWLNEQQREELKQMKGSGKGRTEMQQRVMEWYGQLEGQEKQKAREHLRDGCRDILAQVLGKEKADQLKQLREGGMSGTELEAKANEMVDQIQEEEKKAKAKEFGTVCRKI

SEQ ID NO: 161506 - protein, 94 aa, Heterodera glycines
  Coding regions on vcDNA: vcDNA=SeqID_87929; Strand=+; Position=2-283
QTRTQHFLIFFLLLICEMINSFPSKSSESGEPPANGAEVAQSRKKRQAEEVTTEEPPSETNDAEDHQSAAAGNGKAPKNKGTKNKSDSSDSSSS

SEQ ID NO: 161507 - protein, 228 aa, Heterodera glycines
  Homolog annotation: Hit_ID=CAE70800.1; Match level="QueryCoverage =99%, HitCoverage=33%, E-value=1e-103, Identity=81%"; Hit description= Hypothetical protein CBG17560 [Caenorhabditis briggsae]
  Gene Ontology: Cellular component=cytosol
  Coding regions on vcDNA: vcDNA=SeqID_87930; Strand=+; Position=7-690
LLDFVERTTRAFDANVHRVRPHHGQNLVAGRLRALLHSDLNRSEIAESHRHCGKVQDAYALRCVPQVHGVVHDTIAFVKGILETEINSATDNPLVFSEIEEVISGGNFHGEYPAKVLDYLAIAVHELAQMSERRLERLLNHQLSGLPTFLTRNGGLNSGFMTVQLCAASSVSENKVLCHPSSADSIPTSCNQEDHVSMGGFSARKALKIVEHTEAVLAMELMAACQGM

SEQ ID NO: 161508 - protein, 32 aa, Heterodera glycines
  Coding regions on vcDNA: vcDNA=SeqID_87931; Strand=-; Position=52-150
ESDDPSRAPHAEWSTRRKCCVYFRALATHVHV

SEQ ID NO: 161509 - protein, 102 aa, Heterodera glycines
  misc_feature (50)..(50): Xaa can be any naturally occurring amino acid
  Homolog annotation: Hit_ID=G89582; Match level="QueryCoverage=100%, HitCoverage=33%, E-value=4e-24, Identity=55%"; Hit description =protein K07E3.3 [imported] - Caenorhabditis elegans
  Gene Ontology: Mol. function=methylenetetrahydrofolate dehydrogenase (NADP+) activity; Cellular component=mitochondrion; Biological process=coenzymes and prosthetic group metabolism
  Coding regions on vcDNA: vcDNA=SeqID_87932; Strand=+; Position=1-310
SRTERLAEHCREADILIAVAGLRGMVRGDWINPGAVVIDCGINAVHIPGXKRHLVGDVNRDEAKAADGFLTPVPGGVGPMTVAMLVRNTFLQAVCQKLNCRV

SEQ ID NO: 161510 - protein, 176 aa, Heterodera glycines
  Homolog annotation: Hit_ID=Q92076; Match level="QueryCoverage=97%, HitCoverage=25%, E-value=3e-40, Identity=51%"; Hit description=DNA polymerase gamma subunit 1 (Mitochondrial DNA polymerase catalytic subunit) gb|AAC60018.1| DNA polymerase
  Gene Ontology: Mol. function=gamma DNA-directed DNA polymerase activity; Cellular component=mitochondrion; Biological process=DNA dependent DNA replication
  Coding regions on vcDNA: vcDNA=SeqID_87933; Strand=+; Position=18-548
IRTTSPHPPVLKCRLSQALEQIQPAMAVGVQPANLHKFNSIFKRTIANWFVQSSAVDFLHLLLVCMRWLCREYEIPARYVISIHDEVRYLVPEKDKYRCALALSLSNMYVRAAISEALGIRELPRSVAFFSQVDIDSVLRKEVDLECRTPDGKTIEKGEALNIEQIVEHTNGRLGR

SEQ ID NO: 161511 - protein, 260 aa, Heterodera glycines
  Homolog annotation: Hit_ID=NP_495704.1; Match level="QueryCoverage =87%, HitCoverage=55%, E-value=3e-71, Identity=58%"; Hit description =Cystinosin/ERS1p repeat (45.4 kD) (2I426) [Caenorhabditis elegans] emb|CAA88102.2| Hypothetical protein C
  Gene Ontology: Mol. function=cystine transporter activity; Cellular component=integral to membrane; Biological process=cystine transport
  Coding regions on vcDNA: vcDNA=SeqID_87934; Strand=+; Position=3-782
VAWSISFYPQIILNFQRKSVIGLNFDFLLLNVIGFSCYTVYNVLLYFDPNVQRIYIERHGQRSLIPVLINDVVFASHALLACIITGVQCFFYERGNQRISYIGRAWASLLLCFSSVSLALALFRVLNWLDFINYLSYSKMAVTLSKYFPQAILNFKRKSTVGWSIGNVLLDFSGGFMDICQMCLQATNTNDWSAFTGNPVKFGLGLISMLFDILFIIQHYVLYIKKDVNSSSSSNRVDNSHAVTATTLPPPLIAASPMDY

SEQ ID NO: 161512 - protein, 173 aa, Heterodera glycines
  Homolog annotation: Hit_ID=NP_499756.1; Match level="QueryCoverage =78%, HitCoverage=67%, E-value=7e-18, Identity=35%"; Hit description =polyposis locus protein 1 family member (3O468) [Caenorhabditis elegans]
  Gene Ontology: Cellular component=membrane; Biological process =membrane organization and biogenesis
  Coding regions on vcDNA: vcDNA=SeqID_87935; Strand=+; Position=13-531
MSSDESTTSSASVVSVQLREVPIKDFKDVLPVLQKTLNELEHPFIKKAEEISGMEREKLFYITSSLVLLVLMLCPGNMLLSTLITVAYPMYASLLTLNTQNTSEYTQWLVYWCVFAEFCQFDYLFGSINGLLLLYVPLKTVFLLYLALPQTYGAHNLYVKHIRKVLAVTNVLD

SEQ ID NO: 161513 - protein, 256 aa, Heterodera glycines
  Homolog annotation: Hit_ID=NP_495449.1; Match level="QueryCoverage =99%, HitCoverage=64%, E-value=7e-87, Identity=59%"; Hit description =cystathionine gamma-lyase (43.1 kD) (2H346) [Caenorhabditis elegans] gb|AAB93432.1| Hypothetical protein
  Gene Ontology: Biological process=sulfur amino acid metabolism
  Coding regions on vcDNA: vcDNA=SeqID_87936; Strand=+; Position=1-768
PAGNTPEKWDYEPGLSPPISLSTTYKRNWPGMPKGHDYIREGNPTRDVLQESIATLESARHCRIFSSGLAAIAAVSHLLNSGQHVIVSGDCNGGTKNYFDKICVPHHGLELSFVDLTRLENLENEFKPNTKMVLFETPSNPLLKIVDIEAVCRMVRARSKDCVVVVDNTFMTPYFQRPLELGADVTVQSLTKYINGHTDVLMGTVVTNKEQLDQHIYAQQIYAGAVPSAFDAFLVLRGIKTLPLRMRQHMENALAI

SEQ ID NO: 161514 - protein, 90 aa, Heterodera glycines
  Coding regions on vcDNA: vcDNA=SeqID_87937; Strand=+; Position=2-274
IGRVGIVGHRERHPGSFDIVHIKDKVVKGSTNCARLRSRRSVTSKCRTLSRRRANTIRYPDPHIKAQCAICCGPTRTIGAGRRAQLLLAV

SEQ ID NO: 161515 - protein, 187 aa, Heterodera glycines
  misc_feature (40)..(40): Xaa can be any naturally occurring amino acid
  Homolog annotation: Hit_ID=CAE60358.1; Match level="QueryCoverage =91%, HitCoverage=98%, E-value=1e-70, Identity=74%"; Hit description =Hypothetical protein CBG03955 [Caenorhabditis briggsae]
  Gene Ontology: Mol. function=calcium channel regulator activity; Cellular component=cytoplasm; Biological process=regulation of action potential
  Coding regions on vcDNA: vcDNA=SeqID_87938; Strand=+; Position=13-575
EFPKNILPIWSLSSPDIQLIFQSVDRDRSGQISADELNRXLSNGTWKPFNPETCRMMISMFDSNNDGGINFQEFGALWEYINDWTRTFRTFDRDNSGNIDRDELVNALTQFGYRLSGTFYDMLMRKFDRTQSGRINFDDFIQLCVVLQTLTTAFREKDTDRDGWIRIYYEEFLAMVFSLKMSMMAKQ

SEQ ID NO: 161516 - protein, 137 aa, Heterodera glycines
  misc_feature (9)..(9): Xaa can be any naturally occurring amino acid
  misc_feature (11)..(11): Xaa can be any naturally occurring amino acid
  misc_feature (23)..(24): Xaa can be any naturally occurring amino acid
  misc_feature (28)..(28): Xaa can be any naturally occurring amino acid
  misc_feature (34)..(34): Xaa can be any naturally occurring amino acid
  misc_feature (59)..(59): Xaa can be any naturally occurring amino acid
  Homolog annotation: Hit_ID=CAD22154.1; Match level="QueryCoverage =100%, HitCoverage=51%, E-value=2e-67, Identity=75%"; Hit description= pherophorin-dz1 protein [Volvox carteri f. nagariensis]
  Gene Ontology: Mol. function=profilin binding; Cellular component =actin cytoskeleton; Biological process=hearing
  Coding regions on vcDNA: vcDNA=SeqID_87939; Strand=+; Position=1-410
PPPPPPPPXPXPPPPPPPPRSPXXSPRXRPPFLXPPPPFPPLPPPPSPPPPPPPPPPPXPPPPPFPPPPFPPPPLPPPPLPPPPPRPHAPSPPSPAPAPSPPPPPPLPPPSSPPLPPPPPPPAPPPPPPPPPPPPPP

SEQ ID NO: 161517 - protein, 127 aa, Heterodera glycines
  Coding regions on vcDNA: vcDNA=SeqID_87940; Strand=+; Position=113-496
MGIRSKDHHQSHLFLMGVASADDDSVPDPIVIKLGESLSLSQLVQKIEQLQNRTVRELLVTLRRRTYKMPVGPPDPNGDRFFQNGHLLVEDVVYNWVRKTRNSIHGIVQLHVLYEGIAMLDEVNYHF

SEQ ID NO: 161518 - protein, 86 aa, Heterodera glycines
  Coding regions on vcDNA: vcDNA=SeqID_87941; Strand=-; Position=3-260
FVKTMNKIAFLPIDRMNRQSENSMSPTVFSPNVEDEHRSDEHQRHDQHGNRSNFQPGRVLSIKAPQSAAVHSSAPSSASSSSTTSV

SEQ ID NO: 161519 - protein, 55 aa, Heterodera glycines
  Coding regions on vcDNA: vcDNA=SeqID_87942; Strand=-; Position=115-282
LLAVEVSVYLTRVRIGDNSSIMPETPLRMSSTFASVDQCISVMGYQVSFGNYQGS

SEQ ID NO: 161520 - protein, 72 aa, Heterodera glycines
  Coding regions on vcDNA: vcDNA=SeqID_87943; Strand=-; Position=53-271
FLRPFAFYQSVRPSIRTVIINGAVMMKIRSLGICHWLVIIDIVQYLMTKHIIRYVPPDIVKVYLLGRWPAQC

SEQ ID NO: 161521 - protein, 104 aa, Heterodera glycines
  misc_feature (98)..(98): Xaa can be any naturally occurring amino acid
  Coding regions on vcDNA: vcDNA=SeqID_87944; Strand=-; Position=16-330
CRNSPNLLAQFDGVVHFAVNVEYITILLGSQNGVQWHSMSCDGSSSGSPFIVELSLCWSDPILPHPQVVLRLSRFIVELKGVISHVQQLQTMTKSNRXQFDVCP

SEQ ID NO: 161522 - protein, 241 aa, Heterodera glycines
  Coding regions on vcDNA: vcDNA=SeqID_87945; Strand=+; Position=2-724
LFCDFVLFLPPYILPFSFLFTTFREFNLHIFCTKIFWKTNILLMDIQKQNYTEQSLELLSQELRSILLDPNSQMPTETTESNEKKENPEDISSTVFFEHQQELLNETVSSGDEDFRCVSVTSNESEIQEPRLSTPTSQLPTETSDSSGKKENPEDISSTVFFEHQQELLNESVSSGDEDSRCASVTPPESEVQEARLLTPTSQMPTETSNSNGKKENPEDISSTVFFEHQKELLNESVSSG

SEQ ID NO: 161523 - protein, 194 aa, Heterodera glycines
  Homolog annotation: Hit_ID=NP_871650.1; Match level="QueryCoverage =98%, HitCoverage=45%, E-value=3e-78, Identity=69%"; Hit description =ALDH1J1, ALdehyde deHydrogenase (alh-1) [Caenorhabditis elegans] gb|AAN63391.1| Aldehyde dehydrogenase pr
  Gene Ontology: Mol. function=androgen binding; Cellular component =cytosol; Biological process=alcohol metabolism
  Coding regions on vcDNA: vcDNA=SeqID_87946; Strand=+; Position=16-651
HRQCCCAGSRTFVDAKIYDEFIQRSKQIAEKRVLGNPFHLDTDQGPQIDGDQMDKILQYIDQGRKEGAKLITGGKQFGGKGFFVEPTIFAGVEDQMKIAQEEIFGPVMSIIKFDGLKDLVEKANSTIYGLAAGVMTRDLDKALYVANNIRAGTVWVNCYDVFDPAAPFGGYKMSGIGRELGEYGLSAYSEARKI

SEQ ID NO: 161524 - protein, 250 aa, Heterodera glycines
  misc_feature (249)..(249): Xaa can be any naturally occurring amino acid
  Homolog annotation: Hit_ID=CAE68838.1; Match level="QueryCoverage =78%, HitCoverage=40%, E-value=7e-44, Identity=43%"; Hit description =Hypothetical protein CBG14799 [Caenorhabditis briggsae]
  Gene Ontology: Cellular component=membrane
  Coding regions on vcDNA: vcDNA=SeqID_87947; Strand=+; Position=48-797
MVFYSEFMEFVSGENFSKALKKVDANGESESSDAKLNNANKNKRRRSPGGVSSFSMPSPVRAVLSKFLFAAFCAILLLIFGNSSDPAQIVSPWAWRMPWLQWLLLFWFLIFMQRVQYYYAWTMTDAICNISGFGFDGFTSDGKPKWDLTTTVDVWKVETAQSFKETLDGWNLKTMFWLRYIAYERMPKNYRTLSTYALSAVWHGLFMGYYLCFATGALITVAGRMSRRCIRHHFQRNAFLHHLYNLLTXL

SEQ ID NO: 161525 - protein, 94 aa, Heterodera glycines
  Coding regions on vcDNA: vcDNA=SeqID_87948; Strand=+; Position=206-490
SVFPSLPKATDRRNSLKLIIVVINELCPFGLISRSLLLIIRSLPSAPFQSADLSPPPFPRCFSLLISVFSSLSLLLKYKLDGYHGAHVLASSAA

SEQ ID NO: 161526 - protein, 199 aa, Heterodera glycines
  Homolog annotation: Hit_ID=NP_956451.1; Match level="QueryCoverage =89%, HitCoverage=60%, E-value=3e-63, Identity=64%"; Hit description =hypothetical protein MGC55468 [Danio rerio] gb|AAH45350.1| Hypothetical protein MGC55468 [Danio rerio]
  Coding regions on vcDNA: vcDNA=SeqID_87949; Strand=+; Position=3-599
DGPTIAQDPTPSPRRVFLRDLCSLFCCPPLPSAIVAKLAFMPPEPSYRILTSDSGRTTLELIDGRTEWPHGQDELNNVEVFFTRTQRRNKIACMFVRPFELSHFTLLFSHGNAVDIGQMCNFYLGLGCRLRCNVFSYDYSGYGQSTGRPSEKNLYADIAAALKSLESRYQIPPEQVILYGQSIGTVPSIDLASCYPRIA

SEQ ID NO: 161527 - protein, 167 aa, Heterodera glycines
  Coding regions on vcDNA: vcDNA=SeqID_87950; Strand=+; Position=183-686
WKKTTGGSLQIVLKSILCAMAPLLRIGLFAVDIFAIIGSHFYAHLSSDSSLSVITKSPDFNDAAEFVATFKSMTDASADVLDKISNIGNGAFTLLKFAGPIGQMVHIGLSIGLKQQDSPELRAIQALQRQITEQFETLFRKIDDSIVPQEYRDLMTDYQKMSLFLFF

SEQ ID NO: 161528 - protein, 210 aa, Heterodera glycines
  Homolog annotation: Hit_ID=AAH82373.1; Match level="QueryCoverage =91%, HitCoverage=26%, E-value=5e-11, Identity=27%"; Hit description =MGC81656 protein [Xenopus laevis]
  Coding regions on vcDNA: vcDNA=SeqID_87951; Strand=+; Position=32-664
MAEIDMAEFEGAGERYKFLIQPVKDLAANWDLDIAKTLEDYIRKVVAETKRIDAEAPDDEYRRHKVFNFAEAALLIHGTTTVYARKVDYVLQKAQNFFDQLREDENIHHQQQQKGKRRKDDPLEEGAEATGEEMDENANADDAGEGREKRQPKANQINYASLGHLLDRLIVSQRRTSLLPVVPIAFFSLTDFEKRNVSLCTRTNPTEVFG

SEQ ID NO: 161529 - protein, 209 aa, Heterodera glycines
  Homolog annotation: Hit_ID=CAG01478.1; Match level="QueryCoverage =68%, HitCoverage=13%, E-value=4e-24, Identity=40%"; Hit description =unnamed protein product [Tetraodon nigroviridis]
  Coding regions on vcDNA: vcDNA=SeqID_87952; Strand=+; Position=62-688
MRFDLRDYPTPPKAKIEESVTRKFTASECVELEKDYQQMLRQFRIFLRDLLRQIIREPRFKCFHLPVDKTDAEDYYEIVKQPMCLSQMMGNIDVGLYASKDAFAKDIQLIRNNAIEYNPDTDMDSKQIRHAANALVDMTEALFSMEMDDDFPTKLEEARKLVEEAKRWTEKMESAEKDDGTRNGGREKNIVPSTVAEDERRGDVGTETQ

SEQ ID NO: 161530 - protein, 31 aa, Heterodera glycines
  Coding regions on vcDNA: vcDNA=SeqID_87953; Strand=-; Position=1-93
ASTGRRTGERDRRGRPGRAPGIQKAEVEKSN

SEQ ID NO: 161531 - protein, 183 aa, Heterodera glycines
  misc_feature (172)..(172): Xaa can be any naturally occurring amino acid
  Homolog annotation: Hit_ID=AAP30775.1; Match level="QueryCoverage =100%, HitCoverage=100%, E-value=1e-87, Identity=88%"; Hit description=putative gland protein G32E03 [Heterodera glycines]
  Coding regions on vcDNA: vcDNA=SeqID_87954; Strand=+; Position=49-601
MRAILFLAMVCLVMAVILETANSKAVKNKKGAVATPAKGKAAPKGAAKGGIKKDAKSKGKGKKDAKGKKDKKAKPAKGKGVPKNDKKSPAAKANDKKSPTKPMAAVKAVPKAAENAQKGPSSAEVVAEENNLDTEAVDDLGAEESDFDQLAEDELLEDDAMDGEADELEGMXEETEMDSQMAL

SEQ ID NO: 161532 - protein, 184 aa, Heterodera glycines
  Coding regions on vcDNA: vcDNA=SeqID_87955; Strand=+; Position=28-582
MASSLTIEKRCKLFNTKQMECQFDGTEAGKCAFCVKLPCKFGAVNCAEEVSISCVNPQELEKCCKARDNECCVCVLCEKNKVMKVLVECCGKRTETSAEAGKALCICVPKIGGGKCGGQVQVKQCDAKLVDECCAANTESGDCCCVCLSCNDQKCVVTVRCPAGEAKSTGPTCTASKCESVKCC

SEQ ID NO: 161533 - protein, 153 aa, Heterodera glycines
  Homolog annotation: Hit_ID=AAS78778.1; Match level="QueryCoverage =80%, HitCoverage=80%, E-value=3e-24, Identity=45%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_87956; Strand=+; Position=81-542
MNGQLALEVLKWKNGCEIVALYFGAHMSQRCREFIPVLKQFYDQLKKSPETMPFEIVFVPFDRSEDEFRNSLRDLHDDWLYIPYGSVHINPLAARFNIINWGVIPTLVVLKEDGTLITMAGQADVQYSSASEAMARWRSTPNPESGFKDFSKF

SEQ ID NO: 161534 - protein, 29 aa, Heterodera glycines
  Coding regions on vcDNA: vcDNA=SeqID_87957; Strand=+; Position=1-87
HSLSLSPFPFFLHTLTKNANSPHSFCSFS

SEQ ID NO: 161535 - protein, 166 aa, Heterodera glycines; identical to SEQ ID NO: 159756
  Coding regions on vcDNA: vcDNA=SeqID_87958; Strand=+; Position=39-539

SEQ ID NO: 161536 - protein, 54 aa, Heterodera glycines
  Coding regions on vcDNA: vcDNA=SeqID_87959; Strand=-; Position=1-162
HSNAQRCGRAQRGANARRRYPRDAGGGGPFSEWSAESRIDREGPSEKQVVVEVQ

SEQ ID NO: 161537 - protein, 67 aa, Heterodera glycines
  Coding regions on vcDNA: vcDNA=SeqID_87960; Strand=+; Position=96-299
MEHKWRRATRYARPIQVTTEEPPSKTNDANDHQSAAPGNGKAPKNKGKKNKSDSSDSSSVEEFVYRK

SEQ ID NO: 161538 - protein, 239 aa, Heterodera glycines
  misc_feature (110)..(110): Xaa can be any naturally occurring amino acid
  Homolog annotation: Hit_ID=NP_505818.1; Match level="QueryCoverage =99%, HitCoverage=63%, E-value=1e-130, Identity=98%"; Hit description= actin (41.8 kD) (act-2) [Caenorhabditis elegans] emb|CAB04675.1| Hypothetical protein T04C12.5 [Caenorha
  Gene Ontology: Mol. function=structural constituent of cytoskeleton; Cellular component=cytoskeleton; Biological process=reproduction
  Coding regions on vcDNA: vcDNA=SeqID_87961; Strand=+; Position=2-721
GAVLSLYASGRTPGIVLDSGDGVTHTVPIYEGYALPHAILRLDLAGRDLTDYLMKILTERGYSFTTTAEREIVRDIKEKLCYVALDFEQEMATAASSSSLEKSYELPDGXVITVGNERFRCPEALFQPSFLGMESAGIHETSYNSIMKCDIDIRKDLYANTVLSGGSTMYPGIADRMQKEITALAPSTMKIKIIAPPERKYSVWIGGSILASLSTFQQMWISKSEYDESGPSIVHRKCF

SEQ ID NO: 161539 - protein, 123 aa, Heterodera glycines
  misc_feature (9)..(9): Xaa can be any naturally occurring amino acid
  misc_feature (23)..(23): Xaa can be any naturally occurring amino acid
  misc_feature (122)..(122): Xaa can be any naturally occurring amino acid
  Homolog annotation: Hit_ID=CAE60538.1; Match level="QueryCoverage =98%, HitCoverage=35%, E-value=2e-44, Identity=76%"; Hit description =Hypothetical protein CBG04165 [Caenorhabditis briggsae]
  Gene Ontology: Mol. function=fructose-bisphosphatase activity; Cellular component=cytosol; Biological process=gluconeogenesis
  Coding regions on vcDNA: vcDNA=SeqID_87962; Strand=+; Position=1-367
EQKKFPDAXGDLTPLLTSLLTAXKAISSAVRKAGLAQLYGVAGNVNVQGEDVKKLDVLSNELMINMLKSSYTVSTLVSEENEQVIEVEVSGTQGKYIVTFDPLDGSSNIDCLVSIGTIFGIXQ

SEQ ID NO: 161540 - protein, 174 aa, Heterodera glycines
  misc_feature (164)..(164): Xaa can be any naturally occurring amino acid
  Homolog annotation: Hit_ID=AAK94490.1; Match level="QueryCoverage =100%, HitCoverage=17%, E-value=2e-94, Identity=94%"; Hit description= PAZ/Piwi domain protein [Heterodera glycines]
  Coding regions on vcDNA: vcDNA=SeqID_87963; Strand=+; Position=36-558
QNPEQIREMIKETAIPPTVLRVHNERAKESLQLVNNEYLTKASVHFDTTPLHVDYRVLGPPATLYRNNHRVTPATSNCEWRPGDALVNAQIGTWVAYAFGNPVGDSVRRLGLTETMWRNFVDKYASEMRNKGIVCVPPVRVSICWYTSVNEVLNILHKEALNGXVEFCLIGHAK

SEQ ID NO: 161541 - protein, 171 aa, Heterodera glycines
  Homolog annotation: Hit_ID=CAE58391.1; Match level="QueryCoverage =78%, HitCoverage=16%, E-value=1e-08, Identity=27%"; Hit description =Hypothetical protein CBG01520 [Caenorhabditis briggsae]
  Coding regions on vcDNA: vcDNA=SeqID_87964; Strand=+; Position=42-554
MPKSKELDALRIRFEYLSALLELLDALFPSIESLLSNSNDIETRFVPDLKRSNLLLPKCIQLNKMISNTICVGSQPSDGFDSDFSWLPVFDANSSLYFGLPSFPRKSRLLPRVGACEYFNNLLEKILFVVSNLPEIPLTVEGIIELLQQIGEDDSCVLIRSLTQLLIMPND

SEQ ID NO: 161542 - protein, 82 aa, Heterodera glycines
  Coding regions on vcDNA: vcDNA=SeqID_87965; Strand=+; Position=2-250
GAAKKQERERERERDRETTAKEKKERKRSRSREKKRDKDEEKSSKKSKKSSSSDLSHSPKKAKKEPQTPPSERTNASGKGKE

SEQ ID NO: 161543 - protein, 133 aa, Heterodera glycines
  Homolog annotation: Hit_ID=AAO33474.1; Match level="QueryCoverage =100%, HitCoverage=96%, E-value=8e-69, Identity=100%"; Hit description=gland-specific protein g4g12 [Heterodera glycines]
  Coding regions on vcDNA: vcDNA=SeqID_87966; Strand=+; Position=17-415
MPNIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGP

SEQ ID NO: 161544 - protein, 251 aa, Heterodera glycines
  misc_feature (248)..(248): Xaa can be any naturally occurring amino acid
  Homolog annotation: Hit_ID=NP_495449.1; Match level="QueryCoverage =100%, HitCoverage=64%, E-value=1e-100, Identity=68%"; Hit description=cystathionine gamma-lyase (43.1 kD) (2H346) [Caenorhabditis elegans] gb|AAB93432.1| Hypothetical protei
  Gene Ontology: Biological process=sulfur amino acid metabolism
  Coding regions on vcDNA: vcDNA=SeqID_87967; Strand=+; Position=1-753
PEKWDMNTVVPPISLATTYKQQFAGMPKGHDYARGGNPTRDVLQQSIAALENARHCRVFSSGLSATAAMANWLHSGDHIIASDDGYGGTQRYFRQISVQHHGMELSFVDLTKLSNLEKEFKPNTKMVWFETPSNPLLKVIDIEAVCRAVQSRSKECIIVVDNTFMTPYFQRPLELGADVVMHSLTKYINGHTDVLMGAMVTNNDELDQHLNSQQLAAGAVPSPFDVYLVIRGIKTLHLRMRQHMENAXAVA

SEQ ID NO: 161545 - protein, 92 aa, Heterodera glycines
  Coding regions on vcDNA: vcDNA=SeqID_87968; Strand=+; Position=3-278
RNFSSTEFSSQRIQNKLFANSSSISSDGRELQIEYWTSLGYPFPSSSTAHCNYISPNDVGHSNNANVGSKFSMKASVRTLSIVREPMSNLLS

SEQ ID NO: 161546 - protein, 73 aa, Heterodera glycines
  Coding regions on vcDNA: vcDNA=SeqID_87969; Strand=+; Position=2-223
PAACLLLALRMKGIGEWGPVLHKYTGFKHSDIEPLMWRLNRMIIERKQHYPDLDTVFLNIAMKFSSKWRRLSS

SEQ ID NO: 161547 - protein, 120 aa, Heterodera glycines
  misc_feature (25)..(25): Xaa can be any naturally occurring amino acid
  Homolog annotation: Hit_ID=ZP_00357698.1; Match level="QueryCoverage =55%, HitCoverage=33%, E-value=4e-16, Identity=68%"; Hit description =hypothetical protein Chlo02002738 [Chloroflexus aurantiacus]
  Coding regions on vcDNA: vcDNA=SeqID_87970; Strand=-; Position=101-463
QNGGPPGGPEIFISFKTGGKPPRGXFFFFFFFFKFFFFFFFFFFFFFFFFFFFFFFFFFFFNNYLFFLIEKAFLKLSQLNACILSVFDQFFDFSSTSHFRILKQYKLDQSTLLLQQDNGR

SEQ ID NO: 161548 - protein, 237 aa, Heterodera glycines
  misc_feature (24)..(24): Xaa can be any naturally occurring amino acid
  misc_feature (225)..(225): Xaa can be any naturally occurring amino acid
  Homolog annotation: Hit_ID=CAE66267.1; Match level="QueryCoverage =99%, HitCoverage=30%, E-value=9e-73, Identity=58%"; Hit description =Hypothetical protein CBG11511 [Caenorhabditis briggsae]
  Gene Ontology: Mol. function=calcium ion binding; Cellular component =integral to plasma membrane; Biological process=signal transduction
  Coding regions on vcDNA: vcDNA=SeqID_87971; Strand=+; Position=3-712
DVARLFPFYCSYCSIMELLLPFYXKLFPRMMPSTFQDTSNSEQQYKRQLKAKNETAKFLQDSLEEIALARQEQGHAHGAQAIEFAQFLKKVRTGEGGYVNNQELFKFSKLFEDELTLDNLSMVHLRALCRLLGIAQFGTPEILRFRLRMKLRELKADDQLIEREGGVEVLSAQELQAACRARGMRALGLSEERLRQQLRQWVELSLDEQVPPSLLLLTRAMYFPXDVDFTARIRSIG

SEQ ID NO: 161549 - protein, 82 aa, Heterodera glycines
  Coding regions on vcDNA: vcDNA=SeqID_87972; Strand=-; Position=1-246
IRHEVFVLLFPSRKMNDDEVVIASLPLHPQKNDVWVMKAKKNVWGMMASLVMMRRNDAVIVAFQQGTHIHRFLHYQRHRKKM

SEQ ID NO: 161550 - protein, 92 aa, Heterodera glycines; identical to SEQ ID NO: 160901
  Homolog annotation: Hit_ID=AAH65651.1; Match level="QueryCoverage =84%, HitCoverage=19%, E-value=4e-09, Identity=37%"; Hit description =Nr2f1l protein [Danio rerio]
  Coding regions on vcDNA: vcDNA=SeqID_87973; Strand=+; Position=22-300

SEQ ID NO: 161551 - protein, 51 aa, Heterodera glycines
  Coding regions on vcDNA: vcDNA=SeqID_87974; Strand=+; Position=1-153
YCPHFAVGCCVRLSDVNLTSLFHASEMDIARARMKSSESYGMKYCAPGTTI

SEQ ID NO: 161552 - protein, 102 aa, Heterodera glycines
  misc_feature (68)..(68): Xaa can be any naturally occurring amino acid
  Homolog annotation: Hit_ID=CAE75230.1; Match level="QueryCoverage =100%, HitCoverage=100%, E-value=3e-20, Identity=41%"; Hit description=Hypothetical protein CBG23181 [Caenorhabditis briggsae]
  Gene Ontology: Biological process=N-linked glycosylation
  Coding regions on vcDNA: vcDNA=SeqID_87975; Strand=+; Position=336-640
FFVRKFSGECAKSKVKKKKGWRKKKKAKKEEGKRKRKKKRRKRNEKETEEKEEGKRKRKKKSRKRKKXKRKRKRRKRNEMETEEKEEGKRKRKKKRRKRNEK

SEQ ID NO: 161553 - protein, 178 aa, Heterodera glycines
  misc_feature (37)..(37): Xaa can be any naturally occurring amino acid
  misc_feature (118)..(118): Xaa can be any naturally occurring amino acid
  Homolog annotation: Hit_ID=NP_492433.1; Match level="QueryCoverage =99%, HitCoverage=40%, E-value=8e-63, Identity=63%"; Hit description =HomoGentisate Oxidase (49.2 kD) (hgo-1) [Caenorhabditis elegans] emb|CAB07848.4| Hypothetical protein W06
  Gene Ontology: Mol. function=homogentisate 12-dioxygenase activity; Biological process=phenylalanine catabolism
  Coding regions on vcDNA: vcDNA=SeqID_87976; Strand=+; Position=7-542
NGRNYVGPQEIAVVPHGVRFSVDVSVPSRGYLLEDFXRHFQLPELGPIGANGLANAHCFRIPTAWLEERETHFIIINKLQGQLFAAEQNHSPFDVFAWRGNYFPYKLYLRHFMSANEXAFDHCDPSIITVLTVPGLRKGVELANFVIFPPRWFVADGTFRTPYFHRNCLSESMGLIDG

SEQ ID NO: 161554 - protein, 212 aa, Heterodera glycines
  Homolog annotation: Hit_ID=CAE60769.1; Match level="QueryCoverage =100%, HitCoverage=66%, E-value=6e-80, Identity=64%"; Hit description= Hypothetical protein CBG04457 [Caenorhabditis briggsae]
  Gene Ontology: Mol. function=protein binding; Cellular component =cytoplasm; Biological process=protein folding
  Coding regions on vcDNA: vcDNA=SeqID_87977; Strand=+; Position=3-638
NKAAVFFEEGKYDECIEMCGKAVEVGRENRADYALVAKAYARMANSYKMKDDPKKALHFYEKALSGHRDPDIVKKHKELAKEVKEMEQKAYIDPELSDKEKNLGNQLFKKGDYPGAMRHYNEAIKRNPDNAVLYSNRAACFTKLMEFQRAVDDCDLCLKKDPSFVKAYIRKGAALSAMREFGRAQKAYEDALQMDPSNHEAMEGLRTCMQSN

SEQ ID NO: 161555 - protein, 129 aa, Heterodera glycines
  Homolog annotation: Hit_ID=AAH31825.1; Match level="QueryCoverage =31%, HitCoverage=8%, E-value=2e-12, Identity=83%"; Hit description =TAOK2 protein [Homo sapiens]
  Coding regions on vcDNA: vcDNA=SeqID_87978; Strand=+; Position=292-678
MKFICSKKKKKKKKKKKKKKKKKKKKKKKKKKKKGPIKKKKKKKSFWLFPPVKPLRISGPPGGPLLGKPPTGGGPNLGFFFGAPKKLGEKPGNTCSLGRKLFSFKIPPNNKTGKHKRENPGGPLGGPPP

SEQ ID NO: 161556 - protein, 247 aa, Heterodera glycines
  Homolog annotation: Hit_ID=NP_498540.1; Match level="QueryCoverage =95%, HitCoverage=73%, E-value=1e-100, Identity=73%"; Hit description= tissue specific transplantation antigen p35B like (3I150) [Caenorhabditis elegans] gb|AAA50647.1| Hypoth
  Gene Ontology: Mol. function=electron transporter activity; Biological process=nucleotide-sugar metabolism
  Coding regions on vcDNA: vcDNA=SeqID_87979; Strand=+; Position=2-742
QSGGEAAAAIRVLVTGGTGLVGSAIRQVVTEEEQQQKPQRLQEQWFFVGSSECDLTDLEQTRALFRHVRPTHVVNLAAMVGGLFHNLRHNLQFFVKNLAICQNVLQCCHETDVERCVSCLSTCIFPDKTPYPIDETMVHNGPPHDSNFGYSYAKRMIDVLNRGYAQEHNRKYTSAVPCNVFGPHDNFNLENAHVVPALIHKCFLAKRDGGPLVVAGSGKPLRQFIYSLDLGRLFVWAIREYEDVEPI

SEQ ID NO: 161557 - protein, 193 aa, Heterodera glycines
  Homolog annotation: Hit_ID=CAE73263.1; Match level="QueryCoverage =86%, HitCoverage=79%, E-value=1e-37, Identity=44%"; Hit description =Hypothetical protein CBG20679 [Caenorhabditis briggsae]
  Gene Ontology: Mol. function=NADH dehydrogenase (ubiquinone) activity; Cellular component=membrane fraction; Biological process =mitochondrial electron transport, NADH to ubiquinone
  Coding regions on vcDNA: vcDNA=SeqID_87980; Strand=+; Position=7-588
MPGPYPRNEEERRAAAIKYGLRPEDYKPHHPLDFVNHIGDYPEIGVVTYEQRDPYDNYSHTMHRRNWNEPVPRQFTRYRYDRWSYTGLDEENYEPREVLRTLLMYFVPVFLLAYWLIRTPEDPFYWFKQKYEPVYRPRVMPRQYPYDYFRAWPFEEYTKYPVLNYTFEPADEGFDPKEAEVKHPFNETSRVPL

SEQ ID NO: 161558 - protein, 168 aa, Heterodera glycines
  Homolog annotation: Hit_ID=NP_501176.1; Match level="QueryCoverage =77%, HitCoverage=36%, E-value=5e-24, Identity=41%"; Hit description =membrane interacting protein of RGS16 family member (40.7 kD) (4I141) [Caenorhabditis elegans] gb|AAD1473
  Gene Ontology: Mol. function=glycerophosphodiester phosphodiesterase activity; Cellular component=integral to membrane; Biological process=lipid metabolism
  Coding regions on vcDNA: vcDNA=SeqID_87981; Strand=+; Position=1-507
LGLELVLKLRSCSGIYLFDRAIVCSFFPWIIYWIKRRNSHILTGFTFRRRNISYTDLKMTIPRFSSPFYHCSAVALDALYRWSIKVCLPHFLGVDMLLIERGEICENFVSEMVDQGFHMCVWTVNDKNEMAWIAHKLKIPFLTDFPHKARGVLDGANGVPTELTFELN

SEQ ID NO: 161559 - protein, 104 aa, Heterodera glycines
  misc_feature (68)..(68): Xaa can be any naturally occurring amino acid
  Homolog annotation: Hit_ID=CAE75230.1; Match level="QueryCoverage =100%, HitCoverage=100%, E-value=2e-20, Identity=40%"; Hit description=Hypothetical protein CBG23181 [Caenorhabditis briggsae]
  Gene Ontology: Biological process=N-linked glycosylation
  Coding regions on vcDNA: vcDNA=SeqID_87982; Strand=+; Position=336-646
FFVRKFSGECAKSKVKKKKGWRKKKKAKKEEGKRKRKKKRRKRNEKETEEKEEGKRKRKKKSRKRKKXKRKRKRRKRNEMETEEKEEGKRKRKKKRRKRNEKET

SEQ ID NO: 161560 - protein, 214 aa, Heterodera glycines
  Homolog annotation: Hit_ID=NP_498775.2; Match level="QueryCoverage =96%, HitCoverage=33%, E-value=2e-64, Identity=53%"; Hit description =protein disulfide isomerase (69.8 kD) (3J225) [Caenorhabditis elegans] gb|AAM22024.1| Hypothetical protei
  Gene Ontology: Mol. function=phospholipase C activity; Cellular component=mitochondrion; Biological process=protein-nucleus import
  Coding regions on vcDNA: vcDNA=SeqID_87983; Strand=+; Position=18-659
RNWHSFDKVDSTIEKKLSDEYAVKGFPTLKILRNGRRFDYNGPREADGIVSYMLDQAKPAAKRLNSAKEVLKFMSPSDVTVVGFFSSESGAFYEAFADAAERTRGDFAVGYALDGAIAQHFGAKFGEVVLFWPEIFHSEYEPKRKIFPRETATSEELVSFWRDNAIPLVGQMTRANSATRYHRRPLVAVYYNVDFSLAYRDGTQFWRKKVLAIA

SEQ ID NO: 161561 - protein, 86 aa, Heterodera glycines
  misc_feature (22)..(22): Xaa can be any naturally occurring amino acid
  misc_feature (53)..(53): Xaa can be any naturally occurring amino acid
  misc_feature (59)..(60): Xaa can be any naturally occurring amino acid
  misc_feature (62)..(62): Xaa can be any naturally occurring amino acid
  misc_feature (71)..(72): Xaa can be any naturally occurring amino acid
  misc_feature (78)..(79): Xaa can be any naturally occurring amino acid
  Coding regions on vcDNA: vcDNA=SeqID_87984; Strand=-; Position=1-258
PPPKKKTPPPPKNLGARPPFWXFLGQRPPLFSLGGPKSPNKLKGSHCIENMQXKAKERXXNXERDLPHLLXXKSISPXXCFFCRTI

SEQ ID NO: 161562 - protein, 80 aa, Heterodera glycines
  Homolog annotation: Hit_ID=NP_001003835.1; Match level="QueryCoverage= 100%, HitCoverage=6%, E-value=4e-15, Identity=46%"; Hit description =TATA box binding protein (TBP)-associated factor 150kDa [Danio rerio] gb|AAT68099.1| TATA box binding
  Coding regions on vcDNA: vcDNA=SeqID_87985; Strand=+; Position=10-249
MIQSPNSDDDSLKTLCYQLLVPTSAANIGFAIGDFQIHVQPEMPEIINFVVPELIPLLKHTMKSLNRIFVFFEELLSCRF

SEQ ID NO: 161563 - protein, 129 aa, Heterodera glycines
  Homolog annotation: Hit_ID=CAE56800.1; Match level="QueryCoverage =92%, HitCoverage=33%, E-value=5e-42, Identity=66%"; Hit description =Hypothetical protein CBG24612 [Caenorhabditis briggsae]
  Gene Ontology: Cellular component=membrane; Biological process =intracellular protein transport
  Coding regions on vcDNA: vcDNA=SeqID_87986; Strand=+; Position=2-391
HLNRFLRRTRDCDVVEWAYCFDVHLNAFFPLLILLHVILPLLFYGLVDYQNFLARFFGNSIWCIATIYYNYITFLGYTALPTLKNTQFFLYPITFLFIFFVAATSAGWNVSITAMDFYHFRVTNADRRG

SEQ ID NO: 161564 - protein, 250 aa, Heterodera glycines
  misc_feature (29)..(29): Xaa can be any naturally occurring amino acid
  Homolog annotation: Hit_ID=AAL78214.1; Match level="QueryCoverage =56%, HitCoverage=75%, E-value=5e-13, Identity=30%"; Hit description =putative esophageal gland cell protein Hgg-20 [Heterodera glycines]
  Coding regions on vcDNA: vcDNA=SeqID_87987; Strand=+; Position=2-753
HRRFNCIVDEHFKTRKWKLGCMRICPKLXENGTKQLQIVNSDAKPLPIPQNPLPNKVIGFRHIQIHYIDQNVIAFLRRFHRRIFDVCSMVLYIHTDNDRILDYFLLNIWPMFRHSMRLMNLNSISLRRLRQLAGPSLLSDCPSLRFVSFNEAILPAFPPDESANASDGQALAKWLFTPRPDGQFKWFRGFVNSPDQWSPTMEQLKTAFSNASSPITYRISLAFSSTSIDSVVPFDDLINEVTGGEIDTGT

SEQ ID NO: 161565 - protein, 107 aa, Heterodera glycines
  Coding regions on vcDNA: vcDNA=SeqID_87988; Strand=-; Position=64-387
EERCSIRRSRPREINLSGAKTQGLGLTNQAQVKWFYLIHDTKVLMRLLCQRNLIIGINRFRKYPMWSVMGISHPLYYRCVVPGAQHFFPGNLSISSSPSQFHLNRIK

SEQ ID NO: 161566 - protein, 264 aa, Heterodera glycines
  misc_feature (29)..(29): Xaa can be any naturally occurring amino acid
  misc_feature (253)..(253): Xaa can be any naturally occurring amino acid
  Homolog annotation: Hit_ID=XP_415417.1; Match level="QueryCoverage =99%, HitCoverage=39%, E-value=3e-74, Identity=52%"; Hit description =PREDICTED: similar to Mitochondrial processing peptidase alpha subunit, mitochondrial precursor (Alpha-MP
  Gene Ontology: Mol. function=protein binding; Cellular component =mitochondrial inner membrane; Biological process=proteolysis and peptidolysis
  Coding regions on vcDNA: vcDNA=SeqID_87989; Strand=+; Position=1-791
YCRDVLRYENETLSRQPECEPLLTDWIHXAAFRSNTVGLSRYCPNKLVDVVNSGHILSFLSQYYTSPRIVLAGVGVDQQFLVDSGKELFDPRETTWEKHPERLLTQLPPVDESLAQYTGGEVLIEKDLSQMALGPTPFPNLAHIVIGFEGVNVSDADFVPFCVLQSLMGGGGSFSAGGPGKGMYTRLYVDVLNQHHWIYNATAFNHSYMDSGLFCIRASADPTKLNDLVDIILAEFGRLTKGAWLDELERAKXQLKSQLLMNLE

SEQ ID NO: 161567 - protein, 131 aa, Heterodera glycines
  misc_feature (69)..(69): Xaa can be any naturally occurring amino acid
  Homolog annotation: Hit_ID=CAI19747.1; Match level="QueryCoverage =80%, HitCoverage=63%, E-value=3e-18, Identity=42%"; Hit description =OTTHUMP00000039500 [Homo sapiens]
  Gene Ontology: Mol. function=DNA binding; Cellular component =nucleosome; Biological process=nucleosome assembly
  Coding regions on vcDNA: vcDNA=SeqID_87990; Strand=+; Position=3-399
CSSSSTVPFSTTPIKMARQMKEAGKPSYKLYVRRMLKQTHPDKEISTRVLNIMESFLNDLMDRIATEAXLIALYNRRKTMNLRDMQSAVQLCLPVGMATRANRKAYDVVAQYNAARKRKGILGQFCSWLGF

SEQ ID NO: 161568 - protein, 120 aa, Heterodera glycines
  misc_feature (100)..(100): Xaa can be any naturally occurring amino acid
  misc_feature (103)..(103): Xaa can be any naturally occurring amino acid
  Coding regions on vcDNA: vcDNA=SeqID_87991; Strand=+; Position=1-360
TRRRRASSSKKVDTKSGPIPSPLEAFLKPQLNNAMSDPSQNCLILLQVLYGLNTFWWRIFDANDADTDEDDNDAADEEEGSDGEEETTDEVEDNEQKQPXTNXPPITHRPIIAPSFFYSP

SEQ ID NO: 161569 - protein, 46 aa, Heterodera glycines
  Coding regions on vcDNA: vcDNA=SeqID_87992; Strand=+; Position=2-139
HPFGDLSGGIEETLSERVLNQDEIDSLLGFDMGDDDGSERSGIRAI

SEQ ID NO: 161570 - protein, 82 aa, Heterodera glycines
  Coding regions on vcDNA: vcDNA=SeqID_87993; Strand=+; Position=57-305
MRAGEPRHLSPTRGMYTVYPNYNNGFRTIELFLDHYLRTGTSVTTERFVTLRKAVHRANWELSHSSITVSSELGRGAFSVVK

SEQ ID NO: 161571 - protein, 233 aa, Heterodera glycines
  Homolog annotation: Hit_ID=NP_493387.1; Match level="QueryCoverage =100%, HitCoverage=89%, E-value=1e-109, Identity=82%"; Hit description=protein YR-29 (29.7 kD) (1O220) [Caenorhabditis elegans] emb|CAB04941.1| Hypothetical protein W09C5.1 [
  Gene Ontology: Cellular component=nucleus; Biological process=protein biosynthesis
  Coding regions on vcDNA: vcDNA=SeqID_87994; Strand=+; Position=47-745
MPQNEHIELHRKRHGRKLDHEERTRKKLARAVHDRSKVAKKLRKGKAKLYHKKRYAEKVQMRKLIKQHEEKKQKGTTDTQTEGAVPAYLLDRQKETAGKALSTAIKQKRKEKAAKYQVPLPKVRAVSDAEAFKVVNTGKTRRKGWKRMVTKVTFVGETFTRKPAKFERFIRPMGLRFKKAHVTHPELKTTFCLPLVGVKKNPSSQLYTSLGVITKGTIIEVNVSELGMVTQGG

SEQ ID NO: 161572 - protein, 38 aa, Heterodera glycines
  Coding regions on vcDNA: vcDNA=SeqID_87995; Strand=-; Position=66-182
ERIYFLIFFNFKILGRDSYFSTLLSYRFTINKLLITLP

SEQ ID NO: 161573 - protein, 174 aa, Heterodera glycines
  misc_feature (169)..(169): Xaa can be any naturally occurring amino acid
  Coding regions on vcDNA: vcDNA=SeqID_87996; Strand=+; Position=74-595
YTHLASFTCATAKDGAINGFTAGDGGLTIGSDATNATGAIILFGFQTSNKKDLSFKVFAPTSASCLSSVNNFVISGRICKLEALETETESANCPEEDSAGSGCNSRSVTCQMTTKEIAESDDGRVFKVDLGNLTQVTSLCTKWKAHFTNVRQVMESSGGGEPRVSTRTXAAGGG

SEQ ID NO: 161574 - protein, 234 aa, Heterodera glycines
  Homolog annotation: Hit_ID=NP_741554.1; Match level="QueryCoverage =98%, HitCoverage=46%, E-value=3e-65, Identity=53%"; Hit description =ALDH3C1, ALdehyde deHydrogenase (55.6 kD) (alh-4) [Caenorhabditis elegans] gb|AAM45357.1| Aldehyde dehydr
  Gene Ontology: Mol. function=aldehyde dehydrogenase activity; Cellular component=integral to membrane; Biological process =acetaldehyde metabolism
  Coding regions on vcDNA: vcDNA=SeqID_87997; Strand=+; Position=71-772
MTSPFHSLVESQREFFRTGKTAELAHRRQQLKKLRKTILDNSEFLCEAVQKDLKRDAKLNYPLEISSVIIEIEYVLDNLERWTAPLNVEKTFTTLLDSPQIVREPKGVVLLIGPWNYPLNTLLMPLVDVLAAGNTAILKPSEVASNTAAAVDEIISKAFDRNYLAVVQGGIEQTGELLKEKFDHIVFTGSALVARHISRAAAEHLTPCTLELGGKSPVFIDSNVDLPITARRLA

SEQ ID NO: 161575 - protein, 57 aa, Heterodera glycines
  misc_feature (1)..(1): Xaa can be any naturally occurring amino acid
  Coding regions on vcDNA: vcDNA=SeqID_87998; Strand=-; Position=2-172
XQVVLRHPGLALLREMFELNGCCSWDGAAHPNPHADRRGCPPGHSRSGPAAVMPKFT

SEQ ID NO: 161576 - protein, 112 aa, Heterodera glycines
  misc_feature (10)..(10): Xaa can be any naturally occurring amino acid
  Homolog annotation: Hit_ID=CAE69305.1; Match level="QueryCoverage =86%, HitCoverage=62%, E-value=2e-18, Identity=36%"; Hit description =Hypothetical protein CBG15362 [Caenorhabditis briggsae]
  Gene Ontology: Mol. function=growth factor activity; Cellular component=extracellular; Biological process=cell-cell signaling
  Coding regions on vcDNA: vcDNA=SeqID_87999; Strand=+; Position=15-349
GHYGCCPLPXAICCMDHLHCCPEDTQCDLPQQKCVNSDGNSQPFHRKMPAKTQNGETVEQKGTDKEATEEVICPDGSSKCPPRATCCPLGDGFGRRRKDWRLETNAQQSISY

SEQ ID NO: 161577 - protein, 184 aa, Heterodera glycines
  Coding regions on vcDNA: vcDNA=SeqID_88000; Strand=+; Position=50-604
MASSLTIEKRCKLFNTKQMECQFDGTEAGKCAFCVKLPCKFGAVNCAEEVSISCVNQQELEKCCKARDNECCVCVLCEKNKVMKVLVECCGKRTETSAEAGKALCICVPKIGGGKCGGQVQVKQCDAKLVDECCAANTESGDCCCVCLSCNDQKCVVTVRCPAGEAKSTGPTCTASKCESVKCC

SEQ ID NO: 161578 - protein, 122 aa, Heterodera glycines
  misc_feature (48)..(48): Xaa can be any naturally occurring amino acid
  misc_feature (57)..(57): Xaa can be any naturally occurring amino acid
  Homolog annotation: Hit_ID=AAL78214.1; Match level="QueryCoverage =88%, HitCoverage=55%, E-value=1e-26, Identity=50%"; Hit description =putative esophageal gland cell protein Hgg-20 [Heterodera glycines]
  Coding regions on vcDNA: vcDNA=SeqID_88001; Strand=+; Position=176-542
MDQIGGTFSDQIWLDTLAWIGRGEVGWHLALVNARFAALVNMQLQQRXWCLEEFHIXERKPKRTGAEVLSLANNGSYFSLPLATSPLPDSVIGFNGTFNIWYLDAEVINFLQRFRRLFNTYI

SEQ ID NO: 161579 - protein, 210 aa, Heterodera glycines
  Homolog annotation: Hit_ID=NP_741829.1; Match level="QueryCoverage =60%, HitCoverage=25%, E-value=2e-11, Identity=34%"; Hit description =myosin heavy chain like family member (64.3 kD) (XH858) [Caenorhabditis elegans] gb|AAB37024.1| Hypotheti
  Coding regions on vcDNA: vcDNA=SeqID_88002; Strand=+; Position=72-701
MESKFGEVNQWWNDAKWRVGELEAETAHRSHLLDRAHHRIGELERRLANNLSFEDLRREKETLEGRVAELTKALDDAKWRVGELEAEMTRKDNFEEQKRKLEWRLGEMTQWWNDAKWRIGELEATLGHEGSARNNRGEGNGDDNLETLGRFRELLSDGILLIRKQSHLDRDKWKMMKYEHALEKDVRLRSCWFQVDSERHEVFLIGTFVN

SEQ ID NO: 161580 - protein, 97 aa, Heterodera glycines
  Coding regions on vcDNA: vcDNA=SeqID_88003; Strand=+; Position=152-442
SLNINFGFPHFDAAFPFPSLPFHSLPFHSIHSFIHSFIHFSYSFSVGLPCFFYWSIVPPFFFGSFWTMQKNDDAHTKKKSLSAAIVGFWCSIFLRLL

SEQ ID NO: 161581 - protein, 216 aa, Heterodera glycines
  Homolog annotation: Hit_ID=CAE72583.1; Match level="QueryCoverage =75%, HitCoverage=20%, E-value=4e-11, Identity=30%"; Hit description =Hypothetical protein CBG19771 [Caenorhabditis briggsae]
  Coding regions on vcDNA: vcDNA=SeqID_88004; Strand=+; Position=73-720
MQLLATDDYYFIKSVKTILKCCRTTANISVFRHCDLAALEDFELLGDVFAFIGKITVDDISYLLLVSECSEIAEIETVNATLTRVERVCALPVLTDGMIHKKLFDIPSLDGFERLKNRPRNLLKLMSHKVPIKNLPTSPKLIDEIIAFFNQPKSFYFSHNFDITKTLQQSGCLGSSTSDNRFFWNKNLLKEMFVNDGSPIPAFKEWDTPLIYRFIE

SEQ ID NO: 161582 - protein, 83 aa, Heterodera glycines
  Coding regions on vcDNA: vcDNA=SeqID_88005; Strand=-; Position=79-330
GIKDHIIQFDNYRSILCSSVRSIHGPNKDVGRVLSASDAVIPVPAFPQAVCAGVPTLFRLYHPPFHMAQNKVSGSSDQCGNMG

SEQ ID NO: 161583 - protein, 218 aa, Heterodera glycines
  misc_feature (46)..(46): Xaa can be any naturally occurring amino acid
  Homolog annotation: Hit_ID=CAC21848.1; Match level="QueryCoverage =78%, HitCoverage=78%, E-value=9e-23, Identity=40%"; Hit description =hypothetical protein [Globodera rostochiensis]
  Coding regions on vcDNA: vcDNA=SeqID_88006; Strand=+; Position=29-684
MKRMSSMFKKENDQKNILEKISELEKQTQKKGFLKFQENCWDSFAXYKDIEISGDKSLIVQHKGNDWPSVFAKYPIVLNKHLSDFFYYEIPVMKKDERHYGLAFGFAVKQQTKLDVDIRYKKGTYAYESDGYLCINGGGKGPNAEYLYGAGDTVGIGVNSATRQIIFTKNGLRLDTSDFFVDPSFADDSLYPFVSLLDSGDKIEANFGPNFKFDLATL

SEQ ID NO: 161584 - protein, 138 aa, Heterodera glycines; identical to SEQ ID NO: 161031
  Coding regions on vcDNA: vcDNA=SeqID_88007; Strand=+; Position=14-430

SEQ ID NO: 161585 - protein, 139 aa, Heterodera glycines
  Homolog annotation: Hit_ID=CAE65927.1; Match level="QueryCoverage =71%, HitCoverage=23%, E-value=7e-12, Identity=36%"; Hit description =Hypothetical protein CBG11100 [Caenorhabditis briggsae]
  Coding regions on vcDNA: vcDNA=SeqID_88008; Strand=+; Position=3-422
FAEFVVHFWVKCILQNKFETARNFLELGVKRVTLLPETEPTILLSFYCCYAEALFHTGDIERALDYAKRAQKLSQGSDIDAAVRAYVRDFSRQIERDTLRASVRSNNERTASSSSSTSLSAEGAEGTEKGISNWLWPFK

SEQ ID NO: 161586 - protein, 229 aa, Heterodera glycines
  Homolog annotation: Hit_ID=XP_418257.1; Match level="QueryCoverage =93%, HitCoverage=17%, E-value=1e-30, Identity=36%"; Hit description =PREDICTED: similar to Paired amphipathic helix protein Sin3b [Gallus gallus]
  Gene Ontology: Cellular component=chromatin; Biological process =negative regulation of transcription
  Coding regions on vcDNA: vcDNA=SeqID_88009; Strand=+; Position=9-695
MFYGTHPWVLFIRLHAIMCDRLAKIKRRTEELAEEYHVELAIRERQKKLFEEKGDSVEAQLMNAVDVHLGLRDLKKPLQNPENFYQIMLQEMKNLLDGQVDASKFEDTLRSMFDTRAYVLFTMDKLVNTLVRQLQNFVGDSASGQCVEQFEKYFDQRVNGCESGQPAARVDKDYSEAMEKVLLNQHCFKMFFFNRDHPVVTIELIDTDETESEEGRGVPMWWHCTIGSI

SEQ ID NO: 161587 - protein, 52 aa, Heterodera glycines; identical to SEQ ID NO: 130690
  Homolog annotation: Hit_ID=NP_501223.1; Match level="QueryCoverage =100%, HitCoverage=16%, E-value=1e-12, Identity=75%"; Hit description= mitochondrial carrier protein family, embryonic tissue differentiation factor, DIFferentiation abnormal
  Coding regions on vcDNA: vcDNA=SeqID_88010; Strand=+; Position=212-370

SEQ ID NO: 161588 - protein, 224 aa, Heterodera glycines
  misc_feature (213)..(213): Xaa can be any naturally occurring amino acid
  misc_feature (220)..(220): Xaa can be any naturally occurring amino acid
  Coding regions on vcDNA: vcDNA=SeqID_88011; Strand=+; Position=65-739
LTMLAFSLFPNFLLLLLAICHVHGMFGRERERKSEEKRTNSRSSSRENREPDNGILSIEVVPSLAGNPLHGYRFVVRCGTLKFREYSRAESEELRWIYPTKEPEKVEIQLTKERCVNMAVFIFMTTRNQTDTNLWNKQFQANTSSRHLSVDFVHYSKLTVSPNLGQVVRQSYYVQVRCANTTKGPGCAFPHRIQIGDWWLCCWRTRIVWVFTXKLWGGVXQTKS

SEQ ID NO: 161589 - protein, 258 aa, Heterodera glycines
  Homolog annotation: Hit_ID=BAB03174.1; Match level="QueryCoverage =69%, HitCoverage=8%, E-value=8e-09, Identity=22%"; Hit description =unnamed protein product [Arabidopsis thaliana] ref|NP_189519.1| expressed protein [Arabidopsis thaliana]
  Coding regions on vcDNA: vcDNA=SeqID_88012; Strand=+; Position=3-776
ALETDQTKQSKETNDQRTKTIDQTKPKEEINVQKKPEITDQSNGLDKPKEALTDQSNKKEHDINKEQINAEKMLKDVIADHGKLKALETDQMKKNEEIDGQKTKMIGQTKPKEGINDQEKPKANSTDFMKPKEETNDQEEPKTIGTDQIKPKEDAANTSVKSKAVIIDLGDPKENNVNDRKKTTTDDKAPKVMPFAQTEKSLHKINDQIDQRIKPREENRDHIKQSRANTEHPLPGQRIKPTKFKKPFDPLSTVADTL

SEQ ID NO: 161590 - protein, 203 aa, Heterodera glycines
  Homolog annotation: Hit_ID=AAL78214.1; Match level="QueryCoverage =91%, HitCoverage=94%, E-value=1e-30, Identity=39%"; Hit description =putative esophageal gland cell protein Hgg-20 [Heterodera glycines]
  Coding regions on vcDNA: vcDNA=SeqID_88013; Strand=+; Position=143-751
MSDHPDAALADLSCVANDVWLDTLFWIDRAEVGTKFALIDARFGRLVATHFKLRKWKLGELGIHRAPSGWDRGGTAAVTVMDDHPLMNRLPLAKCPAPNGVIGFRAIYIWYVDLEVITFLQCLQRVLNLGTALQFTIHSKDVRCWALMSQRIWPLIAHAVTTLHDMKDVDFALLRRHVSPNVLFDCVKLRVITNTHMFPVQPP

SEQ ID NO: 161591 - protein, 161 aa, Heterodera glycines
  Coding regions on vcDNA: vcDNA=SeqID_88014; Strand=+; Position=1-483
AIMKCTGEKALGCVIAPELAKDTNNDGQKLLKTVRRQWLIFPNAPNDPIDLLANANPYSRLFADSAKKRDEPKSRHNLTFNSTADDPIATEKDADQTSNWAGAHDTAFLSGTLSSNQRIECGTQQIRYEKGVRTALYFSRGKSNAFVTHAICAKENSLSTH

SEQ ID NO: 161592 - protein, 61 aa, Heterodera glycines
  misc_feature (48)..(48): Xaa can be any naturally occurring amino acid
  Coding regions on vcDNA: vcDNA=SeqID_88015; Strand=-; Position=15-200
ENGAQQMDNLILSLLFDGFVKEIGAHFGVETNIVDDCGVPRMFLVALXTSFKKWRKRGGNS

SEQ ID NO: 161593 - protein, 94 aa, Heterodera glycines
  Coding regions on vcDNA: vcDNA=SeqID_88016; Strand=+; Position=1-282
PNFFFNAYINNSIWLKFLITAFLFKIACSKFGSSENKGLFFYFGYGSNLLEERIHVQVKGATFVAIGALKGYRLAFVDFEEPNRWHSAAATIEQ

SEQ ID NO: 161594 - protein, 206 aa, Heterodera glycines
  Homolog annotation: Hit_ID=CAE63648.1; Match level="QueryCoverage =56%, HitCoverage=7%, E-value=2e-09, Identity=30%"; Hit description =Hypothetical protein CBG08146 [Caenorhabditis briggsae]
  Coding regions on vcDNA: vcDNA=SeqID_88017; Strand=+; Position=63-680
MFFKGLHGDVSFDDLWELHKERQAEVLMERYYRADKSKGEGPITFCAFVWRLVKCTWEWQICSILLSVLVVFCLYANAVFLRVIVTFVDLGFPLWLSMAALCVLFFVDFTGKVMLARRDFDSFIALLSLRSIISCAILDKLFKLSSSARQSFSTGEVVNFLSTDLFRISYFWLTIRSFVYCPFMIGFASFGLWMELGDEFCGSVSP

SEQ ID NO: 161595 - protein, 124 aa, Heterodera glycines
  misc_feature (118)..(118): Xaa can be any naturally occurring amino acid
  Homolog annotation: Hit_ID=NP_700900.1; Match level="QueryCoverage =100%, HitCoverage=92%, E-value=2e-20, Identity=39%"; Hit description= hypothetical protein PF11_0035 [Plasmodium falciparum 3D7] gb|AAN35624.1| hypothetical protein [Plasmodi
  Gene Ontology: Biological process=N-linked glycosylation
  Coding regions on vcDNA: vcDNA=SeqID_88018; Strand=+; Position=2-373
ERRRKRSRKQEAEKKENEEQKPAGKKEKRAAEKEEKKSESKEAEKKENEEQKPAGKKEKRAAEKEEKKTESKEAEKKENEEQKPAGKKEKRAAEKEEKKSERKEAEKKENEEQKPAGXKKKKKK

SEQ ID NO: 161596 - protein, 155 aa, Heterodera glycines
  misc_feature (30)..(30): Xaa can be any naturally occurring amino acid
  misc_feature (45)..(45): Xaa can be any naturally occurring amino acid
  misc_feature (50)..(50): Xaa can be any naturally occurring amino acid
  misc_feature (60)..(60): Xaa can be any naturally occurring amino acid
  misc_feature (79)..(79): Xaa can be any naturally occurring amino acid
  Homolog annotation: Hit_ID=CAE62805.1; Match level="QueryCoverage =53%, HitCoverage=19%, E-value=4e-16, Identity=50%"; Hit description =Hypothetical protein CBG06980 [Caenorhabditis briggsae]
  Coding regions on vcDNA: vcDNA=SeqID_88019; Strand=+; Position=5-471
FCAQVCRTNHYYLFSLAISDLLLLVLGLPXELHGVFGAVYPYKFXEFICXGRAFLIEFTXYALHFDHSLAFQWKRWLAXLFPVAHKKFLNFWTGPSKTIPRLLFWLFWAGPRPLICWGTQYACSQGATYKPFGCPSVLQPAHFLCGPQNCPRGFL

SEQ ID NO: 161597 - protein, 175 aa, Heterodera glycines
  Homolog annotation: Hit_ID=CAE60538.1; Match level="QueryCoverage =100%, HitCoverage=51%, E-value=1e-62, Identity=70%"; Hit description= Hypothetical protein CBG04165 [Caenorhabditis briggsae]
  Gene Ontology: Mol. function=fructose-bisphosphatase activity; Cellular component=cytosol; Biological process=gluconeogenesis
  Coding regions on vcDNA: vcDNA=SeqID_88020; Strand=+; Position=64-588
MPSEYGIETDSVTLQRFVLNEQKKFPDATGDLTTLLTSLLTAVKAISSAVRKAGLAQLYGVAGNVNVQGEDVKKLDVLSNELMINMLKSSYTVSTLVSEENGQVIEVEVSGTQGKYIVTFDPLGGSSNVDCFVSIGTIFGIFRKASNTSTKEEDTLQTGRKMVAAGYALYGSATM

SEQ ID NO: 161598 - protein, 42 aa, Heterodera glycines
  Coding regions on vcDNA: vcDNA=SeqID_88021; Strand=-; Position=0-125
VEVARLGPGPGLFLHLFDFLFRHDGCVLFVEETGGLTNAEKA

SEQ ID NO: 161599 - protein, 83 aa, Heterodera glycines
  misc_feature (25)..(25): Xaa can be any naturally occurring amino acid
  misc_feature (60)..(60): Xaa can be any naturally occurring amino acid
  Homolog annotation: Hit_ID=AAH77943.1; Match level="QueryCoverage =74%, HitCoverage=11%, E-value=6e-13, Identity=56%"; Hit description =MGC80917 protein [Xenopus laevis]
  Coding regions on vcDNA: vcDNA=SeqID_88022; Strand=+; Position=165-413
QQSEARFQLFVRGFKHTKYWFDQWXQSPEKTLPKPTQVELQLPSEKMVILDYIIRNTDRXNDNWMICYTPPTAEAQSPEWART

SEQ ID NO: 161600 - protein, 189 aa, Heterodera glycines
  misc_feature (144)..(144): Xaa can be any naturally occurring amino acid
  Homolog annotation: Hit_ID=CAE69821.1; Match level="QueryCoverage =72%, HitCoverage=43%, E-value=2e-19, Identity=37%"; Hit description =Hypothetical protein CBG16139 [Caenorhabditis briggsae]
  Gene Ontology: Mol. function=enoyl-CoA hydratase activity; Cellular component=mitochondrion; Biological process=growth
  Coding regions on vcDNA: vcDNA=SeqID_88023; Strand=+; Position=101-665
MIGGILEDIWTRFIDLVEDISDQYDDSEQPTIIHHEPATPTTMFDNYGPIEKIVVVGTGLMGSGIAQIAVESGVKVCLVGRSQEKCDQTRLKINTGVQKSIKKRMANETAEAQQQLVEATMESLELVANLDEAGLSDADIVIEXAVVENLKVKQKLFTELEAKVSEKCLLVTNTSSFLLEDVSCKMGAA

SEQ ID NO: 161601 - protein, 108 aa, Heterodera glycines
  misc_feature (12)..(12): Xaa can be any naturally occurring amino acid
  Homolog annotation: Hit_ID=NP_503790.1; Match level="QueryCoverage =95%, HitCoverage=17%, E-value=4e-27, Identity=59%"; Hit description =matrix metalloproteinase (62.5 kD) (5D384) [Caenorhabditis elegans] gb|AAG23982.2| Hypothetical protein C
  Gene Ontology: Mol. function=zinc ion binding; Cellular component =integral to plasma membrane; Biological process=proteolysis and peptidolysis
  Coding regions on vcDNA: vcDNA=SeqID_88024; Strand=+; Position=1-326
GGVLAHATLPQXGKLHFDDDENWVFMDGRKIGNHRFTDLYWVALHEIGHVLGLSHSNIETAIMAPFYQDPRDLVDWRGNYKRPELTHDDVRAAQQIYGKRYGRLGTSN

SEQ ID NO: 161602 - protein, 129 aa, Heterodera glycines
  Homolog annotation: Hit_ID=CAE62153.1; Match level="QueryCoverage =100%, HitCoverage=24%, E-value=2e-54, Identity=76%"; Hit description= Hypothetical protein CBG06199 [Caenorhabditis briggsae]
  Gene Ontology: Cellular component=mitochondrion; Biological process =glutamate catabolism
  Coding regions on vcDNA: vcDNA=SeqID_88025; Strand=+; Position=2-427
FRWSKGGVKIDPKKYSAYEIEKITRSFTIELAKKGFLGPGVDVPAPDMGTGEREMAWIADTYAQTVGHTDKDASACVTGKPIVAGGIHGRVSATGRGLWKGLAVFINDEKFMTKLGLTTGFKGKTFIVQ

SEQ ID NO: 161603 - protein, 246 aa, Heterodera glycines
  Homolog annotation: Hit_ID=NP_509429.1; Match level="QueryCoverage =97%, HitCoverage=36%, E-value=2e-86, Identity=62%"; Hit description =transmembrane 9 superfamily member 2 (75.3 kD) (XJ38) [Caenorhabditis elegans] gb|AAB71307.1| Temporarily
  Gene Ontology: Mol. function=transporter activity; Cellular component= membrane fraction; Biological process=transport
  Coding regions on vcDNA: vcDNA=SeqID_88026; Strand=+; Position=2-739
MNLRILLFFAVFIPSARSFYLPGLAPVNFCEGKDKKPTCPNKVTLFVNKLDSDQSVIPYEYHSFDFCIGSEQESPVENLGQVLFGERIRPSPYEINFKENKQCSYLCEKDYKSSDKSHQEKLRLLQRGMKLNYQHHWIIDNMPVTFCFINQQNMNVCTTGFPMGCYVTKEGKPKDACVLDGRYRQQDSFYLFNHVDIKIEYRDMSDDPNFLDEKIGGRIIRIKVQPRSIKHESKAGMNCGMEAAPQ

SEQ ID NO: 161604 - protein, 232 aa, Heterodera glycines
  misc_feature (12)..(12): Xaa can be any naturally occurring amino acid
  misc_feature (170)..(170): Xaa can be any naturally occurring amino acid
  Homolog annotation: Hit_ID=AAO18686.1; Match level="QueryCoverage =93%, HitCoverage=30%, E-value=1e-27, Identity=31%"; Hit description =semaphorin 2a [Trichinella spiralis]
  Coding regions on vcDNA: vcDNA=SeqID_88027; Strand=+; Position=1-699
YLYLATEEKVSXFRLGQCALYGSDCVRCARDPYCSWSIARRQCFPTDSSHSGAVGWIVLGTRPTATFPSPADEVTERCAKYTKTVAVTVFPGDSVHLKCPSEGQMAQWKHNGRKIPSDEEMPHFVHSMSGGLVLINATETMDGTYECATEESANGKVPLAIYSLKWDGRXCARPKSVEQFRSAQREWCRRMDTYRSNLSKWESIRDANGQGKDLCDTNAETERRTDSGNFVA

SEQ ID NO: 161605 - protein, 86 aa, Heterodera glycines
  Coding regions on vcDNA: vcDNA=SeqID_88028; Strand=+; Position=1-258
GCFLVLRFVLPSPLFLLSLSSFVFCHFRPHFPPFLQKASVEQRRQYNRIVTSQNDTKAQINSNVYNWASNAGVASDYNNFTSEQKQ

SEQ ID NO: 161606 - protein, 197 aa, Heterodera glycines
  misc_feature (158)..(158): Xaa can be any naturally occurring amino acid
  misc_feature (163)..(163): Xaa can be any naturally occurring amino acid
  misc_feature (172)..(172): Xaa can be any naturally occurring amino acid
  Homolog annotation: Hit_ID=AAL78214.1; Match level="QueryCoverage =91%, HitCoverage=93%, E-value=4e-94, Identity=87%"; Hit description =putative esophageal gland cell protein Hgg-20 [Heterodera glycines]
  Coding regions on vcDNA: vcDNA=SeqID_88029; Strand=+; Position=128-715
MGQINLCDDVWLDTLAWINRGEVGMKFALVNARFNTLVDRHFEQRKWCFGEFHICERMTEESGAEIMTSIDGSDFSTLPLPTTPLPDSVVGFQSISIWYINEEVINFLCTIRRLLAEDIALEFSTYFTEYRSWKVMARHIWPLLRDGISTLFLKKCDXGHAPXNTCRPPCCXDCAGLHRIHTQMLPECPSADGAVDG

SEQ ID NO: 161607 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_88030; Strand=+; Position=17-433

SEQ ID NO: 161608 - protein, 142 aa, Heterodera glycines; identical to SEQ ID NO: 160068
  Homolog annotation: Hit_ID=AAO33474.1; Match level="QueryCoverage =94%, HitCoverage=97%, E-value=1e-70, Identity=100%"; Hit description= gland-specific protein g4g12 [Heterodera glycines]
  Coding regions on vcDNA: vcDNA=SeqID_88031; Strand=+; Position=3-431

SEQ ID NO: 161609 - protein, 272 aa, Heterodera glycines
  misc_feature (53)..(53): Xaa can be any naturally occurring amino acid
  misc_feature (220)..(220): Xaa can be any naturally occurring amino acid
  misc_feature (244)..(244): Xaa can be any naturally occurring amino acid
  Homolog annotation: Hit_ID=NP_495405.2; Match level="QueryCoverage =94%, HitCoverage=49%, E-value=6e-31, Identity=29%"; Hit description =amino acid transporter family member (54.4 kD) (2H166) [Caenorhabditis elegans] gb|AAA68337.2| Hypothetic
  Gene Ontology: Mol. function=neutral amino acid transporter activity; Cellular component=vacuole; Biological process=alanine transport
  Coding regions on vcDNA: vcDNA=SeqID_88032; Strand=+; Position=1-815
SPKIPFLTFGDLAEQSCKVSFGWIKNYGPLAKNIVNIITIVHQFGICSMYYLXIASTFQTVFDKEKADNEPKGKDPTWFLVILLPIVALNSIVSMRILSIMCLLGNVLMITSLTLILFMLSQIVFTERAHSIPFALPSAEGFFKACGTIIVSCLAQSLVLPMENKIKKPSQMLGPFGVLSIGIAISTIVYAIVGFLGYSAYGESLRDSVLNHLECVSNAXELTVLTYIIRIALCLSIFASFMLXMFVIVGRLWPLLENGSKTFSYLENWHSF

SEQ ID NO: 161610 - protein, 119 aa, Heterodera glycines
  Coding regions on vcDNA: vcDNA=SeqID_88033; Strand=-; Position=13-372
MVIINGMLIFGSFSLSHFRFHSFALPSFSFLRLKQNAMANCRADQSHGNKNHHKVMANAGLSASSTPSRRRHSKGNFHIGKDNVNAILQFWRYRHRRVLGVWRGRRNRSVHRIWGGVLA

SEQ ID NO: 161611 - protein, 89 aa, Heterodera glycines
  Coding regions on vcDNA: vcDNA=SeqID_88034; Strand=-; Position=144-413
IFSSDPSQSLIVRWTELIMVVDNLGASMSCHKAGICSSWTLRAVSARMICSHVSSGWSFALSIVACRISGIEIESGPIRMVLPSGKCQF

SEQ ID NO: 161612 - protein, 263 aa, Heterodera glycines
  Homolog annotation: Hit_ID=CAE66860.1; Match level="QueryCoverage =60%, HitCoverage=72%, E-value=5e-17, Identity=34%"; Hit description =Hypothetical protein CBG12233 [Caenorhabditis briggsae]
  Coding regions on vcDNA: vcDNA=SeqID_88035; Strand=+; Position=27-815
MNFVSEEELQKQREAGEEKPESSEPVDKRTLYERLKEQKDIKQLEYDETHALKNQFRGIDEAESDFLTQVERAKEEQEARKRKEEQELVRLSRQLTQQHATGATTDKQQHALLEKPQKATAAASSGISRQAALITSLVRRKRPLSTDSEPKSARGEVPSPPSSSDSDKRKTNTVEGFRAVRHQNNGTNRIAKSLECFPAYRTTPIRVTRPRVAATARVWSRDCHVWQFTRVKAHQSRTESVEMDTNERDEDMLFMTYFCEIRS

SEQ ID NO: 161613 - protein, 99 aa, Heterodera glycines
  Coding regions on vcDNA: vcDNA=SeqID_88036; Strand=+; Position=1-300
CRRFPPNKKHQILEEEMKPSFNFKLFASVFLVLCVASLVLCQHKPAAACKPPKNVGRGNLALTRWWWDGRSCKQFIYKGQGGNTNNFPSKKLCDQVCKP

SEQ ID NO: 161614 - protein, 246 aa, Heterodera glycines
  Homolog annotation: Hit_ID=AAP30770.1; Match level="QueryCoverage =95%, HitCoverage=90%, E-value=6e-73, Identity=60%"; Hit description =putative gland protein G17G01 [Heterodera glycines]
  Coding regions on vcDNA: vcDNA=SeqID_88037; Strand=+; Position=33-770
MRTIVYFKLLQIVLGLAFVWQLLSFHQFCGTFVCPKAFLHDISVGHCKRFTLIGKDSKTGEFGAVLDERKWHNQLFMSSTNGLPIKEQQQQFMDELAAKLPCPGRHCIPITTPSFFFWTEKNRNLFDNVMDSFSGQLLLALCSLLTIGIGFARMLRPAAEYECFDYCMALYSVFCWCCSAWASSYLLLYWTPYWSCMNFRADDTNVPLVTFVFDIVMVCSFVFEMFFNNSLVKKRPEMLQSLPLIA

SEQ ID NO: 161615 - protein, 210 aa, Heterodera glycines
  misc_feature (36)..(36): Xaa can be any naturally occurring amino acid
  Homolog annotation: Hit_ID=AAP30770.1; Match level="QueryCoverage =100%, HitCoverage=81%, E-value=3e-62, Identity=59%"; Hit description= putative gland protein G17G01 [Heterodera glycines]
  Coding regions on vcDNA: vcDNA=SeqID_88038; Strand=+; Position=19-647
MRTIVYFKLLQIVLGLAFVWQLLSFHQFCGTFVCPXAFLHDISVGHCKRFTLIGKDSKTGEFGAVLDERKWHNQLFMSSTNGLPIKEQQQRFMDELAAKLPCPGRHCIPITTPSFFFWTEKNRNLFDNVMDSFSGQLLLALCSLLTIGIGFARMLRPAAEYECFDYCMALYSVFCWCCSAWASSYLLLYWTPYWSCMNFRADDTNVPLVT

SEQ ID NO: 161616 - protein, 274 aa, Heterodera glycines
  misc_feature (181)..(181): Xaa can be any naturally occurring amino acid
  misc_feature (211)..(211): Xaa can be any naturally occurring amino acid
  misc_feature (220)..(220): Xaa can be any naturally occurring amino acid
  misc_feature (238)..(238): Xaa can be any naturally occurring amino acid
  misc_feature (242)..(242): Xaa can be any naturally occurring amino acid
  Homolog annotation: Hit_ID=NP_741074.1; Match level="QueryCoverage =89%, HitCoverage=46%, E-value=4e-57, Identity=46%"; Hit description =putative protein, with a transmembrane domain, 2 coiled coil-4 domains, of bilaterial origin (60.0 kD) (3
  Coding regions on vcDNA: vcDNA=SeqID_88039; Strand=+; Position=2-822
PFLFAFSLFISAFFFVYSADESIKPPTRNVLITAEEEKQRDVEGFLAIKAIHAVLDDDNSGSIDRFESADFLKEDLKFGGSDKIRRENAFHSNDEAITVDDLWENWFQSEERGWTNKQVVEWLTNQVKLPQYANGFLSAEVTGLDLPKMAVQNSSFLSTKIGIKNYVHRQKLQLKALDLVXFGFQDTSSIAKDIALAGLLGLLVAVLVIFXKHKNRSKKXMEELSTVLNKLRDMETDXAGVXNRLEDENLNDSQQRRIETSIGENQLRELETTT

SEQ ID NO: 161617 - protein, 185 aa, Heterodera glycines
  misc_feature (9)..(9): Xaa can be any naturally occurring amino acid
  misc_feature (178)..(178): Xaa can be any naturally occurring amino acid
  Homolog annotation: Hit_ID=AAP30775.1; Match level="QueryCoverage =100%, HitCoverage=100%, E-value=3e-92, Identity=90%"; Hit description=putative gland protein G32E03 [Heterodera glycines]
  Coding regions on vcDNA: vcDNA=SeqID_88040; Strand=+; Position=20-576
MRAILFLAXVCLVMAVILETANSKAVKKDNKKGAVATPAKGKAAPKGAAKGGIKKDAKSKGKGKKDAKGKKDKKAKPAKGKASPKNDKKSPAAKANDKKSPTKPMAAVKAVPKAAENAQKGPSSAEVVAEENNLDTEAVDDLGAEESDFDQLAEDELLEDDAMGGEADGWEGLGEETXMDSQMAL

SEQ ID NO: 161618 - protein, 197 aa, Heterodera glycines
  Coding regions on vcDNA: vcDNA=SeqID_88041; Strand=+; Position=25-615
GTDEENLGILHKSEIDVSVLPGGYLTKVRIACCILRFLTDEQVRTMFNISIDQFYGNFVTMLNQRLYSLCRIDSSPKDLKEAERVDFVRTILSPQSIFRQTPEIARLLVCLIVDNDIDGLTTLGKAAQRLVQLRLSVPLLELLKYLRNIKGKDIRTIPNISAFFAKTFEALFDKIDAPATDRKELASLVFFLISCPV

SEQ ID NO: 161619 - protein, 261 aa, Heterodera glycines
  misc_feature (203)..(203): Xaa can be any naturally occurring amino acid
  misc_feature (248)..(248): Xaa can be any naturally occurring amino acid
  Homolog annotation: Hit_ID=CAE57522.1; Match level="QueryCoverage =92%, HitCoverage=12%, E-value=1e-87, Identity=69%"; Hit description =Hypothetical protein CBG00497 [Caenorhabditis briggsae]
  Gene Ontology: Mol. function=helicase activity; Cellular component =nucleus; Biological process=establishment and/or maintenance of chromatin architecture
  Coding regions on vcDNA: vcDNA=SeqID_88042; Strand=+; Position=1-780
GTGVFPRHFVPAPFERYDHEITQHSLRLYADEEGHLAQRAYIARQLEFPELRLIEYDCGKLQMLARLLESLFSNKHRCLIFTQMSRMLDILQAFLSYHNYKYFRLDGSTHIDQRQAMMERFNSDSSVFCFILSTRSGGVGVNLTGADTVIFYDSDWNPTMDAQAQDRCHRIGQTRNVTIYRLISEKTIEENILTKSMQKRRLXGEMAIDQGEFTPDFFKNTGNLRDLFSNETAVAKIIAPVVDEPKTXKDVEAAMNRVEDH

SEQ ID NO: 161620 - protein, 43 aa, Heterodera glycines
  Coding regions on vcDNA: vcDNA=SeqID_88043; Strand=-; Position=1-129
PYPLAPIDCHFPLSESHPFALGRPFPKAHPFDAARGLPNCAFE

SEQ ID NO: 161621 - protein, 237 aa, Heterodera glycines
  misc_feature (182)..(182): Xaa can be any naturally occurring amino acid
  Homolog annotation: Hit_ID=CAE71918.1; Match level="QueryCoverage =100%, HitCoverage=77%, E-value=2e-76, Identity=55%"; Hit description= Hypothetical protein CBG18981 [Caenorhabditis briggsae]
  Gene Ontology: Mol. function=palmitoyl-protein hydrolase activity; Cellular component=extracellular space; Biological process =neurogenesis
  Coding regions on vcDNA: vcDNA=SeqID_88044; Strand=+; Position=25-733
MPHAYVLSLQLGSSVAEDIGRGYFANMNDEVAAVCQQLAEDARLANGYNAIGFSQGALFVRALAQRCPHPPIRNLISIGGPQQGIFGLPFCPGSFYVCSLIRRLLDNGAYTEFAQHNLVQAQYWHDPNLAEGYRRANIFLADVNCERSCDSTYRDNMGKLRNFVLVGFSNDHKLVPKETAWXFGFYADNDTQTIVPMEQTELYKQDRIGLKTLNESNRLHFLTFNGEHLQIPTDLFI

SEQ ID NO: 161622 - protein, 267 aa, Heterodera glycines
  misc_feature (27)..(27): Xaa can be any naturally occurring amino acid
  misc_feature (41)..(41): Xaa can be any naturally occurring amino acid
  misc_feature (256)..(256): Xaa can be any naturally occurring amino acid
  Homolog annotation: Hit_ID=CAE56320.1; Match level="QueryCoverage =99%, HitCoverage=30%, E-value=2e-82, Identity=57%"; Hit description =Hypothetical protein CBG23985 [Caenorhabditis briggsae]
  Gene Ontology: Mol. function=transporter activity; Cellular component= integral to membrane; Biological process=transport
  Coding regions on vcDNA: vcDNA=SeqID_88045; Strand=+; Position=3-801
VKIFSAEAKELQSYKNKIMEIWEISRXEGTTKGLMFGGFQXTGYLALTSMLYYGSVLIADGCLTYGDLSSFMLYSALCFGGITNFQLFYTELMRGLGASARIFELRDQKPSISSEGGLVINALNKEVRFESVAFSYLNRESIFSDITFRIPKASVTAIVGASGSGKSTIAHLLLRLYSPTAGRIMVDDIDLKQLDLSSWRRMIGTVSQEPILFSTSIRDNILYGVENSHLITDEELTEAAEQSNCLEFIRSFPNGXDTVLGEHGSSC

SEQ ID NO: 161623 - protein, 93 aa, Heterodera glycines
  Coding regions on vcDNA: vcDNA=SeqID_88046; Strand=-; Position=0-278
LVHPPEHQSHFLFSEWQSVNFQQHGSGSYHAAYSVANQQLRCWGHLLLPGPPFRQTMRSLSCIRSVRWSFRSTICRISIYALHDTSNSNQSTS

SEQ ID NO: 161624 - protein, 172 aa, Heterodera glycines
  Homolog annotation: Hit_ID=AAC60120.1; Match level="QueryCoverage =88%, HitCoverage=16%, E-value=3e-12, Identity=34%"; Hit description =XL-INCENP [Xenopus laevis]
  Gene Ontology: Biological process=reproduction
  Coding regions on vcDNA: vcDNA=SeqID_88047; Strand=+; Position=197-715
MTLSEELVESSADDKTKEKIPLPSSLVVSVPITPLKTSTSVVDMTLSEELVEISAYDMTKEKIPLPSTEDNYNVDDLSSNDETDPEDSPKKQIPKWAQKEYLAQQINGLQRIDVLEKVEKYFGRIRQPALIDFFKQSKKKYTKRRSSSAVWDSPMSDPTPGGRFQKFQKSSN

SEQ ID NO: 161625 - protein, 142 aa, Heterodera glycines
  misc_feature (136)..(136): Xaa can be any naturally occurring amino acid
  Homolog annotation: Hit_ID=CAE71877.1; Match level="QueryCoverage =99%, HitCoverage=28%, E-value=3e-41, Identity=52%"; Hit description =Hypothetical protein CBG18932 [Caenorhabditis briggsae]
  Gene Ontology: Mol. function=aldehyde dehydrogenase activity; Cellular component=integral to membrane; Biological process =epidermal differentiation
  Coding regions on vcDNA: vcDNA=SeqID_88048; Strand=+; Position=3-429
VDLPYPARRLAWGKWLNCGQTCLAPDYVMVTNEMKPRLVEELKAVLVEYYGTNPETSKDYSRVINEAHFDRICALLKNSVGIEICKMGQPNREDLFIPPTILEVQTDDALMQSEIFGPILPFLIVRSFDEAIDIIXGGEKPL

SEQ ID NO: 161626 - protein, 172 aa, Heterodera glycines
  Coding regions on vcDNA: vcDNA=SeqID_88049; Strand=+; Position=101-616
QIDRCPLLFDLLLLLSDLGFHGLFFCLPLIKAQFANVLSQLECTPLKDLPISVAIRQRCRQLFALLISADFFPDLIDICVEMLPETTNHEMAVLMRDLWNFLKSLFSMSSSPTSLHSSDVRPMPPPSPNRMDALTSKEGRLLTSTILLIGQRHIASMGPLLAKLVDLLGGVE

SEQ ID NO: 161627 - protein, 123 aa, Heterodera glycines
  Coding regions on vcDNA: vcDNA=SeqID_88050; Strand=+; Position=2-373
ACGVRMCHIETYIFMDFETTGLFDDGHNNPLTNPNRSNETARERAQRLDNLIKSDGNRFPKITEMAYMSVPRVLFLEGTEQMSARHLSSMSQDGEEGIEPVQVVTNVHVRQLSPQLNDKERFK

SEQ ID NO: 161628 - protein, 140 aa, Heterodera glycines
  Coding regions on vcDNA: vcDNA=SeqID_88051; Strand=+; Position=34-456
TAAGREQRIRDLMLTNTKKLAGRDRLIRQQEIKIQRLERANTQKSDSLKRKMEEMQKLKKKERRKTMFETNNPRKPLTPINEQLTPESKHLERLNTTYIVDTPSEEQKKGRLLGELPEEKDSNYQIPPLLSGCCPKGPSV

SEQ ID NO: 161629 - protein, 47 aa, Heterodera glycines
  misc_feature (19)..(19): Xaa can be any naturally occurring amino acid
  Homolog annotation: Hit_ID=NP_788547.1; Match level="QueryCoverage =100%, HitCoverage=10%, E-value=5e-17, Identity=87%"; Hit description= CG5605-PG, isoform G [Drosophila melanogaster] ref|NP_730520.1| CG5605-PF, isoform F [Drosophila melanog
  Gene Ontology: Biological process=protein biosynthesis
  Coding regions on vcDNA: vcDNA=SeqID_88052; Strand=+; Position=2-140
KFGFIVMDGNGSLFGTLQXKCREVLHKFSVELPKKHGRGGQSALRFA

SEQ ID NO: 161630 - protein, 68 aa, Heterodera glycines
  misc_feature (12)..(12): Xaa can be any naturally occurring amino acid
  misc_feature (19)..(19): Xaa can be any naturally occurring amino acid
  misc_feature (32)..(32): Xaa can be any naturally occurring amino acid
  misc_feature (41)..(41): Xaa can be any naturally occurring amino acid
  Homolog annotation: Hit_ID=AAN15806.1; Match level="QueryCoverage =92%, HitCoverage=23%, E-value=2e-18, Identity=68%"; Hit description =putative esophageal gland cell secretory protein 26 [Meloidogyne incognita]
  Coding regions on vcDNA: vcDNA=SeqID_88053; Strand=+; Position=1-205
CREDKPIDPTHXLIDCLCXGQICETNRANALXGLPFKFDSXRFNGVRGWEIGCPNVRPEEPNSSGVIV

SEQ ID NO: 161631 - protein, 248 aa, Heterodera glycines
  misc_feature (212)..(212): Xaa can be any naturally occurring amino acid
  Homolog annotation: Hit_ID=NP_871674.1; Match level="QueryCoverage =93%, HitCoverage=54%, E-value=7e-31, Identity=32%"; Hit description =g-protein beta WD-40 repeat (46.4 kD) (3H390) [Caenorhabditis elegans] gb|AAN63388.1| Hypothetical protei
  Coding regions on vcDNA: vcDNA=SeqID_88054; Strand=+; Position=24-767
MASLLDSNGKYRCNTYGLCFEPIDNEICLGSSNRILIGMVLAPADRDVTCLLFATARSFYQEQQHSVGSCPKIVTKCTVNLRPIEFNLSEEGRESMSSPIYNAHWTSTEPIWSLCFNSHHMKICVGMEKCAKILNVLSGQNFYVGSGGKNVISCIFSKDGNTLFLGRKNADVSMLDMRMTSNHKVGELAQSPSTGYMHLLQTRPHTLVTENXEGKIKLWDVRGRCQPLAELEIGHRNSSHKLPCFVDA

SEQ ID NO: 161632 - protein, 208 aa, Heterodera glycines
  misc_feature (177)..(177): Xaa can be any naturally occurring amino acid
  misc_feature (208)..(208): Xaa can be any naturally occurring amino acid
  Coding regions on vcDNA: vcDNA=SeqID_88055; Strand=+; Position=106-729
RPSPPLKEQNRRMASQNGDLENQLEICQGLVNELRAEVDSLRGELSECKLPFRISNSELQNITVRHSRTGDAVERIGPRKANTKSLLKPRARLCSNTPKMAVPSEKRAKRGLTKDSEDDDNFRTAEFVPTTPRPQFLLPPLVLTPLSSRFPPLPRRSFSVEPTPTHIQKNAEQQLTXIRDGNGDMPCPFSQKRLNDNGEIQCPSSSTX

SEQ ID NO: 161633 - protein, 84 aa, Heterodera glycines; identical to SEQ ID NO: 160731
  Homolog annotation: Hit_ID=AAL78214.1; Match level="QueryCoverage =89%, HitCoverage=38%, E-value=2e-13, Identity=48%"; Hit description =putative esophageal gland cell protein Hgg-20 [Heterodera glycines]
  Coding regions on vcDNA: vcDNA=SeqID_88056; Strand=+; Position=300-554

SEQ ID NO: 161634 - protein, 200 aa, Heterodera glycines
  misc_feature (16)..(16): Xaa can be any naturally occurring amino acid
  misc_feature (24)..(24): Xaa can be any naturally occurring amino acid
  misc_feature (41)..(41): Xaa can be any naturally occurring amino acid
  misc_feature (48)..(48): Xaa can be any naturally occurring amino acid
  misc_feature (61)..(61): Xaa can be any naturally occurring amino acid
  misc_feature (110)..(110): Xaa can be any naturally occurring amino acid
  misc_feature (124)..(124): Xaa can be any naturally occurring amino acid
  Homolog annotation: Hit_ID=AAL78227.1; Match level="QueryCoverage =99%, HitCoverage=78%, E-value=2e-93, Identity=84%"; Hit description =hypothetical protein Hgg-18 [Heterodera glycines]
  Coding regions on vcDNA: vcDNA=SeqID_88057; Strand=+; Position=65-661
SQKGGAENGRGQKGRXQSPVPRPXLTEAADNVNKAVDDLSXLNRQKHXKNAAEATAEKTPXRAGKSIERSGRKRRKRTAEDGCQQNFGGKSEKRRGIGKRSENENGNTFXGQQKGQRRVDFDNXRQKDDFGREGEADGGADSQNVGQHEEGAESEQQCRRRRLRQVVLRRRRAGGGHGGQSMINQSDRRIRHCCVMKCSQ

SEQ ID NO: 161635 - protein, 31 aa, Heterodera glycines
  Coding regions on vcDNA: vcDNA=SeqID_88058; Strand=-; Position=2-94
YSKHKTINTTLMHTTISNHQKHILLFKYFNC

SEQ ID NO: 161636 - protein, 102 aa, Heterodera glycines
  misc_feature (12)..(12): Xaa can be any naturally occurring amino acid
  Homolog annotation: Hit_ID=CAE65983.1; Match level="QueryCoverage =100%, HitCoverage=19%, E-value=1e-10, Identity=36%"; Hit description= Hypothetical protein CBG11172 [Caenorhabditis briggsae]
  Coding regions on vcDNA: vcDNA=SeqID_88059; Strand=+; Position=11-317
VKGSITQNLPKXNPFVIVRLLFTLVMFFGFAIQMYVVVEMLWPEFVKFLRNLCPNFGVYNENDHKNMVGIELLFRAALVTVSMLIGLAVPELENIIPLVGAT

SEQ ID NO: 161637 - protein, 182 aa, Heterodera glycines
  misc_feature (149)..(149): Xaa can be any naturally occurring amino acid
  Coding regions on vcDNA: vcDNA=SeqID_88060; Strand=+; Position=3-548
KRRRRRKKRRKQFQWLRKVFMATTRTLTRRRERGRRIIRREGKCRRLNAMERRQKAMGPIKRAKATMWTRGRASSHKTCVRVGSARHCSAVLRCRDRQNGSGTTGTPPRSLCLSKTMPPTRVKSKTTPGMVKSRATMPPNFESTSATQXADVLRSGNASPLARSTPQPMDQENEQSCSNRLF

SEQ ID NO: 161638 - protein, 96 aa, Heterodera glycines
  Homolog annotation: Hit_ID=CAE73278.1; Match level="QueryCoverage =82%, HitCoverage=23%, E-value=3e-22, Identity=60%"; Hit description =Hypothetical protein CBG20696 [Caenorhabditis briggsae]
  Gene Ontology: Cellular component=kinetochore; Biological process =mitotic checkpoint
  Coding regions on vcDNA: vcDNA=SeqID_88061; Strand=+; Position=1-291
RRAYLPGQRCCLPPGPPNFRPGGSDYIVNMWDPFNRKRLCQFRKFPSSVVSLSFSPDGGMLAIASTYMYEEERDPNPIPESSLTIRRMTELEVRPK

SEQ ID NO: 161639 - protein, 244 aa, Heterodera glycines
  Homolog annotation: Hit_ID=NP_491476.1; Match level="QueryCoverage =85%, HitCoverage=86%, E-value=1e-24, Identity=33%"; Hit description =putative protein, with at least 3 transmembrane domains (26.1 kD) (1F480) [Caenorhabditis elegans] gb|AAB
  Coding regions on vcDNA: vcDNA=SeqID_88062; Strand=+; Position=3-737
VRIGFGDADPLWDSENEKYKVLCRTFMFPGSSVIGYMRLLVSLVSSLFFAYQYMMAVTGRLSSDHWINQVTARFMSQAMMSICLQVIVVVLMVHGVKAEKKSLLLPFIAYAAIAVLAGSIKVMSDLVYLDTSVYKNNEAESRAAKVQFLTNLLRTVLQAWCLSVVWRCYGYLTEKKVARQIREQLNSTATAFNYPENLMGHPSMPQQPPPYAAVVTAPIAIGPSNDKPQTSATNTSATASHIQQ

SEQ ID NO: 161640 - protein, 245 aa, Heterodera glycines
  misc_feature (127)..(127): Xaa can be any naturally occurring amino acid
  Homolog annotation: Hit_ID=AAP30764.1; Match level="QueryCoverage =100%, HitCoverage=56%, E-value=1e-131, Identity=96%"; Hit description=putative gland protein G28B03 [Heterodera glycines]
  Coding regions on vcDNA: vcDNA=SeqID_88063; Strand=+; Position=3-736
NILLKSVLFISLLSLFGDCMKNSDQIGVKRKSAGIRIEEPNDVKGKGKVVETSRKGKEKVGEKISVMNTAERIEKMDLAQDKAKMDIDTNGKPKQNEENAPPKYVFIWSGSNEKKNLEVDLRVTRHXQKKLSELFHAKSDQSVNAKHGKQEALPVPKQEAEKILKEVEEWYAHHKNDKHKNAPVFVFKCKDNVSLVINVHLDAVRLSKELSNMLEDTADEGYPKPIPSPVPNFKSDITLKLIKLC

SEQ ID NO: 161641 - protein, 92 aa, Heterodera glycines
  Homolog annotation: Hit_ID=AAC34373.1; Match level="QueryCoverage =72%, HitCoverage=24%, E-value=4e-10, Identity=37%"; Hit description =apoptosis inhibitor IAP-1 [Buzura suppressaria nucleopolyhedrovirus]
  Coding regions on vcDNA: vcDNA=SeqID_88064; Strand=+; Position=200-478
MYNQFRFQLPNTWKNELCANETFQYVSHYTTRAGKRKQSENAKICKGCKNEERKIAFDPCGHFFLCKKCANTIKTCPECKVKVKERLEIFNV

SEQ ID NO: 161642 - protein, 223 aa, Heterodera glycines
  misc_feature (159)..(159): Xaa can be any naturally occurring amino acid
  misc_feature (184)..(184): Xaa can be any naturally occurring amino acid
  misc_feature (208)..(208): Xaa can be any naturally occurring amino acid
  misc_feature (215)..(215): Xaa can be any naturally occurring amino acid
  Homolog annotation: Hit_ID=AAL78216.1; Match level="QueryCoverage =99%, HitCoverage=66%, E-value=1e-129, Identity=98%"; Hit description= aspartic protease precursor Hgg-33 [Heterodera glycines]
  Gene Ontology: Mol. function=aspartic-type endopeptidase activity; Cellular component=lysosome; Biological process=induction of non -apoptotic programmed cell death
  Coding regions on vcDNA: vcDNA=SeqID_88065; Strand=+; Position=2-672
WHAKFDGILGMGFSEISVQKLPTVFDNMVTQQKVPEPVFAFWLNRDPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGKAYTXEGQGLCAENDQHGQKHMPFRFYGHXFAGTCRRTLDSWRCVYWSLLHGVXCGPKSCXFCAGQRRK

SEQ ID NO: 161643 - protein, 185 aa, Heterodera glycines
  Coding regions on vcDNA: vcDNA=SeqID_88066; Strand=+; Position=35-592
KCAKCKCDNRLQATAYWSFDIRTQLLDNGAELGSQLEPNKIHQQSPSKYSISNKKLLKLCRVVYVSACPQEFSEKLILHMERFGELFDYDINATPQIFTYKEPLDAQRAVNEAVGSFELAKLKVEWAPVAKGVKDDKNIVPDGERKPSEQVAAKDLIALLEYDEEEEDDKKEGDEEQLSEKEGND

SEQ ID NO: 161644 - protein, 224 aa, Heterodera glycines
  misc_feature (209)..(209): Xaa can be any naturally occurring amino acid
  Homolog annotation: Hit_ID=CAE62153.1; Match level="QueryCoverage =87%, HitCoverage=36%, E-value=3e-79, Identity=74%"; Hit description =Hypothetical protein CBG06199 [Caenorhabditis briggsae]
  Gene Ontology: Cellular component=mitochondrion; Biological process =glutamate catabolism
  Coding regions on vcDNA: vcDNA=SeqID_88067; Strand=+; Position=28-697
MLIAYIPKRIHLNLNVVGAAFRQRMPFSAAVLDPHDQLKDSDKPMSEQMNPSFFKMVDYYFDKGAAAIEPKLVENFKASHGKSKEERVSSVKGILAAIKPVNKVLYVTFPLRRDDGSYEMIEAWRAMHSEHRTPTKGGIRFSMDVNEDEVKALSALMTAKCAVVDVPFGGAKGGVKIDPKKYSAYEIEEITRSFTIELAKKGFLGPGVXDVPAPDMGTGEREMA

SEQ ID NO: 161645 - protein, 235 aa, Heterodera glycines
  misc_feature (133)..(134): Xaa can be any naturally occurring amino acid
  Homolog annotation: Hit_ID=NP_495324.2; Match level="QueryCoverage =89%, HitCoverage=20%, E-value=1e-51, Identity=48%"; Hit description =human WeRNer syndrome related (118.5 kD) (wrn-1) [Caenorhabditis elegans] gb|AAA68410.2| Human wrn (werne
  Gene Ontology: Mol. function=3'-5' exonuclease activity; Cellular component=nucleus; Biological process=aging
  Coding regions on vcDNA: vcDNA=SeqID_88068; Strand=+; Position=62-767
TSAVALSSAIPGNDENSSSPAVPSERSLELLKKYFGYSRFRPLQYEVIEAALSKRDQLVVMSTGYGKSVCYQLPSLIQNNLTLVVSPLISLMEDQVNALENVGVEAAYLGGNQSREAIFDSIKRGRLRILYIXXEAYQSTPDFIQNIHEYVGLLAVDEAHCISQWGHEFRPGYRQIADIRNVLTGVPVIALTATATDPVRNDIVQNLRLRNPKVTLSAFDRKNLFIEVQKRTQSL

SEQ ID NO: 161646 - protein, 95 aa, Heterodera glycines
  misc_feature (40)..(40): Xaa can be any naturally occurring amino acid
  misc_feature (54)..(54): Xaa can be any naturally occurring amino acid
  misc_feature (71)..(71): Xaa can be any naturally occurring amino acid
  Homolog annotation: Hit_ID=AAO33474.1; Match level="QueryCoverage =100%, HitCoverage=68%, E-value=2e-19, Identity=61%"; Hit description= gland-specific protein g4g12 [Heterodera glycines]
  Coding regions on vcDNA: vcDNA=SeqID_88069; Strand=+; Position=1-285
SGNISSAGIVTTITIIVARRLFYPSLATGGAEPIGGKSAXVGNALCLQPSLATXRSTLTPPAAGQFERCGXNRLKRMRAHLRELAEKMPVHLSNR

SEQ ID NO: 161647 - protein, 235 aa, Heterodera glycines
  Homolog annotation: Hit_ID=NP_495741.1; Match level="QueryCoverage =76%, HitCoverage=34%, E-value=3e-58, Identity=63%"; Hit description =pyridoxal-5'-phosphate-dependent enzyme, beta family and Amino acid -binding ACT (2I557) [Caenorhabditis e
  Gene Ontology: Cellular component=mitochondrion
  Coding regions on vcDNA: vcDNA=SeqID_88070; Strand=+; Position=3-707
NGRASGGIEIGTRGDSCSISANSSASLISVPDFVRVEEIPEECAIKRVPSALCSFVDPFCDPKKPVKTTFSDISTAAFNIRDGILRTPTIKSDALSSMFGVDLFFKQEYLQVTGSFKERGARFALLRLTEEQRRIGVIAASAGNHALSLAYHGSKLGIPVTVVMPKFAPLMKISCCESYKAKVILHGLNIQESKIFAYELAKEKNLKYVNGFDNPDVIAGQGTIGLEILDQVGDV

SEQ ID NO: 161648 - protein, 101 aa, Heterodera glycines
  misc_feature (52)..(52): Xaa can be any naturally occurring amino acid
  misc_feature (56)..(56): Xaa can be any naturally occurring amino acid
  Homolog annotation: Hit_ID=XP_320329.1; Match level="QueryCoverage =99%, HitCoverage=73%, E-value=3e-16, Identity=39%"; Hit description =ENSANGP00000014080 [Anopheles gambiae]
  Gene Ontology: Mol. function=DNA binding; Cellular component =nucleosome; Biological process=nucleosome assembly
  Coding regions on vcDNA: vcDNA=SeqID_88071; Strand=+; Position=10-311
FLRNRQFCSRSQQRHSQQHRTKMARRRRKKEPRKQSYKLYVRRVLKEVHPGXGNLXMRALNIMNSFVIDALDRIATEATRMAHNDRRKTITLRDMEFSVRL

SEQ ID NO: 161649 - protein, 209 aa, Heterodera glycines
  Coding regions on vcDNA: vcDNA=SeqID_88072; Strand=+; Position=2-631
PEHGGGGGAGTSATNDGIGTGNGVPSDQRNIRRFVAELEQRLVESEAEIAALCSEKRELAKRVGHMANKLDTERVQNASAMESVRRDRQLLVEENERERALHAVMRDKFDELKRKFDTIAKTVLDKQSELEKMTKMNTELSQQLHEQAEALERHRAELETATKMVAERDTELKGSECELAKCREENTKLDELRQQMVHLLEEFGANLDK

SEQ ID NO: 161650 - protein, 96 aa, Heterodera glycines
  misc_feature (95)..(95): Xaa can be any naturally occurring amino acid
  Homolog annotation: Hit_ID=CAE62153.1; Match level="QueryCoverage =70%, HitCoverage=12%, E-value=5e-15, Identity=58%"; Hit description =Hypothetical protein CBG06199 [Caenorhabditis briggsae]
  Coding regions on vcDNA: vcDNA=SeqID_88073; Strand=+; Position=50-337
MLIAYIPKRIHLNLNVVGAAFRQRMPFSAAVLDPHDQLKDSDKPMSEQMNPSFFKMVDYYFDKGAAVIEPKLVENFKASHGKSKEERVSSVKGIXC

SEQ ID NO: 161651 - protein, 54 aa, Heterodera glycines
  Coding regions on vcDNA: vcDNA=SeqID_88074; Strand=+; Position=2-166
LCFRSFFYLHCPTDWKMITDMQLGIMANVLGVSIFILVIFYHYIVANQKKQSPQ

SEQ ID NO: 161652 - protein, 221 aa, Heterodera glycines
  Coding regions on vcDNA: vcDNA=SeqID_88075; Strand=+; Position=3-665
DSLENFRSQGSRTLLGDDFHWLNPLRGSVQFAAFGSNSLNSSSSSFDVTHWLHEMSRLGVRPSVKTFNAALSSLLQIKEKGANSFDYGTEEMAAAVTPSTEESSYDKEHLWKTASDLVHEMRSLGIEPTLATFSYTLKLAPTKMSLDALLNEILTRLEYKLSRSEPIERVGDDDAIFYRNAISMARILNNELQMDRLVKIYRSEHNKVFFQNYDNEQRFYA

SEQ ID NO: 161653 - protein, 107 aa, Heterodera glycines
  Homolog annotation: Hit_ID=AAP30762.1; Match level="QueryCoverage =100%, HitCoverage=98%, E-value=2e-61, Identity=98%"; Hit description= putative gland protein G7E05 [Heterodera glycines]
  Coding regions on vcDNA: vcDNA=SeqID_88076; Strand=+; Position=2-325
KFLFFLHFCILIKAISGLHCWNSNMILLSEMPEKGSVTVRQCPSGHQCVTANCWLGVGNYIVQKCVPDQPGARNYCKDFNNICQMGFFGMPIHCSSCKGDLCNEARN

SEQ ID NO: 161654 - protein, 77 aa, Heterodera glycines
  Coding regions on vcDNA: vcDNA=SeqID_88077; Strand=-; Position=74-307
TIHNFPSPFDDSDGPKFHSLFRNSGDMTRVHNITNIFVGFRSLKHDEFWRCHPNGNALLFQSVQNLLKAQCPPRLCT

SEQ ID NO: 161655 - protein, 191 aa, Heterodera glycines
  Coding regions on vcDNA: vcDNA=SeqID_88078; Strand=+; Position=3-578
KEDPTVAVYCYSSFSDIRSIDSFVDKILIAVKAPFEPQPRSSIEVPDPCETGRYEMTVRNENGGPLQAYLCREPTQKNASELAPNNCKAETEETKAIDSLGTQSFCGPKIPSNELRSPSKQQKMLSPLKLLFANSQPHPDAVSSNSVGPGGVFFPPPGDSFLSLDPPFEENDPYCPLFMNDQNTSLNSLFG

SEQ ID NO: 161656 - protein, 261 aa, Heterodera glycines
  misc_feature (229)..(229): Xaa can be any naturally occurring amino acid
  misc_feature (249)..(249): Xaa can be any naturally occurring amino acid
  Homolog annotation: Hit_ID=NP_499625.2; Match level="QueryCoverage =99%, HitCoverage=49%, E-value=1e-47, Identity=36%"; Hit description =CD36 antigen family member (60.2 kD) (3N544) [Caenorhabditis elegans] emb|CAB11566.3| Hypothetical protei
  Gene Ontology: Mol. function=cell adhesion molecule activity; Cellular component=integral to membrane; Biological process=apoptosis
  Coding regions on vcDNA: vcDNA=SeqID_88079; Strand=+; Position=2-784
RTRRSFFFVPSLSCAECRLSDRVTVPNILFQKIVEITQKGPKWTPFIEMIVKGRENVFISVSVDELLFNGYQDPLISEICSNVLFKMMCKLANIPDRIGLFYGQNNTDDGQYAVDTGLNDPDFLDRVYSFKGIEGKLSDDHWYGERARMINGTDAELFGPNLMDAPKLQIFIGQLCRSFDLEVRQPALTADLPVFRYAQPDSALDIAVQRSQGFCNPNSPLFFNESVQXVGCAPSGLLDMSSCFPGSPXIFFSASHFRNAH

SEQ ID NO: 161657 - protein, 128 aa, Heterodera glycines
  Homolog annotation: Hit_ID=CAE67927.1; Match level="QueryCoverage =100%, HitCoverage=58%, E-value=5e-36, Identity=57%"; Hit description= Hypothetical protein CBG13527 [Caenorhabditis briggsae]
  Gene Ontology: Mol. function=transporter activity; Cellular component= integral to membrane; Biological process=immune response
  Coding regions on vcDNA: vcDNA=SeqID_88080; Strand=+; Position=136-519
MTLQWTVVAFILYAEIATIIVLLLPWVRPTMWKKVFNSRVVHKLKQFSNVYAYAFIFVLILLFVDATREVRKYSHVDTTREMVGRVAEADAVVHMRLFRAQRNLYLSGFSLLMALIISRIVTLLARCA

SEQ ID NO: 161658 - protein, 197 aa, Heterodera glycines
  misc_feature (14)..(14): Xaa can be any naturally occurring amino acid
  Homolog annotation: Hit_ID=AAH73441.1; Match level="QueryCoverage =96%, HitCoverage=17%, E-value=6e-66, Identity=63%"; Hit description =MGC80941 protein [Xenopus laevis]
  Gene Ontology: Mol. function=ATP dependent helicase activity; Cellular component=polysome; Biological process=mRNA catabolism, nonsense-mediated
  Coding regions on vcDNA: vcDNA=SeqID_88081; Strand=+; Position=2-591
WDNGPFICEYVWNXTSFDRMFAALVKLESKESCVSQYIYHKLMGHDVDDILFKLIMPKKFSAPGLPELNHSQISAIKAALQRPLSLIQGPPGTGKTVTSATLVYHLVKLTNGQVLVCAPSNIAVDQLAEKIHRTGLKVLRFCAKGRETVDSSVAFLSLHNQLKALQSGDLFKLMKLKEEIGELSQADQNRFMALRRQ

SEQ ID NO: 161659 - protein, 117 aa, Heterodera glycines
  Coding regions on vcDNA: vcDNA=SeqID_88082; Strand=+; Position=1-351
QLADLAKKTLILFRDANESFSDQNAVSDWLRHSFDLPANSICELSSPSLVTNSQVFFIVFDEIGTAERILEMSKSEERAQKTFLTSATEFLQSNSPGKFTDAAFSDENAWRNLAAAS

SEQ ID NO: 161660 - protein, 149 aa, Heterodera glycines
  Homolog annotation: Hit_ID=CAE62813.1; Match level="QueryCoverage =98%, HitCoverage=17%, E-value=7e-46, Identity=59%"; Hit description =Hypothetical protein CBG06989 [Caenorhabditis briggsae]
  Coding regions on vcDNA: vcDNA=SeqID_88083; Strand=+; Position=3-449
IADKEVLNGFEDLYEAFVHFFTRGAPAERCMVNDAAFDRMVHTVEDKHLRAQHYIGGNAALMAQKIASSFPAATAYLVGPIGPRSHALLHPAIVRNNSTRIAEDELHLILEYKQGEILGEYVSPASSRFIVSHDQFSGSAMIIEMFFKA

SEQ ID NO: 161661 - protein, 45 aa, Heterodera glycines
  Coding regions on vcDNA: vcDNA=SeqID_88084; Strand=-; Position=2-136
MPTLSSFPSAICCFIRLSLALVASSFTSNELFWCVCCDGNLCCAD

SEQ ID NO: 161662 - protein, 200 aa, Heterodera glycines
  misc_feature (22)..(22): Xaa can be any naturally occurring amino acid
  misc_feature (170)..(170): Xaa can be any naturally occurring amino acid
  Homolog annotation: Hit_ID=AAH09744.1; Match level="QueryCoverage =84%, HitCoverage=49%, E-value=9e-38, Identity=52%"; Hit description =CSDA protein [Homo sapiens]
  Gene Ontology: Mol. function=transcription co-repressor activity; Cellular component=cytoplasm; Biological process=negative regulation of transcription from Pol II promoter
  Coding regions on vcDNA: vcDNA=SeqID_88085; Strand=+; Position=2-601
KRGRPWRAATPTITSTTARGRXENTTKNGGEEGVEKKILSKGVSGVVKWFNVMNGYGFICRDDTNDDIFVHNSAITANNPSKIQRSLGDGEKVMFDIVDGAKGPEAANVTGPDGVPVQGSKYAADLSQRRRFAGPRRNYFFRGNRNRRPRHSEEAAGGEVPVGEKKEGAXENNGKEAKKEEVAKDANGGRGGGQRPGRGV

SEQ ID NO: 161663 - protein, 241 aa, Heterodera glycines
  Homolog annotation: Hit_ID=NP_510459.1; Match level="QueryCoverage =99%, HitCoverage=43%, E-value=4e-15, Identity=31%"; Hit description =liquid facets (50.8 kD) (XP436) [Caenorhabditis elegans] emb|CAC35824.1| Hypothetical protein T04C10.2a [
  Coding regions on vcDNA: vcDNA=SeqID_88086; Strand=+; Position=2-724
EECEQECELRRGDDIRLQIAIEESKRELARSSSLSSPSGGIDPVEKQGTSKSHGALDDLLSLGLDDVFRSNIPNATAPGSSAQTQQQPPQLGVFNDPWSPRPSTTIPMVETAPPVSAHQTIIQNDPWAPAASSSDPSFVSFGSSSTTRTINPDGGHVLGPLMQASSTKNDPWASFETQSFAASEPTKQSSDDFFGNIGEPAQTTNQPTSQGQQRAGVKTPESFLGENSALVILISAWPSTI

SEQ ID NO: 161664 - protein, 170 aa, Heterodera glycines
  Homolog annotation: Hit_ID=XP_236612.2; Match level="QueryCoverage =98%, HitCoverage=10%, E-value=3e-27, Identity=41%"; Hit description =similar to mKIAA0800 protein [Rattus norvegicus]
  Coding regions on vcDNA: vcDNA=SeqID_88087; Strand=+; Position=1-510
CRVPVANCPPFSLFYPHRCPEPKMLYPAQANIVNRLLSRPSPSYRCTMDTLRRADRRLVFSRFRHWKSFSEESEALTCCAFSPTDNHAFLGTYAGDIFVFNIHTGTVETNYNAQHSAIRTIQPSKDRLMLTSSAYVKPYCILWKMDEKGISIHERLIDFNEEESVEFANL

SEQ ID NO: 161665 - protein, 243 aa, Heterodera glycines
  Homolog annotation: Hit_ID=AAN14978.1; Match level="QueryCoverage =99%, HitCoverage=69%, E-value=1e-139, Identity=99%"; Hit description= chitinase [Heterodera glycines]
  Gene Ontology: Mol. function=chitinase activity; Cellular component =extracellular space; Biological process=response to bacteria
  Coding regions on vcDNA: vcDNA=SeqID_88088; Strand=+; Position=43-771
LHRIVGYYQGIRPLTNDQAKKLTHLILAFSTPDSQGNLSPLFSVLKQALKAGKSANGALKVMIAIGGGGFDPAIFTSLASNSGTRKSFINNIVSYLKTNELDGCDIDWEFPTSSDKAIFVTFLRDLKKAMAPSGAVLSMASAASAFYLDPGYDLPGIESAVDFINVMCYDYYGSWTKTSTGPNSPLFKGGSADPSDTLNSNWTMNYHLMKVYNRAKLNMGVPFYGKSWTNVGAPLNGDGLWRQ

SEQ ID NO: 161666 - protein, 205 aa, Heterodera glycines
  misc_feature (7)..(7): Xaa can be any naturally occurring amino acid
  misc_feature (63)..(63): Xaa can be any naturally occurring amino acid
  misc_feature (88)..(88): Xaa can be any naturally occurring amino acid
  misc_feature (112)..(112): Xaa can be any naturally occurring amino acid
  misc_feature (128)..(128): Xaa can be any naturally occurring amino acid
  misc_feature (132)..(132): Xaa can be any naturally occurring amino acid
  misc_feature (153)..(153): Xaa can be any naturally occurring amino acid
  misc_feature (161)..(161): Xaa can be any naturally occurring amino acid
  misc_feature (193)..(193): Xaa can be any naturally occurring amino acid
  Homolog annotation: Hit_ID=AAL78216.1; Match level="QueryCoverage =100%, HitCoverage=61%, E-value=1e-105, Identity=92%"; Hit description=aspartic protease precursor Hgg-33 [Heterodera glycines]
  Gene Ontology: Mol. function=aspartic-type endopeptidase activity; Cellular component=extracellular space; Biological process=induction of non-apoptotic programmed cell death
  Coding regions on vcDNA: vcDNA=SeqID_88089; Strand=+; Position=1-616
QNGCHAXADTGTSLLAGPKNDIEKIQKYIGAIPLFHGEYMISCERIPTLPDVTINIGGKAYTXEGQGLCAENDQHGQKHMPFRFYGHXFAGTCRRTLDSWRCVYWSLLHGVXCGPKSCWFCAGQRRKXKFQXASSARLRKGRRTLLRSFQRSXTILISRWXGRFCNDGLKKIDFIYAIFSFIQFLIHDEAYEXTIFPSLIIVITM

SEQ ID NO: 161667 - protein, 92 aa, Heterodera glycines
  Coding regions on vcDNA: vcDNA=SeqID_88090; Strand=+; Position=84-362
DRIHVRMTRKTVQGTANRTESHLLLDNTEPIGGADILMASSVLAIVLQQFALFRAARLSLILHSLLHFAHLNCLVSMYGAAGIVLLFSTSKK

SEQ ID NO: 161668 - protein, 70 aa, Heterodera glycines
  Homolog annotation: Hit_ID=NP_502247.1; Match level="QueryCoverage =50%, HitCoverage=10%, E-value=1e-09, Identity=85%"; Hit description =protein phosphatase catalytic (36.3 kD) (4M623) [Caenorhabditis elegans] emb|CAB01174.1| Hypothetical pro
  Gene Ontology: Mol. function=protein phosphatase type 2A, intrinsic catalyst activity; Cellular component=cytoplasm; Biological process =embryogenesis and morphogenesis
  Coding regions on vcDNA: vcDNA=SeqID_88091; Strand=+; Position=130-342
QASAVHCRADARTPFATRTRTSRPNVRFAVVRPGRLELDDELNYSFLQFDPPAARRGEPHVTRRTPDYFL

SEQ ID NO: 161669 - protein, 240 aa, Heterodera glycines
  misc_feature (239)..(239): Xaa can be any naturally occurring amino acid
  Homolog annotation: Hit_ID=AAK26375.1; Match level="QueryCoverage =100%, HitCoverage=54%, E-value=1e-136, Identity=98%"; Hit description=class V aminotransferase [Heterodera glycines]
  Gene Ontology: Mol. function=alanine-glyoxylate aminotransferase activity; Cellular component=peroxisome
  Coding regions on vcDNA: vcDNA=SeqID_88092; Strand=+; Position=1-723
TGVVTPLERFGDICNAYDVLFLVDTVASICGAPFHADALKVDCVYAATQKVLNCPPGLAPISFSEKALEKITKRKTRVPSFYFDALELGNYWGCFDEPRRYHHTAPISLVYALREGLSAVAQEGIGHMVNRHKINAKLLYDAFDQLGLELFVQKENNRLPCLTTVRVPEGVDWKAVQDKLMAQGFEIAGGLGPTAGKIWRIGTFGINSNPEDIESLKQALKGALYEQEEEGQSDHFKAXI

SEQ ID NO: 161670 - protein, 43 aa, Heterodera glycines
  Coding regions on vcDNA: vcDNA=SeqID_88093; Strand=+; Position=1-129
SELYSHTKPLSPKRALPLGKWRPNVSGFCAVFFTEVPKVVEWL

SEQ ID NO: 161671 - protein, 89 aa, Heterodera glycines
  Coding regions on vcDNA: vcDNA=SeqID_88094; Strand=-; Position=2-268
FFFFFFFFFLVNFLFYSKSSISSCIRTNSQRQKASILNSRSQDTARDESRLLHLRHSRILEQIVVRSIRALLIGVIWRISEIIAIPSVL

SEQ ID NO: 161672 - protein, 50 aa, Heterodera glycines
  Coding regions on vcDNA: vcDNA=SeqID_88095; Strand=-; Position=2-154
MSLLFDVGRVCPSDSSHPSECVRRPHAEKWEFLVRHFIRIAVGIRSLNSV

SEQ ID NO: 161673 - protein, 138 aa, Heterodera glycines
  Homolog annotation: Hit_ID=AAO33474.1; Match level="QueryCoverage =100%, HitCoverage=100%, E-value=2e-72, Identity=99%"; Hit description=gland-specific protein g4g12 [Heterodera glycines]
  Coding regions on vcDNA: vcDNA=SeqID_88096; Strand=+; Position=18-434
MPDIFKILLIVLLAVVSFRLSASTGDKKTANDGSGNNSSAGIGTKIKRIVTAGLLFTSLATGGAEAIGRSNAQGGNAAGLVPSHVTNRSMAPPPPPVQFEMGANRLEKMRAHLRELAEKMPVNESKRLSPSGPDPHHH

SEQ ID NO: 161674 - protein, 175 aa, Heterodera glycines
  Coding regions on vcDNA: vcDNA=SeqID_88097; Strand=-; Position=2-526
SNDGDVDMRADSYDSEDSDANEQISARQLKLMRELEQKCVEFLNESDVTELNACEKFNDKFVAFVLANRPFENFRDLKSKLTVAPGRKAGAGAFVRLLDNYLEWLENRATTNQSPPPVAIPPHGTIKLPCHGYPLVLVHELNGFDGDLLLSSSPSYSVKSAAFDDVGMDNKAKVT

SEQ ID NO: 161675 - protein, 63 aa, Heterodera glycines
  Coding regions on vcDNA: vcDNA=SeqID_88098; Strand=+; Position=4-192
FLRIIAAAVLCPCHHQIKSTKAEPSEVCTNRLPNETGHHKSTKSSLSSAVKVVQKETHGPNRR

SEQ ID NO: 161676 - protein, 82 aa, Heterodera glycines
  Homolog annotation: Hit_ID=CAC35731.1; Match level="QueryCoverage =90%, HitCoverage=19%, E-value=2e-14, Identity=51%"; Hit description =diphosphomevalonate decarboxylase [Mus musculus] sp|Q99JF5|ER19 _MOUSE Diphosphomevalonate decarboxylase (M
  Gene Ontology: Mol. function=diphosphomevalonate decarboxylase activity; Cellular component=cytosol; Biological process =embryogenesis and morphogenesis
  Coding regions on vcDNA: vcDNA=SeqID_88099; Strand=+; Position=2-247
GAKLCRAGRNTMAESNQLHAACMDTSPPLNYLNVTSHALIEFVHDFNTRYGTRLAYTFDAGPNCCLLFELETFDLLRHALPN

SEQ ID NO: 161677 - protein, 75 aa, Heterodera glycines
  Coding regions on vcDNA: vcDNA=SeqID_88100; Strand=-; Position=10-237
VIDVPPPPCVVVVVVSLSLLPMPKMPKVPSTIRRKVKRAQKVLKFASWVILILCSLYGGLFLSFCNDRRRYFKYK

SEQ ID NO: 161678 - protein, 150 aa, Heterodera glycines
  Coding regions on vcDNA: vcDNA=SeqID_88101; Strand=-; Position=40-492
KFHCYLNIPTVATGNFKKKQRYNYVKHQSQVKANLNGLEKDVKEKGQFVDDAKESFHQKNVNDDTNENVKQRKRPEKHHGNEHEAEEQRETEHTAKLGMVFDIKCCTAAFEVSVRIVGIDSECRAKLGHFNGKSGNEWTRLFSINSNFQN

SEQ ID NO: 161679 - protein, 167 aa, Heterodera glycines
  Homolog annotation: Hit_ID=CAE70331.1; Match level="QueryCoverage =53%, HitCoverage=30%, E-value=2e-18, Identity=47%"; Hit description =Hypothetical protein CBG16864 [Caenorhabditis briggsae]
  Coding regions on vcDNA: vcDNA=SeqID_88102; Strand=+; Position=8-508
MAGKFIGGRMPFRQSLWAPSFLTVSPLWPFPLRPNSAFSHARVFNSEFPSSHSPKLRCVLSANNKTNSRARRYHHPRPHLVIFDKDGTLICFHSLWVPWVRSFAQKVDEAGIDGIAPNVFHALGFCPVLKKVKRGLLAEGTMRQILDRVVHLLVQNGLQRRESLNVD

SEQ ID NO: 161680 - protein, 50 aa, Heterodera glycines
  Coding regions on vcDNA: vcDNA=SeqID_88103; Strand=+; Position=14-163
MSAAVSSSRPMEDWKSELAMPDKDLRYKTSDVTATKGVEFEEFGLTRDPL

SEQ ID NO: 161681 - protein, 83 aa, Heterodera glycines
  misc_feature (42)..(42): Xaa can be any naturally occurring amino acid
  Coding regions on vcDNA: vcDNA=SeqID_88104; Strand=-; Position=30-281
FLAPPRKEKFGGAPKKIFGISLSEGRSMAKSERVPLFFVPFXSELRIIYSFMHFIAWLIGWAKIFFVNYWFWLLHFFRKKTRI

SEQ ID NO: 161682 - protein, 77 aa, Heterodera glycines
  misc_feature (18)..(18): Xaa can be any naturally occurring amino acid
  misc_feature (28)..(28): Xaa can be any naturally occurring amino acid
  Homolog annotation: Hit_ID=CAE73419.1; Match level="QueryCoverage =100%, HitCoverage=7%, E-value=3e-24, Identity=70%"; Hit description =Hypothetical protein CBG20862 [Caenorhabditis briggsae]
  Gene Ontology: Biological process=cell cycle
  Coding regions on vcDNA: vcDNA=SeqID_88105; Strand=+; Position=22-252
GLLERVEIEPKSSSDTMXFKDNTAGYFXNLATLDKGGQYKTVKHRHTVQVHPNSCLFEDRLRWVIYYELVFTSKEFM

SEQ ID NO: 161683 - protein, 30 aa, Heterodera glycines
  Coding regions on vcDNA: vcDNA=SeqID_88106; Strand=-; Position=1-90
GHLICVRFTGDILSFWKIGGGFQRKERGAS

SEQ ID NO: 161684 - protein, 88 aa, Heterodera glycines
  Coding regions on vcDNA: vcDNA=SeqID_88107; Strand=-; Position=2-265
WGQLANEIWGGTRNWRGTQMMIKMGLGGVHFFGFFSDPSVCFLHHRFSSFHPILLLLLLLQLIILRLRLLVEHYFALFFLRLLFFFLP

SEQ ID NO: 161685 - protein, 131 aa, Heterodera glycines
  Homolog annotation: Hit_ID=CAE57411.1; Match level="QueryCoverage =100%, HitCoverage=16%, E-value=4e-29, Identity=47%"; Hit description= Hypothetical protein CBG00366 [Caenorhabditis briggsae]
  Coding regions on vcDNA: vcDNA=SeqID_88108; Strand=+; Position=2-394
LQCAGDSAGLWQSYVTRSAFSSQMLNNSQNIEELRHNTEGFAKALGFSSTAHHRISSKMAGSPQTVRVFVDELSRRFRPVFFSRLEGAWKTYAEEQEERVISDLEAFDLFYICRKEAEHNQNVDSLELMEH

SEQ ID NO: 161686 - protein, 86 aa, Heterodera glycines
  Coding regions on vcDNA: vcDNA=SeqID_88109; Strand=+; Position=306-566
MRILPPYFSDHFMLFIHQPQNTTTNRQHIFHIWITKKKPDDDFDQPHQFFNCFFLQFLNLFKEFACFFAPPSSPPPPLIYLVYMLL

SEQ ID NO: 161687 - protein, 256 aa, Heterodera glycines
  misc_feature (1)..(1): Xaa can be any naturally occurring amino acid
  Coding regions on vcDNA: vcDNA=SeqID_88110; Strand=+; Position=3-770
XKMETTKAQLLGIFWDFFSEAAKANLLWKRLRFADQQIVELVDQFCRIDKQYLLSHSQITLALRNVDNAMAFCQNWLVACAKAANAMQTTIVMDAFSHWIYSGRPPLNGAIEIVHFWIELFSKRTATNDIRRMCRWPEIDKNLFRRIGILFVEANEKYVLKLKILEKIKGVRQLLDEICANVNHLSLTCCAHNSLQIAMDQWKTTVCPNGQFRYLLQPKNKKNKQSAEMVLYQNRQLPPAHANQQLSTNKCAICLS

SEQ ID NO: 161688 - protein, 244 aa, Heterodera glycines
  Homolog annotation: Hit_ID=EAA58591.1; Match level="QueryCoverage =85%, HitCoverage=46%, E-value=3e-30, Identity=38%"; Hit description =hypothetical protein AN6773.2 [Aspergillus nidulans FGSC A4] ref|XP _410910.1| hypothetical protein AN6773.
  Coding regions on vcDNA: vcDNA=SeqID_88111; Strand=+; Position=1-732
TAPPVLDLTALVTVTTFLVPSHAHRDRVVTISSPENSNFIQCAPSYAFRKTGVLEIANFEPRWEQMLYTLFLAEGWIVNAPDHEGPESAFSAGRFGGHMVLDSMRAANNFKPLQLSKRPMHIGHGYSGGSTPNGWAASLHETYANELNVVGWSLGGSMTDPLYTLNSLDGKPTSSLVVAGAIGLMDAYRDEVGNLLDDEVWTEEGKIAEKVMRNSCVYEAVIRYFGATFQSERYIKGGRNLSSW

SEQ ID NO: 161689 - protein, 200 aa, Heterodera glycines
  Coding regions on vcDNA: vcDNA=SeqID_88112; Strand=+; Position=1-600
QEIVTLRMNVQPPPTATHSQPTILPMPIQNWSHELGIEFGDVLIADLLRRMCSPDFSSPLAPSARWHDIPFFEQFRSDLQFQWTLLRSVLVGGNRGKLNAKLLSILFWTVSDREEWQKRTVARLIYAAKDDKELANLVSLVIAVLPQLCQHRQQSSGELGLMSAAILLALADARRFGTEWDQFVMATDASGSTDPKNGSK

SEQ ID NO: 161690 - protein, 59 aa, Heterodera glycines
  Coding regions on vcDNA: vcDNA=SeqID_88113; Strand=+; Position=1-177
GVENFFYNKMMNKIYTTIHFLLLLTVIANKSTNCATNVQGTQTVKTADATYDEAGKIFA

SEQ ID NO: 161691 - protein, 143 aa, Heterodera glycines
  Homolog annotation: Hit_ID=CAE60278.1; Match level="QueryCoverage =95%, HitCoverage=31%, E-value=3e-26, Identity=41%"; Hit description =Hypothetical protein CBG03859 [Caenorhabditis briggsae]
  Gene Ontology: Mol. function=protein binding; Cellular component =integral to membrane; Biological process=regulation of cell cycle
  Coding regions on vcDNA: vcDNA=SeqID_88114; Strand=+; Position=35-466
PHPLQGIIHCDIAARNCLYSNGVVKISDFGMAHRGPVKKMEPNARVPVKWLSPEALAERCFTAKSDTWAYGVMCWEIFTNGEVPYSQMAGSDVAVSLINGQRLDFPRDAPSKFVEFILQHTWDAETSGRYSMAAVHDWLKRHT

SEQ ID NO: 161692 - protein, 79 aa, Heterodera glycines
  Coding regions on vcDNA: vcDNA=SeqID_88115; Strand=-; Position=6-245
AFPLFVVFVGEFAVFVFLLTLYRPSSEEIPDTATEVLVDEMPESFSMCRTDLSVLSIFFSLSVKAFPELSSISTEFVAF

SEQ ID NO: 161693 - protein, 105 aa, Heterodera glycines
  Coding regions on vcDNA: vcDNA=SeqID_88116; Strand=+; Position=57-371
MKMVEKENDIAAAVPNNAANNGHVEAVDPSASKSAKEVPNNTEKHSAEDLMGLARLFLKEYYTKLSDLPSEAGIFYGDDSHFVHADVEETGRENIQRAIGNMGLR

SEQ ID NO: 161694 - protein, 127 aa, Heterodera glycines
  Coding regions on vcDNA: vcDNA=SeqID_88117; Strand=+; Position=1-384
PLLLLASPIHLLCAAFLLPDSASSRSDQIAAAALISRCVSTPTKGRLAGESLHKAERVYRIYHNMEPVYLLPTYTLGLRPIITNRNTLRSLPSALLPNSLKLTWTPGLTTFGCQTQRAIPLLTQKCY

SEQ ID NO: 161695 - protein, 78 aa, Heterodera glycines
  Homolog annotation: Hit_ID=AAP30775.1; Match level="QueryCoverage =97%, HitCoverage=38%, E-value=2e-31, Identity=90%"; Hit description =putative gland protein G32E03 [Heterodera glycines]
  Coding regions on vcDNA: vcDNA=SeqID_88118; Strand=+; Position=24-257
MRAVLFLAMVCLVMAVILETANSKAAKKENKKGAVATSAKGKAAPKGAAKGGIKKDAKSKGKGKKDAKGKKKKKKKKK

SEQ ID NO: 161696 - protein, 182 aa, Heterodera glycines
  Coding regions on vcDNA: vcDNA=SeqID_88119; Strand=+; Position=62-610
MNRRWLCNDVWMDILPFFDRPQLGLKLAMLSPRFDALVGIHFDGKTELTLWRPIAIRNSAAAVPELHVFFDGANNSVPFPLPDVHSPPMPNNIRFKDLRINCIDHSVIAFLRANQLIFQKGTNLRLSVPFGPFNIDDVQPILDDFARQIWPIFASTIRHFWFPDCRILDTLASSSFADNSHR

SEQ ID NO: 161697 - protein, 43 aa, Heterodera glycines
  Homolog annotation: Hit_ID=AAM74953.1; Match level="QueryCoverage =90%, HitCoverage=14%, E-value=2e-14, Identity=94%"; Hit description =chorismate mutase [Heterodera glycines]
  Coding regions on vcDNA: vcDNA=SeqID_88120; Strand=+; Position=3-131
DSNLLVGMNGTTEDKTAPGANANGAFLCCKATQGTATLFIVGV

SEQ ID NO: 161698 - protein, 81 aa, Heterodera glycines
  Coding regions on vcDNA: vcDNA=SeqID_88121; Strand=-; Position=2-244
RMLCMQQHCFIRYFNGVPSLRSASAVAPPTGVDAVSVAPVVFVSARRVPMTRERQIRPPHVPFCRSCQSQAANPYSSSCPS

SEQ ID NO: 161699 - protein, 260 aa, Heterodera glycines
  Homolog annotation: Hit_ID=NP_394249.1; Match level="QueryCoverage =86%, HitCoverage=21%, E-value=3e-12, Identity=28%"; Hit description =chromosome segregation protein related ptotein [Thermoplasma acidophilum DSM 1728] emb|CAC11918.1| chromo
  Gene Ontology: Mol. function=cytoskeletal protein binding; Cellular component=cell-cell adherens junction; Biological process =intercellular junction assembly and/or maintenance
  Coding regions on vcDNA: vcDNA=SeqID_88122; Strand=+; Position=1-780
EGKVCEPINQVEALTAEKRRMEKTLQTTSREREELAQENKKLAAKLMNRKAQDRIIGERERGLEEELRQERLKSESANARIRELEQRIECIQDMNRDIAVEISNANSPLLITISSLEEKLLGLERENDILTRSTRQMSAELGAMKRRHEAEMGTIERSLEEEKQQNAQKTEELAKAFSERANIQTRIEKLEDELLQSKREHSERVNRMEKRMEQLETDIQAKRNELTESQRKNCEFQQKIIASTVERRNHANSLLIVNPL

SEQ ID NO: 161700 - protein, 55 aa, Heterodera glycines
  Coding regions on vcDNA: vcDNA=SeqID_88123; Strand=-; Position=0-164
AVLTFGAFDLETFGDLGLEAFGNFGLEAFIAFGLAVFSDFDFEAFVGVRDFFGVV

SEQ ID NO: 161701 - protein, 67 aa, Heterodera glycines
  Coding regions on vcDNA: vcDNA=SeqID_88124; Strand=-; Position=3-203
WPYSVQLQQKFLSCDQWLAVFNVPTEQKFFKNAGTELRFLLEHKLGHQLEQFLLIQSGQNGISSERR

SEQ ID NO: 161702 - protein, 55 aa, Heterodera glycines
  Homolog annotation: Hit_ID=AAP30764.1; Match level="QueryCoverage =98%, HitCoverage=12%, E-value=1e-22, Identity=100%"; Hit description= putative gland protein G28B03 [Heterodera glycines]
  Coding regions on vcDNA: vcDNA=SeqID_88125; Strand=+; Position=48-212
MNILLKSVLFISLLSLFGDCMKNSDQIGVKRKSAGIRIEEPNDVKGKGKVVETSI

SEQ ID NO: 161703 - protein, 32 aa, Heterodera glycines
  Coding regions on vcDNA: vcDNA=SeqID_88126; Strand=-; Position=2-97
TGQTKQETQPLLEAHDHSRENGQQAECLTITS

SEQ ID NO: 161704 - protein, 147 aa, Heterodera glycines
  Coding regions on vcDNA: vcDNA=SeqID_88127; Strand=+; Position=67-510
MAEFLALFDRSIQETTTDQLSEPAREKVRCLFNLRENKWGVVAEPNVGDGPLTTASTSVGIIGPDDVPLTEDECAFMEENLDNFVDNSPGESQCLNAFDEDNVEDDFEKFLQATAIRAAEKALEKVSIDEDDDASSIVSSHKFSTSK

SEQ ID NO: 161705 - protein, 51 aa, Heterodera glycines
  Homolog annotation: Hit_ID=XP_391994.1; Match level="QueryCoverage =94%, HitCoverage=6%, E-value=1e-14, Identity=70%"; Hit description =similar to hypothetical protein [Apis mellifera]
  Gene Ontology: Mol. function=iron ion binding; Cellular component =cytosol; Biological process=citrate metabolism
  Coding regions on vcDNA: vcDNA=SeqID_88128; Strand=+; Position=34-186
WKMYNISQLLFNKYGVGFWHPGAGIIHQVILEHYAFPGLLLIGTDSHTPKR

SEQ ID NO: 161706 - protein, 94 aa, Heterodera glycines
  misc_feature (60)..(60): Xaa can be any naturally occurring amino acid
  Homolog annotation: Hit_ID=CAE60587.1; Match level="QueryCoverage =90%, HitCoverage=9%, E-value=6e-13, Identity=40%"; Hit description =Hypothetical protein CBG04223 [Caenorhabditis briggsae]
  Gene Ontology: Biological process=locomotory behavior
  Coding regions on vcDNA: vcDNA=SeqID_88129; Strand=+; Position=1-281
QPVHKILTLRTAANPSLKTNKCAIVHRSVDAALNWLNYDEHNPFVLCSRSFVPLYWGKPXDRVPSAAPTFAGSVCGVCEVAEIGREASSDLMIS

SEQ ID NO: 161707 - protein, 89 aa, Heterodera glycines
  misc_feature (86)..(86): Xaa can be any naturally occurring amino acid
  Homolog annotation: Hit_ID=AAP30754.1; Match level="QueryCoverage =100%, HitCoverage=47%, E-value=9e-44, Identity=97%"; Hit description= putative gland protein G11A06 [Heterodera glycines]
  Coding regions on vcDNA: vcDNA=SeqID_88130; Strand=+; Position=27-293
MSSSPSVSVLAIVAIVCLMCQCCFSAPHPCCPGSQKVVSLMSNYVGTFANSISKSSLCSDAQNVADALKGQLIGCSKGGDRTLLAXIEA

SEQ ID NO: 161708 - protein, 197 aa, Heterodera glycines
  Homolog annotation: Hit_ID=EAL33677.1; Match level="QueryCoverage =35%, HitCoverage=33%, E-value=3e-11, Identity=43%"; Hit description =GA21056-PA [Drosophila pseudoobscura]
  Gene Ontology: Mol. function=chromatin binding; Cellular component =nucleus
  Coding regions on vcDNA: vcDNA=SeqID_88131; Strand=+; Position=1-591
ILKKFPSLTDAFKKKRGNILNFEEEEFDEIISNGTSKRDNSPYTDHDYAGTRQLATAKGATGKHQRQKGGGGTAKEPKKKTALVNGTDSVVRSSARPHRPTKRFVEETNESFIRGTSKVRRTSPRKHGKKSTAEGGSEGEESEDDGKEYSVEKVFKKRVKGGKMEYFVKWAGYDDGWNTWEPRKSLKHLEVFKQYEK

SEQ ID NO: 161709 - protein, 202 aa, Heterodera glycines
  misc_feature (188)..(188): Xaa can be any naturally occurring amino acid
  Homolog annotation: Hit_ID=AAP30770.1; Match level="QueryCoverage =100%, HitCoverage=78%, E-value=2e-35, Identity=42%"; Hit description= putative gland protein G17G01 [Heterodera glycines]
  Coding regions on vcDNA: vcDNA=SeqID_88132; Strand=+; Position=86-691
MRKFAYFKLCQAVLTSVFLWQILSTHQFCGEFDEPTAFFNSAVSSSHCEQFTLIGMDSTTGEYGAMPDKQKWHMQLMASSGSGQPIDEQQQNHMDEFSSKLPTVGRHCIPIAFSLVKPWVRDNKSHLQKVADLFAIQLLCGLLSLFVIAMHVLDQPRSWGYESIDYERTTFCAVLWCCPALVSSVLLXHWTSYWHCTNFRAD

SEQ ID NO: 161710 - protein, 90 aa, Heterodera glycines
  Homolog annotation: Hit_ID=CAA70694.1; Match level="QueryCoverage =100%, HitCoverage=24%, E-value=1e-38, Identity=95%"; Hit description= cathepsin S-like cysteine proteinase [Heterodera glycines]
  Coding regions on vcDNA: vcDNA=SeqID_88133; Strand=+; Position=23-292
MAFLSRLSILPNSPISLLAVSLAVLAFVALASANPPTARETAPNAQQNNANSVATGEIAKNIAEKMERMNEFINYFRAKKFIDAHNLAFE

SEQ ID NO: 161711 - protein, 141 aa, Heterodera glycines
  Homolog annotation: Hit_ID=AAH80970.1; Match level="QueryCoverage =96%, HitCoverage=93%, E-value=5e-28, Identity=46%"; Hit description =MGC79746 protein [Xenopus tropicalis] ref|NP_001008076.1| MGC79746 protein [Xenopus tropicalis]
  Gene Ontology: Cellular component=TRAPP; Biological process =intracellular protein transport
  Coding regions on vcDNA: vcDNA=SeqID_88134; Strand=+; Position=114-539
MTIYNLYFFNRHGVCLAYKEWCREKKSGISPDEELKLVNGMLLSLRSFSHKLATRADQVPMISCFRTSSYKMNYMETATGLKMILNTDPDAVSIPELLQSIFCVFVETVLKNPFVDTSKRIDSELFNKRVDELVRAHFCFT

SEQ ID NO: 161712 - protein, 177 aa, Heterodera glycines
  Homolog annotation: Hit_ID=EAL18365.1; Match level="QueryCoverage =90%, HitCoverage=17%, E-value=1e-20, Identity=35%"; Hit description =hypothetical protein CNBJ2880 [Cryptococcus neoformans var. neoformans B-3501A]
  Gene Ontology: Mol. function=translation initiation factor activity; Biological process=embryonic development
  Coding regions on vcDNA: vcDNA=SeqID_88135; Strand=+; Position=32-562
PIPVGICANVAFHPHNFVGDYFYQQSRKESVDVGQLAERTTWILRMLETNRVVHARPKYIIVLRDGLSEAQFSMAIDEEMGALKMGCMDYDESYKPKFMFVVGAKRHFKKFFMVHDGTVVNLTPGSVINEKMVRPDIPEFFMQSHYPKKGTGKPVEYSVLVDEIGMTQDELHGFLNA

SEQ ID NO: 161713 - protein, 204 aa, Heterodera glycines
  misc_feature (63)..(63): Xaa can be any naturally occurring amino acid
  Homolog annotation: Hit_ID=NP_501624.1; Match level="QueryCoverage =62%, HitCoverage=39%, E-value=1e-10, Identity=34%"; Hit description =putative protein family member (4K58) [Caenorhabditis elegans] emb|CAA92507.1| Hypothetical protein F49C1
  Coding regions on vcDNA: vcDNA=SeqID_88136; Strand=+; Position=3-618
TKGHALLSHYGGGHTAKAEKELLKIYPECHWIDADPSDEINADMTESIGGTFVDGPIGAEDGXKQPVISWGATITELKLQKQIGIIDFLNNHTNWHHHPVDLLLMDIEGAEFPIVELFAYHFERFTGSICQINMEVHDPNTLIANYTHQQFFQSFDTLVRSGQFALMNTDMYTGRCTTAYVSQNVLCECGGRKVYKEIPVLITN

SEQ ID NO: 161714 - protein, 166 aa, Heterodera glycines
  Coding regions on vcDNA: vcDNA=SeqID_88137; Strand=-; Position=29-529
RVRYASLCFCAIHPFSLSLFVELRNSTEASEIPSFEIWIMVPIVITAGHWPIAIIRIGWQKLETVEAAIVPIGVQQITAIGRPIRTEQWVKVVIGDDVAQVAGHRPVIGLVFGPVSRGRIDLRVSLCDVRRGMDPRHLRIRAVGPTFGHICGRLTAAQVTSANAAD

SEQ ID NO: 161715 - protein, 57 aa, Heterodera glycines; identical to SEQ ID NO: 160188
  Coding regions on vcDNA: vcDNA=SeqID_88138; Strand=-; Position=523-696

SEQ ID NO: 161716 - protein, 46 aa, Heterodera glycines
  misc_feature (6)..(6): Xaa can be any naturally occurring amino acid
  Coding regions on vcDNA: vcDNA=SeqID_88139; Strand=+; Position=1-138
YAALEXAPPQNHGVPSRMYGQTEWRPNPNGCQRISQSDGGGAFAGE

SEQ ID NO: 161717 - protein, 196 aa, Heterodera glycines
  misc_feature (16)..(16): Xaa can be any naturally occurring amino acid
  misc_feature (168)..(168): Xaa can be any naturally occurring amino acid
  Homolog annotation: Hit_ID=CAE71397.1; Match level="QueryCoverage =97%, HitCoverage=18%, E-value=7e-96, Identity=88%"; Hit description =Hypothetical protein CBG18305 [Caenorhabditis briggsae]
  Gene Ontology: Mol. function=calcium-transporting ATPase activity; Cellular component=smooth endoplasmic reticulum; Biological process =calcium ion homeostasis
  Coding regions on vcDNA: vcDNA=SeqID_88140; Strand=+; Position=1-586
VAKSAAEMVLADDNFXTIVAAVEEGRAIYNNMKQFIRYLISSNIGEVVSIFLVAALGIPEALIPVQLLWVNLVTDGLPVTALGFNPPDLDIMDRLPRSASESLISKWLFFRYMAIGTYVGVATVAASMWWFLIYEDGPQVSYYQLTHWMRCEIEPENFEDLDCAVFVXNHPNTMALSVLVTIEMLNAINSLSGESV

SEQ ID NO: 161718 - protein, 103 aa, Heterodera glycines
  Coding regions on vcDNA: vcDNA=SeqID_88141; Strand=+; Position=2-313
SSPLYISCQAVSEDVLVSKLSGVARLDQLMEELILEDNDPKEPEPPLAASSSKNADSVGTYDERSHAEPPSAETDLSIIAPNIGRFLVGSLPFAMGSKLSHCC

SEQ ID NO: 161719 - protein, 191 aa, Heterodera glycines
  misc_feature (158)..(158): Xaa can be any naturally occurring amino acid
  misc_feature (163)..(163): Xaa can be any naturally occurring amino acid
  misc_feature (172)..(172): Xaa can be any naturally occurring amino acid
  Homolog annotation: Hit_ID=AAL78214.1; Match level="QueryCoverage =94%, HitCoverage=93%, E-value=3e-94, Identity=87%"; Hit description =putative esophageal gland cell protein Hgg-20 [Heterodera glycines]
  Coding regions on vcDNA: vcDNA=SeqID_88142; Strand=+; Position=140-709
MGQINLCDDVWLDTLAWINRGEVGMKFALVNARFNTLVDRHFEQRKWCFGEFHICERMTEESGAEIMTSIDGSDFSTLPLPTTPLPDSVVGFQSISIWYINEEVINFLCTIRRLLAEDIALEFSTYFTEYRSWKVMARHIWPLLRDGISTLFLKKCDXGHAPXNTCRPPCCXDCAGLHRIHTQMLPECPSA

SEQ ID NO: 161720 - protein, 143 aa, Heterodera glycines
  Coding regions on vcDNA: vcDNA=SeqID_88143; Strand=+; Position=32-463
FILSSHWQSLGYAPKYLCFMFDVSIDLVWFAVGEAIISLHPLTNALISSVPSSALSRGVETNAAVVRPPNSADALFQLPAEYDNSQPNRLLQYRTNDHRRLGYFWRSGQSRRHSARSIVTTKRYALPQILTKVPSYVSHHFIN

SEQ ID NO: 161721 - protein, 242 aa, Heterodera glycines
  Homolog annotation: Hit_ID=AAL78214.1; Match level="QueryCoverage =59%, HitCoverage=75%, E-value=4e-14, Identity=32%"; Hit description =putative esophageal gland cell protein Hgg-20 [Heterodera glycines]
  Coding regions on vcDNA: vcDNA=SeqID_88144; Strand=+; Position=46-771
MPSEMRFISADCWLLVFDFLAPSQLGLGIALISRRFDFYVDEHFKTRKWMLNKQLLITWDIEENGTKKMQIIDADRKETLPIPQKPLPNKVIGFSGRIQIIYIDQNVLTFLGHFHRFFATSAMDLDIVIENGRILEFVLLNIWPMFRDSIRRLFLNAIAFRCLRQLAPSMLTDCPSLCAVVFNDGIVSEFPIDDSAMASDVQVLAKWLFTPHPDGVPKWLKCSVNSSVEQWSSTIEQFKSAF

SEQ ID NO: 161722 - protein, 230 aa, Heterodera glycines
  Homolog annotation: Hit_ID=NP_505526.1; Match level="QueryCoverage =94%, HitCoverage=38%, E-value=2e-67, Identity=53%"; Hit description =zinc finger protein 277 (71.1 kD) (5K268) [Caenorhabditis elegans] emb|CAA94823.1| Hypothetical protein F
  Gene Ontology: Biological process=regulation of transcription, DNA -dependent
  Coding regions on vcDNA: vcDNA=SeqID_88145; Strand=+; Position=1-690
DLLRNECIYCEKTFADRNVLMEHMRKKNHREVNPKNNYYDKFYIINYLELGKRWLDVLAEDFEDTMPTFVDSDDEEEDSWHEWQEDNADEGDLFAVCLFCPHAREELEETIKHMNETHKFDLIGYIHDNSMDTYDRMKFVNFIRKRTFNTRTKDQQTMESKCVEIPDKEQWDNEENLVPLFGNDHLLWMLESWHLEHEMEIGKKATECDEPIEKAVTESVVDSPKINMGT

SEQ ID NO: 161723 - protein, 170 aa, Heterodera glycines
  Coding regions on vcDNA: vcDNA=SeqID_88146; Strand=+; Position=2-511
EKHLTSMEPIIPREQAQCLQNVFKHFAHFEINSATKDWTQEELRLYKRLFLGLRLCTLTFPPQLLRNLQILFKCIRQFCFNAKLMRENCWSANLRISNEENSLSICEINDQRIERVLRELFVLFFPQKNLECPKSFSLFKLLVEHVTPCLIQTPKWLADEVQKEMKDLLI

SEQ ID NO: 161724 - protein, 128 aa, Heterodera glycines
  Coding regions on vcDNA: vcDNA=SeqID_88147; Strand=+; Position=87-470
FVSTRSSVVGALSVYNCSSQFGALIGDTFTIIQPNLIRFRWKDWGWDDDYRKMKECIKSTDGRGAGVDKPSVVVAVSGDGYDAEAKSAADVANSSAENHHNDDHYAEHCLLMIRALNPSRQLLKNGTP

SEQ ID NO: 161725 - protein, 84 aa, Heterodera glycines
  misc_feature (11)..(11): Xaa can be any naturally occurring amino acid
  Coding regions on vcDNA: vcDNA=SeqID_88148; Strand=+; Position=5-256
RSAMSNAAANXGNGNGPQKCLVDEENVGPQLSSDSAAEHPPSYRRAAPPRSPSRNFQKRLSSTRPTPAASPTRKKSLSAISASG

SEQ ID NO: 161726 - protein, 199 aa, Heterodera glycines
  Coding regions on vcDNA: vcDNA=SeqID_88149; Strand=-; Position=15-614
AEMPSPTTTTGQSPDTSSVSAVAAIVARAIVVAVASVAGAIVVAVSVAPESPPSVSSNRCFNELRLYTTRPSAAAADSPGTPNSLGCCRPHANTTCLQRSVKVRCSAVFGTVSVPCSSQWHVPTKEGWQIFFPLLLCDEKMTFISQKTMNECEKNGRQLNDWGRERDRRESEKERKKGKGKDERTAEECTIKGVNYMCN

SEQ ID NO: 161727 - protein, 141 aa, Heterodera glycines
  Coding regions on vcDNA: vcDNA=SeqID_88150; Strand=-; Position=158-583
QTSFSKSYYQVQKNMLIIVRNGTGRLFALGQLYLVVGMMAFSVCWCSTVSPFPLDDRRLNEPRLGGGRLSVVEESPRRGTHTPPMQQQTPNEDDDHQKEYHSNGGNCFAFHSIVHFAESENMRVERMQTAITVKVLWTPTT

SEQ ID NO: 161728 - protein, 179 aa, Heterodera glycines; identical to SEQ ID NO: 160140
  Homolog annotation: Hit_ID=NP_499756.1; Match level="QueryCoverage =75%, HitCoverage=67%, E-value=8e-18, Identity=35%"; Hit description =polyposis locus protein 1 family member (3O468) [Caenorhabditis elegans]
  Gene Ontology: Cellular component=membrane; Biological process =membrane organization and biogenesis
  Coding regions on vcDNA: vcDNA=SeqID_88151; Strand=+; Position=27-566

SEQ ID NO: 161729 - protein, 214 aa, Heterodera glycines
  Homolog annotation: Hit_ID=AAL78214.1; Match level="QueryCoverage =66%, HitCoverage=74%, E-value=9e-15, Identity=30%"; Hit description =putative esophageal gland cell protein Hgg-20 [Heterodera glycines]
  Coding regions on vcDNA: vcDNA=SeqID_88152; Strand=+; Position=17-658
MSSENEIFICSDCWLLVFDFLAPSQLGLGIALISRRFDFYVDEHFKTRKWKLNKPFLIQWDTQENGTKQMQIVNSDDGSPLPIPQNLLPNKVIGFKYIEIIYIDQNVIAFLRRFHRFFAVCSTDLFIITENDRILDFVLLNIWPMFRHSMHLMIFNTIVFRRLRQLAPSLLSDCPSIRIVSFLDAIFPAFPPDESANASDGQAVTKWLLTPRPD

SEQ ID NO: 161730 - protein, 59 aa, Heterodera glycines
  Coding regions on vcDNA: vcDNA=SeqID_88153; Strand=-; Position=1-177
FNQPLGHVSRYHYTESSHMIVCGRARTRLFGSATRGLSVSVPAASKAVIVALSSRVSVA

SEQ ID NO: 161731 - protein, 201 aa, Heterodera glycines
  Homolog annotation: Hit_ID=CAE58525.1; Match level="QueryCoverage =89%, HitCoverage=30%, E-value=9e-14, Identity=27%"; Hit description =Hypothetical protein CBG01680 [Caenorhabditis briggsae]
  Coding regions on vcDNA: vcDNA=SeqID_88154; Strand=+; Position=140-742
MVVSQSKERIEPHGFKERAKVETLSKETIKTETSPKKDLFYIPKRKPLQGAPSISPASTATSTPKTISPPIVRPPSVESTLQHSSSCSPEDSFGSMTIPTKPTRDWSREFTMILNQDEAKRYHNIFKNEYAEYRRCYDDLTHVAQDFLALKSTMDKANDAIECQMVVKRIREKFTSLQNDQQFMLKRQRHTDLHAKLNAIK

SEQ ID NO: 161732 - protein, 67 aa, Heterodera glycines
  misc_feature (27)..(27): Xaa can be any naturally occurring amino acid
  Coding regions on vcDNA: vcDNA=SeqID_88155; Strand=+; Position=1-201
IPSYVKACKKYDPNWEPKFVYCIVDKXITTNVSSLRGQQQVENTAPGAVIDSKVVRVDIHEFWMQSH

SEQ ID NO: 161733 - protein, 64 aa, Heterodera glycines
  Coding regions on vcDNA: vcDNA=SeqID_88156; Strand=-; Position=76-270
IMYNWGVRAHDDAFDGAMQMVIVMFKVGSDRNSSRELATLSFPLIKLSGFLREFSSDGLAFQIQ

SEQ ID NO: 161734 - protein, 105 aa, Heterodera glycines
  Homolog annotation: Hit_ID=CAA70694.1; Match level="QueryCoverage =100%, HitCoverage=29%, E-value=7e-51, Identity=97%"; Hit description= cathepsin S-like cysteine proteinase [Heterodera glycines]
  Coding regions on vcDNA: vcDNA=SeqID_88157; Strand=+; Position=21-335
MAFLSRLSILPNSPISLLAVSLAVLAFVALASANPPTARETAPNAQQNNANSVATGEIAKNIAEKMERMNEFIKARKFIDAHNLAFENGEVSFKVAPNHLMHYTP

SEQ ID NO: 161735 - protein, 104 aa, Heterodera glycines
  Coding regions on vcDNA: vcDNA=SeqID_88158; Strand=-; Position=40-354
FFFFFFFGINAIYLIISGICKAHQIKKVQNRKQIKTPKIIVINPSSKHLLFMSRHWLSFVPPCQSLRCWSSPSFPRVSVRTGRTPRPAVASSPRQCHLMRATCI

SEQ ID NO: 161736 - protein, 74 aa, Heterodera glycines
  misc_feature (25)..(25): Xaa can be any naturally occurring amino acid
  misc_feature (47)..(47): Xaa can be any naturally occurring amino acid
  Homolog annotation: Hit_ID=CAE60349.1; Match level="QueryCoverage =77%, HitCoverage=17%, E-value=2e-09, Identity=50%"; Hit description =Hypothetical protein CBG03945 [Caenorhabditis briggsae]
  Coding regions on vcDNA: vcDNA=SeqID_88159; Strand=+; Position=125-349
EAIPFADNTVRVRYFRFEFPLMRGXHFVGTGDLFTDMLMAWLEESRXDLCHSVKCTISSMQSVIRRTFDFAFAI

SEQ ID NO: 161737 - protein, 180 aa, Heterodera glycines
  Coding regions on vcDNA: vcDNA=SeqID_88160; Strand=-; Position=130-672
NFKEWHFSLAKRLEQAAKLEPTRVTLLRSSVGLAHTKEKHRVLVLFDGQSKNIFAMRRPKWEMIAIRLFRPLLRSIGGRGSAAAQAHLYSPLLCSDEPVFDLLFELKSLFSEGILFAVLRFSCHFQCLFGPPISQQSASSADEHSLPWPRTICPYRKINFCLFSPGGILALFHFSAKAFR

SEQ ID NO: 161738 - protein, 188 aa, Heterodera glycines
  misc_feature (183)..(183): Xaa can be any naturally occurring amino acid
  Homolog annotation: Hit_ID=AAP30757.1; Match level="QueryCoverage =98%, HitCoverage=77%, E-value=9e-89, Identity=91%"; Hit description =putative gland protein 30G12 [Heterodera glycines]
  Coding regions on vcDNA: vcDNA=SeqID_88161; Strand=+; Position=1-562
CRLLTAAFLSSGLALPAPYDAESVVSSELNVPLLSADANVEAAITNESDAAAEIQAPSIPVPIEHQTAADITHPTETGNESSIASSSSTPKSEQTPKKVMNMKSALEGAVANVYGGLSLDKQTKTIAEAASKAKQTPAKLPADYDVNRVAERAAPRVYGWLPEDKQPKEIYDAAENAKNTPKXPPGDY

SEQ ID NO: 161739 - protein, 99 aa, Heterodera glycines
  Homolog annotation: Hit_ID=NP_500063.1; Match level="QueryCoverage =100%, HitCoverage=10%, E-value=4e-31, Identity=61%"; Hit description= RNA helicase (109.9 kD) (4C62) [Caenorhabditis elegans] gb|AAK68386.1| Hypothetical protein F53H1.1a [Ca
  Coding regions on vcDNA: vcDNA=SeqID_88162; Strand=+; Position=2-301
HRVGRTGRAGNKGWAYTFILPVGQEKIAGEVCRAFETADATPPEDLKKLWDDYKARMAAEGVEVYSGGGGYSGSGYRYHDMEDESELNKRKMTKLVYGL

SEQ ID NO: 161740 - protein, 193 aa, Heterodera glycines
  Homolog annotation: Hit_ID=NP_499991.1; Match level="QueryCoverage =74%, HitCoverage=67%, E-value=1e-28, Identity=43%"; Hit description =putative membrane protein of fungal and metazoan origin (4B548) [Caenorhabditis elegans] gb|AAK29831.1| H
  Coding regions on vcDNA: vcDNA=SeqID_88163; Strand=+; Position=15-593
MRRHFSCTSRLLLATTTDNKSDAASAKQQQFAKIELKPKTGSDGAVAEPERTYLEEMLIERDAEPKTAGQKVKRAVETTFYISFGLISCAVLGVMTYLVFKEFFAFNTPQGVYRDAVKRVKADERCREMFGKRIMTFGEESGRGRRRHILHNKYVKDGQERLSVMFHVKGDAGIGKTYAEIYKGEDGKWDYRF

SEQ ID NO: 161741 - protein, 178 aa, Heterodera glycines
  Homolog annotation: Hit_ID=AAT45384.1; Match level="QueryCoverage =92%, HitCoverage=59%, E-value=2e-11, Identity=27%"; Hit description =sperm nuclear basic protein PL-I isoform PLIa [Spisula solidissima]
  Gene Ontology: Mol. function=protein binding
  Coding regions on vcDNA: vcDNA=SeqID_88164; Strand=+; Position=3-536
VVLKRYTFCHLSTNSSSSTSSVNKFNNKTFKMSAESPTTSQRRARSRKTKKRAVSAGETKPLRRSARIAAQKAAKEKAAKQKARDGSTASTKSAGRGRPSRSPKKSGPKSRRSPAGRGGGRSQTPRKKKQPLKKAPGPSSRTPGRRAKKPSTKKSPAPRRAKTSTKKRGRPAKKAEQA

SEQ ID NO: 161742 - protein, 94 aa, Heterodera glycines
  Coding regions on vcDNA: vcDNA=SeqID_88165; Strand=+; Position=2-283
RKNCRLLHFVQKKGSESLDNEHMQNDDRENDKLPAQRQWETDTTKRKSWRARLLRTLSVGSPSVGRVMKDKEKQRGEKPTSHFANLDREWEVVT

SEQ ID NO: 161743 - protein, 94 aa, Heterodera glycines
  Coding regions on vcDNA: vcDNA=SeqID_88166; Strand=-; Position=1-282
QLFVHVHRFHSIRVQDNLAWKAEQLLDKRYVISHQSGAGDETDLNVQGGLHSKFPFLASSLRVCIPFKEQFLSICPFRIPLSTVALRFWFQIVF

SEQ ID NO: 161744 - protein, 131 aa, Heterodera glycines
  misc_feature (2)..(2): Xaa can be any naturally occurring amino acid
  Coding regions on vcDNA: vcDNA=SeqID_88167; Strand=+; Position=42-434
YXVITIIDTYTHHSGEIPSTSHNRHMYGASAPSSIKYHMPSVRNICWSFRNVVIDIRTTSTLLHHSCLFLIRRGQYRHIYRIHTGCGPHHVYSGRPHKTCPTVLATVHTGITAPTDTAAFMFGRLSTLFTF

SEQ ID NO: 161745 - protein, 167 aa, Heterodera glycines
  Coding regions on vcDNA: vcDNA=SeqID_88168; Strand=+; Position=36-536
MSSSSVIFTCHLCKRRNPITFESIDHLEAHFAQQHFQCLPYVCEQCPQFASGLYPTEGAIIEHMKLVHGSESEFEFKIIIREDTEEKRAKVRAALEHCVRNSGDVATSSSAATTTSNNDSTAIELPRTQQQVQTTHQPRVVQVVPAPTVVVRTEVVQQTAEKHSGAN

SEQ ID NO: 161746 - protein, 66 aa, Heterodera glycines
  Coding regions on vcDNA: vcDNA=SeqID_88169; Strand=-; Position=0-197
FILRVLRPTHHLNYATKFLYLNVVNAVSTGRIVVKIVWFHIATPRFCTPLVYTCCCSEIESPARGR

SEQ ID NO: 161747 - protein, 106 aa, Heterodera glycines
  Homolog annotation: Hit_ID=AAO33474.1; Match level="QueryCoverage =100%, HitCoverage=76%, E-value=2e-50, Identity=96%"; Hit description= gland-specific protein g4g12 [Heterodera glycines]
  Coding regions on vcDNA: vcDNA=SeqID_88170; Strand=+; Position=17-334
MPNIFKILLIVLLAVVSFRLSASTGDKKTANDGSGNNSSAGIGTKIKRIVTAGLLFTSLATGGAEAIGRITAHGGNAAGLVPSHVTNRSMAPPPPPVQFEVGANRL

SEQ ID NO: 161748 - protein, 156 aa, Heterodera glycines
  Coding regions on vcDNA: vcDNA=SeqID_88171; Strand=-; Position=34-504
LRTYRLLDVSGLHSPGFLASCSLVESIAIRKRPTADTRYGLFLSWTANWYAVWASTLCSFRTANGSWAHTFSALCNVSCTDKLRHSWSAVSTSHLPVQIHKGERLVFSRRAFSFVSQPSSDGWARLTSNVRRSLAFHNFCFAVSVSHCPRAGNVSF

SEQ ID NO: 161749 - protein, 180 aa, Heterodera glycines
  misc_feature (39)..(39): Xaa can be any naturally occurring amino acid
  Homolog annotation: Hit_ID=NP_509787.2; Match level="QueryCoverage =41%, HitCoverage=38%, E-value=1e-12, Identity=52%"; Hit description =tumor protein D52 like (21.3 kD) (XL294) [Caenorhabditis elegans] emb|CAA92122.2| Hypothetical protein F1
  Coding regions on vcDNA: vcDNA=SeqID_88172; Strand=+; Position=2-540
TTENWQETPAFQKTSEMMSGTAESVASKVNDFRNLSLFXSLEPKLGAAVTNAKEAASTSIDHMAGIRQGQRDRPRLRRAKTRIAMPKATAKANRHFLERAAYGGKSVSTGHDTVPARLFMPLRQLTIRIWMMEEQLEVGLTTVGTHCHSRYCWETQRVPSTTNVKPFIARHSFRLTFLLM

SEQ ID NO: 161750 - protein, 102 aa, Heterodera glycines
  Homolog annotation: Hit_ID=NP_497406.1; Match level="QueryCoverage =80%, HitCoverage=70%, E-value=9e-36, Identity=90%"; Hit description =ATP synthase (12.1 kD) (3C509) [Caenorhabditis elegans] gb|AAK26152.1| Hypothetical protein Y82E9BR.3 [Ca
  Gene Ontology: Mol. function=transporter activity; Cellular component= proton-transporting ATP synthase complex (sensu Eukarya); Biological process=energy pathways
  Coding regions on vcDNA: vcDNA=SeqID_88173; Strand=+; Position=3-311
SRLRTLPRLAPFLTNSPCALSTSAVRKDIDSAAKYVGAGAATVGVAGSGAGIGNVFGSLVIGYARNPSLKQQLFQYAILGFALSEAMGLFCLTMGFLILFAF

SEQ ID NO: 161751 - protein, 51 aa, Heterodera glycines
  Coding regions on vcDNA: vcDNA=SeqID_88174; Strand=-; Position=2-154
QCSASINHCYNVAQKPICGPPSNRWVPPPVSLARTTCKSSSSSMRIIRPQL

SEQ ID NO: 161752 - protein, 88 aa, Heterodera glycines
  Coding regions on vcDNA: vcDNA=SeqID_88175; Strand=-; Position=1-264
LFRWCFLPQYFHYWLCCPFCPVIWHFLFPFVPPIRHFPLPFLPPFGTFFLLLLGILFFHLSPVFLSLLFLSIFFLHLPSSFLPHFPLH

SEQ ID NO: 161753 - protein, 67 aa, Heterodera glycines
  Coding regions on vcDNA: vcDNA=SeqID_88176; Strand=+; Position=302-502
SKMNRIHSLYEKSMTTAPREELDKYSIYFFRKRIWNVQDHFLCLNFWWNMQHPCLIQTPIWKADQAQ

SEQ ID NO: 161754 - protein, 163 aa, Heterodera glycines
  Coding regions on vcDNA: vcDNA=SeqID_88177; Strand=-; Position=24-515
EPLLPFAPLFPDNGPLGGRHFRQTTVGGMAPIGRTGPAGVIGAMGDCPVAHTGKDSKFGCCCCWFVCCRFSRALPRIDESSEWFSSCAVPPPFGFAVVVDVPPPPCVVVVVVSLSLLPMPKMPKVPSTIRRKVKRAQKVLKFASWVILILCSLYGGLFLSFCE

SEQ ID NO: 161755 - protein, 33 aa, Heterodera glycines
  Coding regions on vcDNA: vcDNA=SeqID_88178; Strand=+; Position=1-99
KILLIVLVAVVSYRLSASTGDQKTALDGSGNNS

SEQ ID NO: 161756 - protein, 214 aa, Heterodera glycines
  Coding regions on vcDNA: vcDNA=SeqID_88179; Strand=+; Position=2-643
NLRNFLGLPSFDESLFPPKSIALLKVLDSEKNRLEVKREEIVGSQARLTGKYKALCDRVGTTARQIEGVHDRIMSEDDLDKLKGEVDALHTFVNKRLEKALQLQAESKRIFETIRPSINSFNEDYLHFLRVDLDSQSTVLSSDFLKKMETLNERLKDHHDLWAKQVVFRYDELLVKLDELSAKCFQPSTEFPAKPNLKNLSEKELLKLEEEVRI

SEQ ID NO: 161757 - protein, 190 aa, Heterodera glycines
  Homolog annotation: Hit_ID=CAE69498.1; Match level="QueryCoverage =97%, HitCoverage=39%, E-value=5e-23, Identity=36%"; Hit description =Hypothetical protein CBG15706 [Caenorhabditis briggsae]
  Gene Ontology: Biological process=regulation of protein activity, epigenetic
  Coding regions on vcDNA: vcDNA=SeqID_88180; Strand=+; Position=58-627
MPQRISTTSIPTSTASGQQTVHLQLVPQQGNSPIPGQQQQQQQQQHIIISAQPVQTTNTTTESADGNPIAAFMEYFVEQQQQPTCSTNTLPNVQTIQQYGSPVLDSKFTLKNKLLSGMDKSSEKAEREAVKRARQAEAARQRYHKLTPEQKKELNLKRTEAQKRKKQREKEVAELESILRASNDIVDDPE

SEQ ID NO: 161758 - protein, 166 aa, Heterodera glycines
  Coding regions on vcDNA: vcDNA=SeqID_88181; Strand=+; Position=71-571
MECQFDGTEAGKCAFCVKLPCKFGAVNCAEEVSISCVNPQELEKCCNARDNECCVCVLCEKNKVMKVLVECCGKRTETSAEAGKALCICVPKIGGGKCGGQVQVKQCDAKLVDECCAANTESGDCCCVCLSCNDQKCVVTVRCPAGEAKSTGPTCTASKCESVKCC

SEQ ID NO: 161759 - protein, 214 aa, Heterodera glycines
  misc_feature (18)..(18): Xaa can be any naturally occurring amino acid
  misc_feature (46)..(46): Xaa can be any naturally occurring amino acid
  misc_feature (110)..(110): Xaa can be any naturally occurring amino acid
  misc_feature (198)..(198): Xaa can be any naturally occurring amino acid
  Homolog annotation: Hit_ID=NP_499188.2; Match level="QueryCoverage =100%, HitCoverage=56%, E-value=3e-66, Identity=61%"; Hit description= NAD-dependent glycerol-3-phosphate dehydrogenase (3K944) [Caenorhabditis elegans] emb|CAA80176.2| Hypoth
  Gene Ontology: Mol. function=glycerol-3-phosphate dehydrogenase (NAD+) activity; Cellular component=cytoplasm; Biological process =intracellular accumulation of glycerol
  Coding regions on vcDNA: vcDNA=SeqID_88182; Strand=+; Position=2-642
NWGTAIALIVGKTTQDAXSHFDDSAVKMWVFEEVVEGPKLSEIINXKHQNVKYLPGKKLPTNVIVATDVAEASKNADVLIFIIPHQFLHKVCEQLKGNIKKSAIAISLIXKGLATFHEKDIGLRLISNEIATSLGIDTSVLMGANLANEVADDHFCEATTGTKNPQHGNELKKLFHTDNFRINVVEDAATVDLCGALXNIVACRAGFSFGLGYG

SEQ ID NO: 161760 - protein, 178 aa, Heterodera glycines
  misc_feature (14)..(14): Xaa can be any naturally occurring amino acid
  Homolog annotation: Hit_ID=AAL78216.1; Match level="QueryCoverage =100%, HitCoverage=52%, E-value=1e-94, Identity=94%"; Hit description= aspartic protease precursor Hgg-33 [Heterodera glycines]
  Gene Ontology: Mol. function=aspartic-type endopeptidase activity; Cellular component=extracellular space; Biological process=induction of non-apoptotic programmed cell death
  Coding regions on vcDNA: vcDNA=SeqID_88183; Strand=+; Position=58-590
MKGFVSKDICLYGXNVCVQKQEFTEATSEPGLTFVAAKFDGILGMGFSEISVQKLPTVFDNMVTQQKVPEPVFAFWLNRDPTSEFGGEITIGGTDQRRFVAPITYTPVTHKAYWQFKMDSISGGNGKLACHNGCQAIADTGTSLLAGPKNDIEKIHKHIGAIPLFHGEYMISCERFPT

SEQ ID NO: 161761 - protein, 116 aa, Heterodera glycines
  Homolog annotation: Hit_ID=NP_491977.1; Match level="QueryCoverage =78%, HitCoverage=16%, E-value=1e-25, Identity=52%"; Hit description =ceramide kinase (62.4 kD) (1H511) [Caenorhabditis elegans] gb|AAC67466.1| Hypothetical protein T10B11.2 [
  Coding regions on vcDNA: vcDNA=SeqID_88184; Strand=+; Position=54-401
GRIPADEHFPFHWQGDYTHVISCVIACVSPFTPYGLAPYTGLNDGTMDLALIPRVFRFTNLQIIRKVAMYGARFITDEYPDVKVYRVSRWKVTPGALIGPSREDTDQAAEQGQHSG

SEQ ID NO: 161762 - protein, 115 aa, Heterodera glycines
  Coding regions on vcDNA: vcDNA=SeqID_88185; Strand=-; Position=1-345
CRCNDLHWSAVRSVTFRAIYQCWEQIVSDGKYSRPVLASRCSAGVRSVKRVKGRQHLRLSPFWVDPQTAKYSRAAPLALITALNSSLGKASFAITGHMNIAVRHYGNCSFCVHAL

SEQ ID NO: 161763 - protein, 80 aa, Heterodera glycines
  misc_feature (40)..(40): Xaa can be any naturally occurring amino acid
  Homolog annotation: Hit_ID=AAO33474.1; Match level="QueryCoverage =95%, HitCoverage=55%, E-value=5e-14, Identity=55%"; Hit description =gland-specific protein g4g12 [Heterodera glycines]
  Coding regions on vcDNA: vcDNA=SeqID_88186; Strand=+; Position=1-241
MMASGNNSSAGMGAMIKTFVTAGLFFSSLETGGAATTGRXKRLQEKHTRSVASDVTNRSMVAPPPAAHTTLGANRLKMMP

SEQ ID NO: 161764 - protein, 148 aa, Heterodera glycines
  misc_feature (21)..(21): Xaa can be any naturally occurring amino acid
  misc_feature (30)..(30): Xaa can be any naturally occurring amino acid
  misc_feature (90)..(90): Xaa can be any naturally occurring amino acid
  Homolog annotation: Hit_ID=AAO33474.1; Match level="QueryCoverage =95%, HitCoverage=100%, E-value=3e-60, Identity=87%"; Hit description= gland-specific protein g4g12 [Heterodera glycines]
  Coding regions on vcDNA: vcDNA=SeqID_88187; Strand=+; Position=2-442
MPNIFKILLIALLAVVSFRLXSASTGDKKXTANDGSGNNSSTGIGTKIKRIVTAGLLFTFLSTGGAEAIGLSNAHGGNAAGLVATCTVTXNRSMAPPPPPVQFEMGANRLEKMKAHLHELAEKMPVTESKRLSPSGPDPHHHYGHGWI

SEQ ID NO: 161765 - protein, 116 aa, Heterodera glycines
  Coding regions on vcDNA: vcDNA=SeqID_88188; Strand=-; Position=0-347
SSALFVHTILSNIPDHFSSFSPLQLADGGERRPNSISLLRAQTNSDIIKVVPGSMCCVPTEINKAGIVNIVRLFVLPLSHLSKLASLHHPIGIMFAHSNRISASGGDQVKWNNCFV

SEQ ID NO: 161766 - protein, 89 aa, Heterodera glycines
  Coding regions on vcDNA: vcDNA=SeqID_88189; Strand=-; Position=48-317
VCLWWRKRPIGFVVSTQTNAHIIKVVPNRMFSVSVQMNNAGIVHIVGYSSSHRTTCPIWHRFITQLAFCVIIVIVSLFVLLTNSYGPDA

SEQ ID NO: 161767 - protein, 55 aa, Heterodera glycines
  Coding regions on vcDNA: vcDNA=SeqID_88190; Strand=-; Position=14-181
SHIPSLALINAPLWSLSAFSSAGKWCPSTPLWASVAISVSNSVCSIATKGKEPKS

SEQ ID NO: 161768 - protein, 154 aa, Heterodera glycines
  misc_feature (129)..(129): Xaa can be any naturally occurring amino acid
  Homolog annotation: Hit_ID=NP_504583.2; Match level="QueryCoverage =93%, HitCoverage=30%, E-value=6e-46, Identity=61%"; Hit description =expulsion defective protein 2 like family member, EXPulsion defective during defecation EXP-2 (53.1 kD) (
  Gene Ontology: Mol. function=protein binding; Cellular component =voltage-gated potassium channel complex; Biological process=cation transport
  Coding regions on vcDNA: vcDNA=SeqID_88191; Strand=+; Position=3-464
KPPEDVLGVHAELEFWRISTSYIGACCAESVSPLERLLETSKEEKVDEISFHILCCGRLRRRMWTFLERPGSSLQAKTFQLCSTLFVMVSVLGLSFGTIPDFQVTEYIPTGNRSVITSNGTSIEREEFXAVRVEHPAFVFTERIRIAFFTIEYC

SEQ ID NO: 161769 - protein, 35 aa, Heterodera glycines
  Coding regions on vcDNA: vcDNA=SeqID_88192; Strand=+; Position=1-105
GGGGFFFLGGGRPPPPPPPPKKKKNFFFFFFSPPP

SEQ ID NO: 161770 - protein, 87 aa, Heterodera glycines
  Coding regions on vcDNA: vcDNA=SeqID_88193; Strand=-; Position=96-359
SPVVSINSQSACTIRCVDEKTFGIECQRPYHAIVSIQFVKIGIVLLCIPPRFVDRGISVLYNQLQPRKQKHISVKFFLPGCVICPLK

SEQ ID NO: 161771 - protein, 47 aa, Heterodera glycines
  Coding regions on vcDNA: vcDNA=SeqID_88194; Strand=+; Position=67-210
WTEQWYGASKICSLDELTPWNYFNQYCQSDTRFSSKHIHAKKNSLVI

SEQ ID NO: 161772 - protein, 259 aa, Heterodera glycines
  Homolog annotation: Hit_ID=CAE72870.1; Match level="QueryCoverage =73%, HitCoverage=27%, E-value=3e-23, Identity=34%"; Hit description =Hypothetical protein CBG20172 [Caenorhabditis briggsae]
  Gene Ontology: Mol. function=ATP-binding cassette (ABC) transporter activity; Cellular component=mitochondrion; Biological process =transport
  Coding regions on vcDNA: vcDNA=SeqID_88195; Strand=+; Position=2-778
RRIGCVGDTKRTMRRRVNEVIDEFGLEECRHELVGFSGVEKSILGGETRRLLFASELLNNPQIIFADEPTTGLDFSMADSVISVMRALALSGRTIICTIVQPPLDIYWMAAGNNARLTRDELFRAVERLRESILLMDTERARFRRSNGALLRMIVRLSGGIPPNFNHAHFAAAAQPVVNVTAVLANANPTGQNYQRLLNLNADLTETIARLTVEISQLGYMNEQLTEQLEHLTEVPPNANFNLDDVAFHPPLDQQHQVP

SEQ ID NO: 161773 - protein, 164 aa, Heterodera glycines
  misc_feature (16)..(16): Xaa can be any naturally occurring amino acid
  Homolog annotation: Hit_ID=AAH61653.1; Match level="QueryCoverage =98%, HitCoverage=39%, E-value=8e-50, Identity=56%"; Hit description =MGC68640 protein [Xenopus laevis]
  Gene Ontology: Mol. function=aminoacylase activity; Cellular component=cytosol; Biological process=amino acid metabolism
  Coding regions on vcDNA: vcDNA=SeqID_88196; Strand=+; Position=3-496
PNLRLGDVTSVNLTKXEGGVQTNVIPAQFVAYFDMRVTPTDDFQQMEAMIANWCKEAGPDVTFEFVQKGMCKSLTPTDASSPWWHAFSSALSEEKCAFSKEIFIGGTDARFLREKGIPAIGFSPMNNTPILLHDHNEFLNEGVFLRGVKIYTKMIPRLANLPSF

SEQ ID NO: 161774 - protein, 80 aa, Heterodera glycines
  misc_feature (5)..(6): Xaa can be any naturally occurring amino acid
  misc_feature (13)..(14): Xaa can be any naturally occurring amino acid
  misc_feature (48)..(49): Xaa can be any naturally occurring amino acid
  misc_feature (51)..(51): Xaa can be any naturally occurring amino acid
  Coding regions on vcDNA: vcDNA=SeqID_88197; Strand=+; Position=1-240
KKGGXXPFPRENXXKGGGGFSYPPPLLTLFVFIKKGFFFPPHPAGGGXXIXPHPPPRKKPPHFFFFFLRVPPPPKKKKKK

SEQ ID NO: 161775 - protein, 114 aa, Heterodera glycines
  misc_feature (102)..(102): Xaa can be any naturally occurring amino acid
  Homolog annotation: Hit_ID=CAE70068.1; Match level="QueryCoverage =76%, HitCoverage=5%, E-value=2e-11, Identity=43%"; Hit description =Hypothetical protein CBG16504 [Caenorhabditis briggsae]
  Gene Ontology: Cellular component=extracellular space; Biological process=regulation of protein activity, epigenetic
  Coding regions on vcDNA: vcDNA=SeqID_88198; Strand=+; Position=64-405
MKEMGHAASHMKHWVPLWGMQSPQPGDNPPPPPFLWGEKAPPPPGGPPPLGEKIWAPGGKKPPKKRGAQKEGGGPPPPPPKKKKKKNPPPQKEGGGKKKGGXLNNPPPGGGGKK

SEQ ID NO: 161776 - protein, 34 aa, Heterodera glycines
  Coding regions on vcDNA: vcDNA=SeqID_88199; Strand=-; Position=0-101
ARRGNLNAKKSNSALGTSHRDGSRKCICHWRRTP

SEQ ID NO: 161777 - protein, 26 aa, Heterodera glycines
  Coding regions on vcDNA: vcDNA=SeqID_88200; Strand=-; Position=2-79
LRKNVHPHHRFDKRLVIQEYIKVISA

SEQ ID NO: 161778 - protein, 30 aa, Heterodera glycines
  Coding regions on vcDNA: vcDNA=SeqID_88201; Strand=-; Position=0-89
GTPSPSIPTLSGSTNSSQSSALNTGLSVRL

SEQ ID NO: 161779 - protein, 25 aa, Heterodera glycines
  Coding regions on vcDNA: vcDNA=SeqID_88202; Strand=-; Position=0-74
VVSSPKSEAKRRENEWDSKNKKILA

SEQ ID NO: 161780 - protein, 27 aa, Heterodera glycines
  Coding regions on vcDNA: vcDNA=SeqID_88203; Strand=-; Position=3-83
FFGPFAAEVDLSQWSMGKRCRLTKIGC

SEQ ID NO: 161781 - protein, 82 aa, Heterodera glycines
  Coding regions on vcDNA: vcDNA=SeqID_88204; Strand=-; Position=57-305
KKKKNCFFPQKKILNSLFFWDKKKKGFLPPKKVLKKRGGKNTFPNFKAPNLEDGSNQRPKCPIQASLHSPRFIFECLTSVHF

SEQ ID NO: 161782 - protein, 169 aa, Heterodera glycines
  misc_feature (43)..(43): Xaa can be any naturally occurring amino acid
  misc_feature (56)..(56): Xaa can be any naturally occurring amino acid
  misc_feature (130)..(130): Xaa can be any naturally occurring amino acid
  misc_feature (148)..(148): Xaa can be any naturally occurring amino acid
  misc_feature (155)..(155): Xaa can be any naturally occurring amino acid
  Homolog annotation: Hit_ID=AAR85527.1; Match level="QueryCoverage =100%, HitCoverage=66%, E-value=2e-25, Identity=45%"; Hit description= 14-3-3b protein [Meloidogyne incognita]
  Gene Ontology: Mol. function=protein domain specific binding; Cellular component=nucleus; Biological process=protein targeting
  Coding regions on vcDNA: vcDNA=SeqID_88205; Strand=+; Position=2-508
VGARRSSRRVICSIAQNTDGLDKMHETAQEYPDNAAPELREIXLDVLDLLDICLTXAGTLCIPVFLLKMTGQSSRFMCEVVPCDDLRHFSSQKHYVGAKMCRPLPQTRMHHHRMPFVFGSDANAFFEFYXELLNSPDKACQLHTQAFXDAIAVIXSLNEDSIRDCDLVM

SEQ ID NO: 161783 - protein, 213 aa, Heterodera glycines
  Homolog annotation: Hit_ID=CAE56190.1; Match level="QueryCoverage =92%, HitCoverage=54%, E-value=6e-37, Identity=44%"; Hit description =Hypothetical protein CBG23813 [Caenorhabditis briggsae]
  Coding regions on vcDNA: vcDNA=SeqID_88206; Strand=+; Position=1-639
FLLCPYNGIAAKSKCADRSGRQVNKLFIMPPNRPTRIKKAMNILFGRTEEEKRVTGNFVSRIAGRNPRREDMPTTHDWPSVWTTAQYFRSSVVPLPVRMGFRRRPERFAPKGPYGNLELMKIPNFLHLTPAHVQRHGHAIKKFCTKFPEELKQADVNEQYTPLRLVYSDYFHHGNIIRDKRAREVTAKIQLNSFGLKDTHAHNKCRQLVGDRY

SEQ ID NO: 161784 - protein, 258 aa, Heterodera glycines
  misc_feature (13)..(13): Xaa can be any naturally occurring amino acid
  Homolog annotation: Hit_ID=NP_506610.1; Match level="QueryCoverage =100%, HitCoverage=54%, E-value=5e-85, Identity=59%"; Hit description= glutamate carboxypeptidase-like protein 1 (52.6 kD) (5P76) [Caenorhabditis elegans] emb|CAB07646.1| Hypo
  Gene Ontology: Mol. function=dipeptidase activity; Cellular component= cytosol; Biological process=proteolysis and peptidolysis
  Coding regions on vcDNA: vcDNA=SeqID_88207; Strand=+; Position=2-773
KDGKLFGRGSPMXQGPVLGWLNVIETMQGLGIDMPINIKFVFEGMEECGSDGLDECLEQRKDFLSGVDFVCISDNYWLGKQKPCITYGLRGLSPFAIEISGPNQDLHSGVYGGTIHEPMNDLCWLLSQLTDTKANILIKNIDKMVAKLTEEERNTYTKIDFDLNGFKKDVGVEKLTSEDPKQILMRRWREPALSIHGIEGAFSGKGFKTVIPSKVTGKFSIRIVPDMVPEEVDKIVVDFVSEVWKGRGSPTNENPSVG

SEQ ID NO: 161785 - protein, 26 aa, Heterodera glycines
  Coding regions on vcDNA: vcDNA=SeqID_88208; Strand=+; Position=1-78
SFTVVPILFCFFLPALSIYKPNWDSI

SEQ ID NO: 161786 - protein, 30 aa, Heterodera glycines
  Coding regions on vcDNA: vcDNA=SeqID_88209; Strand=+; Position=1-90
SRFFRRLVHVRQMDFEFAAWQMLYLLVNPH

SEQ ID NO: 161787 - protein, 151 aa, Heterodera glycines
  misc_feature (9)..(9): Xaa can be any naturally occurring amino acid
  misc_feature (35)..(35): Xaa can be any naturally occurring amino acid
  Homolog annotation: Hit_ID=CAE56800.1; Match level="QueryCoverage =100%, HitCoverage=47%, E-value=2e-49, Identity=61%"; Hit description= Hypothetical protein CBG24612 [Caenorhabditis briggsae]
  Gene Ontology: Cellular component=membrane; Biological process =intracellular protein transport
  Coding regions on vcDNA: vcDNA=SeqID_88210; Strand=+; Position=2-455
SRFFRRLVXVRQMDFEFAAWQMLYLLVIRKRSQDXWARDDPAFLLLLALSLLGSSVLFALALNLSFSSFCAFFLWVVFIDCIGIGIAIATALWFISNRFLRRTRDCDVVEGAYCFDVHLNAFFPLLILLHVVLPLLFYGPSFFSFFEQNIF

SEQ ID NO: 161788 - protein, 211 aa, Heterodera glycines
  Coding regions on vcDNA: vcDNA=SeqID_88211; Strand=+; Position=47-679
FSHILFDFFALLCLIHMIDFKRECNGRLGYTLVEDDSSLLGGITFRSIVSGDKLPLLRDSPPESHVEPVAQLLRSPRDHMDNIFNPADNNIVDNTNGFALAPYTEQRRAPSGVLAQQTMQRFGNAYFMGNSNNSTNNTTTSSAYSLATIGTNTTTYSGGACNGSGGTLVTNATGTTGGRRKEVYTDGILLDCDTNRILSGGGVDFRSANAP

SEQ ID NO: 161789 - protein, 101 aa, Heterodera glycines
  misc_feature (9)..(9): Xaa can be any naturally occurring amino acid
  misc_feature (13)..(14): Xaa can be any naturally occurring amino acid
  Coding regions on vcDNA: vcDNA=SeqID_88212; Strand=+; Position=1-303
FLPKRCRWXAAFXXAVFFFCPPLFFKKRKYFTNPFNPGNLAGGPENCLKKKIGKRGPLFFFPPRPKGGGFFWAPPRGEILEFFFGGGAGAPKKKKKKFFFF

SEQ ID NO: 161790 - protein, 60 aa, Heterodera glycines
  misc_feature (11)..(11): Xaa can be any naturally occurring amino acid
  misc_feature (14)..(14): Xaa can be any naturally occurring amino acid
  Coding regions on vcDNA: vcDNA=SeqID_88213; Strand=+; Position=45-224
DSSLYEVFRLXLIXYINIWKKDYGANWIFDPKNPFGKKGPFIKKTPPPFFKKNFFFPPKK

SEQ ID NO: 161791 - protein, 112 aa, Heterodera glycines
  misc_feature (80)..(80): Xaa can be any naturally occurring amino acid
  misc_feature (82)..(83): Xaa can be any naturally occurring amino acid
  Coding regions on vcDNA: vcDNA=SeqID_88214; Strand=-; Position=1-336
FFFFFSPLFSQKKNGFFLKNPPRGGDKILGGTFPRGQIFLKKPFWGGPFQKTLFLFQGIKQREKGTPAQKPFDANGCHLXEXXHCESISQPGWPKKNTQWAFVYAMARQRKG

SEQ ID NO: 161792 - protein, 28 aa, Heterodera glycines
  Coding regions on vcDNA: vcDNA=SeqID_88215; Strand=-; Position=3-86
VYSLKAVPSLISFINSTSSMAFQSVSSS

SEQ ID NO: 161793 - protein, 68 aa, Heterodera glycines
  Coding regions on vcDNA: vcDNA=SeqID_88216; Strand=-; Position=1-204
PPLWGGGGAPPRKIFGPRGGPPPKWVQGGFSGNWVIPPTNVRIMVERGNSRNVHSLRRQRPNGKTAEF

SEQ ID NO: 161794 - protein, 63 aa, Heterodera glycines
  Coding regions on vcDNA: vcDNA=SeqID_88217; Strand=-; Position=0-188
PLFFFFFWGPPFFQGFFFSKIFSARGKPIPGGDWDGLFDDDGTGAVIDQTSRCAGRSARPPPS

SEQ ID NO: 161795 - protein, 34 aa, Heterodera glycines
  misc_feature (15)..(15): Xaa can be any naturally occurring amino acid
  Homolog annotation: Hit_ID=AAM50038.1; Match level="QueryCoverage =100%, HitCoverage=14%, E-value=2e-10, Identity=97%"; Hit description= putative gland protein G27D09 [Heterodera glycines]
  Coding regions on vcDNA: vcDNA=SeqID_88218; Strand=+; Position=2-102
MVCLVMAVLMEMANXKAVKKDNKKGAVAASPAKG

SEQ ID NO: 161796 - protein, 60 aa, Heterodera glycines
  Coding regions on vcDNA: vcDNA=SeqID_88219; Strand=+; Position=1-183
KCLWEKVWSPKTKLEKKWRGGNFAPKKGGRKLGGRLTAPFFKGGGGGGKKSVAPPLYFFL

SEQ ID NO: 161797 - protein, 90 aa, Heterodera glycines
  misc_feature (24)..(24): Xaa can be any naturally occurring amino acid
  misc_feature (35)..(35): Xaa can be any naturally occurring amino acid
  Coding regions on vcDNA: vcDNA=SeqID_88220; Strand=+; Position=3-275
KAVDQCSSPRPGGLALRRLESTLXLLPVARRPRPXAVVMKTETHWRKSAPLEDGPPFARKFSRKISFPIFQIKKLGPFLKNFPPSFPPGF

SEQ ID NO: 161798 - protein, 71 aa, Heterodera glycines
  misc_feature (1)..(3): Xaa can be any naturally occurring amino acid
  misc_feature (5)..(6): Xaa can be any naturally occurring amino acid
  misc_feature (10)..(31): Xaa can be any naturally occurring amino acid
  misc_feature (33)..(33): Xaa can be any naturally occurring amino acid
  misc_feature (35)..(35): Xaa can be any naturally occurring amino acid
  Coding regions on vcDNA: vcDNA=SeqID_88221; Strand=+; Position=4-216
XXXLXXQRLXXXXXXXXXXXXXXXXXXXXXXRXGXDTSLVVPTKMKEIAESSSSRSEKCRRYCARLTLTML

SEQ ID NO: 161799 - protein, 39 aa, Heterodera glycines
  Coding regions on vcDNA: vcDNA=SeqID_88222; Strand=+; Position=3-119
MNFLLSCLAVQNTLQIHVQTISWKEYEANALKSDGELER

SEQ ID NO: 161800 - protein, 27 aa, Heterodera glycines
  Coding regions on vcDNA: vcDNA=SeqID_88223; Strand=-; Position=0-80
KRAPHSELNSKRLLPLELKAVTPAELG

SEQ ID NO: 161801 - protein, 28 aa, Heterodera glycines
  Coding regions on vcDNA: vcDNA=SeqID_88224; Strand=-; Position=1-84
EIFCISTDNNFRETAQHYYFFLMCQSYW

SEQ ID NO: 161802 - protein, 25 aa, Heterodera glycines
  Coding regions on vcDNA: vcDNA=SeqID_88225; Strand=-; Position=1-75
GRFVAKCFLRSGNRSGTDPHSPRSL

SEQ ID NO: 161803 - protein, 121 aa, Heterodera glycines
  misc_feature (92)..(92): Xaa can be any naturally occurring amino acid
  misc_feature (98)..(98): Xaa can be any naturally occurring amino acid
  misc_feature (100)..(100): Xaa can be any naturally occurring amino acid
  Coding regions on vcDNA: vcDNA=SeqID_88226; Strand=-; Position=65-430
PPPPPKKGGEKFLLPSFGEKKNGFFFFQKKEKGFFFSPQGKNFFVGGEKKKTFLGEKNLGGAPVGTKKVFVPQRGPKKFPGGGPGGLFGGSXPKRVLXPXGAYTCPVSISMDCSYLATISE

SEQ ID NO: 161804 - protein, 25 aa, Heterodera glycines
  Coding regions on vcDNA: vcDNA=SeqID_88227; Strand=-; Position=0-74
DGADEAFKRKAFRDWSTVCLTNAYS

SEQ ID NO: 161805 - protein, 38 aa, Heterodera glycines
  Coding regions on vcDNA: vcDNA=SeqID_88228; Strand=+; Position=51-164
TDVKQSKINLAVHDVWMDILPLFDRPQLGLKLAMLSPR

SEQ ID NO: 161806 - protein, 248 aa, Heterodera glycines
  misc_feature (10)..(10): Xaa can be any naturally occurring amino acid
  misc_feature (214)..(214): Xaa can be any naturally occurring amino acid
  Homolog annotation: Hit_ID=CAE64662.1; Match level="QueryCoverage =100%, HitCoverage=24%, E-value=1e-119, Identity=88%"; Hit description=Hypothetical protein CBG09434 [Caenorhabditis briggsae]
  Gene Ontology: Mol. function=sodium/potassium-exchanging ATPase activity; Cellular component=sodium/potassium-exchanging ATPase complex; Biological process=neurotransmitter uptake
  Coding regions on vcDNA: vcDNA=SeqID_88229; Strand=+; Position=3-745
ERVLGFCDFXLGPDKFPKGFEFDVEGPNFPIEGFRFVGLISMIDPPRAAVPDAVAKCRSAGIKVVMVTGDHPITAKAIAKSVGIISEGMETVEDIAVRKEISVDQVDPREAKAIVIHGSDLREMNEDQLAEVINNHDEIVFARTSPQQKLMIVEGFQRQGQIVAVTGDGVNDSPALKKADIGVAMGIAGSDVSKQAADMILLDDNFASIVTGVXESRLIFDNLKKSIAYTLTSNIPEISPFLMYILFG

SEQ ID NO: 161807 - protein, 152 aa, Heterodera glycines
  misc_feature (7)..(7): Xaa can be any naturally occurring amino acid
  Coding regions on vcDNA: vcDNA=SeqID_88230; Strand=-; Position=1-456
FFFFFFXKQFEVLLRKQSSTFWTMSRKKEGKSVEMTEKRKRKAVLHQTLESKQQNKQLSASRRRLLSPNFIIIRRSFSYASLSHPFVAVALFIFPLTVCATGRTRVSGTSGVQSVLAGTAGALASAPRWYGAQCMPACWERLLRQGGPHQSD

SEQ ID NO: 161808 - protein, 27 aa, Heterodera glycines
  Coding regions on vcDNA: vcDNA=SeqID_88231; Strand=+; Position=1-81
LTKIYRQFNEMSRCFLHFYTVKTDEKG

SEQ ID NO: 161809 - protein, 27 aa, Heterodera glycines
  Coding regions on vcDNA: vcDNA=SeqID_88232; Strand=-; Position=1-81
QTQVSLGPVVCFGSTLECVTNHSGPNR

SEQ ID NO: 161810 - protein, 26 aa, Heterodera glycines
  Coding regions on vcDNA: vcDNA=SeqID_88233; Strand=-; Position=38-118
KVLKFASWVILILCSLYGGLFLSFCE

SEQ ID NO: 161811 - protein, 55 aa, Heterodera glycines
  Coding regions on vcDNA: vcDNA=SeqID_88234; Strand=-; Position=1-165
GKKKKKTFFFIKKKKCKFCFFYLGRKKPPPTNFGGGGFFSKKFFFFFLFEKKKKK

SEQ ID NO: 161812 - protein, 42 aa, Heterodera glycines
  misc_feature (7)..(7): Xaa can be any naturally occurring amino acid
  misc_feature (22)..(22): Xaa can be any naturally occurring amino acid
  Homolog annotation: Hit_ID=AAK00310.1; Match level="QueryCoverage =100%, HitCoverage=8%, E-value=2e-15, Identity=75%"; Hit description =DNA-dependent RNA polymerase II largest subunit RPB1 [Glaucosphaera vacuolata]
  Gene Ontology: Mol. function=protein binding; Cellular component=DNA -directed RNA polymerase II, core complex; Biological process =regulation of transcription, DNA-dependent
  Coding regions on vcDNA: vcDNA=SeqID_88235; Strand=+; Position=1-124
QYSPSSXQYSPSSPQYSPSSPXYSPSSPQYSPSSPQYSPSSP

SEQ ID NO: 161813 - protein, 94 aa, Heterodera glycines
  misc_feature (79)..(79): Xaa can be any naturally occurring amino acid
  Homolog annotation: Hit_ID=NP_498263.1; Match level="QueryCoverage =91%, HitCoverage=16%, E-value=4e-30, Identity=73%"; Hit description =ALDH7A2, ALdehyde deHydrogenase (alh-9) [Caenorhabditis elegans] gb|AAC46640.1| Aldehyde dehydrogenase pr
  Gene Ontology: Mol. function=aldehyde dehydrogenase (NAD+) activity; Biological process=aldehyde metabolism
  Coding regions on vcDNA: vcDNA=SeqID_88236; Strand=+; Position=238-519
ILGQVFFQVGVISAFNFPAAVYGWNAALALVCGNSVLWKPSPSTPLTSIAITRLVGEVLSKNGLSPDICSLICGGGDVXMCLGKDPRVNLVSFT

SEQ ID NO: 161814 - protein, 235 aa, Heterodera glycines
  misc_feature (9)..(9): Xaa can be any naturally occurring amino acid
  misc_feature (225)..(225): Xaa can be any naturally occurring amino acid
  misc_feature (229)..(229): Xaa can be any naturally occurring amino acid
  Homolog annotation: Hit_ID=CAE68424.1; Match level="QueryCoverage =99%, HitCoverage=37%, E-value=1e-49, Identity=42%"; Hit description =Hypothetical protein CBG14204 [Caenorhabditis briggsae]
  Gene Ontology: Mol. function=protein binding; Cellular component =actin cytoskeleton; Biological process=hearing
  Coding regions on vcDNA: vcDNA=SeqID_88237; Strand=+; Position=2-705
GKVLLFEGXEGGKVGELVDETCKGAAAHSGGVFALNWHSGGIKLATASGDKTIKIWDVPGRKLIGTVSFGSAIEDQQLAVVWLRNWIVSVSLSGFINYICPETLKVCRVLRGHNKSITALTLSEDRRMAFTADFEGHITRWNVSDGSSERVTPQVHKSQVSGLSLTSGGLLISIGWDDSVAFIENALSPSIENVQSLSHRLSSQPRGVASIGQNGERVAVACHRXIFIXTDKKQS

SEQ ID NO: 161815 - protein, 133 aa, Heterodera glycines
  misc_feature (7)..(8): Xaa can be any naturally occurring amino acid
  misc_feature (97)..(97): Xaa can be any naturally occurring amino acid
  Coding regions on vcDNA: vcDNA=SeqID_88238; Strand=+; Position=3-401
LSEPKTXXLQVPITSPDNISQLCTPSNPSPPQGILSLPEFANSYQLDIISALRGNEHDFLAKAAIADAIRAVQSDEDKMELIDFIASEEHGAIALTXENNACKMFNCSPSELPLVSSNYKTKKHFLSELCELF

SEQ ID NO: 161816 - protein, 46 aa, Heterodera glycines
  Coding regions on vcDNA: vcDNA=SeqID_88239; Strand=-; Position=1-138
AISVDFCSFCASSKSNERRILSRINWVEKFGFDQLSLHLCRSVKST

SEQ ID NO: 161817 - protein, 124 aa, Heterodera glycines
  Coding regions on vcDNA: vcDNA=SeqID_88240; Strand=-; Position=5-376
KKKKKKFFFFGRGGFFFFFFEGRGEKFFGFFFPPQKKRVVWGGPSFFFFFFFFFKKKTPRVGGGIYLWGPQKKKKNVGGKRPPPPQKGKTPFPFSFFPIKVFNWPLLKTFKGAIHKNTDGERFS

SEQ ID NO: 161818 - protein, 124 aa, Heterodera glycines
  misc_feature (60)..(60): Xaa can be any naturally occurring amino acid
  misc_feature (68)..(68): Xaa can be any naturally occurring amino acid
  Coding regions on vcDNA: vcDNA=SeqID_88241; Strand=+; Position=2-373
AFAGAMKQTDKKSEDGKESLSPTLPPYDKWAAGVCFAMRFTQYFIYTNLETIGSGYAMMXVMLGQESXGYYKSLGPCLGPGFFPILQIPGLLFFWGLGEKKKKTPKGAFGVPFFSPPFFFFFWG

SEQ ID NO: 161819 - protein, 39 aa, Heterodera glycines
  misc_feature (12)..(13): Xaa can be any naturally occurring amino acid
  misc_feature (28)..(28): Xaa can be any naturally occurring amino acid
  Coding regions on vcDNA: vcDNA=SeqID_88242; Strand=-; Position=1-117
WPPPLQSVVRYXXMVEDKLCSTRILAEXGRVQWRVTAEI

SEQ ID NO: 161820 - protein, 25 aa, Heterodera glycines
  Coding regions on vcDNA: vcDNA=SeqID_88243; Strand=+; Position=1-75
QRTEPLRTTAEWLLETDGTALLRVL

SEQ ID NO: 161821 - protein, 26 aa, Heterodera glycines
  Coding regions on vcDNA: vcDNA=SeqID_88244; Strand=-; Position=1-78
ENSHPCTSMDGLSSKFFCSAAWDKGN

SEQ ID NO: 161822 - protein, 28 aa, Heterodera glycines
  Coding regions on vcDNA: vcDNA=SeqID_88245; Strand=-; Position=0-83
RDGQRTCRNMPRLCFVGTVKAGDQPLAS

SEQ ID NO: 161823 - protein, 139 aa, Heterodera glycines
  Coding regions on vcDNA: vcDNA=SeqID_88246; Strand=-; Position=6-422
EKKNPPPPPPPVEYFPRRWVFYTPPKKPPLLGEKKKNIFLPPNKRVGEKKTFFWVKKFFFPENFSLGAPPPQKIFFSQKKKHWGGKKKVGSGIPPNFGLVPRSGENVGKKFFQQNTFPSKSIPRSLLQLHCSLLPQSQK

SEQ ID NO: 161824 - protein, 23 aa, Heterodera glycines
  Coding regions on vcDNA: vcDNA=SeqID_88247; Strand=+; Position=3-74
IVSYLRHLNGTETYTKGAAGPRP

SEQ ID NO: 161825 - protein, 31 aa, Heterodera glycines
  misc_feature (14)..(14): Xaa can be any naturally occurring amino acid
  Coding regions on vcDNA: vcDNA=SeqID_88248; Strand=-; Position=1-96
IGQRRGRGRRESNXKGRQNKSTALCPNICRK

SEQ ID NO: 161826 - protein, 135 aa, Heterodera glycines
  Homolog annotation: Hit_ID=CAF97140.1; Match level="QueryCoverage =67%, HitCoverage=11%, E-value=3e-09, Identity=28%"; Hit description =unnamed protein product [Tetraodon nigroviridis]
  Coding regions on vcDNA: vcDNA=SeqID_88249; Strand=+; Position=26-430
MDVHDEEVEIIGTRSNERQMDRAHRQEQQQEKFYSQQQMSEESEEALFCISKHDVKEISQVVKAMAFRDHCTLNVSNEGIRLAVDDQHNQQGSAYFRSEHFQDFNFRTQTCSIKIPMRPLMEALNMFSGTMTMVF

SEQ ID NO: 161827 - protein, 70 aa, Heterodera glycines
  Coding regions on vcDNA: vcDNA=SeqID_88250; Strand=-; Position=2-211
PGGGGVFFLKLGGPPIEKIFGPKKKFAGCPIWAFVGVVGRQLLTNWHRVRFCCCGVPSTAVVAGRGRRCW

SEQ ID NO: 161828 - protein, 114 aa, Heterodera glycines
  Coding regions on vcDNA: vcDNA=SeqID_88251; Strand=-; Position=1-342
MRGGGGGGGGISLSSLFAKRKREKKEKGSAPAPPPRSIGEKKKVAAPTNKKEKSGGGPPPKRKGFFFFCGGRPPPCIKKGFFFIPPRGGGRFFFSFLKKMWPPPFPRSLLKNST

SEQ ID NO: 161829 - protein, 25 aa, Heterodera glycines
  Coding regions on vcDNA: vcDNA=SeqID_88252; Strand=+; Position=20-94
VKEMRLWTKCVQLITYLLLSFVALT

SEQ ID NO: 161830 - protein, 85 aa, Heterodera glycines
  Coding regions on vcDNA: vcDNA=SeqID_88253; Strand=-; Position=93-350
DSVVQQRRHSTCPSSQVGQFAPSHQLRCCYCCCSCHCPSAHHFEIGPMGKAPLQTACQLWHRFCGNSRSSPSKTNPSSSLWHFRR

SEQ ID NO: 161831 - protein, 73 aa, Heterodera glycines
  misc_feature (72)..(72): Xaa can be any naturally occurring amino acid
  Coding regions on vcDNA: vcDNA=SeqID_88254; Strand=-; Position=2-220
FFFFKKKFFFSAKKKKIKTPLFLLGGGPPPPPKKRGGGVFQKIFARGGGAPLQKGGEFLESHSPKLGYFFQXG

SEQ ID NO: 161832 - protein, 93 aa, Heterodera glycines
  misc_feature (62)..(62): Xaa can be any naturally occurring amino acid
  misc_feature (66)..(66): Xaa can be any naturally occurring amino acid
  misc_feature (68)..(69): Xaa can be any naturally occurring amino acid
  misc_feature (78)..(78): Xaa can be any naturally occurring amino acid
  Coding regions on vcDNA: vcDNA=SeqID_88255; Strand=-; Position=3-281
PPPLGVKKKGGPPPPFPPGRRGETPFWVGENGKFQTGGPIVSAPESFFALRFDIFLFHISGXHVTXSXXANNSKLIGXLVKWWCCAWYGSFFG

SEQ ID NO: 161833 - protein, 222 aa, Heterodera glycines
  Homolog annotation: Hit_ID=NP_497213.1; Match level="QueryCoverage =97%, HitCoverage=23%, E-value=2e-46, Identity=40%"; Hit description =DEAD/DEAH box helicase and helicase, C-terminal (102.9 kD) (3B196) [Caenorhabditis elegans] gb|AAF59587.2
  Gene Ontology: Mol. function=theta DNA polymerase activity; Cellular component=mitochondrion; Biological process=DNA repair
  Coding regions on vcDNA: vcDNA=SeqID_88256; Strand=+; Position=106-771
HVRSPQIGSATFNANFNPQMALDMCNDLGANLGKGIVLISHFHLLYNCVPLDVAVQVDWNLFYNEYLGLSSEERQLIHSMGLSEAVLIRHIHSHHQQKDPSKGMRIYVVFMLRQIWNQKPLWEVARYFGVPRGWLQSVLQSAVCQSSSIVRFAERTPDLWALRSLLPEMVRRLCECSRQELIPLLRIECVKIGRARQLYENGFRTVGSISKAEPCQLIKALG

SEQ ID NO: 161834 - protein, 154 aa, Heterodera glycines
  Homolog annotation: Hit_ID=S56117; Match level="QueryCoverage=68%, HitCoverage=84%, E-value=1e-18, Identity=57%"; Hit description =spermatid-specific protein T2 precursor - longfin squid
  Gene Ontology: Mol. function=protein binding; Cellular component =nucleus; Biological process=mRNA splicing
  Coding regions on vcDNA: vcDNA=SeqID_88257; Strand=+; Position=3-467
RRRRRKQRHRARKRRRRRRRRRKRRSGQRRRKHQRKEQRKRRRTRHRRRRRRSRRTRRRRRRRRRRRARRRRRRTRRRPARRRSAGCSEPNGSLSERPKTRDEARRTRDPLTGEPSNPQTFSHHFHPFILPLEFILNFSTFFVKFSVNKTMISY

SEQ ID NO: 161835 - protein, 30 aa, Heterodera glycines
  Coding regions on vcDNA: vcDNA=SeqID_88258; Strand=+; Position=40-129
MVCLVMAVLMEMANSKAVKKDNKKGAVAAS

SEQ ID NO: 161836 - protein, 32 aa, Heterodera glycines
  Coding regions on vcDNA: vcDNA=SeqID_88259; Strand=+; Position=1-99
EMVGTWHFAMFCRFIRIYLSVSIRTLGGRDSR

SEQ ID NO: 161837 - protein, 74 aa, Heterodera glycines
  Coding regions on vcDNA: vcDNA=SeqID_88260; Strand=-; Position=2-223
RIMHVQGVGDFFPFVCPLLLAVIPLSIKLVVPRQSSLLAPPLWMGSSKGSVYYRASKCSACHYQEGEKAVHAGL

SEQ ID NO: 161838 - protein, 75 aa, Heterodera glycines
  misc_feature (54)..(54): Xaa can be any naturally occurring amino acid
  misc_feature (63)..(63): Xaa can be any naturally occurring amino acid
  Coding regions on vcDNA: vcDNA=SeqID_88261; Strand=-; Position=1-225
GGGFFFFFFFPTPPLFFKKNFFFHKKILAAFPKKFLGGPQIFCQTQRPFQWHAXLTVFNWVSXCTTTSWRSAAAV

SEQ ID NO: 161839 - protein, 70 aa, Heterodera glycines
  Homolog annotation: Hit_ID=AAP30774.1; Match level="QueryCoverage =100%, HitCoverage=37%, E-value=4e-34, Identity=97%"; Hit description= putative gland protein G30E03 [Heterodera glycines]
  Coding regions on vcDNA: vcDNA=SeqID_88262; Strand=+; Position=31-240
MASSFCSSIISIVAIVCLLCKCCFSTPHPCCPGSQHVVSMMKDHTGTFSASMPKSSLCMSAERVAAAVEN

SEQ ID NO: 161840 - protein, 82 aa, Heterodera glycines
  misc_feature (41)..(41): Xaa can be any naturally occurring amino acid
  misc_feature (53)..(53): Xaa can be any naturally occurring amino acid
  misc_feature (59)..(59): Xaa can be any naturally occurring amino acid
  Coding regions on vcDNA: vcDNA=SeqID_88263; Strand=-; Position=0-245
KKKKKKIFFPAEKKKQRGKEGVFVFPTKRVNSQPGFTKNGXMFLSGVKGRPPXCSSSVXVLFHFHIVRMDPEKFGVLSARRG

SEQ ID NO: 161841 - protein, 69 aa, Heterodera glycines
  misc_feature (27)..(27): Xaa can be any naturally occurring amino acid
  Coding regions on vcDNA: vcDNA=SeqID_88264; Strand=+; Position=42-248
HETSTYNFTALRDTSLFSRAYEKFSGXWIGWNFGGPKRANFPGFGDHQFFEKNWGGNTKNFFFFLGAPP

SEQ ID NO: 161842 - protein, 67 aa, Heterodera glycines
  Coding regions on vcDNA: vcDNA=SeqID_88265; Strand=-; Position=121-324
GGGGVFFFPPPLFFKKKGGGGPPPPPPKKKKKKPPEKKKKKRGGVKKFLGGKTHGGENFCGSFGGLF

SEQ ID NO: 161843 - protein, 35 aa, Heterodera glycines
  Coding regions on vcDNA: vcDNA=SeqID_88266; Strand=-; Position=1-105
LPNVFVLLLDAYHQFHHVLSVCQYFVYKCIARGCA

SEQ ID NO: 161844 - protein, 26 aa, Heterodera glycines
  misc_feature (4)..(4): Xaa can be any naturally occurring amino acid
  Coding regions on vcDNA: vcDNA=SeqID_88267; Strand=-; Position=0-77
KRQXLGRCYADAFEQLGLISGSSTTS

SEQ ID NO: 161845 - protein, 26 aa, Heterodera glycines
  misc_feature (5)..(5): Xaa can be any naturally occurring amino acid
  Coding regions on vcDNA: vcDNA=SeqID_88268; Strand=-; Position=0-77
RRASXSTSRLCSYSPFSRFLLSTSFP

SEQ ID NO: 161846 - protein, 212 aa, Heterodera glycines
  misc_feature (10)..(10): Xaa can be any naturally occurring amino acid
  misc_feature (16)..(16): Xaa can be any naturally occurring amino acid
  Homolog annotation: Hit_ID=NP_495705.1; Match level="QueryCoverage =99%, HitCoverage=59%, E-value=2e-91, Identity=62%"; Hit description =transitional endoplasmic reticulum ATPase TER94 (89.6 kD) (2I431) [Caenorhabditis elegans] emb|CAA88314.1
  Gene Ontology: Mol. function=ATPase activity; Cellular component =cytosol; Biological process=microtubule cytoskeleton organization and biogenesis
  Coding regions on vcDNA: vcDNA=SeqID_88269; Strand=+; Position=3-636
RGHVRDVFDXARAAAXCVLFFDELDSIAKSRGGNVGDAGGAADRVINQVLTEMDGMGSKKNVFIIGATNRPDIIDSAILRPGRLDQLIYIPLPDEPSRLQIYRASLRKTPIAKDAELEYLAKVTVGFSGADITEICQRACKLAIRESIEKAVAIEKDRQAKEQRGEEVMDVAEDPVPQLTRKHFEDAMKFARRSIFDNDIRKYEMFAQTLQQ

SEQ ID NO: 161847 - protein, 106 aa, Heterodera glycines
  Coding regions on vcDNA: vcDNA=SeqID_88270; Strand=+; Position=1-318
GCTTPVIIPKPFAPYISRIAFPIPCQFGHSCDRYLCFVGALGLGEPLKQNFWGPPQGNLGGPLFFFCWGPPKAGGGGPPPLFFSPPLLSIKKPPPPPPQKKKPPPP

SEQ ID NO: 161848 - protein, 54 aa, Heterodera glycines
  misc_feature (36)..(36): Xaa can be any naturally occurring amino acid
  misc_feature (44)..(44): Xaa can be any naturally occurring amino acid
  Coding regions on vcDNA: vcDNA=SeqID_88271; Strand=-; Position=1-162
GGGGENPPFFWGVFGREQARSQGHGPRGCGYSAAPXLCPLAQVXGSSSARTTRP

SEQ ID NO: 161849 - protein, 50 aa, Heterodera glycines
  Coding regions on vcDNA: vcDNA=SeqID_88272; Strand=+; Position=87-239
PDNYVIGQIIINYSLIFKLCIFLFWFIAILILTFASFLLPPLINILLNNF

SEQ ID NO: 161850 - protein, 236 aa, Heterodera glycines
  Coding regions on vcDNA: vcDNA=SeqID_88273; Strand=+; Position=33-740
MDSEENDLGQAVESSSVDVQQQMTTKSDEDADISNNGTVVPSRQTVSSGNERMGGMDLSGEPALLFSAETSFEAINASNKFAQRLLQPFKPLPLAQLLSGSATVGNVYLLQNGAHSKIGGPSTPLPYNSLISAFTPSAAGGSSSSTSGGMMFSSPLDSCKTEEANETGGDSNSTTQMMPWRMGGRHGKNDGQRTSSLDATSVGSSSVDWSPPESRKHSRRNTALGGGSSTATSAHF

SEQ ID NO: 161851 - protein, 218 aa, Heterodera glycines
  Homolog annotation: Hit_ID=CAE64905.1; Match level="QueryCoverage =94%, HitCoverage=61%, E-value=1e-39, Identity=42%"; Hit description =Hypothetical protein CBG09724 [Caenorhabditis briggsae]
  Gene Ontology: Mol. function=protein kinase activity; Cellular component=cytoplasm; Biological process=asymmetric protein localization involved in cell fate commitment
  Coding regions on vcDNA: vcDNA=SeqID_88274; Strand=+; Position=34-687
MSSEIAKNATANKGNDFRTARKISSLEMDENTGEGNKQKMQQTKGRAGERNWIIVTRISDRSMFYKTFELVSQIGQGNFSDVFLVFSSEKGEKYAVKEIDKERMRSKLHFVENEVALLQRCRHRNICRLIDAFECRRAFFLLFDYAQKGDLFETIRRIGRLSERSAAQITRQISSALAFLHRRRIVHRDVRPENILLGADSTAKLTDFGLACFFLGPL

SEQ ID NO: 161852 - protein, 47 aa, Heterodera glycines
  misc_feature (7)..(8): Xaa can be any naturally occurring amino acid
  Coding regions on vcDNA: vcDNA=SeqID_88275; Strand=-; Position=340-483
FFFFFFXXASVARVQPRTSKGITDLLLLNFVRLNTENPSKKLCPQKQ

SEQ ID NO: 161853 - protein, 170 aa, Heterodera glycines
  misc_feature (46)..(46): Xaa can be any naturally occurring amino acid
  Homolog annotation: Hit_ID=ZP_00198102.3; Match level="QueryCoverage =99%, HitCoverage=30%, E-value=2e-12, Identity=35%"; Hit description =COG1309: Transcriptional regulator [Kineococcus radiotolerans SRS30216]
  Coding regions on vcDNA: vcDNA=SeqID_88276; Strand=+; Position=1-509
GRHRGRPEHAVPGRGGHPRRMGAAGAPVRPLPRRVDRARSGRRRGXSRRPVPWADAASRAASASRRPAGRPGPLPAAPPTGRVTAPPADRPAAPDWSGALHDDRRARPHHRDRHGRAARGRRGPRRRAAPRGAGDPRRAHLPQHHRLDGRPVPPAGQRGGAQRHRRRRRG

SEQ ID NO: 161854 - protein, 173 aa, Heterodera glycines
  misc_feature (11)..(11): Xaa can be any naturally occurring amino acid
  misc_feature (24)..(24): Xaa can be any naturally occurring amino acid
  misc_feature (162)..(162): Xaa can be any naturally occurring amino acid
  Homolog annotation: Hit_ID=CAE68486.1; Match level="QueryCoverage =100%, HitCoverage=47%, E-value=1e-47, Identity=56%"; Hit description= Hypothetical protein CBG14288 [Caenorhabditis briggsae]
  Coding regions on vcDNA: vcDNA=SeqID_88277; Strand=-; Position=1-518
HFEQLLAKADXTEEQSKKLLSAMXAYLQPNPALRMGDLFYEKMEITSPAPNRSNTLEYLSEAMQEAAQSFGTETPFGGALQKIAQTEAKLGAAEREMVQTTAGQTLVPIKRFLEGEMRNIQRERRVLQKKRLDLDAAKSRLKRARTLEGQATRTETNYLFVXQAEADLRVAQA

SEQ ID NO: 161855 - protein, 88 aa, Heterodera glycines
  Coding regions on vcDNA: vcDNA=SeqID_88278; Strand=+; Position=16-279
MSFLRLITFVLLITLCSLPSLVESGLIGIVGTPVEAAWCGVLGKESSHCPTAGGGQHGGGGGGGNYGGGAPGGNYGGSSGSYNGHRAR

SEQ ID NO: 161856 - protein, 100 aa, Heterodera glycines
  Coding regions on vcDNA: vcDNA=SeqID_88279; Strand=+; Position=135-434
RFYYFVINFLSFLETETNGAITTDNEPKIHAEKNETGDAAVGQKSTEEQFDKTDKKAEQQNVLDVNKTQQEPKAPLDEVKETPQEDNSEEVPTEAIVVDV

SEQ ID NO: 161857 - protein, 84 aa, Heterodera glycines
  misc_feature (76)..(76): Xaa can be any naturally occurring amino acid
  Homolog annotation: Hit_ID=NP_510427.1; Match level="QueryCoverage =94%, HitCoverage=10%, E-value=4e-19, Identity=54%"; Hit description =putative protein of eukaryotic origin (XP188) [Caenorhabditis elegans] emb|CAB01868.2| Hypothetical prote
  Coding regions on vcDNA: vcDNA=SeqID_88280; Strand=+; Position=47-298
MTSILKNQIIKHLSAFARNLKPEQITMELLRGKGQLRDLELNEEVLAEKLELPPWLKIVSARCDRVSIKIPSWNKXEECSHPIV

SEQ ID NO: 161858 - protein, 66 aa, Heterodera glycines
  Coding regions on vcDNA: vcDNA=SeqID_88281; Strand=+; Position=1-198
GRQDLLIIYYRTDWISGDNRTDRWSARCKTCSLNRTIGLWTTYCLNCPMDWKRCPILSTVLSGTII

SEQ ID NO: 161859 - protein, 175 aa, Heterodera glycines
  Coding regions on vcDNA: vcDNA=SeqID_88282; Strand=+; Position=86-610
QWACCGLHTFTLCISAHWAKCAGPLCRRHATDTQIVRPKYEGSCREAGDLPRKAMRAALAFYDRTVRHRFADGSSGGEAQREELKLCLNSLVSTLESADAEREAKWERLKQFLRVCGTAAIFAVLAFLFTLYWPLFSSLAVGVVRTVWTLISSLRDLLVAHWPDLLFGVCSSALS

SEQ ID NO: 161860 - protein, 108 aa, Heterodera glycines
  Coding regions on vcDNA: vcDNA=SeqID_88283; Strand=+; Position=3-326
PPRFEMDLNISPTLEDPNASLVDNEQTADEKMEKPNSSANVSFSNVTDKFRAHPVEKVGSPITINQSISDPTTELTEEDIFRMKSMSIEQNGWKNGPCASELQSAVSQ

SEQ ID NO: 161861 - protein, 141 aa, Heterodera glycines
  Homolog annotation: Hit_ID=NP_493251.1; Match level="QueryCoverage =87%, HitCoverage=24%, E-value=1e-20, Identity=43%"; Hit description =amino acid/polyamine transporter, family II (1N460) [Caenorhabditis elegans] emb|CAA22315.1| Hypothetical
  Coding regions on vcDNA: vcDNA=SeqID_88284; Strand=+; Position=27-449
MRKIIPPNALMNILPKQGLSWPLAAFFMVTDMAIGGMVTLPGAICRIGLSRGLALLLLSGLFCCCSAILLGQCWLFVLDKSPQLRQKHCRRPYAEIGFCALGRWMSILVSVGVNVTQFGIATVFLLLCAVNLSRICSTLFH

SEQ ID NO: 161862 - protein, 80 aa, Heterodera glycines
  Homolog annotation: Hit_ID=CAE72462.1; Match level="QueryCoverage =97%, HitCoverage=8%, E-value=3e-31, Identity=87%"; Hit description =Hypothetical protein CBG19635 [Caenorhabditis briggsae]
  Gene Ontology: Cellular component=Golgi apparatus
  Coding regions on vcDNA: vcDNA=SeqID_88285; Strand=-; Position=1-240
RQRALDYLSGCIEQVAQFGDILQLVIVELIYKVCHNNPGERNRFIRCVYNLLQSQSGAVRYEAAGTLVTLSTAPTAVKAA

SEQ ID NO: 161863 - protein, 145 aa, Heterodera glycines
  Homolog annotation: Hit_ID=AAP30755.1; Match level="QueryCoverage =100%, HitCoverage=63%, E-value=4e-77, Identity=97%"; Hit description= putative gland protein 29D09 [Heterodera glycines]
  Coding regions on vcDNA: vcDNA=SeqID_88286; Strand=+; Position=35-469
MSSLLLSIFPIVFLVCCNAMPNFPCCPGSQQVVAVMSKYIDTFSSAADESTVCSTAKSTVDGIKNELSSRGGCQNGGEAQIVDEIDRQLKNIAKMEINYEDECPYNLGFARAMFDLAAAAAGHAGNGTEWQYMKVQFEQESQAIK

SEQ ID NO: 161864 - protein, 175 aa, Heterodera glycines
  Homolog annotation: Hit_ID=AAT40742.1; Match level="QueryCoverage =100%, HitCoverage=48%, E-value=9e-93, Identity=100%"; Hit description=lactose operon repressor [Phage display vector pTScDisp] gb|AAT40740.1| lactose operon repressor [Phage
  Coding regions on vcDNA: vcDNA=SeqID_88287; Strand=-; Position=254-781
AGPLSSVSARLRLAGWHKYLTRNQIQPIAEREGDWSAMSGFQQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKRKTTLAPNTQTASPRALADSLMQLARQVSRLESGQ

SEQ ID NO: 161865 - protein, 201 aa, Heterodera glycines
  Homolog annotation: Hit_ID=ZP_00266445.1; Match level="QueryCoverage =99%, HitCoverage=86%, E-value=1e-87, Identity=83%"; Hit description =hypothetical protein Pflu02000752 [Pseudomonas fluorescens PfO-1]
  Coding regions on vcDNA: vcDNA=SeqID_88288; Strand=-; Position=1-603
FGANAMALDLGSLSQGDASGGLKDALTQGAQIAVKQLGTPGGFSNNPDVKIGLPGKLGKVADKLKMFGMGDQVTQLETSMNKAAETAVTQAQPILVNAVKNMSVTDAKGILSGGQDSATQYLNKSSREEIRAKFLPIVKAATDKVGVAQQYNALAGKAAAFGAVDAKSANVENYVTEQALDGLFKMIAQQEETIRKNPAAA

SEQ ID NO: 161866 - protein, 141 aa, Heterodera glycines
  Homolog annotation: Hit_ID=AAM94882.1; Match level="QueryCoverage =90%, HitCoverage=94%, E-value=9e-73, Identity=100%"; Hit description= hypothetical protein [Erwinia amylovora] ref|NP_758764.1| hypothetical protein [Erwinia amylovora]
  Coding regions on vcDNA: vcDNA=SeqID_88289; Strand=+; Position=40-465
YGYPQNQGITQERTCEQKASKRPGTVKRPRCWRFSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTR

SEQ ID NO: 161867 - protein, 152 aa, Heterodera glycines
  Homolog annotation: Hit_ID=ZP_00138004.1; Match level="QueryCoverage =100%, HitCoverage=50%, E-value=9e-89, Identity=100%"; Hit description=COG3555: Aspartyl/asparaginyl beta-hydroxylase and related dioxygenases [Pseudomonas aeruginosa UCBPP
  Coding regions on vcDNA: vcDNA=SeqID_88290; Strand=-; Position=3-458
NWQAIRSEALHLHGAGNIKRSEQYDDIGFNSFFKSGWKRFYLKWYDEAHPSAGQLCPQTTALLRQIPSVKAAMFAELPPGSKLVRHRDPYAGSLRFHLGLFTPNDPACFIEVDGERYHWRDGEAVVFDETFIHYAENATEHNRIILFCDIER

SEQ ID NO: 161868 - protein, 86 aa, Heterodera glycines
  Coding regions on vcDNA: vcDNA=SeqID_88291; Strand=+; Position=17-274
EKTMSSSLIMNCLIALTILAVFVSTIDAIGMPMQCCGQQQQSCCGGGGGGCGRRKRDTEAVQPHFKSDETPCPQTEWRQVIDESIR

SEQ ID NO: 161869 - protein, 87 aa, Heterodera glycines
  Coding regions on vcDNA: vcDNA=SeqID_88292; Strand=-; Position=2-262
HRNWRRTPTDDPRGCCPFVSHHFPDHFGTSKTLMDNSQCYFWGNALMNTNSDNNFHPIISSSASLSRRSFVFRFSSPCACRLCFLGG

SEQ ID NO: 161870 - protein, 34 aa, Heterodera glycines
  Coding regions on vcDNA: vcDNA=SeqID_88293; Strand=-; Position=0-101
PHCHQYRQSLHSLNQSALAHGDTMKRHSDAFWRP

SEQ ID NO: 161871 - protein, 34 aa, Heterodera glycines; identical to SEQ ID NO: 161870
  Coding regions on vcDNA: vcDNA=SeqID_88294; Strand=-; Position=0-101

SEQ ID NO: 161872 - protein, 178 aa, Heterodera glycines
  Homolog annotation: Hit_ID=CAE68486.1; Match level="QueryCoverage =97%, HitCoverage=47%, E-value=1e-49, Identity=58%"; Hit description =Hypothetical protein CBG14288 [Caenorhabditis briggsae]
  Coding regions on vcDNA: vcDNA=SeqID_88295; Strand=-; Position=1-534
LGKNPHFEQLLAKADKTEEQSKKLLSAMEAYLQPNPALRMGDLFYEKMEITSPAPNRSNTLEYLSEAMQEAAQSFGTETPFGGALQKIAQTEAKLGAAEREMVQTTAGQTLVPIKRFLEGEMRNIQRERRVLQKKRLDLDAAKSRLKRARTLEGQATRTETNYLFVEQAEADLRVAQA

SEQ ID NO: 161873 - protein, 30 aa, Heterodera glycines
  Coding regions on vcDNA: vcDNA=SeqID_88296; Strand=-; Position=2-91
KAQAQNSATKRTNRAIRDITKANLEFYLGG

SEQ ID NO: 161874 - protein, 97 aa, Heterodera glycines
  Coding regions on vcDNA: vcDNA=SeqID_88297; Strand=+; Position=53-343
MKTACFVAAAVVLATANAQIFRSADFEADKCNTQDLLAKAYPLLVNPNYSVCQKDADFQFYPITGLPSDEKLAKMCASPACQELLKVIAAADLPDCD

SEQ ID NO: 161875 - protein, 62 aa, Heterodera glycines
  Homolog annotation: Hit_ID=XP_318639.1; Match level="QueryCoverage =98%, HitCoverage=21%, E-value=2e-23, Identity=81%"; Hit description =ENSANGP00000022859 [Anopheles gambiae] gb|EAA43466.1| ENSANGP00000022859 [Anopheles gambiae str. PEST]
  Gene Ontology: Mol. function=homogentisate 12-dioxygenase activity; Biological process=phenylalanine catabolism
  Coding regions on vcDNA: vcDNA=SeqID_88298; Strand=+; Position=1-186
GRQAVAEGTFRPPYFHRNCMSEFMGLIVGRYEAKEGGFSAGGASLHSMMTPHGPDAACFEKA

SEQ ID NO: 161876 - protein, 56 aa, Heterodera glycines
  Coding regions on vcDNA: vcDNA=SeqID_88299; Strand=+; Position=300-470
THEEYECAISLSWERKHEALRRRPKGLIAYPFFFSFILVFPIYNDNLHVLCTVSLI

SEQ ID NO: 161877 - protein, 117 aa, Heterodera glycines
  Coding regions on vcDNA: vcDNA=SeqID_88300; Strand=+; Position=2-352
AAKVIVDQNAEQTDTESDPEDYEYDADPSSPREMCKFKRRRMTYSSGTAKPPKLENRRTSHVEFGSSMFDYDAQVMDIGLPLPTIQKVENVEIVIPSFRKKCGLLSDFSLSPTECER

SEQ ID NO: 161878 - protein, 134 aa, Heterodera glycines
  Homolog annotation: Hit_ID=AAT40742.1; Match level="QueryCoverage =100%, HitCoverage=36%, E-value=7e-68, Identity=100%"; Hit description=lactose operon repressor [Phage display vector pTScDisp] gb|AAT40740.1| lactose operon repressor [Phage
  Coding regions on vcDNA: vcDNA=SeqID_88301; Strand=-; Position=260-664
QQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKRKTTLAPNTQTASPRALADSLMQLARQVSRLESGQ

SEQ ID NO: 161879 - protein, 137 aa, Heterodera glycines
  Coding regions on vcDNA: vcDNA=SeqID_88302; Strand=+; Position=50-460
NEKAFFLNICIFKNFQNAPVSAIVSAAFHLLRLHDRLSNGLNCQQGAEIKPNGQKFNNTDQKCPQKDAKYCVTSICTTDEIPNYTNIAWFCDVIKNAEKCANRRKEKFTGLKNISCKCLYGEEGEDHGNAQFTPPPL

SEQ ID NO: 161880 - protein, 82 aa, Heterodera glycines
  Coding regions on vcDNA: vcDNA=SeqID_88303; Strand=-; Position=0-245
PSTRADCPWAFSSVPSMVAAHDAGPVEFFGSVLSLLLVVISPSFCSSAVCLFCLLRRIASSEAAANGGECANLKCAVAPWRP

SEQ ID NO: 161881 - protein, 146 aa, Heterodera glycines
  Homolog annotation: Hit_ID=NP_740864.1; Match level="QueryCoverage =100%, HitCoverage=20%, E-value=8e-40, Identity=56%"; Hit description= hydroxyacyl-Coenzyme A dehydrogenase 3-ketoacyl-Coenzyme enoyl -Coenzyme hydratase (1G784) [Caenorhabditi
  Gene Ontology: Mol. function=enoyl-CoA hydratase activity; Cellular component=mitochondrion; Biological process=growth
  Coding regions on vcDNA: vcDNA=SeqID_88304; Strand=+; Position=2-439
AISACEQLAAGTLKINRERPLMERIQNVLLTRKPLLDAVVMRMARDKVMKQTHGNYPAPLRILDVVRTGLVDGQQEGYEEETKEFGYLTQTTQSEALIGLFKGQTECKKNKHGEARKTERLGVIGAGLMGAGIANVSIDKGIHTTL

SEQ ID NO: 161882 - protein, 103 aa, Heterodera glycines
  Coding regions on vcDNA: vcDNA=SeqID_88305; Strand=-; Position=2-310
LATIVVCIVGLSLIGSICIIWCHALSEFCLNRTDISSSSARKMFALCTIIGTRNTRTSRAQVLQRMPIEANKWEDLGQGGEAEDEDDDEQYCISEYVVLPTCG

SEQ ID NO: 161883 - protein, 149 aa, Heterodera glycines
  Homolog annotation: Hit_ID=CAE72049.1; Match level="QueryCoverage =98%, HitCoverage=23%, E-value=3e-51, Identity=62%"; Hit description =Hypothetical protein CBG19133 [Caenorhabditis briggsae]
  Gene Ontology: Mol. function=gamma-glutamyl transferase activity; Cellular component=plasma membrane; Biological process =spermatogenesis
  Coding regions on vcDNA: vcDNA=SeqID_88306; Strand=-; Position=2-448
DSDNGNNSAALPPRAHSARVHLKWPSPTGSMHAQYRRAAVATDHGLCSEIGRDVLLEGGNSVDSMIASLLCIGVVNPQSSGLGGGFIMTLYNTSTQRCTTIDARETAPLGTNSTMYVGTPRDSVIGYRSIAVPGELHGFWTAFTKFGSG

SEQ ID NO: 161884 - protein, 167 aa, Heterodera glycines
  Homolog annotation: Hit_ID=CAE65006.1; Match level="QueryCoverage =100%, HitCoverage=61%, E-value=2e-59, Identity=60%"; Hit description= Hypothetical protein CBG09844 [Caenorhabditis briggsae]
  Gene Ontology: Mol. function=phosphatidylinositol transporter activity; Cellular component=subrhabdomeral cisterna; Biological process=nonselective vesicle transport
  Coding regions on vcDNA: vcDNA=SeqID_88307; Strand=+; Position=45-545
MLIREYRIVMPLTIEEYQIGQLFSVAEASRQETGGGEGVHVVRNEPFEGQSLFNGRFTSGQFTHKIIHLDTKVPAFLRTIMPRGSTTLHERSWNAFPYCKTEVTNPDYMKDDFLIRIETMHLSDRGTTKNALGLTKDVLKERKVVRIDIANDNEFLRAADILDNTRP

SEQ ID NO: 161885 - protein, 168 aa, Heterodera glycines
  misc_feature (84)..(84): Xaa can be any naturally occurring amino acid
  misc_feature (98)..(98): Xaa can be any naturally occurring amino acid
  misc_feature (106)..(106): Xaa can be any naturally occurring amino acid
  misc_feature (123)..(123): Xaa can be any naturally occurring amino acid
  misc_feature (130)..(130): Xaa can be any naturally occurring amino acid
  misc_feature (143)..(143): Xaa can be any naturally occurring amino acid
  Homolog annotation: Hit_ID=AAL78227.1; Match level="QueryCoverage =75%, HitCoverage=49%, E-value=4e-33, Identity=59%"; Hit description =hypothetical protein Hgg-18 [Heterodera glycines]
  Coding regions on vcDNA: vcDNA=SeqID_88308; Strand=+; Position=16-511
MNSQLLCIFLLVICTVSIGTLTQAKPIPEEAAATETKADEGKKEEPKKEKPKRKRKKRRRRSRKRKKQRKERAKRKKLRKMKPXKGGAENGRGQKGRXQSPVPRPXLTEAADNVNKAVDDLSXLNRQKHXKNAAEATAEKTPXRAGKSIERSGRKRRKRTAEDGCQQN

SEQ ID NO: 161886 - protein, 80 aa, Heterodera glycines
  Coding regions on vcDNA: vcDNA=SeqID_88309; Strand=+; Position=1-243
GRQAFLHRSLLMNLPPSSSSSPVLFNRLTNRQTLAFSAIVRRVTRGFSTRQRNLYKVLGVSPSASQSDIKKAYYTDCVDE

SEQ ID NO: 161887 - protein, 124 aa, Heterodera glycines
  Homolog annotation: Hit_ID=AAK91501.1; Match level="QueryCoverage =97%, HitCoverage=59%, E-value=9e-49, Identity=77%"; Hit description =R2 [Brugia malayi]
  Gene Ontology: Mol. function=chaperone activity; Cellular component =endoplasmic reticulum; Biological process=signal transduction
  Coding regions on vcDNA: vcDNA=SeqID_88310; Strand=+; Position=2-373
AAKYKDSKFHRVIRNFMIQGGDFTRGDGTGGKSIFEGKSFEDENFKLHHYGAGWLIMANAGPDTNGSQFFITTVHTPWLDGRHVVFGKVLEGMNIVREIEDGETAGGDRPKKDVVIVDSGELTV

SEQ ID NO: 161888 - protein, 177 aa, Heterodera glycines
  Homolog annotation: Hit_ID=AAB96364.1; Match level="QueryCoverage =100%, HitCoverage=49%, E-value=1e-59, Identity=66%"; Hit description= L-glycerol-3-phosphate [Takifugu rubripes] sp|O57656|GPDA_FUGRU GLYCEROL-3-PHOSPHATE DEHYDROGENASE [NAD+]
  Gene Ontology: Mol. function=ATP binding; Cellular component =cytoplasm; Biological process=nucleotide-sugar metabolism
  Coding regions on vcDNA: vcDNA=SeqID_88311; Strand=-; Position=1-531
IINEKHENVKYLPGKKLPTNVIAVTDVVEASKNADVLIFIIPHQFLHKVCEQLKGNIKKSAIAISLIKGLATFHEKDIGLRLISNEIATSLGIDTSVLMGANLANEVADDHFCEATIGTKNPQHGNELKKLFHTDNFRINVVEDAATVELCGALKNIVACGAGFSVGLGYGDNTMAA

SEQ ID NO: 161889 - protein, 71 aa, Heterodera glycines
  Coding regions on vcDNA: vcDNA=SeqID_88312; Strand=+; Position=97-309
MSAAASAGQTHRWGGMAAPHRSRPPLRFDRTFLEERDNQLKLIQMLCGLVALLLTVQCWPNPLFPFCLGRV

SEQ ID NO: 161890 - protein, 51 aa, Heterodera glycines
  Coding regions on vcDNA: vcDNA=SeqID_88313; Strand=-; Position=0-152
DSQSVFTSAVLFYCFSSSFCWSTAAFFFISMGMVRPPLSAVFIPLMNTWRP

SEQ ID NO: 161891 - protein, 103 aa, Heterodera glycines; identical to SEQ ID NO: 161882
  Coding regions on vcDNA: vcDNA=SeqID_88314; Strand=-; Position=2-310

SEQ ID NO: 161892 - protein, 61 aa, Heterodera glycines
  Homolog annotation: Hit_ID=NP_500767.1; Match level="QueryCoverage =90%, HitCoverage=52%, E-value=2e-12, Identity=65%"; Hit description =MSP-domain protein like family member (4G39) [Caenorhabditis elegans] gb|AAC26930.1| Hypothetical protein
  Coding regions on vcDNA: vcDNA=SeqID_88315; Strand=+; Position=47-229
MEETPISLLRMAREAEKEQKEEKKEEKKEEKPEEGKKEEKKEEKKEEGKQEEKKEEKTEEK

SEQ ID NO: 161893 - protein, 61 aa, Heterodera glycines
  Coding regions on vcDNA: vcDNA=SeqID_88316; Strand=-; Position=29-214
RSHSFATAREYLPVPRHVHVRVAFLSLQFIVFSSFDCEIEQNQLNSEETEEEGAVHFILKN

SEQ ID NO: 161894 - protein, 143 aa, Heterodera glycines
  misc_feature (38)..(38): Xaa can be any naturally occurring amino acid
  Homolog annotation: Hit_ID=NP_508280.1; Match level="QueryCoverage =100%, HitCoverage=12%, E-value=5e-37, Identity=51%"; Hit description= atp citrate lyase (XC101) [Caenorhabditis elegans] gb|AAB00585.1| Hypothetical protein D1005.1 [Caenorha
  Gene Ontology: Mol. function=ATP citrate synthase activity; Cellular component=mitochondrion; Biological process=ATP catabolism
  Coding regions on vcDNA: vcDNA=SeqID_88317; Strand=+; Position=52-479
MSAKAVNEYSGKELLYRSLNHVQALVKPNAVQLDENHXFQDAIINCDWISKEGQGVLKPDQLIKRRGKHGLVKIGTTDELAKWFDEKKGQNVQIGKTTGRLSKFILEPLCKHGAKDELYIAIYSKMNEDVILFYEEGGVEVGD

SEQ ID NO: 161895 - protein, 98 aa, Heterodera glycines
  Coding regions on vcDNA: vcDNA=SeqID_88318; Strand=-; Position=1-294
HSQTENGRSQLGQFGEFFFSHPPLIRRERTDHRMDNESFVHSLKGPSFTPRPPPRRQPQALPLPPPPPASVSPTLAWLAPPRWLLRPLSSLGSPGLAA

SEQ ID NO: 161896 - protein, 76 aa, Heterodera glycines
  misc_feature (55)..(55): Xaa can be any naturally occurring amino acid
  Coding regions on vcDNA: vcDNA=SeqID_88319; Strand=+; Position=2-229
AAKNLLPAPLVGSILLLGHFVFVSVGSNFHVLKKRGYDESESYSSEEEPRQAPRXGGRFGGKRHRYPPAHGKGHRP

SEQ ID NO: 161897 - protein, 90 aa, Heterodera glycines
  misc_feature (54)..(54): Xaa can be any naturally occurring amino acid
  Homolog annotation: Hit_ID=NP_508902.3; Match level="QueryCoverage =98%, HitCoverage=28%, E-value=2e-28, Identity=64%"; Hit description =stomatin (sto-2) [Caenorhabditis elegans] gb|AAA81390.3| Stomatin protein 2 [Caenorhabditis elegans] sp|Q
  Gene Ontology: Mol. function=protein binding; Cellular component =integral to membrane; Biological process=signal transduction
  Coding regions on vcDNA: vcDNA=SeqID_88320; Strand=+; Position=1-269
GRQSLAQLKLSYYPKNADFDDTSSMVCQWMFWLLSWLLLLFTFPVSVCFCIKIXKEYERAVIFRLGRLIGGGAKGPGLFWVMPCIESFVR

SEQ ID NO: 161898 - protein, 166 aa, Heterodera glycines
  Homolog annotation: Hit_ID=NP_510277.1; Match level="QueryCoverage =83%, HitCoverage=71%, E-value=4e-37, Identity=48%"; Hit description =BMP receptor Associated protein (21.5 kD) (bra-1) [Caenorhabditis elegans] emb|CAA94138.1| Hypothetical p
  Gene Ontology: Cellular component=nucleus; Biological process=cell proliferation
  Coding regions on vcDNA: vcDNA=SeqID_88321; Strand=+; Position=66-621
MLVGEDGIVAGLSVGGTEPRPPTLQVEPTYSDNYVLDGQHMISESRMRDILMELQQRWLKEYEQSREKLLVELTEKLHQEYLTDLQRKQTEYMAQCREEMEAERVRQDELFQRRLQEEVQRLTEKQRREIQLIKKKQWCWQCEKEAIYHCCWNTAYCTVECQQAHW

SEQ ID NO: 161899 - protein, 95 aa, Heterodera glycines
  Coding regions on vcDNA: vcDNA=SeqID_88322; Strand=+; Position=2-289
AAKQNVLPSSDHFCSSETLCSLPSLVESGLIGIDGTPVEADWCGVLGKESSHCPTAGGGQHGGGGGGGNYGGGAPGGNYGGSSGSYNGHRARRFA

SEQ ID NO: 161900 - protein, 134 aa, Heterodera glycines
  Coding regions on vcDNA: vcDNA=SeqID_88323; Strand=+; Position=3-404
PPPGGGCAVRTLRGCDIDASLRYSVERALQAAVCLRKLARTETAIELNVLSDDGGAFAACLVAAGVAIASANIEMLDVLLACNVLLIPSNSLTAPLRIVFDPDKATIAAHVGKASALTMGVIPTIGQVVCAELS

SEQ ID NO: 161901 - protein, 34 aa, Heterodera glycines
  Coding regions on vcDNA: vcDNA=SeqID_88324; Strand=-; Position=5-109
KAQAQNSATKRTNRAIRDITKANLEFYLKPWRPL

SEQ ID NO: 161902 - protein, 70 aa, Heterodera glycines
  Coding regions on vcDNA: vcDNA=SeqID_88325; Strand=+; Position=1-213
QGRNCCFCSMSVPRALPLVNTLVLPLTRCLFVNFCKICVCFFIILINRISLVLYHSPFSSHSFLLFFVSL

SEQ ID NO: 161903 - protein, 63 aa, Heterodera glycines
  Homolog annotation: Hit_ID=NP_496361.1; Match level="QueryCoverage =98%, HitCoverage=20%, E-value=2e-20, Identity=67%"; Hit description =COLlagen structural gene (30.9 kD) (col-81) [Caenorhabditis elegans] emb|CAA90187.1| Hypothetical protein
  Gene Ontology: Mol. function=structural constituent of cuticle; Cellular component=extracellular; Biological process=cuticle biosynthesis (sensu Nematoda)
  Coding regions on vcDNA: vcDNA=SeqID_88326; Strand=+; Position=3-194
PPSGENGQPGQPGNPGPQGYPGDGGSPGQPGNPGGSGEPGQPGAQGSSGQCYHCPPPRTAPGY

SEQ ID NO: 161904 - protein, 156 aa, Heterodera glycines
  Homolog annotation: Hit_ID=CAF89757.1; Match level="QueryCoverage =34%, HitCoverage=12%, E-value=2e-11, Identity=57%"; Hit description =unnamed protein product [Tetraodon nigroviridis]
  Gene Ontology: Mol. function=transporter activity; Cellular component= membrane; Biological process=transport
  Coding regions on vcDNA: vcDNA=SeqID_88327; Strand=+; Position=1-468
GRQEFSPTLCSNRRASGSAFSSPTNWTSAPTDRHCFSSCHSNGDILAEMQLLMARNIVLTGGNALFPGYRKRIEQELRSMMPEQFTLGVQQPSDPICHAWECARDAIQQQQHDAETSASSAAHVGAATQFSPRLTAKFDKLGLAGDIEAEHKGLLL

SEQ ID NO: 161905 - protein, 208 aa, Heterodera glycines
  misc_feature (173)..(173): Xaa can be any naturally occurring amino acid
  misc_feature (194)..(194): Xaa can be any naturally occurring amino acid
  Homolog annotation: Hit_ID=AAH74591.1; Match level="QueryCoverage =96%, HitCoverage=62%, E-value=1e-36, Identity=40%"; Hit description =MGC69246 protein [Xenopus tropicalis] ref|NP_001004816.1| MGC69246 protein [Xenopus tropicalis]
  Coding regions on vcDNA: vcDNA=SeqID_88328; Strand=+; Position=3-628
PPSEIDVFLDFSHCRPSDQERALFFELEAVLQFAQRSADCLAIYGAGASAEVRAALQNCDDADIQNASFAIVRQFVRRIRKYFETAQRIEKVVPELLWELCSGPLPPVEQLDSAQALCKQLARLIDFVFHFDTMKMNTPAMQNDFSFFRRVISRSEAAAREAETDCSLELANXFSLFLASPTPMLNALTNATAXFVRDHPDLPVSNTT

SEQ ID NO: 161906 - protein, 32 aa, Heterodera glycines
  Coding regions on vcDNA: vcDNA=SeqID_88329; Strand=+; Position=20-115
KMPERLTYRRRLCYNTKSNKTKVVKTPGGRNV

SEQ ID NO: 161907 - protein, 151 aa, Heterodera glycines
  Coding regions on vcDNA: vcDNA=SeqID_88330; Strand=+; Position=56-508
ILRLLLAVSLLVTCCHGQKERKPKTGTTKTSTTTTTTTTTTTTTLPKMTAPNNTAANGGGGSGNTLLFILLGVGVFVALAVAVVVAVVVWRRRQARTDSYAVDGGDAAKGAASSDGANGAKKDAAKGGSSSSQTASVEKFSAVSSVPSSLK

SEQ ID NO: 161908 - protein, 171 aa, Heterodera glycines
  misc_feature (14)..(14): Xaa can be any naturally occurring amino acid
  misc_feature (63)..(63): Xaa can be any naturally occurring amino acid
  misc_feature (77)..(77): Xaa can be any naturally occurring amino acid
  Homolog annotation: Hit_ID=AAL78227.1; Match level="QueryCoverage =87%, HitCoverage=59%, E-value=1e-76, Identity=92%"; Hit description =hypothetical protein Hgg-18 [Heterodera glycines]
  Coding regions on vcDNA: vcDNA=SeqID_88331; Strand=+; Position=1-515
PSRAAAATAEKTPXRAGKSIERSGRKRRKRTAEDGCQQNFGGKSEKRRGIGKRSENENGNSFXGQQKGQRRVDFDNXRQKDDFGREGEADGGADSQNVGQHEEGAESEQQCRRRRLRQVVLRRRRAGGGHGGQSMINQSDRRIRHCCVMKCSQFFFFFFFKIHFYSKFGFM

SEQ ID NO: 161909 - protein, 54 aa, Heterodera glycines
  Coding regions on vcDNA: vcDNA=SeqID_88332; Strand=-; Position=35-199
QFFFFFFFFLVSRSFIISLSLARTLITQRNGTIGGLITLLIVRVLSVFALSLFT

SEQ ID NO: 161910 - protein, 98 aa, Heterodera glycines
  Coding regions on vcDNA: vcDNA=SeqID_88333; Strand=-; Position=0-293
QGFFFFFFFFSPILPLFFHKFSILFCSNFHLLEHLRSFGHIANTFEQWPSELSANDFVLQFLYFIVSSGQSNAYKQRANLLVTDLHFLQLCNFFAWRP

SEQ ID NO: 161911 - protein, 67 aa, Heterodera glycines
  Coding regions on vcDNA: vcDNA=SeqID_88334; Strand=+; Position=42-242
MAKMGFHSTKMEADLSKEQQGKREADSMRMLAFFGVCLSTVATMICVVSVPGAYEHFQQVGTKMQGE

SEQ ID NO: 161912 - protein, 56 aa, Heterodera glycines
  misc_feature (40)..(40): Xaa can be any naturally occurring amino acid
  Homolog annotation: Hit_ID=CAB88203.1; Match level="QueryCoverage =69%, HitCoverage=13%, E-value=4e-09, Identity=79%"; Hit description =putative cuticular collagen [Globodera pallida]
  Coding regions on vcDNA: vcDNA=SeqID_88335; Strand=-; Position=3-170
PSFSSLSAKTQETHIVLGIASVCSLLAIIATVVTPPSLYXEITPMPSKVESVLRWR

SEQ ID NO: 161913 - protein, 119 aa, Heterodera glycines
  Homolog annotation: Hit_ID=BAA24679.1; Match level="QueryCoverage =84%, HitCoverage=23%, E-value=5e-25, Identity=59%"; Hit description =otx/orthodenticle related homeoprotein [Halocynthia roretzi]
  Gene Ontology: Mol. function=transcription factor activity; Cellular component=nucleus; Biological process=central nervous system development
  Coding regions on vcDNA: vcDNA=SeqID_88336; Strand=+; Position=32-388
MARRRHGFAFSTDWSNGGAPPRFGCEFLRGKQRRERTTFSRAQLDVLEGVFKNTRDPDIFVREEMATKINLPESRVQVWFKNRRGKARSQKKAQQITHHHQSASSSSGSSVAGSNPSSA

SEQ ID NO: 161914 - protein, 90 aa, Heterodera glycines
  Coding regions on vcDNA: vcDNA=SeqID_88337; Strand=+; Position=2-271
AAKHYSSYIPRALWWCKCLQKFFGLLCFLLLVDCATILFWFFFGHVKKRRRPHKNEIFICGDCWLLVFDFLAPSQLGLEIALVNRRFNCI

SEQ ID NO: 161915 - protein, 131 aa, Heterodera glycines
  Coding regions on vcDNA: vcDNA=SeqID_88338; Strand=+; Position=2-397
AAKEWVLKVDDDIAGHVRRMVEWTEKKFGKMATEHPLIYFGVPADRGLSRDKNSKWYVPYEMFPGEHFPPFLCGGCYLTTPSTIKAVLEQAHKTNSFYLEDVLAVHGHFGRVGQCHRIGPIEPFLWEWIAV

SEQ ID NO: 161916 - protein, 45 aa, Heterodera glycines
  Homolog annotation: Hit_ID=XP_313281.1; Match level="QueryCoverage =80%, HitCoverage=34%, E-value=2e-12, Identity=94%"; Hit description =ENSANGP00000000415 [Anopheles gambiae]
  Gene Ontology: Cellular component=cytosolic ribosome (sensu Eukarya); Biological process=protein biosynthesis
  Coding regions on vcDNA: vcDNA=SeqID_88339; Strand=+; Position=2-136
AARRSPLRPGRRRWGRKQKGFGGQTKPIFRKKAKTTKKIVLRMEC

SEQ ID NO: 161917 - protein, 78 aa, Heterodera glycines
  Coding regions on vcDNA: vcDNA=SeqID_88340; Strand=-; Position=16-252
VVAVFVAVQLVDVGVVQQHLQLVVVLLLLHPLRRRRWHETMDKTLMMIMQIMLDDENGAAIGGQMLDPFLTKKCLLYF

SEQ ID NO: 161918 - protein, 177 aa, Heterodera glycines
  Homolog annotation: Hit_ID=ZP_00263773.1; Match level="QueryCoverage =100%, HitCoverage=15%, E-value=3e-90, Identity=94%"; Hit description= COG1197: Transcription-repair coupling factor (superfamily II helicase) [Pseudomonas fluorescens PfO-1
  Coding regions on vcDNA: vcDNA=SeqID_88341; Strand=+; Position=1-531
GRVGRSHHQAYACLLRPPRQQITSDAEKRLEAIANTQDLGAGFVLATNDLEIRGAGELLGDGQSGRIQAVGFTLYMEMLERAVKAIRKGEQPNLDQPLGGGPEINLRLPALIPEDYLPDVHARLILYKRIASAADEEGLKDLQVEMIDRFGLLPEPTKNLVRLTLLKLQAEQLGIKK

SEQ ID NO: 161919 - protein, 47 aa, Heterodera glycines
  Coding regions on vcDNA: vcDNA=SeqID_88342; Strand=-; Position=2-142
FNFLIGLANGQKNRRQQKMNKQCQMEKLNKSHPRRQRPKMNQQILGG

SEQ ID NO: 161920 - protein, 59 aa, Heterodera glycines
  Coding regions on vcDNA: vcDNA=SeqID_88343; Strand=+; Position=15-191
MFSILHLYKNVVSKMANVDLALDEIIKSRPPPPPPAPQQRNFGGERPFRMSAYQSSRGR

SEQ ID NO: 161921 - protein, 133 aa, Heterodera glycines
  misc_feature (24)..(24): Xaa can be any naturally occurring amino acid
  misc_feature (31)..(31): Xaa can be any naturally occurring amino acid
  misc_feature (49)..(49): Xaa can be any naturally occurring amino acid
  Homolog annotation: Hit_ID=AAT40742.1; Match level="QueryCoverage =100%, HitCoverage=36%, E-value=5e-55, Identity=86%"; Hit description= lactose operon repressor [Phage display vector pTScDisp] gb|AAT40740.1| lactose operon repressor [Phage d
  Coding regions on vcDNA: vcDNA=SeqID_88344; Strand=-; Position=175-576
QPTQMVNEGIVPTAMLVPTDQMAXGAMRAIXESGLRVGADISVVGYHDXEHSSCYIPPLPTIKQDFRLLGQPSVHRLLQLSQAQAVKRNQLLPVSLVKRNPTLAPNTQTASPRALADSLMQLAPQVSRLESGQ

SEQ ID NO: 161922 - protein, 57 aa, Heterodera glycines
  Coding regions on vcDNA: vcDNA=SeqID_88345; Strand=+; Position=2-172
AAKKFETEMDNYAEERVKIFNFEKQKRRERPIRRRAPENLLRRAGGLKKCTDLRCEQ

SEQ ID NO: 161923 - protein, 68 aa, Heterodera glycines
  Coding regions on vcDNA: vcDNA=SeqID_88346; Strand=-; Position=2-205
VHTLSRRRVNIYQAEHVHVRVAFLSLQFIVFSSFDCEIEQNQLNSEETEEEGPRSFYTQKLNWISLGG

SEQ ID NO: 161924 - protein, 70 aa, Heterodera glycines
  Coding regions on vcDNA: vcDNA=SeqID_88347; Strand=+; Position=1-213
GRQDRFTMVDVSRTSDFRHSLNARLSTAPIMSHTLPMVPLLFLCWFTLRNGSVSPVIFPDSVRRSNRTNE

SEQ ID NO: 161925 - protein, 96 aa, Heterodera glycines
  Coding regions on vcDNA: vcDNA=SeqID_88348; Strand=+; Position=62-349
MAPPNPSLHRVHPLSPPAVPPHHGRQQSLLNPQKGHMPTFSAVPNDQKEHPKRRRSLRLMAFASVAFATVSVLASAITLPIVYSHVQSIQAFMQNE

SEQ ID NO: 161926 - protein, 87 aa, Heterodera glycines
  Coding regions on vcDNA: vcDNA=SeqID_88349; Strand=-; Position=1-261
DSQSVFTSAVLFYCFSSSFCWSTAAFFFISMGMVRPPLSAVFIPLMNKRPPSSSHLMLSFWMPSGMSTRREPSRWPDSLSFCSRLAA

SEQ ID NO: 161927 - protein, 37 aa, Heterodera glycines
  Coding regions on vcDNA: vcDNA=SeqID_88350; Strand=-; Position=1-111
HPNKYIRPSQGLIQCTEVRKMPPIRRKDRRNECRLAA

SEQ ID NO: 161928 - protein, 54 aa, Heterodera glycines
  Coding regions on vcDNA: vcDNA=SeqID_88351; Strand=+; Position=18-179
MSHPSHAVPLLFDRDNEAQLNLPTYEKLVNDQQKPSIGQNSRFQYIPNRCALEA

SEQ ID NO: 161929 - protein, 75 aa, Heterodera glycines
  Coding regions on vcDNA: vcDNA=SeqID_88352; Strand=+; Position=2-226
AAKHFRNFFSALRRAMTITISTPYPCFCLLLPIRLQFGRNDCGHRHAGHHPNSDKDENEEDCFTPSLVRSAFENS

SEQ ID NO: 161930 - protein, 70 aa, Heterodera glycines
  Coding regions on vcDNA: vcDNA=SeqID_88353; Strand=-; Position=1-210
VHILSPRRVNIYQAEHVHVRVAFLSLQFIVFSSFDCEIEQNQLHSEETEEEGAVPLHSKIELDFQLILAA

SEQ ID NO: 161931 - protein, 104 aa, Heterodera glycines
  Homolog annotation: Hit_ID=KRXL2B; Match level="QueryCoverage=59%, HitCoverage=20%, E-value=5e-18, Identity=72%"; Hit description =keratin, 64K type II cytoskeletal (clone pUF164) - African clawed frog (fragment) sp|P04265|K2C2_XENLA Keratin
  Gene Ontology: Mol. function=structural constituent of cytoskeleton; Cellular component=intermediate filament; Biological process =epidermal differentiation
  Coding regions on vcDNA: vcDNA=SeqID_88354; Strand=+; Position=25-339
MSSSCTVFVVLLVIAICCCSLTIAMPAAGNEIDSVPLRQKRGYGYGGYGYGGYGYGGGMGGGGFGGGMGGGMGMGGGMGMGGGMGMGSGMGMGMGSGMGMGFGR

SEQ ID NO: 161932 - protein, 113 aa, Heterodera glycines
  misc_feature (17)..(17): Xaa can be any naturally occurring amino acid
  misc_feature (20)..(20): Xaa can be any naturally occurring amino acid
  Homolog annotation: Hit_ID=CAE61217.1; Match level="QueryCoverage =97%, HitCoverage=26%, E-value=4e-36, Identity=67%"; Hit description =Hypothetical protein CBG05011 [Caenorhabditis briggsae]
  Gene Ontology: Cellular component=mitochondrion; Biological process =aspartate catabolism
  Coding regions on vcDNA: vcDNA=SeqID_88355; Strand=+; Position=1-340
GRQGLYGERVGGVAAVXCHXQDEGARVMSQLKILIRPMISNPPIHGARIASKILCDPKLRQQWLGEGKGMGDRIITMRSQLRDLWGKGGSKRNWDHIVNQIGVCCVTGIRPEQ

SEQ ID NO: 161933 - protein, 89 aa, Heterodera glycines
  misc_feature (15)..(15): Xaa can be any naturally occurring amino acid
  Homolog annotation: Hit_ID=CAE64381.1; Match level="QueryCoverage =89%, HitCoverage=19%, E-value=2e-15, Identity=50%"; Hit description =Hypothetical protein CBG09068 [Caenorhabditis briggsae]
  Gene Ontology: Mol. function=aminopeptidase activity; Cellular component=cytoplasm; Biological process=peptide metabolism
  Coding regions on vcDNA: vcDNA=SeqID_88356; Strand=+; Position=1-268
GRQGKTDQILDMDMXLYDTQPANLSGLNEEFISGARLDNLVSTYTAIKGVVESLEDTDAFDADPNVGSRSAQGAQSHCFEWLLRRVLST

SEQ ID NO: 161934 - protein, 71 aa, Heterodera glycines
  Coding regions on vcDNA: vcDNA=SeqID_88357; Strand=-; Position=2-214
VHILSPARVNISQAEHVHVRVAFLSLQFIVFSSFDCEIEQNQLHSEETEEEGAVHLHSNIELDFQLIFLGG

SEQ ID NO: 161935 - protein, 63 aa, Heterodera glycines
  Homolog annotation: Hit_ID=CAE66891.1; Match level="QueryCoverage =98%, HitCoverage=10%, E-value=9e-12, Identity=54%"; Hit description =Hypothetical protein CBG12272 [Caenorhabditis briggsae]
  Coding regions on vcDNA: vcDNA=SeqID_88358; Strand=+; Position=53-241
TDNERARYHAAVLQLKRGTGSYEYNRIAYLHFDLRAMPGAHSGPTFLPWGREYLKRYEIGLRA

SEQ ID NO: 161936 - protein, 70 aa, Heterodera glycines
  Coding regions on vcDNA: vcDNA=SeqID_88359; Strand=-; Position=0-209
QITYAHTHLFWHTKRTKSSHTRCFGITPFGSPLNVLSAKNQRPKLTSSVGRESTRSRSSLKKWALSTWRP

SEQ ID NO: 161937 - protein, 158 aa, Heterodera glycines
  misc_feature (103)..(103): Xaa can be any naturally occurring amino acid
  misc_feature (117)..(117): Xaa can be any naturally occurring amino acid
  Homolog annotation: Hit_ID=ZP_00127830.1; Match level="QueryCoverage =99%, HitCoverage=50%, E-value=5e-67, Identity=79%"; Hit description =COG0510: Predicted choline kinase involved in LPS biosynthesis [Pseudomonas syringae pv. syringae B728a
  Coding regions on vcDNA: vcDNA=SeqID_88360; Strand=+; Position=109-581
MKALGEACTPQECQLEAAVRGVASWGGTGVRYEPVSGGISNTNWRVEVAGIDTAYFFKVPGVGTEMFIDRRTAHDASLKAAQTGYGAPVFAFLEEFGVEVFEXMEGWRASSNHDFLXRDVRHNALHALKAFNDQPPLVQTKTVFDMIAEHQRQVEQLN

SEQ ID NO: 161938 - protein, 118 aa, Heterodera glycines
  Coding regions on vcDNA: vcDNA=SeqID_88361; Strand=+; Position=64-417
FPSFAPNRSVVVHKSRLRSSAALCAPSPPPQCLSILSLCALFSAAVPMSAAASAGQTHRWGGMAAPHRSRPPLRFDRTFLEERDNQVKLIQMLCGLVALLLTVQCWPNPLFPFCVGRV

SEQ ID NO: 161939 - protein, 53 aa, Heterodera glycines
  Coding regions on vcDNA: vcDNA=SeqID_88362; Strand=+; Position=3-164
AAIHLPFRPPAGTRRWSIFRGENQLRPALHPMGPIISTLAESEEQSPNSMEKK

SEQ ID NO: 161940 - protein, 90 aa, Heterodera glycines
  Coding regions on vcDNA: vcDNA=SeqID_88363; Strand=-; Position=0-269
SAQTNQCASVGAEAPAQRKRKKHTHRTRAQLEAQLVVVPLRLMVTGGSQRRRSPKTTRRRRASMGETRRGMGIHRPLAAKKHAPIVAWRP

SEQ ID NO: 161941 - protein, 87 aa, Heterodera glycines
  misc_feature (36)..(36): Xaa can be any naturally occurring amino acid
  misc_feature (55)..(55): Xaa can be any naturally occurring amino acid
  misc_feature (68)..(69): Xaa can be any naturally occurring amino acid
  Coding regions on vcDNA: vcDNA=SeqID_88364; Strand=+; Position=3-263
PPRRISINFFTRCGVESVNFINHLPEKLYFLESDGXVFHNLNDIDDGELIQLRFXACGGKGGGGVGLXXFRIHKSSNQLMCGNLQGG

SEQ ID NO: 161942 - protein, 89 aa, Heterodera glycines
  Homolog annotation: Hit_ID=NP_509563.1; Match level="QueryCoverage =100%, HitCoverage=19%, E-value=1e-27, Identity=65%"; Hit description= putative N-myristoylated protein, with at least 7 transmembrane domains, of fungal and metazoan origin (
  Coding regions on vcDNA: vcDNA=SeqID_88365; Strand=+; Position=2-268
AALLITGGVVGATGASIFVDRTKFYEETMKVSMGLAVVFGLAFLQFVLHVGMKPWLLVTCFIFGVCGLAAYPVGLQLSAECTFPVSETT

SEQ ID NO: 161943 - protein, 46 aa, Heterodera glycines
  Coding regions on vcDNA: vcDNA=SeqID_88366; Strand=-; Position=1-138
RKPNSSRNKRHRPSNSRLRKSSNRKTQMRSHLLCPMLTLRWRSLAA

SEQ ID NO: 161944 - protein, 175 aa, Heterodera glycines
  Homolog annotation: Hit_ID=CAB62547.1; Match level="QueryCoverage =100%, HitCoverage=54%, E-value=5e-85, Identity=95%"; Hit description= LacIq protein [Shuttle vector pXMJ19]
  Coding regions on vcDNA: vcDNA=SeqID_88367; Strand=-; Position=3-527
RPEESQFRVVNVKPVTLYDVAEYAGVSYQTVSRVVTQASHVSAKTREKVEAAMAELNYIPNRVAQQLAGTQSLLIGVATSSLALHAPSQIVAAIKSRADQLGASVVVSMVARSGVEACKAAVHNLLAQRVSGLIINYPLDDQDAIAVEAACTNVPALFLIASAHTPINSIIFSHK

SEQ ID NO: 161945 - protein, 92 aa, Heterodera glycines
  misc_feature (15)..(15): Xaa can be any naturally occurring amino acid
  Homolog annotation: Hit_ID=CAE64674.1; Match level="QueryCoverage =98%, HitCoverage=17%, E-value=1e-23, Identity=56%"; Hit description =Hypothetical protein CBG09450 [Caenorhabditis briggsae]
  Coding regions on vcDNA: vcDNA=SeqID_88368; Strand=+; Position=2-276
ARDIGDGDPERMCPXGVAEYVKKTFENSSVRVSIIDDVDQIRRDYPLMSAVSRCANAIEEHKARVIWLEYDGGEETETLFLVGKGVTLDTGG

SEQ ID NO: 161946 - protein, 68 aa, Heterodera glycines
  Homolog annotation: Hit_ID=CAB88203.1; Match level="QueryCoverage =100%, HitCoverage=68%, E-value=2e-30, Identity=75%"; Hit description= putative cuticular collagen [Globodera pallida]
  Gene Ontology: Mol. function=structural constituent of cuticle; Cellular component=extracellular; Biological process=reproduction
  Coding regions on vcDNA: vcDNA=SeqID_88369; Strand=+; Position=3-209
PPRPGQPGGQGPPGPPGAPGQPGQPGNSGQPGQPGAPGQPGKDSGYCACPPRSSVLAVKKKMAGAKKA

SEQ ID NO: 161947 - protein, 141 aa, Heterodera glycines
  Homolog annotation: Hit_ID=NP_496450.1; Match level="QueryCoverage =97%, HitCoverage=39%, E-value=3e-20, Identity=36%"; Hit description =kinase serine threonine 22 (2L766) [Caenorhabditis elegans] emb|CAA91402.1| Hypothetical protein W02B12.1
  Coding regions on vcDNA: vcDNA=SeqID_88370; Strand=+; Position=40-462
MQGHHHHHHNSHHQRHKRSYSSARHVLINFGFQFPHDFKLGSGRYSKVYKGFYREANRYFAIKITDLEAVSDRFKHKFVPRELKVWRELSHPNHVRLYKDFMKNDFLFEIIDLAVGGDMLNYLRNHGPVKEAVCSGWMLQL

SEQ ID NO: 161948 - protein, 114 aa, Heterodera glycines
  Homolog annotation: Hit_ID=CAE73431.1; Match level="QueryCoverage =43%, HitCoverage=16%, E-value=3e-12, Identity=60%"; Hit description =Hypothetical protein CBG20874 [Caenorhabditis briggsae]
  Gene Ontology: Mol. function=protein serine/threonine phosphatase activity; Cellular component=cytoplasm; Biological process=protein amino acid dephosphorylation
  Coding regions on vcDNA: vcDNA=SeqID_88371; Strand=+; Position=84-425
TRNTASLLRLLLHRAGPKQTSDQWTSNRTALWTRSSRNFRARLSSSSLPKSVLRTFTSFAISPCSVLQQQSMLIRLQPPVVLCGDIHGQFRDLLRIFTTMGFPPDKKHLFLGDY

SEQ ID NO: 161949 - protein, 36 aa, Heterodera glycines
  Coding regions on vcDNA: vcDNA=SeqID_88372; Strand=-; Position=0-107
QLHRERVRGELIVCERVLVDPPAASVQNNAKNSWRP

SEQ ID NO: 161950 - protein, 134 aa, Heterodera glycines
  misc_feature (16)..(16): Xaa can be any naturally occurring amino acid
  misc_feature (114)..(114): Xaa can be any naturally occurring amino acid
  misc_feature (131)..(131): Xaa can be any naturally occurring amino acid
  Homolog annotation: Hit_ID=JQ1541; Match level="QueryCoverage=92%, HitCoverage=83%, E-value=4e-65, Identity=93%"; Hit description =hypothetical 16.9K protein - Salmonella typhimurium plasmid NTP16
  Coding regions on vcDNA: vcDNA=SeqID_88373; Strand=+; Position=2-405
AALLAFFLGSAPLTGXTKIDAQVRGGETRQDYKDTRRFPLEAPSCALLFRPCRLPDTCPPFSLREAWRFLIAHAVGVSVRCRWFAPSWAVCTNPPFSPTAAPYPVTIVLSPTRXDTTYRHWQQPLVTGLAXRGV

SEQ ID NO: 161951 - protein, 89 aa, Heterodera glycines; identical to SEQ ID NO: 161942
  Homolog annotation: Hit_ID=NP_509563.1; Match level="QueryCoverage =100%, HitCoverage=19%, E-value=1e-27, Identity=65%"; Hit description= putative N-myristoylated protein, with at least 7 transmembrane domains, of fungal and metazoan origin (
  Coding regions on vcDNA: vcDNA=SeqID_88374; Strand=+; Position=2-268

SEQ ID NO: 161952 - protein, 54 aa, Heterodera glycines
  Coding regions on vcDNA: vcDNA=SeqID_88375; Strand=+; Position=3-167
TKCGNKKKNFINPVIRERYLHSYQFCLYILPLELTILIAITASFDKFFSSHHFT

SEQ ID NO: 161953 - protein, 115 aa, Heterodera glycines
  Homolog annotation: Hit_ID=CAE73796.1; Match level="QueryCoverage =98%, HitCoverage=10%, E-value=1e-39, Identity=68%"; Hit description =Hypothetical protein CBG21346 [Caenorhabditis briggsae]
  Gene Ontology: Mol. function=glutamine-tRNA ligase activity; Cellular component=mitochondrion; Biological process=protein complex assembly
  Coding regions on vcDNA: vcDNA=SeqID_88376; Strand=+; Position=1-345
GRQEQTRDEGKFVEWDGAEMGKVVVRFPPEASGYLHIGHAKAALLNQFYRHQFEGGLILRFDDTNPAKEDAHFEKVIEEDLRLLQVEWDKMSRTSDHFDALLDFCQQLLVAGKAY

SEQ ID NO: 161954 - protein, 54 aa, Heterodera glycines
  Coding regions on vcDNA: vcDNA=SeqID_88377; Strand=+; Position=3-167
IKLGTELGSLVTAASVLEFALRGSYTFFDLLKYKMAYLELVMALIKTLTNDPFI

SEQ ID NO: 161955 - protein, 94 aa, Heterodera glycines
  misc_feature (80)..(80): Xaa can be any naturally occurring amino acid
  Homolog annotation: Hit_ID=NP_741296.1; Match level="QueryCoverage =85%, HitCoverage=21%, E-value=2e-16, Identity=53%"; Hit description =growth hormone inducible transmembrane protein (36.1 kD) (4B411) [Caenorhabditis elegans] gb|AAC24402.1|
  Coding regions on vcDNA: vcDNA=SeqID_88378; Strand=+; Position=36-317
WHDVGLQPNNLPSIRYLTTSAFSKARYGFRPSGGAGQYAFRFKEAFAARQVAPTLRERLLGPTTGKPFIVGTYALAGASXFGIGMLCYYGLTTT

SEQ ID NO: 161956 - protein, 103 aa, Heterodera glycines
  Homolog annotation: Hit_ID=CAH85743.1; Match level="QueryCoverage =97%, HitCoverage=100%, E-value=7e-52, Identity=96%"; Hit description= hypothetical protein PC403819.00.0 [Plasmodium chabaudi]
  Coding regions on vcDNA: vcDNA=SeqID_88379; Strand=+; Position=375-683
YGYPQNQGITQERTCEQKASKRPGTVKRRRCWRFSIGSAPLTSITKIDAQVRGGETRQEYKDTRRFPLEAPSCALLFRPCRLPDTCAPFSLREAWGFLIAHAV

SEQ ID NO: 161957 - protein, 82 aa, Heterodera glycines
  Coding regions on vcDNA: vcDNA=SeqID_88380; Strand=+; Position=126-371
MGKGRTTGNSGGGKGGSGGGGDEKSGGSGAGKGTVAAGSGGVRGKGAGQSGPAAAAAGTDKTRAAKAAAAARGAPAEESVKS

SEQ ID NO: 161958 - protein, 146 aa, Heterodera glycines
  misc_feature (126)..(126): Xaa can be any naturally occurring amino acid
  misc_feature (143)..(143): Xaa can be any naturally occurring amino acid
  Homolog annotation: Hit_ID=JQ1541; Match level="QueryCoverage=84%, HitCoverage=83%, E-value=2e-65, Identity=94%"; Hit description =hypothetical 16.9K protein - Salmonella typhimurium plasmid NTP16
  Coding regions on vcDNA: vcDNA=SeqID_88381; Strand=+; Position=54-494
AKGRQKAGNRKKAALLAFFLGSAPLTSITKIDAQVRGGETRQDYKDTRRVPLEAPSCALLFRPCRLPDTCPPFSLREAWRFLIAHAVGVSVRCRSFAPSWAVCTNPPFSPTAAPYPVTIVLSPTRXDTTYRHWQQPLGTGLAXRGV

SEQ ID NO: 161959 - protein, 75 aa, Heterodera glycines
  Coding regions on vcDNA: vcDNA=SeqID_88382; Strand=+; Position=3-230
PPRQKSPIIADNLGSFSDLDGKKNIEEILAAKREAIKRATAVLEMEVPAEEEEDNAKLIRWPQRWRWTKFEREAF

SEQ ID NO: 161960 - protein, 143 aa, Heterodera glycines
  misc_feature (127)..(127): Xaa can be any naturally occurring amino acid
  misc_feature (133)..(133): Xaa can be any naturally occurring amino acid
  misc_feature (141)..(141): Xaa can be any naturally occurring amino acid
  Homolog annotation: Hit_ID=AAA80639.1; Match level="QueryCoverage =99%, HitCoverage=67%, E-value=2e-38, Identity=52%"; Hit description =Mn superoxide dismutase pir||T08047 superoxide dismutase (EC 1.15.1.1) (Mn) - Chlamydomonas reinhardtii sp
  Coding regions on vcDNA: vcDNA=SeqID_88383; Strand=+; Position=66-494
MTFELPKLSYNYDALEPFVDTTTMNIHHTKHHQAYINNINNYIGGDKGAALKGKSILEVVQSATEAPVRNNGGGHYNHTLFWTFMTKPGSTNTAPHGALKERIEKEFGSLDAMKEKFNAAASTRFGXGWAWLXVKADGTLXIT

SEQ ID NO: 161961 - protein, 57 aa, Heterodera glycines
  Coding regions on vcDNA: vcDNA=SeqID_88384; Strand=+; Position=3-173
PPSRAHIRILTGMRAGSRLQSVGHRRRMEKERRSVWLLISIVLLFFLCDTGGVIIRF

SEQ ID NO: 161962 - protein, 80 aa, Heterodera glycines
  misc_feature (21)..(21): Xaa can be any naturally occurring amino acid
  Coding regions on vcDNA: vcDNA=SeqID_88385; Strand=+; Position=1-243
GRLLGAVLFLTFVAPGVILLXLLHARLSFLSSMRTFICPLRKEDVYGLLANTRDLSHWLQRFFLQLRRHNINLFTRCSGV

SEQ ID NO: 161963 - protein, 128 aa, Heterodera glycines
  misc_feature (49)..(49): Xaa can be any naturally occurring amino acid
  Homolog annotation: Hit_ID=NP_504835.1; Match level="QueryCoverage =96%, HitCoverage=47%, E-value=2e-19, Identity=44%"; Hit description =dauer or Aging adult Overexpression DAO-1, FK506 Binding protein family (29.1 kD) (fkb-3) [Caenorhabditis
  Coding regions on vcDNA: vcDNA=SeqID_88386; Strand=+; Position=84-470
IHRWEENNGVRTTRTEWKRKSLTKIPVSKCKLKIEAGEELDQFFKLTDXEGKLIRSNFRQNPYKFVLGHGHAIPPMDNAMLRMCVGEQRPVTIPAETFAENQRARGWARTKPCITLWSLKSIFHALPR

SEQ ID NO: 161964 - protein, 86 aa, Heterodera glycines
  Coding regions on vcDNA: vcDNA=SeqID_88387; Strand=+; Position=71-328
FRRLKHADNLNLNWVHYNGRFLKRLGRKRRTERSKIGKVWCFLFRCTHPATTDHHHNHRHFNNFRSSLLAATPAKGQQQKQNQQHN

SEQ ID NO: 161965 - protein, 43 aa, Heterodera glycines
  Homolog annotation: Hit_ID=NP_496361.1; Match level="QueryCoverage =90%, HitCoverage=12%, E-value=3e-11, Identity=71%"; Hit description =COLlagen structural gene (30.9 kD) (col-81) [Caenorhabditis elegans] emb|CAA90187.1| Hypothetical protein
  Gene Ontology: Mol. function=structural constituent of cuticle; Cellular component=extracellular; Biological process=cuticle biosynthesis (sensu Nematoda)
  Coding regions on vcDNA: vcDNA=SeqID_88388; Strand=+; Position=1-132
GRQGGSPGQPGDPGGDGEQGQPGAQGSSGQCYHCPPPRTAPGY

SEQ ID NO: 161966 - protein, 35 aa, Heterodera glycines
  Coding regions on vcDNA: vcDNA=SeqID_88389; Strand=-; Position=2-106
IDISGIYRPPEFFGNGTVIGPQVFNARFTLQVLGG

SEQ ID NO: 161967 - protein, 64 aa, Heterodera glycines
  Coding regions on vcDNA: vcDNA=SeqID_88390; Strand=+; Position=29-220
VLKCLGCFGIKPQPSSIPAPPDDPNRNPPTPADEKQQKIGAQSAYTFDSTALERAAQAAKTLEK

SEQ ID NO: 161968 - protein, 154 aa, Heterodera glycines
  misc_feature (129)..(129): Xaa can be any naturally occurring amino acid
  misc_feature (141)..(141): Xaa can be any naturally occurring amino acid
  Coding regions on vcDNA: vcDNA=SeqID_88391; Strand=+; Position=1-462
GRQNCEKCRVKRADLMSKTRPLSKADKLRGRQNRLLAQSHPDFLEERRSKRKQYLDEGFEPTFFDDAAEEGEAQNGAALTNGATGAGKKASSRRKRGTAEEQADALFRNIQGDQLDNLTTDDEEEEGAXMADEEEEGRCSXGGGGRRGLGQDAE

SEQ ID NO: 161969 - protein, 157 aa, Heterodera glycines
  misc_feature (71)..(71): Xaa can be any naturally occurring amino acid
  Homolog annotation: Hit_ID=AAC47437.1; Match level="QueryCoverage =90%, HitCoverage=88%, E-value=1e-54, Identity=61%"; Hit description =COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_88392; Strand=+; Position=2-472
AAKLKLIQNGLRRAGRAYRFVGYSTVCFSIISLLSGCFTLPMLKSYVSNVGLKMDSELSSCQSNAKDIWSXVSQLKGLPLIVSGNRTARQVCGGSGGYGSCQDCGSGGGPGPAGPPGQPGRPGNPGAPGSPGQPGHSVQTPCEQVRPPPCTPCPGGE

SEQ ID NO: 161970 - protein, 48 aa, Heterodera glycines
  Coding regions on vcDNA: vcDNA=SeqID_88393; Strand=+; Position=2-145
TKFCQIKNTLRIVRSAFWKCQNDRENGERRKDSSLVDHQWGCFSNSRW

SEQ ID NO: 161971 - protein, 96 aa, Heterodera glycines
  misc_feature (27)..(27): Xaa can be any naturally occurring amino acid
  Homolog annotation: Hit_ID=NP_741756.1; Match level="QueryCoverage =86%, HitCoverage=24%, E-value=1e-12, Identity=45%"; Hit description =endophilin B2 (40.8 kD) (XE420) [Caenorhabditis elegans] gb|AAB52640.1| Endophilin-related protein protei
  Coding regions on vcDNA: vcDNA=SeqID_88394; Strand=+; Position=95-383
MDALKRLASRARQKSAEIILSAEKTEXGAELEQLRTKTDKTEEHMKKLVHAIEVYLQPNPAVRALDPRKDKSGRQNTLDGLGEAMKEAASKAVGAE

SEQ ID NO: 161972 - protein, 57 aa, Heterodera glycines
  Coding regions on vcDNA: vcDNA=SeqID_88395; Strand=-; Position=27-200
HIRLGGPLSLLNSFDFFIGLANGQKNRRQQKLNKQCQMEKLNESHLAEKGPPSINKY

SEQ ID NO: 161973 - protein, 59 aa, Heterodera glycines
  Coding regions on vcDNA: vcDNA=SeqID_88396; Strand=-; Position=2-178
PSFFFSFPLLFLSFVITLLLIFTSTNSAAPSDTLRLKRGYGGYNPGGNGGGWGGNGGGG

SEQ ID NO: 161974 - protein, 54 aa, Heterodera glycines
  Coding regions on vcDNA: vcDNA=SeqID_88397; Strand=+; Position=1-162
GRAPEKWLFYIIVEERNHANLMEKLEDYAKIEKFIMDHYNSGNEILNEAEIPQN

SEQ ID NO: 161975 - protein, 88 aa, Heterodera glycines
  Coding regions on vcDNA: vcDNA=SeqID_88398; Strand=+; Position=2-268
AAKYALIKWCFRVCIYSLSVSPFLSLSPLRFLVILLVAVLRRPFVLKWVNRPQQKWTPHAFDGFRRRAVHIVQQRVVQVQFAQRKLHI

SEQ ID NO: 161976 - protein, 69 aa, Heterodera glycines
  Coding regions on vcDNA: vcDNA=SeqID_88399; Strand=-; Position=0-206
QVFFFFFFFFSVPVCLLKSRRKVRPLSLRNSPFGCLQCGQRTFISFRHIVLQKARFAFHFLQLVSAWRP

SEQ ID NO: 161977 - protein, 67 aa, Heterodera glycines
  Coding regions on vcDNA: vcDNA=SeqID_88400; Strand=+; Position=3-206
PPSTRALGEIWKRNEGIGMRLMIAEALTMRRKRELMLNARQKFMMMTKFLLYLTSPINFYIGNRFTN

SEQ ID NO: 161978 - protein, 106 aa, Heterodera glycines
  Coding regions on vcDNA: vcDNA=SeqID_88401; Strand=+; Position=3-320
PPSFYCARQIDTSREVFGYQQTQFNYGAYASANGQQQSFINYAQQQNNSATAPVAGNATTNAYAASQYSLAASAYAQYSQAATQQQSVAATYGVQPPPPPPDYSAS

SEQ ID NO: 161979 - protein, 141 aa, Heterodera glycines
  Homolog annotation: Hit_ID=CAE63744.1; Match level="QueryCoverage =80%, HitCoverage=99%, E-value=2e-25, Identity=52%"; Hit description =Hypothetical protein CBG08274 [Caenorhabditis briggsae]
  Coding regions on vcDNA: vcDNA=SeqID_88402; Strand=+; Position=48-473
MQEKAFSVRSQEGVLQQQGTAQNGNKEEEAKRQAEQQEMAKNSILTQIIDEEGMSRLSNLRAAKPEKARAVEGMLIEMARSGRIRGRMSDSELRTLLDRVSAAGGTKSTKVKYDRRRAAIDSDEELDKMDEKGASSTDDDD

SEQ ID NO: 161980 - protein, 114 aa, Heterodera glycines
  Coding regions on vcDNA: vcDNA=SeqID_88403; Strand=-; Position=0-341
KRRGRARPRRSRRGYRRPENPHTPIEYGGTLRNIELPTTFETFDVLPPELPNETLQPLGEIPTFGMLDLNIFLPPRPTERPPAATNGTAGANVRRQRHRRRRTSTTIRHLRMRP

SEQ ID NO: 161981 - protein, 64 aa, Heterodera glycines
  Coding regions on vcDNA: vcDNA=SeqID_88404; Strand=+; Position=50-241
MGFHSTKMEADLSKEQQGKREADSMRMLAFFGVCLSTVATMICVVSVPGAYEHFQQVGAKMQGE

SEQ ID NO: 161982 - protein, 157 aa, Heterodera glycines
  Homolog annotation: Hit_ID=AAC47437.1; Match level="QueryCoverage =90%, HitCoverage=77%, E-value=4e-59, Identity=63%"; Hit description =COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_88405; Strand=+; Position=1-471
GRQLNLFKWTSTGAGEAYRFVAYSTVSFSIISLLSVCFTLPMLKSYVSNVGLKMDSELSSCQSNAKDIWSEVSQLKGLPLIVSGNRTARQVYGGSGGYGSCQDCCSGGGPGPAGPPGQPGRPGNPGAPGSPGQPGHSVQTPCEQVHPPPCTPCPGGQ

SEQ ID NO: 161983 - protein, 125 aa, Heterodera glycines
  Homolog annotation: Hit_ID=XP_320182.1; Match level="QueryCoverage =100%, HitCoverage=58%, E-value=9e-52, Identity=76%"; Hit description= ENSANGP00000011602 [Anopheles gambiae]
  Gene Ontology: Mol. function=neurotransmitter:sodium symporter activity; Cellular component=integral to plasma membrane; Biological process=neurotransmitter transport
  Coding regions on vcDNA: vcDNA=SeqID_88406; Strand=+; Position=3-377
PPSLPKVFYVVFETSMGAMSIELYWQHAPRTCMNFQELARKGYYNNTIFHRIIADFMVQGGDPTRTGRGGTSIYGSRFADEISDDLRHTGAGIISMANSGPNTNGSQFFITLGPTQHLDGKHTIF

SEQ ID NO: 161984 - protein, 165 aa, Heterodera glycines
  Homolog annotation: Hit_ID=AAT40742.1; Match level="QueryCoverage =99%, HitCoverage=45%, E-value=8e-87, Identity=99%"; Hit description =lactose operon repressor [Phage display vector pTScDisp] gb|AAT40740.1| lactose operon repressor [Phage di
  Coding regions on vcDNA: vcDNA=SeqID_88407; Strand=-; Position=3-497
EDGTRLGVEHLVALGHQQIALLAGPLSSVSARLRLAGWHKYLTRNQIQPIAEREGDWSAMSGFQQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKEKP

SEQ ID NO: 161985 - protein, 35 aa, Heterodera glycines
  Coding regions on vcDNA: vcDNA=SeqID_88408; Strand=-; Position=192-299
CFCDCCSCCCCCCSFCCCIVATARRFNTNFSRAFS

SEQ ID NO: 161986 - protein, 90 aa, Heterodera glycines
  misc_feature (20)..(20): Xaa can be any naturally occurring amino acid
  Coding regions on vcDNA: vcDNA=SeqID_88409; Strand=+; Position=2-271
AAKHYSSYIPRSLCCCKCLXKFFGLLFFLLLVDCATILFWFFFGHVKKRRRPHKNEIFICGDCWLLVFDFLAPSQLGLEIALVNRRFNCI

SEQ ID NO: 161987 - protein, 114 aa, Heterodera glycines
  Coding regions on vcDNA: vcDNA=SeqID_88410; Strand=-; Position=1-342
KRRGRARPRRSRRGHRRPENPHTPIEYGGTVRNIELPSTFETLDVLPPPPPNETLQPLGEIPTFGMLDLNIFLPRRPTERPPAATNGTAGAKVTTTTTPATTNVNNNTAPENAA

SEQ ID NO: 161988 - protein, 85 aa, Heterodera glycines
  Coding regions on vcDNA: vcDNA=SeqID_88411; Strand=+; Position=24-278
HEQTADEKMEKPNSSANVSFSNVTDKFRAHPVEKVGSPITINQSISDPTTELTEEDIFRMKSMSIEQNGWKNGPCASELQSAVSQ

SEQ ID NO: 161989 - protein, 116 aa, Heterodera glycines
  Coding regions on vcDNA: vcDNA=SeqID_88412; Strand=+; Position=69-416
IKWLGRKLSHLLSEVLVLAALGLFVTLRLTGFDANFTFLSNGSLVAAVGFCGILFNSDKLAGSELFPTGVRNLSCSFGQICSRIGVVGAPMLFFLDVCDHRYCSVFPHFTMIALAL

SEQ ID NO: 161990 - protein, 85 aa, Heterodera glycines
  Coding regions on vcDNA: vcDNA=SeqID_88413; Strand=-; Position=0-254
TWIDFSTLHSFPILNNRFFFSSFFCQRVGIIIAHTGNNAILLVHEHICCSAQRCVCCVRFLRRRFRLWRPRLLLWRLLLYCCLRP

SEQ ID NO: 161991 - protein, 135 aa, Heterodera glycines
  Homolog annotation: Hit_ID=NP_501278.1; Match level="QueryCoverage =85%, HitCoverage=60%, E-value=2e-14, Identity=32%"; Hit description =putative protein, with a coiled coil-4 domain (4I530) [Caenorhabditis elegans] gb|AAB03148.1| Hypothetica
  Coding regions on vcDNA: vcDNA=SeqID_88414; Strand=+; Position=133-537
MNWFEPRVLRSARPFVPSGGERRDEVGKTGDDQAVVQMMCDLVLGEIQAEISRVEKEMERRRQDERRLTNQPDYSWLMDWRLRAKRPLSFRESSEVELLCSKVRAEEWRRLLKEWHIKVRFAESRDEVLDTFRAL

SEQ ID NO: 161992 - protein, 49 aa, Heterodera glycines
  Coding regions on vcDNA: vcDNA=SeqID_88415; Strand=-; Position=0-146
MGENDERKSEGLMVRRSKGRASVSPRPASLASQKATRLALSTQRFSWRP

SEQ ID NO: 161993 - protein, 48 aa, Heterodera glycines
  Coding regions on vcDNA: vcDNA=SeqID_88416; Strand=-; Position=2-145
MIPGRRMLEHVRSGSGAPCTESAASEAATAMYEMLDSMILEELAYSGG

SEQ ID NO: 161994 - protein, 34 aa, Heterodera glycines
  Coding regions on vcDNA: vcDNA=SeqID_88417; Strand=-; Position=139-243
KFFFFFFFFFFFFFFFNSFHVSLMTKKQATTTEK

SEQ ID NO: 161995 - protein, 82 aa, Heterodera glycines
  Homolog annotation: Hit_ID=AAK58435.1; Match level="QueryCoverage =89%, HitCoverage=32%, E-value=6e-10, Identity=53%"; Hit description =glycoprotein gp2 [Equine herpesvirus 4]
  Coding regions on vcDNA: vcDNA=SeqID_88418; Strand=+; Position=3-251
PPSADGATVTNANEPVATTTTTAATTNTEATAPTTTTTTADGAAATNTDATGAATTPTTNAATNTEAPAATTPATTADVALD

SEQ ID NO: 161996 - protein, 37 aa, Heterodera glycines
  Coding regions on vcDNA: vcDNA=SeqID_88419; Strand=-; Position=1-111
GRNGERHETRHGQRQQSGRKEHLETLCNLNERKQLPP

SEQ ID NO: 161997 - protein, 110 aa, Heterodera glycines
  misc_feature (97)..(97): Xaa can be any naturally occurring amino acid
  Homolog annotation: Hit_ID=CAB88203.1; Match level="QueryCoverage =88%, HitCoverage=80%, E-value=1e-32, Identity=66%"; Hit description =putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88420; Strand=+; Position=3-332
PPRVDHPIHPFGSEGFRVNTDSAWTELMEVQISVTPPTRPRENPFNSIFLRQKRQGLPPQCVCQLRQPSCAPGPPGPPGPPGTPGEPGGAGQPGSPXQPGQQAPPCPPPV

SEQ ID NO: 161998 - protein, 58 aa, Heterodera glycines
  Coding regions on vcDNA: vcDNA=SeqID_88421; Strand=+; Position=1-177
GRKASIAEQIERICRWGEFDELTALCEGLAIVQTFDEAQKLLVECAIKKDFADGKAGF

SEQ ID NO: 161999 - protein, 57 aa, Heterodera glycines
  Coding regions on vcDNA: vcDNA=SeqID_88422; Strand=+; Position=26-196
YLLIYFWAFSAKCDSFSFSIWHCLFSFCWRLFFWPLAKPMKKSNEFKRERGPPRRIW

SEQ ID NO: 162000 - protein, 131 aa, Heterodera glycines
  misc_feature (18)..(18): Xaa can be any naturally occurring amino acid
  Coding regions on vcDNA: vcDNA=SeqID_88423; Strand=+; Position=2-397
AAKEWVLKVDDDIAGHVXRMVEWTEKKFGKMASEHPLIYFGVPGDRGLSRDKNSKWCVPYEMCPGEHFPPCLCGGGYLTTPSTIKAVLEQAHKTNSFYLEDVLAVHGHFGRVGQCDRIGPIEPFLWEWIAV

SEQ ID NO: 162001 - protein, 62 aa, Heterodera glycines
  Coding regions on vcDNA: vcDNA=SeqID_88424; Strand=-; Position=2-187
ANLKMKFTLLSILFLALVHIGISGKYDKSDEHDGKYGARPPASGGYHHDNNNYGGGNHYGGG

SEQ ID NO: 162002 - protein, 36 aa, Heterodera glycines
  Coding regions on vcDNA: vcDNA=SeqID_88425; Strand=-; Position=0-107
QVFFFFFFFFFCASSSYVRPHCPSRCDVSCDSSLRP

SEQ ID NO: 162003 - protein, 51 aa, Heterodera glycines
  Coding regions on vcDNA: vcDNA=SeqID_88426; Strand=-; Position=0-152
RSATARARRLLLQRLFLLARRLRTSSSTTGGRATTPRPSLLRRATRTTWRP

SEQ ID NO: 162004 - protein, 78 aa, Heterodera glycines
  Coding regions on vcDNA: vcDNA=SeqID_88427; Strand=+; Position=2-235
AAKVGGANYFLILFKMVRGLINKSRDEQIEQQNARIAEQQQVIRECKTLFRHVSAHSNTISSALLMFTEDHPEFAANC

SEQ ID NO: 162005 - protein, 118 aa, Heterodera glycines
  Coding regions on vcDNA: vcDNA=SeqID_88428; Strand=+; Position=75-431
METKRNNYNNIDSLWSTLCDLGYQTSQGLAYSVGMPNFSFGAFILLSVMTWCCFFMPPVAVFFRGYLRDGNACTEHVIYNIILCFFLWVPGMGHAFWYCFSDMFSGPKKEGAGYSKNA

SEQ ID NO: 162006 - protein, 61 aa, Heterodera glycines
  Coding regions on vcDNA: vcDNA=SeqID_88429; Strand=-; Position=2-184
RPFAEGLSIEEIFFNCTFHQQFLCLVKCLDDGQPLTECRLFVEFTPQTKSFNCLSILMLCG

SEQ ID NO: 162007 - protein, 55 aa, Heterodera glycines
  Coding regions on vcDNA: vcDNA=SeqID_88430; Strand=-; Position=1-165
MGNTRSGSSSSAMTNCPQTIGGSAGKFTSKFDVFPYATAEVLLLLCSEVLSCCAA

SEQ ID NO: 162008 - protein, 72 aa, Heterodera glycines
  misc_feature (53)..(53): Xaa can be any naturally occurring amino acid
  Homolog annotation: Hit_ID=XP_320779.1; Match level="QueryCoverage =91%, HitCoverage=28%, E-value=4e-23, Identity=83%"; Hit description =ENSANGP00000014175 [Anopheles gambiae] gb|EAA00052.1| ENSANGP00000014175 [Anopheles gambiae str. PEST]
  Gene Ontology: Mol. function=ARF small monomeric GTPase activity; Cellular component=cytosol; Biological process=protein-vacuolar targeting
  Coding regions on vcDNA: vcDNA=SeqID_88431; Strand=-; Position=3-217
FIFLRMGHLFSYFKSLFGHREMRILILGLDGAGKTTILHRLQVGEVVTTIPTXGFNVEQLPQKLKFQVWIGR

SEQ ID NO: 162009 - protein, 73 aa, Heterodera glycines
  misc_feature (53)..(53): Xaa can be any naturally occurring amino acid
  Homolog annotation: Hit_ID=XP_320779.1; Match level="QueryCoverage =95%, HitCoverage=30%, E-value=5e-23, Identity=80%"; Hit description =ENSANGP00000014175 [Anopheles gambiae] gb|EAA00052.1| ENSANGP00000014175 [Anopheles gambiae str. PEST]
  Gene Ontology: Mol. function=ARF small monomeric GTPase activity; Cellular component=cytosol; Biological process=ER to Golgi transport
  Coding regions on vcDNA: vcDNA=SeqID_88432; Strand=-; Position=2-219
FIFLRMGHPFSYFKSLFGHREMRILILGLHGAGKTPILHRLQVGEVVTTIPTXGFNVEQPPQKLKFQVWDLGG

SEQ ID NO: 162010 - protein, 143 aa, Heterodera glycines
  misc_feature (2)..(2): Xaa can be any naturally occurring amino acid
  misc_feature (14)..(14): Xaa can be any naturally occurring amino acid
  misc_feature (26)..(26): Xaa can be any naturally occurring amino acid
  Homolog annotation: Hit_ID=CAB62280.1; Match level="QueryCoverage =76%, HitCoverage=22%, E-value=7e-09, Identity=37%"; Hit description =hydroxyproline-rich glycoprotein DZ-HRGP [Volvox carteri f. nagariensis]
  Coding regions on vcDNA: vcDNA=SeqID_88433; Strand=-; Position=25-456
PXHPVQAPSPPPPXEHLPPPLHPPFXLPPPPHHPSSNCPIGPLECCGRVRPPAPPPCRASAATTPFCRRRWRRWSVPLRFAPRPPPPRRQKMLAQPLRPSTASAYCAAPPKSRDGFARAADFACPATCPPCSGAWFFPLNLRV

SEQ ID NO: 162011 - protein, 107 aa, Heterodera glycines
  misc_feature (24)..(24): Xaa can be any naturally occurring amino acid
  Coding regions on vcDNA: vcDNA=SeqID_88434; Strand=+; Position=107-427
MGTHVGNVLSPFRQWERELDHFFXGMQPMRRDHVAQLNVSDKGDLTYKGDVSGFRPEEINVEVIGDEIIVNGEHREQNDSESVHRQFSRRVRHPGGGPKGEHQVRAG

SEQ ID NO: 162012 - protein, 100 aa, Heterodera glycines
  Coding regions on vcDNA: vcDNA=SeqID_88435; Strand=-; Position=25-327
STPSFAAFFSVLISAWGKAQTDAEQVEDGHTKLPARTISIACACRTTAAPVFKLSSSTTADRSFSFEFQHISSLGRAEGERSQKQAAENARKKLGPHFVN

SEQ ID NO: 162013 - protein, 164 aa, Heterodera glycines
  misc_feature (96)..(96): Xaa can be any naturally occurring amino acid
  Homolog annotation: Hit_ID=CAE67276.1; Match level="QueryCoverage =79%, HitCoverage=24%, E-value=5e-12, Identity=29%"; Hit description =Hypothetical protein CBG12724 [Caenorhabditis briggsae]
  Coding regions on vcDNA: vcDNA=SeqID_88436; Strand=+; Position=40-531
RGAAIALEEGLIDVTRTDSESKPIWDDAIPLNHVVVVRRSRVKLRSGVPTGNVSSIESANSNSLFLYYSYRRNAYAWGIRECVIKFETNTDVEKWXTLLGNALTAQKHRPKRLWGCINPFGGEGDAISIWEKEVEPIFKLGNIQYEVRKTERGDHALEIVREFS

SEQ ID NO: 162014 - protein, 68 aa, Heterodera glycines
  Coding regions on vcDNA: vcDNA=SeqID_88437; Strand=-; Position=1-204
VHTLSRRRVNIYQAEHVHVRVAFLSLQFIVFSSFDCEIEQNQLNSEETEEEGAAHFNSKIELDFHLAA

SEQ ID NO: 162015 - protein, 68 aa, Heterodera glycines
  misc_feature (22)..(22): Xaa can be any naturally occurring amino acid
  Homolog annotation: Hit_ID=NP_496361.1; Match level="QueryCoverage =95%, HitCoverage=45%, E-value=5e-21, Identity=57%"; Hit description =COLlagen structural gene (30.9 kD) (col-81) [Caenorhabditis elegans] emb|CAA90187.1| Hypothetical protein
  Gene Ontology: Mol. function=structural constituent of cuticle; Cellular component=extracellular; Biological process=cuticle biosynthesis (sensu Nematoda)
  Coding regions on vcDNA: vcDNA=SeqID_88438; Strand=+; Position=1-206
GRQEPGQPGENGQPGQPGNPGXEGYPGDGGSPGQPGNPGGSGEPGQPGAQGSSGQCYHCPPPRTAPGY

SEQ ID NO: 162016 - protein, 74 aa, Heterodera glycines
  Coding regions on vcDNA: vcDNA=SeqID_88439; Strand=+; Position=2-223
AAKGEDAQYCPCPPRTQGVDKQPTYETGASVPVAKPYETKPYEVPKQQTTYDVKAAVAPGGYESLGGVKAAAAP

SEQ ID NO: 162017 - protein, 76 aa, Heterodera glycines
  misc_feature (4)..(4): Xaa can be any naturally occurring amino acid
  misc_feature (66)..(66): Xaa can be any naturally occurring amino acid
  Coding regions on vcDNA: vcDNA=SeqID_88440; Strand=-; Position=0-227
QIPXGGPLSLPHSFDFFIGLPHAQKHRPPQKLHKQPQMEKLNESHLSRESPKINSQISAPLPPPLXKGREESNSRP

SEQ ID NO: 162018 - protein, 56 aa, Heterodera glycines
  Coding regions on vcDNA: vcDNA=SeqID_88441; Strand=-; Position=0-167
PRRDPGLATDVQRLVVEEHCLAVPRRRRRLGRGDETNGGSPPRRMGFQKLGRSWRP

SEQ ID NO: 162019 - protein, 45 aa, Heterodera glycines
  Coding regions on vcDNA: vcDNA=SeqID_88442; Strand=-; Position=2-136
VHILSRRRVNIYQAEHVHVRVAFLSLQFIVLSSFDCEIEQNQPGG

SEQ ID NO: 162020 - protein, 46 aa, Heterodera glycines
  Coding regions on vcDNA: vcDNA=SeqID_88443; Strand=-; Position=0-137
VHILSRRRVNIHQPEHVHVRVAFLSLQFIVLSSFDCEIEQNQPRRP

SEQ ID NO: 162021 - protein, 88 aa, Heterodera glycines
  Coding regions on vcDNA: vcDNA=SeqID_88444; Strand=-; Position=1-264
KTPQRTSPNVKQWPTRTVANRFSDNSFGRTARRHCQSRYTQLTGEAPRKGTASEAQREMRSDGREGPFFNSKPHLRENWKSFFFFLAA

SEQ ID NO: 162022 - protein, 118 aa, Heterodera glycines
  Coding regions on vcDNA: vcDNA=SeqID_88445; Strand=-; Position=1-354
PPCWSIRSRSLGCTLNTWPPMLSWPDLASICLNRSVSSSGLRLSFEETASTLHPGPWQSGEIHVHPFSGHCTSAYSVAFVQLFTTPQQQQFVVAPGGTVLRNRAFSPFGSWDAERLAA

SEQ ID NO: 162023 - protein, 126 aa, Heterodera glycines
  Homolog annotation: Hit_ID=XP_320182.1; Match level="QueryCoverage =89%, HitCoverage=53%, E-value=4e-48, Identity=78%"; Hit description =ENSANGP00000011602 [Anopheles gambiae]
  Gene Ontology: Mol. function=neurotransmitter:sodium symporter activity; Cellular component=integral to plasma membrane; Biological process=neurotransmitter transport
  Coding regions on vcDNA: vcDNA=SeqID_88446; Strand=+; Position=3-380
PPSLPQSLLTLCCETSMGAMSIELYWQHAPRTCMNFQELARKGDYNNTIFHRIIADFMVQGGDPTRTGRGGTSIYGGRFADEISDDLRHTGAGIISMANSGPNTNGSQFFITLGPTQHLDGEHTIF

SEQ ID NO: 162024 - protein, 66 aa, Heterodera glycines
  Coding regions on vcDNA: vcDNA=SeqID_88447; Strand=-; Position=235-435
TSLAPPHQICHHLECRHTISHPMICRATTEGNEQSALEVMRRHVDQCHRRPVQRFPLLILWVQSPW

SEQ ID NO: 162025 - protein, 58 aa, Heterodera glycines
  Coding regions on vcDNA: vcDNA=SeqID_88448; Strand=-; Position=2-175
PISPRKCSAPKAGVIAPEPTASAMPAASRPFIKAPSLGKQLPNTLHALTPTRCRKDQT

SEQ ID NO: 162026 - protein, 141 aa, Heterodera glycines
  Homolog annotation: Hit_ID=XP_314164.1; Match level="QueryCoverage =61%, HitCoverage=10%, E-value=7e-12, Identity=44%"; Hit description =ENSANGP00000003826 [Anopheles gambiae]
  Coding regions on vcDNA: vcDNA=SeqID_88449; Strand=+; Position=80-502
KRNAQKAAENRENVGTSSRLIVKNLPCGKKTRWDEAKVRARFSKFGTLTDVRLKLSEKTGACKFAFVGFSSAEHCQNAIKALDGAYIGGSKLTVEECEALTTDRTAITKQLSLNKRKKLRRKGECEVDEEEDKEEAAEEAD

SEQ ID NO: 162027 - protein, 62 aa, Heterodera glycines
  Coding regions on vcDNA: vcDNA=SeqID_88450; Strand=+; Position=81-266
MADTPPPPPPPPPAAAAAAGGGDEAVDLEQRVRQLIMCIGLGNEDAVREISILIESFNREQF

SEQ ID NO: 162028 - protein, 85 aa, Heterodera glycines
  Homolog annotation: Hit_ID=BAB27616.1; Match level="QueryCoverage =96%, HitCoverage=48%, E-value=1e-19, Identity=59%"; Hit description =unnamed protein product [Mus musculus]
  Gene Ontology: Biological process=embryogenesis and morphogenesis
  Coding regions on vcDNA: vcDNA=SeqID_88451; Strand=-; Position=3-257
MARRSNATGTRKPHRHRPGTVPRREIRRYQSTTELLLRKLPFNRLVREIAQHNNLEMRFQAVAFAALQEASAAYWFDFWRTPIWR

SEQ ID NO: 162029 - protein, 86 aa, Heterodera glycines
  Homolog annotation: Hit_ID=ZP_00265257.1; Match level="QueryCoverage =100%, HitCoverage=100%, E-value=3e-17, Identity=46%"; Hit description=hypothetical protein Pflu02002576 [Pseudomonas fluorescens PfO-1]
  Coding regions on vcDNA: vcDNA=SeqID_88452; Strand=+; Position=52-312
MKLRTLMLGAALALTAVTGMAQADTAPVVTPYHYGEKMDVQKVLAMHEPDTNVCKVINADIKFVDSQGKVQDVGYRKLSEACDWEN

SEQ ID NO: 162030 - protein, 238 aa, Heterodera glycines
  Homolog annotation: Hit_ID=NP_492260.1; Match level="QueryCoverage =100%, HitCoverage=16%, E-value=8e-27, Identity=31%"; Hit description= single-stranded nucleic acid binding R3H and Helicase-associated region and helicase, C-terminal (1I896)
  Coding regions on vcDNA: vcDNA=SeqID_88453; Strand=+; Position=3-716
PRIAFLAALSHRDACVIASTDEQKQMANTVRDEFSKMDYSDHLMLIRASNAFSRVNGSCREQWCGARLISESAMRMICGIRHQLFIELRRLHLLPSRMTNPDDNMNNLNLFASSWPMVQGCIVAGAYPNIGFVRFGSKLNRIRTMGSKNCVLHPSSCLRRQTANPSKRSAKLNEVFSQKGSEPMLQYLIYQELVGDTHQQHMVPTVTAVTSLHILLFAGPVRMDLKCVKYFELVDPHG

SEQ ID NO: 162031 - protein, 50 aa, Heterodera glycines
  Coding regions on vcDNA: vcDNA=SeqID_88454; Strand=-; Position=1-153
PRSWLLPSWALLCRLRSSVSPCTSSRSRFRPEGCSADEKVRSHCVVVGRT

SEQ ID NO: 162032 - protein, 86 aa, Heterodera glycines
  Homolog annotation: Hit_ID=NP_999712.1; Match level="QueryCoverage =90%, HitCoverage=57%, E-value=2e-26, Identity=76%"; Hit description =histone H3 [Strongylocentrotus purpuratus] emb|CAA27582.1| unnamed protein product [Strongylocentrotus pu
  Gene Ontology: Biological process=embryogenesis and morphogenesis
  Coding regions on vcDNA: vcDNA=SeqID_88455; Strand=-; Position=1-258
MARRSNATGTRKPHRYRPGTVARREIRRYQSTTELLLRKLPFNRLVREIAQDNNLEMRFQAVAFAALQEASEAYLVRLLENTNLAA

SEQ ID NO: 162033 - protein, 59 aa, Heterodera glycines
  Homolog annotation: Hit_ID=NP_491127.1; Match level="QueryCoverage =100%, HitCoverage=20%, E-value=4e-09, Identity=49%"; Hit description= thioredoxin-like protein (31.1 kD) (1D801) [Caenorhabditis elegans] gb|AAF60759.1| Hypothetical protein
  Coding regions on vcDNA: vcDNA=SeqID_88456; Strand=+; Position=41-217
MPVVKPQTDSEFTKFLLNVGTAPCIVDFFATWCQPCSAIAPVFDELSNNYLNLKFVKVD

SEQ ID NO: 162034 - protein, 43 aa, Heterodera glycines
  Coding regions on vcDNA: vcDNA=SeqID_88457; Strand=-; Position=1-129
QLLSGGSRGGGGDNVCHNCNKPGHFSRECPPGRTGGGEAAARV

SEQ ID NO: 162035 - protein, 123 aa, Heterodera glycines
  Coding regions on vcDNA: vcDNA=SeqID_88458; Strand=-; Position=2-370
YSECSMRATALFNECEPFSSSASRSRGAIVFFFRSELLLSLPNSSSSRSPASVPTPLLMVLLLSSICPLQMCRCFRPVPFCMVNAWKNGCNSWYEVNVLMLNSEAERISMSAPVNSVYLLLGG

SEQ ID NO: 162036 - protein, 75 aa, Heterodera glycines
  Homolog annotation: Hit_ID=NP_496361.1; Match level="QueryCoverage =98%, HitCoverage=61%, E-value=2e-22, Identity=44%"; Hit description =COLlagen structural gene (30.9 kD) (col-81) [Caenorhabditis elegans] emb|CAA90187.1| Hypothetical protein
  Gene Ontology: Mol. function=structural constituent of cuticle; Cellular component=extracellular; Biological process=cuticle biosynthesis (sensu Nematoda)
  Coding regions on vcDNA: vcDNA=SeqID_88459; Strand=+; Position=3-230
PPSGPSGPPGQPGQGGENGQPGQPGNPGPQGYPGDGGSPGQPGNPGGNGEQGQAGAQGSSGQCYHCAPPRTAPGY

SEQ ID NO: 162037 - protein, 54 aa, Heterodera glycines
  misc_feature (15)..(15): Xaa can be any naturally occurring amino acid
  Coding regions on vcDNA: vcDNA=SeqID_88460; Strand=-; Position=0-161
KFFLSAFVCVLFMGXKHTHSTKPGRRNEEKNVLTTIIVLALFQVRTHGRLSGGG

SEQ ID NO: 162038 - protein, 72 aa, Heterodera glycines
  misc_feature (50)..(50): Xaa can be any naturally occurring amino acid
  Homolog annotation: Hit_ID=NP_507623.1; Match level="QueryCoverage =97%, HitCoverage=11%, E-value=1e-17, Identity=61%"; Hit description =general substrate transporter family member (66.7 kD) (5T3) [Caenorhabditis elegans] emb|CAA16400.1| Hypo
  Coding regions on vcDNA: vcDNA=SeqID_88461; Strand=-; Position=21-240
LITSFQLMITFGLVAAHIFAFAFSYIDPLNWGWRLMVGFAAIPSVVQFVXWFLPESPRWLYENKSHKECRRC

SEQ ID NO: 162039 - protein, 46 aa, Heterodera glycines
  Coding regions on vcDNA: vcDNA=SeqID_88462; Strand=-; Position=2-139
EIGLVLLGNCCSKCKARGTPNFHLNAKRRPLPRLSNCLVTTAKLGG

SEQ ID NO: 162040 - protein, 68 aa, Heterodera glycines
  Coding regions on vcDNA: vcDNA=SeqID_88463; Strand=+; Position=3-206
PQRFEEKMLALVLAVLSSFLHCLFWKLMVVIGVGKRTRTVTRAERKSTQKKRIRSRTSQANADREGRL

SEQ ID NO: 162041 - protein, 185 aa, Heterodera glycines
  Coding regions on vcDNA: vcDNA=SeqID_88464; Strand=-; Position=2-556
RPRHAFCNRLWVSPWWHHRRHSRRLIRSFFVVFVDLLAHFWVRNQHIAQLFHQFHQFTRCPHSFSGFVHPKVILSERLNSVRFEQLFQPLPRRQRHSESVLHSVQAVQADLVTVLPLLSPGSENSHVPSVDGIKKCPGHFIGQLRTGERQSSAGQNKRNWQRKEKEGEKRGGQPRHTQEKERTPT

SEQ ID NO: 162042 - protein, 40 aa, Heterodera glycines
  Coding regions on vcDNA: vcDNA=SeqID_88465; Strand=+; Position=1-120
GRQDSFPHRSNLHPGVPMVRATTARTRASAARARSIKTNR

SEQ ID NO: 162043 - protein, 46 aa, Heterodera glycines
  Coding regions on vcDNA: vcDNA=SeqID_88466; Strand=-; Position=0-137
NADKTAKATTRSLALTFWHGYSASSESKAWHTLTSEEGKRNKAWRP

SEQ ID NO: 162044 - protein, 69 aa, Heterodera glycines
  Homolog annotation: Hit_ID=NP_498661.1; Match level="QueryCoverage =95%, HitCoverage=12%, E-value=2e-16, Identity=54%"; Hit description =pescadillo, LiPid Depleted LPD-7 (61.6 kD) (lpd-7) [Caenorhabditis elegans] gb|AAK84463.1| Lipid depleted
  Gene Ontology: Cellular component=nucleolus; Biological process=growth
  Coding regions on vcDNA: vcDNA=SeqID_88467; Strand=+; Position=3-209
PRTIGQCRRAVTEFMHFVIEAKALRKVFISIKGVYYQAEILGERVTWVVGHERAVGRANELDFSVMANF

SEQ ID NO: 162045 - protein, 47 aa, Heterodera glycines
  Coding regions on vcDNA: vcDNA=SeqID_88468; Strand=+; Position=63-203
IISINSHIFHCLQSDLTRLRRNFTPMEIQRDSHLRSMKELLSTMDPQ

SEQ ID NO: 162046 - protein, 56 aa, Heterodera glycines
  Coding regions on vcDNA: vcDNA=SeqID_88469; Strand=+; Position=3-170
PPSFHIHHKMELRLLFASLFALWAVTAAMRKQGVAISGKFVCGHAPAMSNSTKVRI

SEQ ID NO: 162047 - protein, 43 aa, Heterodera glycines
  Coding regions on vcDNA: vcDNA=SeqID_88470; Strand=-; Position=2-130
PIYLSPLAHRQLAAQKHRGHACNNLGRNIASKESRSGANPLGG

SEQ ID NO: 162048 - protein, 57 aa, Heterodera glycines
  Homolog annotation: Hit_ID=XP_517026.1; Match level="QueryCoverage =98%, HitCoverage=18%, E-value=1e-19, Identity=75%"; Hit description =PREDICTED: similar to 60S ribosomal protein L29 (Cell surface heparin binding protein HIP) [Pan troglodyt
  Gene Ontology: Mol. function=heparin binding; Cellular component =cytosolic large ribosomal subunit (sensu Eukarya); Biological process=protein biosynthesis
  Coding regions on vcDNA: vcDNA=SeqID_88471; Strand=+; Position=51-221
EMAKSKNHTSHNQNRKDHRNGIHKPKKERYMSMKGVDPKFLRNLRFAKKHNKRNVKA

SEQ ID NO: 162049 - protein, 49 aa, Heterodera glycines
  Coding regions on vcDNA: vcDNA=SeqID_88472; Strand=+; Position=26-172
FVLIGPLKAYMLMYRQIDHSQNEHFVRSTELPEHLILLKDKLEAEEEER

SEQ ID NO: 162050 - protein, 82 aa, Heterodera glycines
  Coding regions on vcDNA: vcDNA=SeqID_88473; Strand=-; Position=0-245
ILANSFFDHADDPKFASSFLCCAIVFHFSGQNFPFRHGSVNGHRTAGSFLCECTWGKEKNNGEKSKRQKKEEAHFYLKPWRP

SEQ ID NO: 162051 - protein, 63 aa, Heterodera glycines
  Homolog annotation: Hit_ID=NP_629022.1; Match level="QueryCoverage =98%, HitCoverage=22%, E-value=3e-18, Identity=67%"; Hit description =putative lipoprotein [Streptomyces coelicolor A3(2)] emb|CAC17656.1| putative lipoprotein [Streptomyces c
  Coding regions on vcDNA: vcDNA=SeqID_88474; Strand=-; Position=316-507
IYHSSMPYSMFFSGGQAVHYSSDFARRGYYGCSHGCVNIRSWSKIAWIYQRVHVGDKVVVYRS

SEQ ID NO: 162052 - protein, 48 aa, Heterodera glycines
  Coding regions on vcDNA: vcDNA=SeqID_88475; Strand=-; Position=0-143
DSQSVFTSAVLFYCFSSSFCWSTAAFFFISMGMVRPPCQPFSFRSWRP

SEQ ID NO: 162053 - protein, 42 aa, Heterodera glycines
  Homolog annotation: Hit_ID=NP_498834.1; Match level="QueryCoverage =100%, HitCoverage=5%, E-value=1e-09, Identity=64%"; Hit description =immunoglobulin-like and Leucine-rich repeat (89.1 kD) (3J416) [Caenorhabditis elegans] gb|AAK29995.1| Hyp
  Coding regions on vcDNA: vcDNA=SeqID_88476; Strand=+; Position=19-144
ERLSRIRAFMEALEKYRQKQMDSLHETYSRRVSAIRDNYHSQ

SEQ ID NO: 162054 - protein, 42 aa, Heterodera glycines
  Coding regions on vcDNA: vcDNA=SeqID_88477; Strand=+; Position=1-126
GRQEDLRTRRFFQAGTPEIVTCVSAMFLSGQLAVCQGRKSNW

SEQ ID NO: 162055 - protein, 73 aa, Heterodera glycines
  Coding regions on vcDNA: vcDNA=SeqID_88478; Strand=-; Position=47-268
LFLGLCVVLIALTVATANIDLTVPYVYAAVALFRFMLALFIGFSFWYGFIGLTIEMKALKETKYSIKKLLRSL

SEQ ID NO: 162056 - protein, 69 aa, Heterodera glycines
  Homolog annotation: Hit_ID=NP_738065.1; Match level="QueryCoverage =82%, HitCoverage=6%, E-value=6e-19, Identity=82%"; Hit description =putative DNA polymerase I [Corynebacterium efficiens YS-314] dbj|BAC18265.1| putative DNA polymerase I [Co
  Coding regions on vcDNA: vcDNA=SeqID_88479; Strand=-; Position=118-327
AALNDASRDQPFQSRVLLQVHDELVVEIAPGELEQVQAIVEEEMPRAITLRVPLEVSAGTGTNWDEAAH

SEQ ID NO: 162057 - protein, 56 aa, Heterodera glycines; identical to SEQ ID NO: 162046
  Coding regions on vcDNA: vcDNA=SeqID_88480; Strand=+; Position=3-170

SEQ ID NO: 162058 - protein, 99 aa, Heterodera glycines
  Homolog annotation: Hit_ID=XP_314661.1; Match level="QueryCoverage =95%, HitCoverage=20%, E-value=1e-10, Identity=34%"; Hit description =ENSANGP00000005009 [Anopheles gambiae]
  Gene Ontology: Mol. function=RNA polymerase II transcription factor activity; Cellular component=cytoplasm; Biological process=TGFbeta receptor signaling pathway
  Coding regions on vcDNA: vcDNA=SeqID_88481; Strand=+; Position=1-297
GRQDSDHASLKRELKSLLKKLRKQKCLDELKKAIIAEGKYVKCVVYKIPEKQQTPYGGQMKSFPHFICCKICRFPDLLTHHQLRPVAQCLHPFNKAQKM

SEQ ID NO: 162059 - protein, 88 aa, Heterodera glycines; identical to SEQ ID NO: 161855
  Coding regions on vcDNA: vcDNA=SeqID_88482; Strand=+; Position=16-279

SEQ ID NO: 162060 - protein, 89 aa, Heterodera glycines
  Coding regions on vcDNA: vcDNA=SeqID_88483; Strand=-; Position=1-267
IFNQMACSVRLDHHILLPSHFFPKFPPHGPPPPIPPPYGEPYIPRLARRAAGSLSTLSSCAVISAEKAHKTTKRKAMIKRRGDILSFAA

SEQ ID NO: 162061 - protein, 65 aa, Heterodera glycines
  Coding regions on vcDNA: vcDNA=SeqID_88484; Strand=-; Position=1-195
QVFFFSTNNNNSMSDNRGASAASTGTTNSQESQVASPVKAGKATTKTTASGKGGKAKANGKVKAA

SEQ ID NO: 162062 - protein, 127 aa, Heterodera glycines
  Homolog annotation: Hit_ID=CAE65006.1; Match level="QueryCoverage =100%, HitCoverage=47%, E-value=1e-48, Identity=64%"; Hit description= Hypothetical protein CBG09844 [Caenorhabditis briggsae]
  Gene Ontology: Mol. function=phosphatidylinositol transporter activity; Cellular component=membrane fraction; Biological process =nonselective vesicle transport
  Coding regions on vcDNA: vcDNA=SeqID_88485; Strand=+; Position=74-454
MLIREYRIVMPFAIEEYQIGQLFSVTEASRQETGGGEGVQMVRNEPFEGQSLFNGRFTSGQFTHKIIHLDTKVPALLRAIMPRGSTTLHERSWNAFPYCKTEVTNPDYMKDNFLIRIETMHLSDRGT

SEQ ID NO: 162063 - protein, 45 aa, Heterodera glycines
  Coding regions on vcDNA: vcDNA=SeqID_88486; Strand=-; Position=90-227
IFFLKGMTIKKKTLDWKALICVAVIGFPKPLYKGVICQCFNQRHN

SEQ ID NO: 162064 - protein, 69 aa, Heterodera glycines
  Coding regions on vcDNA: vcDNA=SeqID_88487; Strand=+; Position=3-209
PPHKSKLSKMDERTRLAHIRLVDTMEHNVKHAEELKADNANNENKALGELRKRQKSGKIRDGRHMEGMP

SEQ ID NO: 162065 - protein, 124 aa, Heterodera glycines
  Homolog annotation: Hit_ID=AAR11446.1; Match level="QueryCoverage =95%, HitCoverage=20%, E-value=1e-62, Identity=99%"; Hit description =matrix metalloproteinase [Heterodera glycines] gb|AAR11445.1| matrix metalloproteinase [Heterodera glycine
  Coding regions on vcDNA: vcDNA=SeqID_88488; Strand=+; Position=3-374
PPRFDAFSKLFLLLPILLLHLQQSQACFSRGNSGEPSDGNPEAQGLKSENDVRTVQLKKEKQTDETEEEKDEESSAEQKLPSELDPEFVKTYLREFGHLKHNENGLSHGVKHFQRFLGYRQTGN

SEQ ID NO: 162066 - protein, 218 aa, Heterodera glycines
  Homolog annotation: Hit_ID=AAH41285.1; Match level="QueryCoverage =65%, HitCoverage=45%, E-value=1e-21, Identity=39%"; Hit description =MGC53558 protein [Xenopus laevis]
  Coding regions on vcDNA: vcDNA=SeqID_88489; Strand=+; Position=40-693
MSRPTPSELTVEMLKKRISGGRMDLSSLRLNKVPIELMCRSLAGQRITCVDLSDNLLTSFSAQFLQFFPDIQELDLHSNKIKRLPENFGVLSSLRRLDLSENQIKKLPISFAELDNLRWLNLVNNPLENDLAEVIGSCSNDEECSFAAKSAVQYVQFFSTVSSESTAIADTAFLQNETSSTSNNSDNINVSALRQADNAKNGKGFGSPNAKPQQKQIP

SEQ ID NO: 162067 - protein, 82 aa, Heterodera glycines
  Coding regions on vcDNA: vcDNA=SeqID_88490; Strand=+; Position=1-246
GRQQTLQNELNREKDHHMKVMVNAQKQVGELSQELEKALVAYGNLAKQQSNDSAKCVELNARNQKMGEEISQLKNEAKCASE

SEQ ID NO: 162068 - protein, 56 aa, Heterodera glycines; identical to SEQ ID NO: 161876
  Coding regions on vcDNA: vcDNA=SeqID_88491; Strand=+; Position=279-449

SEQ ID NO: 162069 - protein, 70 aa, Heterodera glycines
  Coding regions on vcDNA: vcDNA=SeqID_88492; Strand=+; Position=2-211
AARINWKSNSIFEYKMNCSFFLCLFTVQLILLNFAVEGREDDELKRKKRNTDVDVLGLVNIHAPSRKNVN

SEQ ID NO: 162070 - protein, 83 aa, Heterodera glycines
  Coding regions on vcDNA: vcDNA=SeqID_88493; Strand=+; Position=100-348
MDALKKLASRARQRSAEIMLNAEKTEIGAELEALLTKTDKTEEDMKKLVHAIEVYLQPNSAVRALDGLGEAMKGAASRVVGAE

SEQ ID NO: 162071 - protein, 107 aa, Heterodera glycines
  Coding regions on vcDNA: vcDNA=SeqID_88494; Strand=-; Position=0-320
LATIVVCIVGLSLIGSICIIWCHALSEFCLNRTDISSSSARKMFALCTIIGTRNTRTSRAQVLQRMPIEANKWEDLGQGGEAEDEDDDEQYCISEYVFFPFLFSWRP

SEQ ID NO: 162072 - protein, 80 aa, Heterodera glycines
  Coding regions on vcDNA: vcDNA=SeqID_88495; Strand=+; Position=37-276
MLSSSACCTLLAALISAAFFAMANAQTVKQCLCSEIQPCSEKYMNTWKTCMQQCKGHFSSVGGDVEKLGHCLDSNQALLQ

SEQ ID NO: 162073 - protein, 124 aa, Heterodera glycines
  Coding regions on vcDNA: vcDNA=SeqID_88496; Strand=+; Position=23-394
MSTSEVKPEDKSMDETSKNELRAEDTSIKDKGIGSVKETETNGAITTDNEPKIHAEKNETGDAAVGQKSTEEQFDKTDKKAEQQNVLDVNKTQQEPKAPLDEVKETPQGDNSEEVPTEAIVVDV

SEQ ID NO: 162074 - protein, 241 aa, Heterodera glycines
  Homolog annotation: Hit_ID=CAE74225.1; Match level="QueryCoverage =94%, HitCoverage=50%, E-value=1e-74, Identity=50%"; Hit description =Hypothetical protein CBG21909 [Caenorhabditis briggsae]
  Coding regions on vcDNA: vcDNA=SeqID_88497; Strand=+; Position=3-725
PPSEMWRKRTPAKARETNYPLDNAQCASPQHFSAGPMHPFQPWQNIDGLVNKYTDNMYEFAPRPSCSMGPDCGSKYLFCDRSHGKPRCAAKVRPNGNCAGFTNGEDVCLNGECQYGKCVKKSPPPTTPKPPPIVTVSPIESPCFNEHECCAKWAADGQCESNSEYMSQFCKASCKKCQYSYNMQEECADRHKNCKALSYQMKCDSSWMAENCRKYCNKCNVKRMQTCAGGSPGGRKTHAFI

SEQ ID NO: 162075 - protein, 81 aa, Heterodera glycines
  Homolog annotation: Hit_ID=CAG13211.1; Match level="QueryCoverage =80%, HitCoverage=7%, E-value=1e-15, Identity=53%"; Hit description =unnamed protein product [Tetraodon nigroviridis]
  Coding regions on vcDNA: vcDNA=SeqID_88498; Strand=+; Position=20-262
MIDCHCHLADESFNEDISQVIDRAKQNGVKAALVVAEFKDDFERILELTHQFPDFLFPCLGMHPVQRGHISCSEEMYKNFE

SEQ ID NO: 162076 - protein, 157 aa, Heterodera glycines
  misc_feature (116)..(116): Xaa can be any naturally occurring amino acid
  Homolog annotation: Hit_ID=XP_453844.1; Match level="QueryCoverage =76%, HitCoverage=68%, E-value=4e-23, Identity=50%"; Hit description =unnamed protein product [Kluyveromyces lactis] ref|XP_453838.1| unnamed protein product [Kluyveromyces la
  Coding regions on vcDNA: vcDNA=SeqID_88499; Strand=+; Position=80-552
RCSSPCWFAPQVERRTSLSRSTSDRDASTASIRFPPGNFKHSLTLFSKSFSSFPRGTCSLSVSRPYLALDGIYHPIRAAFPNNPTRRQRLVVRQGPGPTGLSPSQAPPSKGLGPGXAAEDASTDYNSGDAAARFSCWALPGSLAATRGILVSFFSSA

SEQ ID NO: 162077 - protein, 46 aa, Heterodera glycines
  Coding regions on vcDNA: vcDNA=SeqID_88500; Strand=-; Position=0-137
IVQLFASICPLVCGQMLRCTNCTCGKPIFGIRFYIAGNSEGFAWRP

SEQ ID NO: 162078 - protein, 73 aa, Heterodera glycines
  Homolog annotation: Hit_ID=XP_394437.1; Match level="QueryCoverage =94%, HitCoverage=16%, E-value=8e-10, Identity=43%"; Hit description =similar to ENSANGP00000017921 [Apis mellifera]
  Coding regions on vcDNA: vcDNA=SeqID_88501; Strand=+; Position=3-221
PPRVYDRMIAFLLDNKNSAKICEELKLRRIDTTNLWDVLFDMIILDAFEDMQKLPSAVTALLRNGFISTSMKQ

SEQ ID NO: 162079 - protein, 47 aa, Heterodera glycines
  Homolog annotation: Hit_ID=AAC47437.1; Match level="QueryCoverage =100%, HitCoverage=15%, E-value=1e-15, Identity=82%"; Hit description= COL-1
  Coding regions on vcDNA: vcDNA=SeqID_88502; Strand=+; Position=32-172
MDFDGRIKAYRFVAYSTVSFSIISLLSVCFTLPMLKSYVSNVGLKMD

SEQ ID NO: 162080 - protein, 58 aa, Heterodera glycines
  Homolog annotation: Hit_ID=CAE62810.1; Match level="QueryCoverage =100%, HitCoverage=18%, E-value=1e-18, Identity=68%"; Hit description= Hypothetical protein CBG06986 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88503; Strand=+; Position=3-179
PPRPGQPGNPGPQGYPGDGGSPGQPGNPGGSGEPGQPGAQGSSGQCYHCPPPRTAPGY

SEQ ID NO: 162081 - protein, 65 aa, Heterodera glycines
  Coding regions on vcDNA: vcDNA=SeqID_88504; Strand=-; Position=0-194
GSLSQFPPAAVAAVCCGVTVVMFVNNAVNVVPLVSSWRTLRDNDGTLGDLHSTSDISASSKNWRP

SEQ ID NO: 162082 - protein, 64 aa, Heterodera glycines
  Coding regions on vcDNA: vcDNA=SeqID_88505; Strand=+; Position=18-209
MGFHSTKMEADLSKEQQGKREADSMRMLAFFGVCLSTVATMICVVSVPVAYEHFQQVGTKMQGE

SEQ ID NO: 162083 - protein, 41 aa, Heterodera glycines
  Coding regions on vcDNA: vcDNA=SeqID_88506; Strand=+; Position=1-123
GRQGPCFVRRIMRALGAFIGMRCDRLKPHFEPIQLTNWLRS

SEQ ID NO: 162084 - protein, 47 aa, Heterodera glycines
  Coding regions on vcDNA: vcDNA=SeqID_88507; Strand=-; Position=0-140
IDNWRRTPTDDPRGCCPFVSHHFPDHFGIYKTLIGQFSMLFLIFRRP

SEQ ID NO: 162085 - protein, 73 aa, Heterodera glycines
  Homolog annotation: Hit_ID=AAC48326.1; Match level="QueryCoverage =95%, HitCoverage=21%, E-value=2e-34, Identity=100%"; Hit description= beta-1,4-endoglucanase-2 precursor [Heterodera glycines]
  Coding regions on vcDNA: vcDNA=SeqID_88508; Strand=+; Position=2-223
AAKLNSGSMSSWWSLLDQLKISYVNWSITDKSEACAALTGGTSAANVGTSSRWTQSGNMVASQHKKKSTGVKC

SEQ ID NO: 162086 - protein, 70 aa, Heterodera glycines
  Coding regions on vcDNA: vcDNA=SeqID_88509; Strand=+; Position=1-213
YSLVPSSDPILFLICSKYKMAYLELVMALIKTLTMTPLYRGLGNPITATQIKAFQSSVFFFIVIPFRKNI

SEQ ID NO: 162087 - protein, 128 aa, Heterodera glycines
  Coding regions on vcDNA: vcDNA=SeqID_88510; Strand=-; Position=32-418
CTRRTMLHSIIYFVFHYLSTIRGGFPLCLECCFTTARDSHTKGGGGGTERRASLGLAMAMAMAMALVGLRMGLERRVTQHVSSTLSALCVQCLFFSTGVIAVVLALLCVCCCVVPDAARVIHVVRRSS

SEQ ID NO: 162088 - protein, 259 aa, Heterodera glycines
  misc_feature (19)..(19): Xaa can be any naturally occurring amino acid
  Homolog annotation: Hit_ID=AAT40742.1; Match level="QueryCoverage =100%, HitCoverage=71%, E-value=1e-138, Identity=99%"; Hit description=lactose operon repressor [Phage display vector pTScDisp] gb|AAT40740.1| lactose operon repressor [Phage
  Coding regions on vcDNA: vcDNA=SeqID_88511; Strand=-; Position=3-779
PVTLYDVAEYAGVSYQTFXRVVNQASHVSAKTREKVEAAMAELNYIPNRVAQQLAGKQSLLIGVATSSLALHAPSQIVAAIKSRADQLGASVVVSMVERSGVEACKAAVHNLLAQRVSGLIINYPLDDQDAIAVEAACTNVPALFLDVSDQTPINSIIFSHEDGTRLGVEHLVALGHQQIALLAGPLSSVSARLRLAGWHKYLTRNQIQPIAEREGDWSAMSGFQQTMQMLNEGIVPTAMLVANDQMALGAMRAITESG

SEQ ID NO: 162089 - protein, 91 aa, Heterodera glycines
  Coding regions on vcDNA: vcDNA=SeqID_88512; Strand=+; Position=47-319
MFGYQQTQFNYGAYASANGQQQSFINYAQQQNNSATAPVAGNATTNAYAASQYSLAASAYAQYSQAATQQQSVAATYGVQPPPPPPDYSAS

SEQ ID NO: 162090 - protein, 53 aa, Heterodera glycines
  Homolog annotation: Hit_ID=AAL78213.1; Match level="QueryCoverage =100%, HitCoverage=20%, E-value=2e-15, Identity=75%"; Hit description= probable protein kinase Hgg-20 [Heterodera glycines]
  Coding regions on vcDNA: vcDNA=SeqID_88513; Strand=+; Position=37-195
MADGLMTLAPGTRVSGRWIIIKKLGAGSFGAVYLCQDERVGTIAALKTEPFNT

SEQ ID NO: 162091 - protein, 124 aa, Heterodera glycines
  misc_feature (20)..(20): Xaa can be any naturally occurring amino acid
  Homolog annotation: Hit_ID=AAR11446.1; Match level="QueryCoverage =95%, HitCoverage=20%, E-value=5e-62, Identity=98%"; Hit description =matrix metalloproteinase [Heterodera glycines] gb|AAR11445.1| matrix metalloproteinase [Heterodera glycine
  Coding regions on vcDNA: vcDNA=SeqID_88514; Strand=+; Position=3-373
PPRFDAFYKLFLLLPILLLXLQQSQACFSRGNSGEPSDGNPEAQGLKSENDVRTVQLKKEKQTDETEEEKDEESSAEQKLPSELDPEFVKTYLREFGHLKHNENGLSHGVKHFQRFLGYRQTGN

SEQ ID NO: 162092 - protein, 100 aa, Heterodera glycines
  Coding regions on vcDNA: vcDNA=SeqID_88515; Strand=-; Position=25-327
STPSFAAFFSVLISAWGKAQTDAEQVEDGHTKLPARTISIACACRTTAAPVFKLSSSTTADRSFSFEFQHISSLGRAEGERSQKQAAENDRKKLGNHFLN

SEQ ID NO: 162093 - protein, 122 aa, Heterodera glycines
  Homolog annotation: Hit_ID=NP_494721.1; Match level="QueryCoverage =100%, HitCoverage=24%, E-value=1e-34, Identity=60%"; Hit description= glycerol kinase (55.2 kD) (2E383) [Caenorhabditis elegans] gb|AAA79749.1| Hypothetical protein R11F4.1 [
  Gene Ontology: Mol. function=glycerol kinase activity; Cellular component=mitochondrial outer membrane; Biological process=glycerol metabolism
  Coding regions on vcDNA: vcDNA=SeqID_88516; Strand=+; Position=60-425
MVLLGAIDQGTSSSRFLVFDSENGNLVAGHQLEVQQQFPNPGFVEMCPEQIFKTTVRCIKSTCEELNRRGIDPKKEIKAIGITNQRETTIVWDRETGCHLSNAIVWLDCRTHELCDEYIQRT

SEQ ID NO: 162094 - protein, 53 aa, Heterodera glycines; identical to SEQ ID NO: 162090
  Homolog annotation: Hit_ID=AAL78213.1; Match level="QueryCoverage =100%, HitCoverage=20%, E-value=2e-15, Identity=75%"; Hit description= probable protein kinase Hgg-20 [Heterodera glycines]
  Coding regions on vcDNA: vcDNA=SeqID_88517; Strand=+; Position=37-195

SEQ ID NO: 162095 - protein, 57 aa, Heterodera glycines
  Coding regions on vcDNA: vcDNA=SeqID_88518; Strand=+; Position=37-207
YLLIYFWPFSAQMRLVQLLHLALLVQLLLAPVLLAVGQTDEKVKRIQKREGPPEANL

SEQ ID NO: 162096 - protein, 117 aa, Heterodera glycines
  misc_feature (13)..(13): Xaa can be any naturally occurring amino acid
  misc_feature (26)..(26): Xaa can be any naturally occurring amino acid
  misc_feature (40)..(40): Xaa can be any naturally occurring amino acid
  misc_feature (112)..(112): Xaa can be any naturally occurring amino acid
  Homolog annotation: Hit_ID=AAM94882.1; Match level="QueryCoverage =100%, HitCoverage=86%, E-value=2e-47, Identity=76%"; Hit description= hypothetical protein [Erwinia amylovora] ref|NP_758764.1| hypothetical protein [Erwinia amylovora]
  Coding regions on vcDNA: vcDNA=SeqID_88519; Strand=+; Position=20-371
TVKRPRCWSVPMXSGPLTSIQKSTLXVRGGETRQDSEDTXRFPLEAPSCALLFRPCRLPDACPPFSLPEAWRFVIHHAVCISVWCMAVAPSWAVCTNPPFSPTAAPYTGTMXLSPTR

SEQ ID NO: 162097 - protein, 233 aa, Heterodera glycines
  misc_feature (214)..(214): Xaa can be any naturally occurring amino acid
  Homolog annotation: Hit_ID=CAE57515.1; Match level="QueryCoverage =60%, HitCoverage=52%, E-value=6e-47, Identity=56%"; Hit description =Hypothetical protein CBG00490 [Caenorhabditis briggsae]
  Coding regions on vcDNA: vcDNA=SeqID_88520; Strand=+; Position=27-725
MSRDVSSAEKLPLLQSSNPRTYSRTSSREEARPIDHNDPLTGEEGEVQGGFVSYQHGDANPRTPMGQGQARNVNQNGSPSDVAEEDDEDSPLMNRGPMVVCRVCEAEIALDGKTTLHVVRCQNCNEVTPIRAAPPGKKYVRCPCNCLLVCKASSARIACPRQNCRRVITLAASSPVGTAVRAPAGTCRVQCAHCAEVIIFNTLSNTVAHCPHCXSVSSVGVRFARARSTLFCI

SEQ ID NO: 162098 - protein, 96 aa, Heterodera glycines
  Homolog annotation: Hit_ID=CAF97135.1; Match level="QueryCoverage =45%, HitCoverage=51%, E-value=1e-10, Identity=71%"; Hit description =unnamed protein product [Tetraodon nigroviridis]
  Coding regions on vcDNA: vcDNA=SeqID_88521; Strand=+; Position=32-319
MRSLQKYHIIADNLGWFSDLDGKKNIEEILAAKGEAIKRGTAVLEMEVPAEEEGDNAKLIRWPQRWRWTKFEREVFSFLKFTYNYDPLLDIGRKVE

SEQ ID NO: 162099 - protein, 122 aa, Heterodera glycines
  Homolog annotation: Hit_ID=NP_492730.2; Match level="QueryCoverage =87%, HitCoverage=12%, E-value=2e-18, Identity=44%"; Hit description =FAD dependent oxidoreductase and glycine cleavage T protein (94.9 kD) (1L16) [Caenorhabditis elegans] emb
  Coding regions on vcDNA: vcDNA=SeqID_88522; Strand=+; Position=1-366
GRQAKSPIVVAGGGLVGLSVAYGLAKRGAKEVFLFERHCIGAHNSTRISTGMINNPCFYTDRSLQSVVRKSHELYAELDSRGTLGFTRCGRVYLASSDDTAIQARRMFSRLSADPANSAAEL

SEQ ID NO: 162100 - protein, 62 aa, Heterodera glycines
  Coding regions on vcDNA: vcDNA=SeqID_88523; Strand=+; Position=2-187
AAKVLTGTGKFPAFFPVFPAKKSRSRSCPNFPVPLHSSVYENGNPSIFRIEFLIAQIVNFTY

SEQ ID NO: 162101 - protein, 51 aa, Heterodera glycines
  Coding regions on vcDNA: vcDNA=SeqID_88524; Strand=-; Position=107-262
SSMDGFIASDCVVLSSVNYSLCFGGAEILLVGGDRLIRQMNEQLTKGRLIN

SEQ ID NO: 162102 - protein, 51 aa, Heterodera glycines
  Coding regions on vcDNA: vcDNA=SeqID_88525; Strand=+; Position=2-154
AARNRTICVSIIIPSLCNNNNTSKATSSPFLIVLSSVRSSHQFARRFRNGT

SEQ ID NO: 162103 - protein, 57 aa, Heterodera glycines; identical to SEQ ID NO: 162048
  Homolog annotation: Hit_ID=XP_517026.1; Match level="QueryCoverage =98%, HitCoverage=18%, E-value=1e-19, Identity=75%"; Hit description =PREDICTED: similar to 60S ribosomal protein L29 (Cell surface heparin binding protein HIP) [Pan troglodyt
  Gene Ontology: Mol. function=heparin binding; Cellular component =cytosolic large ribosomal subunit (sensu Eukarya); Biological process=protein biosynthesis
  Coding regions on vcDNA: vcDNA=SeqID_88526; Strand=+; Position=56-226

SEQ ID NO: 162104 - protein, 35 aa, Heterodera glycines
  Coding regions on vcDNA: vcDNA=SeqID_88527; Strand=-; Position=117-224
SPPPPPSPPPSASGRYPFGYLGQYAPLAALLNQFV

SEQ ID NO: 162105 - protein, 57 aa, Heterodera glycines
  Homolog annotation: Hit_ID=NP_493660.1; Match level="QueryCoverage =98%, HitCoverage=18%, E-value=2e-17, Identity=65%"; Hit description =COLlagen structural gene (col-68) [Caenorhabditis elegans] gb|AAB94952.1| Collagen protein 68 [Caenorhabd
  Gene Ontology: Mol. function=structural constituent of cuticle; Cellular component=extracellular; Biological process=cuticle biosynthesis (sensu Nematoda)
  Coding regions on vcDNA: vcDNA=SeqID_88528; Strand=+; Position=3-176
PPSGQPGNPGPQGYPGDGGSPGQPGNPGGSGEPGQPGAQGSSGQCYHCPPPRTAPGY

SEQ ID NO: 162106 - protein, 52 aa, Heterodera glycines
  Coding regions on vcDNA: vcDNA=SeqID_88529; Strand=+; Position=2-160
AAKGNPPPPPPSAPNRRSVVVGEEIIDGQTKCGSVRPAADPDKSNSRRGSGR

SEQ ID NO: 162107 - protein, 127 aa, Heterodera glycines
  Homolog annotation: Hit_ID=EAA03796.2; Match level="QueryCoverage =66%, HitCoverage=4%, E-value=8e-10, Identity=30%"; Hit description =ENSANGP00000006286 [Anopheles gambiae str. PEST]
  Coding regions on vcDNA: vcDNA=SeqID_88530; Strand=+; Position=20-400
MTDPLQLCLRALVNLLSCAWIQREVMRDVRVPIEIANILYKIVLTRDSIQTHRICVELITTLVTKAAKDAVKAKEEKNELDEQNGNAVDLVNGHEEHRDTDFGQGQRRDFGMNDGVLSSSSSSDATL

SEQ ID NO: 162108 - protein, 38 aa, Heterodera glycines
  Coding regions on vcDNA: vcDNA=SeqID_88531; Strand=-; Position=1-114
KSFSCFVKSRNVTVRRTSTVRRAEKAKPFQRANFDLAA

SEQ ID NO: 162109 - protein, 112 aa, Heterodera glycines
  Coding regions on vcDNA: vcDNA=SeqID_88532; Strand=+; Position=99-434
MSAESPTTSQRRARSRKTKKRAVSAGETKPLRRSARIAAQKAAKEKAAKQKARDGSTASTKSAGRGRPSRSPKKSGPKSRRSPAGRGGGRSQTPRKKKQPMKKAPGPSSRTP

SEQ ID NO: 162110 - protein, 57 aa, Heterodera glycines; identical to SEQ ID NO: 162048
  Homolog annotation: Hit_ID=XP_517026.1; Match level="QueryCoverage =98%, HitCoverage=18%, E-value=1e-19, Identity=75%"; Hit description =PREDICTED: similar to 60S ribosomal protein L29 (Cell surface heparin binding protein HIP) [Pan troglodyt
  Gene Ontology: Mol. function=heparin binding; Cellular component =cytosolic large ribosomal subunit (sensu Eukarya); Biological process=protein biosynthesis
  Coding regions on vcDNA: vcDNA=SeqID_88533; Strand=+; Position=56-226

SEQ ID NO: 162111 - protein, 65 aa, Heterodera glycines
  Coding regions on vcDNA: vcDNA=SeqID_88534; Strand=+; Position=2-196
AARSSLSLFLLFSHSFPFSAFPCYFRPLLLLLLNCRFSYRPLSSASLLLLSLCSPLRRHSVPHRR

SEQ ID NO: 162112 - protein, 62 aa, Heterodera glycines
  Homolog annotation: Hit_ID=CAE74225.1; Match level="QueryCoverage =93%, HitCoverage=8%, E-value=3e-17, Identity=56%"; Hit description =Hypothetical protein CBG21909 [Caenorhabditis briggsae]
  Coding regions on vcDNA: vcDNA=SeqID_88535; Strand=+; Position=1-186
GRQGKGECERNQAYMSSWCKASCRQCDFDYDIDKECGNRHPNCWQWANEGQCQRNLFWMNEN

SEQ ID NO: 162113 - protein, 83 aa, Heterodera glycines
  Homolog annotation: Hit_ID=NP_501793.1; Match level="QueryCoverage =74%, HitCoverage=12%, E-value=1e-09, Identity=50%"; Hit description =SH2 motif and protein kinase family member (kin-5) [Caenorhabditis elegans] emb|CAA93289.1| Hypothetical
  Coding regions on vcDNA: vcDNA=SeqID_88536; Strand=+; Position=63-311
MDVDMWQLPYYHGLLPREDVVELLPNDGDFLVRMTEEISGTERVYALSVNVGGFLNHVIFRRHKGMFTVDLNSDKGFRTIERF

SEQ ID NO: 162114 - protein, 70 aa, Heterodera glycines
  Coding regions on vcDNA: vcDNA=SeqID_88537; Strand=+; Position=3-212
PPRINWKSNSIFEYKMNCSFFLCLFTVQLILLNFAVEGREDDELKRKKRNTDVDVLGLVNIHAPSRKNVN

SEQ ID NO: 162115 - protein, 48 aa, Heterodera glycines
  Coding regions on vcDNA: vcDNA=SeqID_88538; Strand=+; Position=23-166
AEGGEPLGTVGRLLHVIGDNQLPNNAEGNENKVHFNGGNQLKVFSSNL

SEQ ID NO: 162116 - protein, 103 aa, Heterodera glycines
  Coding regions on vcDNA: vcDNA=SeqID_88539; Strand=+; Position=2-310
AQISPGKHGGFEEVPVPTVAQPSYVLGFRGTIHFNGTLSDNALAFFRHALPPPTTLYRFSVLDEFYRANGLLSPFKTTERINIFLARQFAQRTVCGVGGASAG

SEQ ID NO: 162117 - protein, 73 aa, Heterodera glycines
  Coding regions on vcDNA: vcDNA=SeqID_88540; Strand=+; Position=3-221
PPRKNLLYLSLEMSWIFGIKPQPSSIPAPPDDPNRNPPTPADEKQQKIWGTGVPTHLTQLRWNGRHKQQKRWK

SEQ ID NO: 162118 - protein, 67 aa, Heterodera glycines
  Homolog annotation: Hit_ID=NP_503032.1; Match level="QueryCoverage =97%, HitCoverage=46%, E-value=2e-13, Identity=53%"; Hit description =NADH:ubiquinone oxidoreductase 17.2 kD subunit (15.8 kD) (4S44) [Caenorhabditis elegans] emb|CAB55150.2|
  Coding regions on vcDNA: vcDNA=SeqID_88541; Strand=+; Position=1-201
GRQASLRGFEPPPDVEVPSEPPVEWRAWLNKSRRFPPSEEEIQLNLLKQQAQLVQNTDTEKKAPMIV

SEQ ID NO: 162119 - protein, 130 aa, Heterodera glycines
  Homolog annotation: Hit_ID=NP_012721.1; Match level="QueryCoverage =98%, HitCoverage=11%, E-value=1e-21, Identity=40%"; Hit description =Mnn4p [Saccharomyces cerevisiae] sp|P36044|MNN4_YEAST MNN4 protein pir||S78475 mannosylphosphorylation pr
  Gene Ontology: Biological process=N-linked glycosylation
  Coding regions on vcDNA: vcDNA=SeqID_88542; Strand=+; Position=2-391
AAEKEEKKSESKEAEKKENEEQKPAGKKEKRAAEKEEKKTESKEAEKKENEEQKPAGKKEKRAAEKEEKKSESKEAEKKENEEQKPAGKKEKRAAEKEEKKTESKEAEKKENEEQKPAGKKEKRAAEKEE

SEQ ID NO: 162120 - protein, 236 aa, Heterodera glycines
  Homolog annotation: Hit_ID=NP_217596.1; Match level="QueryCoverage =95%, HitCoverage=18%, E-value=8e-13, Identity=32%"; Hit description =pknK [Mycobacterium tuberculosis H37Rv] ref|NP_337687.1| serine/threonine protein kinase / MalT-related p
  Coding regions on vcDNA: vcDNA=SeqID_88543; Strand=+; Position=2-709
AALHESYQRAQWAFGEIFQDCVSGLAFLHVGDATRARSLYERSLESAVALHGQLSPFASMPALLLAEILYEQNDLDRARQLVADYLDVAHGLGYVDKLIAAYLVKARLEAGGGQIETAQRTLDEGDRCARVTGFARLHANISCERMRLLSANSAAVLDLARTAGLLGSCSALQPNVGVTSSTEKLAISWAYAARANGDIDGAIRLLKSWYRFVMARRCLRSGLRLAVELGTLFYLR

SEQ ID NO: 162121 - protein, 41 aa, Heterodera glycines
  Coding regions on vcDNA: vcDNA=SeqID_88544; Strand=+; Position=1-123
GRQKKALSLRSKFSVLKGDITKMTTDCIVNAANSSLLGGGG

SEQ ID NO: 162122 - protein, 62 aa, Heterodera glycines
  Homolog annotation: Hit_ID=NP_501273.2; Match level="QueryCoverage =96%, HitCoverage=17%, E-value=4e-17, Identity=70%"; Hit description =COLlagen structural gene (col-14) [Caenorhabditis elegans] gb|AAB03143.2| Collagen protein 14 [Caenorhabd
  Gene Ontology: Mol. function=structural constituent of cuticle; Cellular component=extracellular; Biological process=cuticle biosynthesis (sensu Nematoda)
  Coding regions on vcDNA: vcDNA=SeqID_88545; Strand=-; Position=1-186
ATCCATVAITSCLIIFPLIVHYIQTLEANVQLDLDFCKSRARDMFKEMFEIKTGGKGGEAAA

SEQ ID NO: 162123 - protein, 75 aa, Heterodera glycines
  Coding regions on vcDNA: vcDNA=SeqID_88546; Strand=-; Position=72-299
VKAVWPVIHQSSEFSSGYSQSRAHLSSSSIWLCRCERTCWPINACLFSLSTVPLSDNHGICGWPSHKAHRIFVRL

SEQ ID NO: 162124 - protein, 53 aa, Heterodera glycines; identical to SEQ ID NO: 162090
  Homolog annotation: Hit_ID=AAL78213.1; Match level="QueryCoverage =100%, HitCoverage=20%, E-value=2e-15, Identity=75%"; Hit description= probable protein kinase Hgg-20 [Heterodera glycines]
  Coding regions on vcDNA: vcDNA=SeqID_88547; Strand=+; Position=49-207

SEQ ID NO: 162125 - protein, 141 aa, Heterodera glycines; identical to SEQ ID NO: 161866
  Homolog annotation: Hit_ID=AAM94882.1; Match level="QueryCoverage =90%, HitCoverage=94%, E-value=9e-73, Identity=100%"; Hit description= hypothetical protein [Erwinia amylovora] ref|NP_758764.1| hypothetical protein [Erwinia amylovora]
  Coding regions on vcDNA: vcDNA=SeqID_88548; Strand=+; Position=125-550

SEQ ID NO: 162126 - protein, 83 aa, Heterodera glycines
  Coding regions on vcDNA: vcDNA=SeqID_88549; Strand=-; Position=0-248
PLRPGPTVRGRFLLCRRWWRHTTRVRMEFFGSVLSLLLVVISPSFCSSAVCLFCLLRRIASSEAAANGGECANLKCAVAPWRP

SEQ ID NO: 162127 - protein, 52 aa, Heterodera glycines
  Coding regions on vcDNA: vcDNA=SeqID_88550; Strand=-; Position=0-155
FSTEEAQEQPTGRTNESKTIARRKKKTLATHSVAKRVPMSHSHLHLRFALRP

SEQ ID NO: 162128 - protein, 70 aa, Heterodera glycines
  Coding regions on vcDNA: vcDNA=SeqID_88551; Strand=+; Position=2-214
AAKNLQREQKVPVVHQPEAADLTGRTTGRWAVTRGVQRRGTSVGRPAKEKLTMHYFRHVLLFARSPFGTN

SEQ ID NO: 162129 - protein, 137 aa, Heterodera glycines
  Homolog annotation: Hit_ID=NP_501221.1; Match level="QueryCoverage =86%, HitCoverage=78%, E-value=6e-24, Identity=46%"; Hit description =cytidine deaminase (cdd-2) [Caenorhabditis elegans] gb|AAB03151.1| Cytidine deaminase protein 2 [Caenorha
  Gene Ontology: Mol. function=cytidine deaminase activity; Biological process=nucleobase, nucleoside, nucleotide and nucleic acid metabolism
  Coding regions on vcDNA: vcDNA=SeqID_88552; Strand=+; Position=23-436
MENEGQLSPAEEQMLIEHAQIVQRNSTSPYSKFAVGAAILNNDGQIFRGANVENASYGATICAERSAICSAIAAIGPTKFCPKAICRQTLVEFGDMAVLLYSRPSKKLLKTRVQNLIPMAFTPNALNTFKSDASMSN

SEQ ID NO: 162130 - protein, 68 aa, Heterodera glycines
  Coding regions on vcDNA: vcDNA=SeqID_88553; Strand=+; Position=1-204
GRLATRASRAGAITAHRHGQRRAIDGIFRIYSFYVNTNFLFQIENLLAIKMHSVTKKKKKKKKKKKNL

SEQ ID NO: 162131 - protein, 123 aa, Heterodera glycines
  misc_feature (44)..(44): Xaa can be any naturally occurring amino acid
  Homolog annotation: Hit_ID=NP_114185.1; Match level="QueryCoverage =86%, HitCoverage=29%, E-value=9e-30, Identity=59%"; Hit description =muscle Y-box protein YB2 [Rattus norvegicus] sp|Q62764|DBPA_RAT DNA -binding protein A (Cold shock domain
  Gene Ontology: Mol. function=transcription co-repressor activity; Cellular component=cytoplasm; Biological process=negative regulation of transcription from Pol II promoter
  Coding regions on vcDNA: vcDNA=SeqID_88554; Strand=+; Position=30-396
MESSDANNNINNSEGEAENTTKNGGEEGVEKKILSKGVSGVANXVNVMNGYGFICRDDTNDDIFVHNSAITANNPSKIQRSLGDGEKVMFDIVDGAKGPEAANVTGPDGVPVQGSKYAADLSQ

SEQ ID NO: 162132 - protein, 80 aa, Heterodera glycines
  Coding regions on vcDNA: vcDNA=SeqID_88555; Strand=+; Position=2-244
AAKLSLHGPLIRNAQDTTCRGKNCREEAAEIKNGNCGQKGNCWSQEKERRQVNDNKRTIGFETIDRIHCFATSYLLKNCY

SEQ ID NO: 162133 - protein, 58 aa, Heterodera glycines
  Coding regions on vcDNA: vcDNA=SeqID_88556; Strand=+; Position=1-174
GRQVPPLPIAINDQPHRGFPSPQTAARRSYSMPIYALPSGKQKQQQQAQDDDKEQQRG

SEQ ID NO: 162134 - protein, 112 aa, Heterodera glycines
  Homolog annotation: Hit_ID=NP_872194.1; Match level="QueryCoverage =96%, HitCoverage=27%, E-value=2e-31, Identity=61%"; Hit description =putative protein family member of ancient origin (43.6 kD) (5C607) [Caenorhabditis elegans] gb|AAN84819.1
  Coding regions on vcDNA: vcDNA=SeqID_88557; Strand=+; Position=35-370
MSTDRYDIVLYGASGFTGQHVLESFVKNGHLDQFNFAVAGRSEKKLKQTLEDIEFITGKVLTKIPIIIADSSDAQQLAEMAKQAKVIVNVVGPYRLYGEAVVKAAVENGASH

SEQ ID NO: 162135 - protein, 113 aa, Heterodera glycines
  Coding regions on vcDNA: vcDNA=SeqID_88558; Strand=+; Position=88-426
MSAESPTTSQRRARSRKTKKRAASAGETKPLRRSARIAAQKAAKEKAAKQKARDGSTASTKSAGRGRPSRSPKKSGPKSRRSPAGRGGGRSQTPRKKKQPLKKKAPGPRSRTP

SEQ ID NO: 162136 - protein, 117 aa, Heterodera glycines
  Homolog annotation: Hit_ID=NP_491557.1; Match level="QueryCoverage =94%, HitCoverage=31%, E-value=3e-09, Identity=34%"; Hit description =DeHydrogenase, Short chain (dhs-1) [Caenorhabditis elegans] gb|AAB37640.1| Dehydrogenases, short chain pr
  Coding regions on vcDNA: vcDNA=SeqID_88559; Strand=+; Position=2-352
AAKLLLLLDLHCTGANTGLGLHFVKSLYASGTYSAIVLACRSEQRAKSAIEQICCGQSSPAENGNGTQTKLEFAKLDLTCNDSVRTFVSQLDERPYQKGSLRLLVNNAGIMGHPFQL

SEQ ID NO: 162137 - protein, 75 aa, Heterodera glycines
  Homolog annotation: Hit_ID=NP_767895.1; Match level="QueryCoverage =96%, HitCoverage=50%, E-value=3e-23, Identity=72%"; Hit description =hypothetical protein blr1255 [Bradyrhizobium japonicum USDA 110] dbj|BAC46520.1| blr1255 [Bradyrhizobium
  Coding regions on vcDNA: vcDNA=SeqID_88560; Strand=+; Position=1-228
GRLISALRFDRVLACKSRNIDLSASGAELDLIGIEFSPTDPPGGSALILFAGGGALRLDLECLECELADLGRDRG

SEQ ID NO: 162138 - protein, 87 aa, Heterodera glycines
  Coding regions on vcDNA: vcDNA=SeqID_88561; Strand=+; Position=3-263
PPSLKMETGPLKLLRKKFSIEWRQIEAIEKMKKKGSPNVRVFAFEDPSFKPGCRKFVVSGLRNFYLWYRECPIRARHFYELIIERMP

SEQ ID NO: 162139 - protein, 124 aa, Heterodera glycines
  Coding regions on vcDNA: vcDNA=SeqID_88562; Strand=+; Position=2-376
AAKAKMTSNSTDGWGCNNSGWGQSQAKMTSNSAADGWGCNNSALRPNQAKMTSNSTDGWGCNNNGWAPSQAKMTNSTDGSGCNNSVRGPREFSRSFSGRPGFNRQPVVFFCVVNFGTSSYFFSL

SEQ ID NO: 162140 - protein, 89 aa, Heterodera glycines
  Homolog annotation: Hit_ID=XP_315798.1; Match level="QueryCoverage =100%, HitCoverage=24%, E-value=4e-33, Identity=76%"; Hit description= ENSANGP00000018739 [Anopheles gambiae]
  Gene Ontology: Biological process=anion transport
  Coding regions on vcDNA: vcDNA=SeqID_88563; Strand=+; Position=16-282
MSDEGQQLLESTLRNVLDQQSLRWIFVGGKGGVGKTTCSCSLAVQLAKYRRNVLIISTDPAHNISDAFNQKFTRSPTKVNGFDNLFAME

SEQ ID NO: 162141 - protein, 56 aa, Heterodera glycines
  Homolog annotation: Hit_ID=BAD02446.1; Match level="QueryCoverage =92%, HitCoverage=42%, E-value=5e-09, Identity=53%"; Hit description =histone 2B [Drosophila sechellia]
  Coding regions on vcDNA: vcDNA=SeqID_88564; Strand=-; Position=1-168
MARRRRKKEPRKVSYKLYVRRVLKEVHPGKEISMRALNIMNSFVIDALDRIATEAA

SEQ ID NO: 162142 - protein, 88 aa, Heterodera glycines
  Homolog annotation: Hit_ID=AAO51573.1; Match level="QueryCoverage =95%, HitCoverage=9%, E-value=3e-11, Identity=37%"; Hit description =similar to Dictyostelium discoideum (Slime mold). Adenylyl cyclase
  Gene Ontology: Mol. function=transcription co-activator activity; Cellular component=nucleus
  Coding regions on vcDNA: vcDNA=SeqID_88565; Strand=-; Position=3-266
AERRKEQRKKEAREAEQQQAAQAQTQKAKEQRQTQQPQKPREVEQQQTPQTQQQPKKAKEDEQQQQAAQSQQQPQKSKYVPPSMRKWR

SEQ ID NO: 162143 - protein, 57 aa, Heterodera glycines
  misc_feature (42)..(42): Xaa can be any naturally occurring amino acid
  Homolog annotation: Hit_ID=XP_310658.1; Match level="QueryCoverage =92%, HitCoverage=39%, E-value=1e-09, Identity=64%"; Hit description =ENSANGP00000020734 [Anopheles gambiae]
  Coding regions on vcDNA: vcDNA=SeqID_88566; Strand=-; Position=1-171
MGSARLGEAQRKQLLEPLLKEGGWQMEQGRDAIKKSFTFRDXNEAFGFMTRVALKAA

SEQ ID NO: 162144 - protein, 43 aa, Heterodera glycines
  Coding regions on vcDNA: vcDNA=SeqID_88567; Strand=-; Position=1-129
SSLSLHLLTGRSLFRFRPSIRRSLLHLLTCRRSDPGTSPALAA

SEQ ID NO: 162145 - protein, 113 aa, Heterodera glycines; identical to SEQ ID NO: 162135
  Coding regions on vcDNA: vcDNA=SeqID_88568; Strand=+; Position=77-415

SEQ ID NO: 162146 - protein, 60 aa, Heterodera glycines
  Homolog annotation: Hit_ID=CAE73343.1; Match level="QueryCoverage =100%, HitCoverage=12%, E-value=1e-19, Identity=75%"; Hit description= Hypothetical protein CBG20774 [Caenorhabditis briggsae]
  Gene Ontology: Mol. function=succinate-semialdehyde dehydrogenase (NAD(P)+) activity; Biological process=aminobutyrate catabolism
  Coding regions on vcDNA: vcDNA=SeqID_88569; Strand=+; Position=2-181
AALAVGCTVVVKPAEDTPLTALALAQTSQEAGVPSGVFNVIPSDREETAEVSKFLCESQD

SEQ ID NO: 162147 - protein, 85 aa, Heterodera glycines
  Coding regions on vcDNA: vcDNA=SeqID_88570; Strand=-; Position=1-255
ELSNALLLTRDGVKQSSSSLSWSLFGWCPAYDVHSHFGQIVDGLVYRRQKQGYGVIQKTEWRQNITKEGKGVGHQPTEGRNILAA

SEQ ID NO: 162148 - protein, 37 aa, Heterodera glycines
  Coding regions on vcDNA: vcDNA=SeqID_88571; Strand=+; Position=1-114
GRQEGKTNFFEKRVSEYQKMGVISTEEQREFRLDADF

SEQ ID NO: 162149 - protein, 33 aa, Heterodera glycines
  Coding regions on vcDNA: vcDNA=SeqID_88572; Strand=-; Position=0-98
KAQAQNSATKRTNRAIRDITKANLEFYLKPWRP

SEQ ID NO: 162150 - protein, 37 aa, Heterodera glycines
  Coding regions on vcDNA: vcDNA=SeqID_88573; Strand=+; Position=65-175
MPRYDATDDLSGAEYLASIYGTEKDKVNCSFFLRLAH

SEQ ID NO: 162151 - protein, 113 aa, Heterodera glycines; identical to SEQ ID NO: 162135
  Coding regions on vcDNA: vcDNA=SeqID_88574; Strand=+; Position=80-418

SEQ ID NO: 162152 - protein, 44 aa, Heterodera glycines
  Homolog annotation: Hit_ID=NP_496361.1; Match level="QueryCoverage =100%, HitCoverage=14%, E-value=4e-12, Identity=68%"; Hit description= COLlagen structural gene (30.9 kD) (col-81) [Caenorhabditis elegans] emb|CAA90187.1| Hypothetical protei
  Gene Ontology: Mol. function=structural constituent of cuticle; Cellular component=extracellular; Biological process=cuticle biosynthesis (sensu Nematoda)
  Coding regions on vcDNA: vcDNA=SeqID_88575; Strand=+; Position=1-135
GRQDGGSPGQPGNPGGNGEQGQPGAQGSSGQCYHCPPPRTAPGY

SEQ ID NO: 162153 - protein, 66 aa, Heterodera glycines
  Coding regions on vcDNA: vcDNA=SeqID_88576; Strand=-; Position=13-213
VHTLSRRAREYLTDRARPRPVPAPLSLQFIVFSSLKCQIEQTHLNSEETEEEGAVHFISKTECISN

SEQ ID NO: 162154 - protein, 113 aa, Heterodera glycines; identical to SEQ ID NO: 162135
  Coding regions on vcDNA: vcDNA=SeqID_88577; Strand=+; Position=79-417

SEQ ID NO: 162155 - protein, 76 aa, Heterodera glycines
  Coding regions on vcDNA: vcDNA=SeqID_88578; Strand=+; Position=62-289
MFPPNIGLASNMMVNSPYMINAIQPNLPGIANQRTINIDGIPRDIRFYDEVTIAFMKENGGEPMEIGFHSGERLIL

SEQ ID NO: 162156 - protein, 70 aa, Heterodera glycines; identical to SEQ ID NO: 162114
  Coding regions on vcDNA: vcDNA=SeqID_88579; Strand=+; Position=3-212

SEQ ID NO: 162157 - protein, 169 aa, Heterodera glycines
  Homolog annotation: Hit_ID=CAE72026.1; Match level="QueryCoverage =82%, HitCoverage=91%, E-value=1e-45, Identity=49%"; Hit description =Hypothetical protein CBG19108 [Caenorhabditis briggsae]
  Coding regions on vcDNA: vcDNA=SeqID_88580; Strand=+; Position=24-530
MICGQSLLLFLPLFVFLQHFDSSAGGEQRSWKDEDGVEVEIIKKIPDSKCKVKSEAGDELEQFFKLTDKEGKLIGSNFGQKPYKFVLGHGQAIRPMDNAMRGMCVGEQRRVTIPAEALAENERPQGVGEDQAMHYFVELKSIFRAVPGEKWMEDDGLSIEVTHKIEEDK

SEQ ID NO: 162158 - protein, 135 aa, Heterodera glycines
  Homolog annotation: Hit_ID=NP_872098.1; Match level="QueryCoverage =39%, HitCoverage=31%, E-value=4e-09, Identity=39%"; Hit description =putative prenylated protein (4O63) [Caenorhabditis elegans] emb|CAD56257.1| Hypothetical protein Y67H2A.4
  Coding regions on vcDNA: vcDNA=SeqID_88581; Strand=+; Position=49-453
MSYAYVLQPHKNSVCLMGWPTTHSVIIRQRHRAETEQARIYWPGSGLRTKSEIEEEFKCARDGKYPEENLEDWSITGKRSLTQKALFHYTDRRAGKGYSDFATTLYYGRPYIWPPVREINRWHFFICVTFALVIL

SEQ ID NO: 162159 - protein, 64 aa, Heterodera glycines
  Coding regions on vcDNA: vcDNA=SeqID_88582; Strand=-; Position=1-192
DDFGTCKAMIGQLSMLFLGKCGDEHKFRQQLPPNYDHLQLRFRVGPLYFGSLLPALVAYAFLAA

SEQ ID NO: 162160 - protein, 66 aa, Heterodera glycines
  Homolog annotation: Hit_ID=CAE62787.1; Match level="QueryCoverage =96%, HitCoverage=12%, E-value=2e-19, Identity=65%"; Hit description =Hypothetical protein CBG06960 [Caenorhabditis briggsae]
  Coding regions on vcDNA: vcDNA=SeqID_88583; Strand=+; Position=3-200
PPSNQCTAMVEADILCPTKHFPELAWARELPKADSHYVTNVEFTEKDELGMEVRRNGRPMPVEYLL

SEQ ID NO: 162161 - protein, 45 aa, Heterodera glycines
  Homolog annotation: Hit_ID=CAE74724.1; Match level="QueryCoverage =100%, HitCoverage=14%, E-value=2e-13, Identity=71%"; Hit description= Hypothetical protein CBG22542 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88584; Strand=+; Position=1-138
GRQGDGGNPGAPGNPGGVGEPGQLGAQGASGQCYHCPPPRTAPGY

SEQ ID NO: 162162 - protein, 80 aa, Heterodera glycines
  Coding regions on vcDNA: vcDNA=SeqID_88585; Strand=-; Position=0-239
LLIVFFLFFGHFHPLWFVPWKTSIFLAFIFPADAQHFVRFANWPIASGLCQCHVRKAAQSEQSESENEEKTERKHFAWRP

SEQ ID NO: 162163 - protein, 70 aa, Heterodera glycines; identical to SEQ ID NO: 162128
  Coding regions on vcDNA: vcDNA=SeqID_88586; Strand=+; Position=2-214

SEQ ID NO: 162164 - protein, 56 aa, Heterodera glycines; identical to SEQ ID NO: 161876
  Coding regions on vcDNA: vcDNA=SeqID_88587; Strand=+; Position=303-473

SEQ ID NO: 162165 - protein, 159 aa, Heterodera glycines
  misc_feature (53)..(53): Xaa can be any naturally occurring amino acid
  Homolog annotation: Hit_ID=CAE60160.1; Match level="QueryCoverage =84%, HitCoverage=66%, E-value=7e-24, Identity=40%"; Hit description =Hypothetical protein CBG03712 [Caenorhabditis briggsae]
  Coding regions on vcDNA: vcDNA=SeqID_88588; Strand=+; Position=15-491
MEPSLLRYFCPRQFRRLATTSFCTLSPRHRIIAEGGMPPLEYEFEREKWAMGXRFGRYGLRGGVDISKLWLTVEEIEEVKAVRRFRTAKEAQHIAKMESEKEQIRRKNRLDRIERNWATYDAQLAEFNQREVQTEAEKETADQELKRQVEEVRNYFGYW

SEQ ID NO: 162166 - protein, 86 aa, Heterodera glycines
  Homolog annotation: Hit_ID=NP_501793.1; Match level="QueryCoverage =81%, HitCoverage=13%, E-value=6e-11, Identity=47%"; Hit description =SH2 motif and protein kinase family member (kin-5) [Caenorhabditis elegans] emb|CAA93289.1| Hypothetical
  Coding regions on vcDNA: vcDNA=SeqID_88589; Strand=+; Position=91-348
MNPDERQMWRLPYHHGLLPREDVTELLPNDGDFLVRTTEETSGTERVFALSVNVGGLVNHVIFRRHNGMYTVDKNSDKVFRTIERF

SEQ ID NO: 162167 - protein, 89 aa, Heterodera glycines
  Coding regions on vcDNA: vcDNA=SeqID_88590; Strand=-; Position=0-266
IFNQMACSVRLDHHILLPSHFFPKFPPHGPPPPIPPPYGEPYIPRLARRAAGSLSTLSSCAVISAEKAHKTTKRKAMIKRRGDILALRP

SEQ ID NO: 162168 - protein, 96 aa, Heterodera glycines
  Homolog annotation: Hit_ID=NP_741756.1; Match level="QueryCoverage =86%, HitCoverage=24%, E-value=9e-14, Identity=46%"; Hit description =endophilin B2 (40.8 kD) (XE420) [Caenorhabditis elegans] gb|AAB52640.1| Endophilin-related protein protei
  Coding regions on vcDNA: vcDNA=SeqID_88591; Strand=+; Position=90-377
MDALKRLASRARQKSAEIILSAEKTEIGAELEQLLTKTDKTEEHMKKLVHAIEVYLQPNPAVRALDPRKDKSGRQNTLDGLGEAMKEAASKAVGAE

SEQ ID NO: 162169 - protein, 103 aa, Heterodera glycines
  Homolog annotation: Hit_ID=AAH64201.1; Match level="QueryCoverage =98%, HitCoverage=33%, E-value=1e-21, Identity=55%"; Hit description =Hypothetical protein MGC76089 [Xenopus tropicalis] ref|NP_989370.1| hypothetical protein MGC76089 [Xenopus
  Coding regions on vcDNA: vcDNA=SeqID_88592; Strand=+; Position=3-311
PPRDNGSKKCQLAYDQNQCHLELISLANGEPLDRKTAFGRIAFATATENLRPLEEKVGTKRIHSPLISLGTPGKATVWVVILKDPNEHEICFVGDEGFQELSK

SEQ ID NO: 162170 - protein, 246 aa, Heterodera glycines
  Homolog annotation: Hit_ID=CAE59655.1; Match level="QueryCoverage =98%, HitCoverage=63%, E-value=1e-112, Identity=68%"; Hit description= Hypothetical protein CBG03070 [Caenorhabditis briggsae]
  Gene Ontology: Mol. function=ATPase activity; Cellular component =cytosol; Biological process=microtubule cytoskeleton organization and biogenesis
  Coding regions on vcDNA: vcDNA=SeqID_88593; Strand=+; Position=1-738
GRQASIVIASDTCPPEKILMNRVVRQNLRVKLGDVVSVSSASNTPNGLRIHVLPIDDTVEGLTGNLFEVFLKPYFLEAYRPVYKGDTFTVNAAMRTVEFKVIETDPAPACIVVPTTIIHCEGEPIKREDEENNLNDVGYDDIGGMRKQLAQIKEMVELPLRHPMLFKSIGIKPPRGMLLFGPPGTGKTLVARAVANETGAFFFLLNGPEIMSKLAGESESNLRKAFSECEKNSPAILFIDEIDAIA

SEQ ID NO: 162171 - protein, 225 aa, Heterodera glycines
  Coding regions on vcDNA: vcDNA=SeqID_88594; Strand=+; Position=1-675
GRSPVVFGGRECARIAGDATAKFDVTTLADRANGGGHSTGRSQFNVHILKPMKSFPIQNEFCSAPKALAGGVFRWRPLLSRPPLPRPFRLRWNGMQCPTVPLHPQSLRLDSVRRILLTNVPPNGNGWPSRCPTNGRPPKWPIPTKDKGASAKKWTFLRWSALHRWHQQNHRQRLRFCRSQGIRKGSRFSSSEYVSSLCLLHLSVQWHPNAAPTRHQHSTRESRRS

SEQ ID NO: 162172 - protein, 54 aa, Heterodera glycines
  Coding regions on vcDNA: vcDNA=SeqID_88595; Strand=+; Position=84-245
YPFLAQLSSVLLGVSRFVSTVPNWIHGHRVECKTKDWIELTNPATNEVVGLVPE

SEQ ID NO: 162173 - protein, 87 aa, Heterodera glycines
  misc_feature (70)..(70): Xaa can be any naturally occurring amino acid
  Homolog annotation: Hit_ID=NP_520914.1; Match level="QueryCoverage =86%, HitCoverage=54%, E-value=4e-10, Identity=53%"; Hit description =PROBABLE HISTONE H1 PROTEIN [Ralstonia solanacearum GMI1000] emb|CAD16500.1| PROBABLE HISTONE H1 PROTEIN
  Coding regions on vcDNA: vcDNA=SeqID_88596; Strand=+; Position=1-260
GRQGHAATLAKASPAKKKSPIKKAKKAAPPAPAAVPKKTSPKVPAPAAVKKVAVKKPTPKKAPKAIARKXAAPPPPAPAAKKAPVPS

SEQ ID NO: 162174 - protein, 70 aa, Heterodera glycines; identical to SEQ ID NO: 162114
  Coding regions on vcDNA: vcDNA=SeqID_88597; Strand=+; Position=3-212

SEQ ID NO: 162175 - protein, 60 aa, Heterodera glycines
  Coding regions on vcDNA: vcDNA=SeqID_88598; Strand=+; Position=1-180
GRQGGFRMYYPKMIRLPSELISELASALPLDPRWAVIRVSSAFDFFVYAKQIIYRKIKLG

SEQ ID NO: 162176 - protein, 102 aa, Heterodera glycines
  Coding regions on vcDNA: vcDNA=SeqID_88599; Strand=+; Position=46-351
MASSGDQSLRDALECPVCKDLFTEPKQLDCGHTYCLNCVNGLEKVPNIVHRIVGDDYFDTLGVGPLSTLVQSVQNNVQCPQCRKMCLVPDSGLSTNYAIKDM

SEQ ID NO: 162177 - protein, 88 aa, Heterodera glycines
  Homolog annotation: Hit_ID=CAA65506.1; Match level="QueryCoverage =96%, HitCoverage=67%, E-value=1e-27, Identity=50%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88600; Strand=+; Position=3-269
PPSGKLTQGPPVVGPPGPSGPPGQPGQPGENGQPGQPGNPGPQGYPGDGGSPGQPGNPGGNGEQGQPGAQGSSGQCYHCPPPRTAPGY

SEQ ID NO: 162178 - protein, 36 aa, Heterodera glycines
  Coding regions on vcDNA: vcDNA=SeqID_88601; Strand=-; Position=130-240
PYFLLFTDRCLLPLLQSYTVMESSADEVTSKELQIN

SEQ ID NO: 162179 - protein, 169 aa, Heterodera glycines
  Homolog annotation: Hit_ID=NP_498265.1; Match level="QueryCoverage =89%, HitCoverage=31%, E-value=4e-37, Identity=50%"; Hit description =aspartyl aminopeptidase (51.2 kD) (3G952) [Caenorhabditis elegans] gb|AAC46643.1| Hypothetical protein F0
  Gene Ontology: Mol. function=aminopeptidase activity; Cellular component=cytoplasm; Biological process=proteolysis and peptidolysis
  Coding regions on vcDNA: vcDNA=SeqID_88602; Strand=+; Position=69-575
MSSHSSSVVVDNCCPPSQMTTSSSPAAFRSSALAFLQFLNKSVTPFHAVESVEAILKSANFVQKSEYDKLQIQPKDRFYVKKSETSIFAFAAGGAFKPSEAGVSIVVAHTDSPCLRIKPVSKKTSEQFLQVGVSLYGGGLWRTWFDRDLSTAGQVVFRESADAPIRHKL

SEQ ID NO: 162180 - protein, 77 aa, Heterodera glycines
  Coding regions on vcDNA: vcDNA=SeqID_88603; Strand=-; Position=17-250
PMSSLFSTIFIQCSPIRTLICPLRQWMAASLLLNHLPMLRDNICGLSFANLAWSFPPPAHPSPIVHHFVLSKSQPRS

SEQ ID NO: 162181 - protein, 53 aa, Heterodera glycines; identical to SEQ ID NO: 162090
  Homolog annotation: Hit_ID=AAL78213.1; Match level="QueryCoverage =100%, HitCoverage=20%, E-value=2e-15, Identity=75%"; Hit description= probable protein kinase Hgg-20 [Heterodera glycines]
  Coding regions on vcDNA: vcDNA=SeqID_88604; Strand=+; Position=49-207

SEQ ID NO: 162182 - protein, 66 aa, Heterodera glycines
  Coding regions on vcDNA: vcDNA=SeqID_88605; Strand=+; Position=2-199
AATIMVATTIMCGCHDDSHQNHADEHHICHRAPPNYPICQKCLCEQVPRKESTKVSIFFVNMIKVG

SEQ ID NO: 162183 - protein, 97 aa, Heterodera glycines
  misc_feature (54)..(54): Xaa can be any naturally occurring amino acid
  misc_feature (83)..(83): Xaa can be any naturally occurring amino acid
  Homolog annotation: Hit_ID=CAE63538.1; Match level="QueryCoverage =94%, HitCoverage=26%, E-value=2e-16, Identity=48%"; Hit description =Hypothetical protein CBG08019 [Caenorhabditis briggsae]
  Coding regions on vcDNA: vcDNA=SeqID_88606; Strand=+; Position=286-575
RNSQCVYNLNAPRQESDARNLPADPHCPTMDGLATLPAMSTHMFGGESRIGIAXGACANVLLHYPMIHHNLLDALLLVNASSXKAVWVEWAYQRWNE

SEQ ID NO: 162184 - protein, 117 aa, Heterodera glycines
  Coding regions on vcDNA: vcDNA=SeqID_88607; Strand=+; Position=1-351
GRQASSAAGFALYRCHTGLGLHFVKSLYASGTYSAIVLACRSEQRAKSAIEQICCGQSSPAENGNGTQTKLEFAKLDLTCNDSVRTFVSQLDERPYQKGSLRLLVNNAGIMGHPFQL

SEQ ID NO: 162185 - protein, 163 aa, Heterodera glycines
  Homolog annotation: Hit_ID=CAE68967.1; Match level="QueryCoverage =96%, HitCoverage=20%, E-value=9e-30, Identity=43%"; Hit description =Hypothetical protein CBG14947 [Caenorhabditis briggsae]
  Gene Ontology: Mol. function=chaperone activity; Cellular component =mitochondrion; Biological process=embryonic cleavage
  Coding regions on vcDNA: vcDNA=SeqID_88608; Strand=+; Position=204-692
KPIFFSVGQPKSSFTGGNASGGSGGMPPNPFQGMSNWQKMAVAAAVIVGLQYFINRLAYTEISWKQFYTDFLEKNNVERLEVIDNKWVRVITRDPTQTVFYFNIGSVDTFERSLTQAQQHLGMETSQQQVPVLYKSESDIVGMIPHMVNFLITGIFLFYMFRM

SEQ ID NO: 162186 - protein, 54 aa, Heterodera glycines
  Homolog annotation: Hit_ID=CAB62547.1; Match level="QueryCoverage =100%, HitCoverage=16%, E-value=2e-22, Identity=100%"; Hit description=LacIq protein [Shuttle vector pXMJ19]
  Coding regions on vcDNA: vcDNA=SeqID_88609; Strand=-; Position=1-162
RPEESQFRVVNVKPVTLYDVAEYAGVSYQTVSRVVNQASHVSAKTREKVEAAMA

SEQ ID NO: 162187 - protein, 67 aa, Heterodera glycines
  misc_feature (56)..(56): Xaa can be any naturally occurring amino acid
  Homolog annotation: Hit_ID=NP_503032.1; Match level="QueryCoverage =97%, HitCoverage=46%, E-value=4e-13, Identity=53%"; Hit description =NADH:ubiquinone oxidoreductase 17.2 kD subunit (15.8 kD) (4S44) [Caenorhabditis elegans] emb|CAB55150.2|
  Coding regions on vcDNA: vcDNA=SeqID_88610; Strand=+; Position=1-202
GRQASLRGFEPPPDVEVPSEPPVEWRAWLNKSRRFPPSEEEIQLNLLKQQAQLVQXTETEKKAPMIV

SEQ ID NO: 162188 - protein, 54 aa, Heterodera glycines
  Coding regions on vcDNA: vcDNA=SeqID_88611; Strand=-; Position=1-162
EVRLNSSNIGTESDLAVFAFLAIGKPQIVEAEHGTDQQQNGEKTKRGHFVILAA

SEQ ID NO: 162189 - protein, 57 aa, Heterodera glycines
  Coding regions on vcDNA: vcDNA=SeqID_88612; Strand=+; Position=3-173
PPSKMHFLFLSVFSLFLAKHCSNAIPIGAGNQRDVRRSMVIDLLNANQEFDQLRSQL

SEQ ID NO: 162190 - protein, 84 aa, Heterodera glycines
  Homolog annotation: Hit_ID=CAE62810.1; Match level="QueryCoverage =94%, HitCoverage=57%, E-value=8e-27, Identity=50%"; Hit description =Hypothetical protein CBG06986 [Caenorhabditis briggsae]
  Gene Ontology: Mol. function=structural constituent of cuticle; Cellular component=extracellular; Biological process=cuticle biosynthesis (sensu Nematoda)
  Coding regions on vcDNA: vcDNA=SeqID_88613; Strand=+; Position=2-256
AAKQAPPSLGPPGPAGPPGQPGQPGENGQPGQPGNPGPQGYPGDGGSPGQPGNPGGSGEPGQPGAQGSSGQCYHCPPPRTAPGY

SEQ ID NO: 162191 - protein, 102 aa, Heterodera glycines
  Homolog annotation: Hit_ID=NP_492370.1; Match level="QueryCoverage =100%, HitCoverage=96%, E-value=6e-21, Identity=45%"; Hit description= transport to INner mitochondrial membrane (yeast TIM) TIN-13, TIMeless related (11.7 kD) (tin-13) [Caeno
  Coding regions on vcDNA: vcDNA=SeqID_88614; Strand=+; Position=41-349
MDIDELKKMSPEQQNKLLEDVRRQSDTQSVLSLLASFSEKCSQRCITSPGNTLSGGEKQCLQRCVDRWLDSFSIVSTAFAAKAQQMAGMGSFGSPDGGPSFS

SEQ ID NO: 162192 - protein, 53 aa, Heterodera glycines
  Homolog annotation: Hit_ID=NP_500767.1; Match level="QueryCoverage =77%, HitCoverage=14%, E-value=2e-09, Identity=76%"; Hit description =MSP-domain protein like family member (4G39) [Caenorhabditis elegans] gb|AAC26930.1| Hypothetical protein
  Coding regions on vcDNA: vcDNA=SeqID_88615; Strand=+; Position=15-173
MEETPISLLRMAREAEKEQKEEKKEEKKEEKPEEGKKEEKKEEKKEEGKQEEK

SEQ ID NO: 162193 - protein, 171 aa, Heterodera glycines
  Coding regions on vcDNA: vcDNA=SeqID_88616; Strand=+; Position=25-540
MPRRVYGIYRSASTARMPSESRGTEFAAARSASLPRSRSNIDIPAFGCAGANYMPFTGFSAVKSDIYRVNPLYSLRNYMSDKYYHFSHRYKRTQFHRHYYHGQIDQYPYEWNFEGRGTATGQFYFARRMKFNPWQFGWNRFYDPYRRYYDPYHDAYIKLYDYRPRLIDGIY

SEQ ID NO: 162194 - protein, 40 aa, Heterodera glycines
  Coding regions on vcDNA: vcDNA=SeqID_88617; Strand=-; Position=12-134
INRSVNVTFSPQNAHSSSTGSAPVPNCILKSFWSNLIKYI

SEQ ID NO: 162195 - protein, 62 aa, Heterodera glycines
  Coding regions on vcDNA: vcDNA=SeqID_88618; Strand=-; Position=1-186
ANLKMKFTLLSILFLALVHIGISGKYDKSDEHDGKYGARPPASGGYHHDNNNYGGGNHYVAA

SEQ ID NO: 162196 - protein, 1151 aa, Heterodera glycines; identical to SEQ ID NO: 158700
  Homolog annotation: Hit_ID=AAC72366.2; Match level="QueryCoverage =100%, HitCoverage=100%, E-value=0.0, Identity=100%"; Hit description= guanylyl cyclase [Heterodera glycines]
  Gene Ontology: Mol. function=protein tyrosine kinase activity; Cellular component=mitochondrial inner membrane; Biological process =transport
  Coding regions on vcDNA: vcDNA=SeqID_88619; Strand=+; Position=78-3533

SEQ ID NO: 162197 - protein, 593 aa, Heterodera glycines
  misc_feature (239)..(239): Xaa can be any naturally occurring amino acid
  Homolog annotation: Hit_ID=AAR11446.1; Match level="QueryCoverage =100%, HitCoverage=100%, E-value=0.0, Identity=97%"; Hit description =matrix metalloproteinase [Heterodera glycines] gb|AAR11445.1| matrix metalloproteinase [Heterodera glycine
  Gene Ontology: Mol. function=stromelysin 1 activity; Cellular component=extracellular space; Biological process=proteolysis and peptidolysis
  Coding regions on vcDNA: vcDNA=SeqID_88620; Strand=+; Position=1-5442
MHFHKLFLLLPILLLHLQQSQACFSRGNSGEPSDGNPEAQGLKSENDVRTVQLKKEKQTDETEEEKDEESSAEQKLPSELDPEFVKTYLREFGHLKHNENGLSHGVKHFQRFLGYRQTGNVDLATLQKMSWKRCANSDEGYTAQDPSQLWERSTLFWNLNASHPKQFTHGETKELIAQAFRAWEIVIKIDFLETNNADNAQIIFTFESDGAKKEKSKNGEEEKEKEGKTGKSLSDLISXDRLASSPPVARIVLNADENWSTFQTQEEGKIDIFVVLLHEIGHALGLRHSGDEHSVMFPMFERSVGEHLPVISNDDVEHLRALYEGDLTDRPTLAADLRPTRPVPVQGGTHSTDSYGGEGATTAAGKEAEKCPHSITTAANVNSETLFLFKDGYAWHLSRGKLVGGPYKISEFFPDGPEKVDVAFSSGRLTVLVKSRMLFGYEFDQKTAQFTRDHRYPRELHSRILFYPEGAFPIVNGSVILFKDDVFATYNVESNTPHLFGSMSEFFPGLPQNLRAGFAATPDFTTYHMLTNDYAFLYDVRVARTVSSQSIGQFVGCEGNKLMPPGPPMPHLFFPYQPSPPQNPRFPQQNYGK

SEQ ID NO: 162198 - protein, 121 aa, Heterodera glycines; identical to SEQ ID NO: 158713
  Coding regions on vcDNA: vcDNA=SeqID_88621; Strand=-; Position=147-512

SEQ ID NO: 162199 - protein, 110 aa, Heterodera glycines
  Coding regions on vcDNA: vcDNA=SeqID_88622; Strand=-; Position=46-378
QSVCYVPATTTAQRRTDASTAVRSPHERASHIGAANQPSEAARHRHIATQQPYTGFHMCSTERYTTAPTYGSTPKAWLVRQLPRNVGQRPQVISNDLCPSADGGIWWCQR

SEQ ID NO: 162200 - protein, 319 aa, Heterodera glycines; identical to SEQ ID NO: 158743
  Homolog annotation: Hit_ID=AAC48326.1; Match level="QueryCoverage =100%, HitCoverage=100%, E-value=0.0, Identity=100%"; Hit description= beta-1,4-endoglucanase-2 precursor [Heterodera glycines]
  Coding regions on vcDNA: vcDNA=SeqID_88623; Strand=+; Position=64-1023

SEQ ID NO: 162201 - protein, 476 aa, Heterodera glycines; identical to SEQ ID NO: 158742
  Homolog annotation: Hit_ID=AAC48327.1; Match level="QueryCoverage =100%, HitCoverage=100%, E-value=0.0, Identity=100%"; Hit description= beta-1,4-endoglucanase-1 precursor [Heterodera glycines] gb|AAC15707.1| beta-1,4-endoglucanase-1 precurso
  Gene Ontology: Mol. function=glucosidase activity; Cellular component= cell wall (sensu Fungi); Biological process=cell wall organization and biogenesis
  Coding regions on vcDNA: vcDNA=SeqID_88624; Strand=+; Position=4-1434

SEQ ID NO: 162202 - protein, 272 aa, Heterodera glycines
  Homolog annotation: Hit_ID=AAO19577.2; Match level="QueryCoverage =100%, HitCoverage=100%, E-value=1e-153, Identity=100%"; Hit description=chorismate mutase [Heterodera glycines]
  Coding regions on vcDNA: vcDNA=SeqID_88625; Strand=+; Position=1-819
MNSSVVSFSLLLFGLFTIRTAKSQCEKHCTKSKPMGQCNEAEEVILRNSDCAFMKKTETAFEFVVGMNGQTEDKTAPGANANGAFLCCKATQGTATLFIVGVANKRLMLAKDVVNYKFHQNISIDDFEREKQVLESVSAQGQKAGIGDNYGEKFFQDQMDANKMIQKGYVKLWTANKSLPPQNVPDLQKDTRPKVTAATEEMILALKVFQQFRKNKNCWASVEKELLKSQSFLSLAEPNGKDAMRKAAVRLCAKMEAKIEAQIDETAKKLLA

SEQ ID NO: 162203 - protein, 125 aa, Heterodera glycines
  Coding regions on vcDNA: vcDNA=SeqID_88626; Strand=-; Position=215-592
DRERNHHPQSVCYVPATTTAQRRTDASTAVRSPHERASHIGAANRAKRAARHRHIATQQPYTGFHMCSTERYTTAPTYGSTPKAWHVRQLPRNVGQTSTSHLERPVPISGRGHLVVPTLAQQDSR

SEQ ID NO: 162204 - protein, 177 aa, Heterodera glycines
  misc_feature (43)..(43): Xaa can be any naturally occurring amino acid
  Homolog annotation: Hit_ID=CAE61732.1; Match level="QueryCoverage =97%, HitCoverage=45%, E-value=8e-28, Identity=40%"; Hit description =Hypothetical protein CBG05683 [Caenorhabditis briggsae]
  Gene Ontology: Mol. function=diacylglycerol O-acyltransferase activity; Cellular component=integral to membrane; Biological process=triacylglycerol biosynthesis
  Coding regions on vcDNA: vcDNA=SeqID_88627; Strand=+; Position=1-535
RPGGGFAVGIVPGGAAEALESFPGMNRLITSRRKGFVKLAIKXGVAIVPVFHLGETDVYEQKESREGSTLKKTQNLLKRLTRVSFPLAYGQSFIAALLPEETAQKLPRWLRVGIFPYRRKIVTIVGEPMEIEENANCEDEQTVDRIHAEYCQRLRKLFDENKVKLGGLSEDSEIEFV

SEQ ID NO: 162205 - protein, 229 aa, Heterodera glycines
  Homolog annotation: Hit_ID=AAD53409.1; Match level="QueryCoverage =100%, HitCoverage=99%, E-value=1e-123, Identity=100%"; Hit description=unknown [Heterodera glycines]
  Coding regions on vcDNA: vcDNA=SeqID_88628; Strand=+; Position=1-687
VQTERVLDQAVRQTLSLSDASRQGLVDSALADILMAPCGLSEGGTEVSLIRAVSKGLVDASKGVVVDPRFQRELSVREAYDRGMFTSLRSAMHLAALLDVHPSLMTPVKKKPYSKKRIQRPGQPALAEDQVKVTLAEAMRQGLIDARTQRFRQGNQEMSLDDALHRGLIDPQSEWIVPSRASGIGPTIEERTQETVTETGQQLAPKIFPDKELQESVNTVKRVRRTETS

SEQ ID NO: 162206 - protein, 302 aa, Heterodera glycines
  Homolog annotation: Hit_ID=AAC48326.1; Match level="QueryCoverage =100%, HitCoverage=94%, E-value=1e-177, Identity=99%"; Hit description=beta-1,4-endoglucanase-2 precursor [Heterodera glycines]
  Coding regions on vcDNA: vcDNA=SeqID_88629; Strand=+; Position=2-910
AVAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPIKGFSNLMYTLHFYASSHFVDGLGNKLKTAVNKGLPVFVTEYGTCEASSNGNLNSGSMSSWWSLLDQLKISYVNWSITDKSEACAALTGGTSAANVGTSSRWTQSGNMVASQHKKKSTGVKC

SEQ ID NO: 162207 - protein, 448 aa, Heterodera glycines
  misc_feature (440)..(440): Xaa can be any naturally occurring amino acid
  Homolog annotation: Hit_ID=AAC48327.1; Match level="QueryCoverage =100%, HitCoverage=93%, E-value=0.0, Identity=99%"; Hit description =beta-1,4-endoglucanase-1 precursor [Heterodera glycines] gb|AAC15707.1| beta-1,4-endoglucanase-1 precursor
  Gene Ontology: Mol. function=glucosidase activity; Cellular component= cell wall (sensu Fungi); Biological process=cell wall organization and biogenesis
  Coding regions on vcDNA: vcDNA=SeqID_88630; Strand=+; Position=2-1346
VAPPFGQLSVSGTNLVGANGQPVQLIGNSLFWHQWYPQFWNADTVKALKCNWNANVIRGAMGVDEGGYLSDANTAYNLMVAVIEAAISNGIYVIVDWHAHNSHPDEAVKFFTRIAQAYGSYPHILYEDFNEPLSVSWTDVLVPYHKKVIAAIRAIDKKNVIILGTPTWSQDVDVASQNPIKDYQNLMYTLHFYASSHFTNDLGAKLKTAVNNGLPVFVTEYGTCEASGNGNLNTDSMSSWWTLLDSLKISYANWAISDKSEACSALSPGTTAANVGVSSRWTSSGNMVASYYKKKSTGVSCSGSSSGSSSGSSSGSSGSSSGSSSGSSSGSSSGSSSGSSGSSSGSSSGSGSASISVVPSNTWNGGGQVNFEIKNIGSVPLCGVVFSVSLPSGTTLGGSWNMESAGSGQYSLPSWVRIEAGKSSKDAGLTFNGKDKPTAXKIVTTKKC

SEQ ID NO: 162208 - protein, 191 aa, Heterodera glycines
  Homolog annotation: Hit_ID=CAE71449.1; Match level="QueryCoverage =96%, HitCoverage=47%, E-value=3e-75, Identity=75%"; Hit description =Hypothetical protein CBG18361 [Caenorhabditis briggsae]
  Gene Ontology: Biological process=tyrosine catabolism
  Coding regions on vcDNA: vcDNA=SeqID_88631; Strand=+; Position=3-578
WSVDDSVIHTDYSALRSIVMSNREETVKMPINEPAKSRKAVSQIQEYVDYYGGAGVQHIALNPSDIVHAIQSLRAPGLEFLSIPDSYYASLKQRLSDAGVELKEDLEKLRELKILVDFDEQGYLLQIFSKPCQDRPTLFLEIIQRHNHQGFGAGNFKALFESIEAEQNERGNLFYKDVAVGGEKIEAKKSE

SEQ ID NO: 162209 - protein, 130 aa, Heterodera glycines
  Homolog annotation: Hit_ID=NP_491611.1; Match level="QueryCoverage =84%, HitCoverage=43%, E-value=4e-18, Identity=40%"; Hit description =putative secreted or extracellular protein precursor of bilaterial origin (1G59) [Caenorhabditis elegans]
  Coding regions on vcDNA: vcDNA=SeqID_88632; Strand=+; Position=31-423
MPMTEKQETAPKCATNVAARSCACCEHVTVRKIRLDDEVCVNVTYLPTKIGVRLAVSVDGHVYYSKDLAVFNPESACFEVPEMREYASICINLYNMELKNNKLTGCAKLEAILLHLRVAQHKIGCFSIPI

SEQ ID NO: 162210 - protein, 125 aa, Heterodera glycines; identical to SEQ ID NO: 162203
  Coding regions on vcDNA: vcDNA=SeqID_88633; Strand=-; Position=215-592

SEQ ID NO: 162211 - protein, 150 aa, Heterodera glycines
  Homolog annotation: Hit_ID=AAF76925.1; Match level="QueryCoverage =100%, HitCoverage=100%, E-value=3e-85, Identity=100%"; Hit description=hypothetical esophageal gland cell secretory protein 11 [Heterodera glycines]
  Coding regions on vcDNA: vcDNA=SeqID_88634; Strand=+; Position=23-475
MFRFSLLLLLVPLVRCVPNPKPLFGIGIGRKQSAGAEGKLTCAGEPLADVKVKLYDDDRGVDTDDLMGETRTDSEGRFRLEGYTHEITTIDPKINIYHDCNDGLKPCQRKISIMIPDKYIASGEHPNTYYDAGTVELEGKFSGETRDCLH

SEQ ID NO: 162212 - protein, 187 aa, Heterodera glycines
  Homolog annotation: Hit_ID=AAF76926.1; Match level="QueryCoverage =100%, HitCoverage=100%, E-value=1e-105, Identity=100%"; Hit description=hypothetical esophageal gland cell secretory protein 12 [Heterodera glycines]
  Coding regions on vcDNA: vcDNA=SeqID_88635; Strand=+; Position=88-651
MMMVRSSSSSFSLPSYFLSLLPLLLLLFSQCSQISFACQCQWAPPKDNYCSSDWVAHVQVIKRQDGVRMPAGITDRQTDLNSRHEVKYLRMFKISKQMPVNQQNQVILPVNVYTATEDAACGILLESGHQYLLAGDYVNGTMLTGLCRQILLEDLKESRKHDILEWTEVPQKLKEQLEKQEFDQKCN

SEQ ID NO: 162213 - protein, 203 aa, Heterodera glycines
  Homolog annotation: Hit_ID=CAE59026.1; Match level="QueryCoverage =99%, HitCoverage=24%, E-value=2e-43, Identity=44%"; Hit description =Hypothetical protein CBG02303 [Caenorhabditis briggsae]
  Gene Ontology: Cellular component=Golgi apparatus
  Coding regions on vcDNA: vcDNA=SeqID_88636; Strand=+; Position=40-651
MEWARIELEKRFAESMRRLAEMQEQCDRVEHINQQLQLENETIADHVVLYQHQRRLIRERLRLKDEQMAALEKERERVVARCNELQEALRQVLGNGRDEVAEFRPRLYSHSTVDEFSGDEECIVDSAKENSQSLLPNVHHSPETNGQKEIRSTEENSPSTDWTNREDAVKKIMDIIDDIKKPSMPLSSVKMQCKQCIGPVLHL

SEQ ID NO: 162214 - protein, 338 aa, Heterodera glycines
  Homolog annotation: Hit_ID=NP_506750.1; Match level="QueryCoverage =40%, HitCoverage=43%, E-value=5e-13, Identity=35%"; Hit description =BTB/POZ domain and Meprin/TRAF-like MATH family member (5P667) [Caenorhabditis elegans] emb|CAA21761.1| H
  Coding regions on vcDNA: vcDNA=SeqID_88637; Strand=+; Position=125 -1141
MEEHQQQKKTAEIYSKYFVVGEHRLSVNLPQQHNANTYYSNPPYSVHVRDWIDGKKWEFSVTKPINSQQCLLKLAMLETDLASNPVTAEIVFWQWFRGKQAHILQKSVKVFCQSGAQVQLQHNAGAANAAPSDGFFNVLIRLLEKREHQIIENPCPPCDSENEVVLKVGPEQFTVSKHFLMSVSPVFHKMFSVDMLEKAQGEVSLEETNGEEFGAFLDAISPKMASPNPANVMGMLKLADRFQVDALRNRCEAHLINCVEISLIERLLCAEMYRLEKLKNFILKSLNGVGMREFYEENQAALNLLSKDLLIQLTVRICSSSKIDRSALCHNCTKILNE

SEQ ID NO: 162215 - protein, 203 aa, Heterodera glycines
  Homolog annotation: Hit_ID=NP_001002546.1; Match level="QueryCoverage= 58%, HitCoverage=46%, E-value=6e-10, Identity=36%"; Hit description =VAMP (vesicle-associated membrane protein)-associated protein A, like [Danio rerio] gb|AAH76262.1| VAM
  Coding regions on vcDNA: vcDNA=SeqID_88638; Strand=+; Position=51-659
MKRNGNSICSETKPPLLELTPKNVLTFRGKLGHVGSVSLDIKNCEICSVYFKVKSNANHFYSVRPNTGVIGAYGRVKVVIQLHDDSLAKLDEIEENKHKFLIMAAIVSDASIGTEKFWKGKKEGMDGIYSSKMKTEVHKVCRWEGGKGVLSQQNSEENVPNGKNSVSVEKVPNQILELCSEKEAPNQFSNLEENVPNGKNSML

SEQ ID NO: 162216 - protein, 197 aa, Heterodera glycines
  Homolog annotation: Hit_ID=CAE59026.1; Match level="QueryCoverage =98%, HitCoverage=23%, E-value=1e-42, Identity=45%"; Hit description =Hypothetical protein CBG02303 [Caenorhabditis briggsae]
  Gene Ontology: Cellular component=Golgi apparatus
  Coding regions on vcDNA: vcDNA=SeqID_88639; Strand=+; Position=40-630
MEWARIELEKRFAESMRRLAEMQEQCDRVEHINQQLQLENETIADHVVLYQHQRRLIRERLRLKDEQMAALEKERERVVARCNELQEALRQVLGNGRDEVAEFRPRLYSHSTVDEFSGDEECIVDSAKENSQSLLPNVHHSPETNGQKEIRSTEENSPSTDWTNREDAVKKIMDIIDDIKKPSMPLSSVKMQCKQCI

SEQ ID NO: 162217 - protein, 184 aa, Heterodera glycines
  Homolog annotation: Hit_ID=XP_313147.1; Match level="QueryCoverage =97%, HitCoverage=27%, E-value=3e-19, Identity=32%"; Hit description =ENSANGP00000013336 [Anopheles gambiae]
  Gene Ontology: Mol. function=protein binding
  Coding regions on vcDNA: vcDNA=SeqID_88640; Strand=+; Position=79-630
MSISLADRMKLLLTNGDGADIQFLVGQGEEKEVLKAHKLILMAASDVFKAMFRFDAQNAKTKTSSSAEQLQSVEITDIDANVFKVMLSFIYAEDSSGLTGDNLIAVLYAAKKYHISLLAKACADFPLENELPNVFLAFDQAQLLDEKDFAIRCLDYINRKAETLFGSEEFLQIGQNLLSKIFAS

SEQ ID NO: 162218 - protein, 51 aa, Heterodera glycines
  Coding regions on vcDNA: vcDNA=SeqID_88641; Strand=-; Position=393-548
MSGVSNGGFDKADDNASQHRSGGVSGHRRATGDATDRHFQRVVVGFPSTYL

SEQ ID NO: 162219 - protein, 155 aa, Heterodera glycines
  Homolog annotation: Hit_ID=CAE66022.1; Match level="QueryCoverage =68%, HitCoverage=49%, E-value=6e-14, Identity=41%"; Hit description =Hypothetical protein CBG11216 [Caenorhabditis briggsae]
  Coding regions on vcDNA: vcDNA=SeqID_88642; Strand=+; Position=23-490
MTSSQPIIYEKIVQQNGSKNSAEWCLASERRLLQKLIHHKPVGINRHFNLNLLVIYMNNIFDFEEDINFDDYLSEKDVEQLKRRRMEGKQDERRPMAFSPSYAIRPTTKQVEEKLNEYFDMELIGENESPSEELEKKAVFELPQEYQFKEEMVPR

SEQ ID NO: 162220 - protein, 249 aa, Heterodera glycines
  Homolog annotation: Hit_ID=CAH91741.1; Match level="QueryCoverage =99%, HitCoverage=29%, E-value=6e-92, Identity=65%"; Hit description =hypothetical protein [Pongo pygmaeus]
  Gene Ontology: Mol. function=ribonucleoside-diphosphate reductase activity; Cellular component=cytoplasm; Biological process=DNA replication
  Coding regions on vcDNA: vcDNA=SeqID_88643; Strand=+; Position=3-752
SPVSKGILQYDMWDVVPTDLWDWPLLKERISKFGVRNSLLVAPMPTASTAQILGNNESIEPYTSNVYSRRVLSGDFQIVNPHLMKDLIELNLWDDQMKNRLIAENGSVQNIKQLPQEIKDLYKTVWEIPQKDILKMAADRAAFIDQSQSLNIHIAQPNYAKLSSMHFYAWSLGLKTGMYYLRTRPAVDAVQFTVDKMALRGTIAKDESVEIDVLKDKENISANSELRLPSKRKYNEQLEESDGCLMCSG

SEQ ID NO: 162221 - protein, 88 aa, Heterodera glycines
  Coding regions on vcDNA: vcDNA=SeqID_88644; Strand=-; Position=34-300
NEATQHLLYKIFVITFRLLVRFSPAVCLRSNDPFQFHCIFDVLCNNLTTLQRLPLTFNATIRLRHLCRVRPPGVRRRCRAGRSPVGLH

SEQ ID NO: 162222 - protein, 221 aa, Heterodera glycines
  Homolog annotation: Hit_ID=CAE69300.1; Match level="QueryCoverage =81%, HitCoverage=73%, E-value=3e-50, Identity=55%"; Hit description =Hypothetical protein CBG15355 [Caenorhabditis briggsae]
  Gene Ontology: Cellular component=integral to plasma membrane; Biological process=mitochondrial translocation
  Coding regions on vcDNA: vcDNA=SeqID_88645; Strand=+; Position=23-685
MMLWGSPSPVSTDETKDKIGHDYSHLELIKGDTYEIGMEPSSVGGTSAGHNAKPFFALDQLKQAGVPLKAQINPYLQLDPSIFKESQPQIIMPEGYESGRGKFEFALGYIGCSVIGGFGVGSVRGMFGELGNPQNRTLAWNPWYTRMLNAATKHGSGYAQTAGTAMFLYSVTELGLKLSRADDLLNSFIAGPIAGGLFRGLPHGLRAGSVGALAGLGLSPS

SEQ ID NO: 162223 - protein, 373 aa, Heterodera glycines
  Homolog annotation: Hit_ID=XP_320495.1; Match level="QueryCoverage =95%, HitCoverage=77%, E-value=7e-45, Identity=32%"; Hit description =ENSANGP00000015654 [Anopheles gambiae]
  Gene Ontology: Mol. function=SNARE binding; Cellular component=plasma membrane; Biological process=vesicle-mediated transport
  Coding regions on vcDNA: vcDNA=SeqID_88646; Strand=+; Position=47-1165
KNIFVQTMRVTIIAGENVASLEISADMELENFLALCKFELPSIADTPIERIALNCSGRQFIANAGLAKKQLKELNIQHEDAIHFETISASSTAQTPHSSLSTPSSAASTSLGAPLQTSNLISSLVQNIKVPQKQKSVAEDRAMSDQIFTMLQHPARLDFLRVDHPELAAAYEKNPTDKDLFYIAFMKNKEEQTRRVRLMYDHSSEEGQRYIAQEIERERITRMQELAMEHMPEAFIPVHMLYIRMKINNHLVIAFVDSGAQASILSESCARRCDILKYVDRRYRVQAHGIGGSQKMVGRIFACQVQVDDNVFACPFEVMSDRDVDILFGLNAMLRHRCNIDLKKMVLRFGDGTETPFLSEQEVKREKEAIAMA

SEQ ID NO: 162224 - protein, 177 aa, Heterodera glycines
  Coding regions on vcDNA: vcDNA=SeqID_88647; Strand=-; Position=170-703
KSHTNQSIKIKSNFCIFFPLIFCWGIEMMASRSRPSLRPPRLVTFLSLSLAFAFAAADDVPAVGGCGGGRSNSAALPISGGVVVHHWHGRHSAGVDGNRKNVANSGHGFALPTDDEGIVTPSVPKAHGRNAKTRTRTRLHQNYTHAIFIGFLKLDQSGGDFLNDTLVPFYCFGMLIG

SEQ ID NO: 162225 - protein, 151 aa, Heterodera glycines
  Coding regions on vcDNA: vcDNA=SeqID_88648; Strand=+; Position=1-456
EPKLFCSHLKSQQPEMCLNRVVLGPEITRRPAAMPFWADLAQGNNDNRDGANWEGARHFEHWLRRGSRAHKCPICQHLTPTQSVMLALFASIFECIFLLFSTFGALASVMRPKMKGFLLLALLPLVTFLPETMAKSIQAAEMSEMNDELSD

SEQ ID NO: 162226 - protein, 39 aa, Heterodera glycines
  Coding regions on vcDNA: vcDNA=SeqID_88649; Strand=-; Position=1-117
TFILLNDKLMKFTLKMKHKLMALFVPTDHFPPPPPLSLS

SEQ ID NO: 162227 - protein, 226 aa, Heterodera glycines
  Homolog annotation: Hit_ID=AAT07059.1; Match level="QueryCoverage =52%, HitCoverage=26%, E-value=5e-14, Identity=36%"; Hit description =cathepsin F-like cysteine proteinase [Brugia malayi]
  Gene Ontology: Mol. function=cysteine-type peptidase activity; Cellular component=extracellular space
  Coding regions on vcDNA: vcDNA=SeqID_88650; Strand=+; Position=13-690
MHKGSLVPLFGKNLQQNSWRAFGEKSPLKRWRLNKLSAFKWLISFLFSKSLPLVLLLIILLLYFQFPLNLFGPSDGTDFGRIISNGTFLAKFVDFQKRFSKNYSTIEEKLTRFSIFVANFEQLEKIRREGEVYGITTFFDCSDEELKELIMPHEYFESVPFSWAKPIREFRPMDANFKRPSEFDWRKNGVVNHVKNQRRGGACWACATARLGQVTAPNSQRNTGSL

SEQ ID NO: 162228 - protein, 284 aa, Heterodera glycines
  Homolog annotation: Hit_ID=NP_506260.1; Match level="QueryCoverage =99%, HitCoverage=54%, E-value=3e-54, Identity=41%"; Hit description =cytosol aminopeptidase (56.1 kD) (5N525) [Caenorhabditis elegans] emb|CAB01448.1| Hypothetical protein W0
  Coding regions on vcDNA: vcDNA=SeqID_88651; Strand=+; Position=16-867
MIQINTSSDLNEKVYDAIVVVSDGINSLSKVDKFSADLRNAVESYSKIDHSLDKGKVSLIQADKFHAKRIVYASTGTVHKDFDDVRRYTKAGIAAGETALSAGVRSPLLVAVPSERFPNASLMAALGFLHTLYTPLNLAVPDKPIRKVDLLGIFEVEANEKSNVGPSVSMLQALQQSFNVARDIGDGDPERMCPAKVAEYVKKTFENSSVRVSIIDDVDQIRRDYPLMSAVSRCANAIEEHKARLIWLEYDGGEETETLFLVGKGVTLDTGGVHLKVNGAMLRM

SEQ ID NO: 162229 - protein, 165 aa, Heterodera glycines
  Coding regions on vcDNA: vcDNA=SeqID_88652; Strand=+; Position=160-654
MSSILKVTFHWKEPKKAHPFPDSVVLKIPGPKYNSLVAQNGREEQTDNAMEEESSDYLIKAHTNEILFYKNFPRFDASLRLPKFYFGSDYSPSHNNGLIIMEDLSSRASSLLTLPGFDDAHVLVVIDELSKIHAISWKHGELKQHFPIEIRPSFIESMRSNAKQL

SEQ ID NO: 162230 - protein, 131 aa, Heterodera glycines
  Coding regions on vcDNA: vcDNA=SeqID_88653; Strand=+; Position=1-396
MTCVKKIEFPDEPGFFCSDRLARYEQSMLIETGHMYAQAARNNSEAARNNSVTAQESVRAMVNKDRLVADKELLLAQQKIELDEKDRLIATLRDTIQNKDQRIVYLEGYINGLGVPLPAPAEQQQQDGGGQ

SEQ ID NO: 162231 - protein, 197 aa, Heterodera glycines
  Coding regions on vcDNA: vcDNA=SeqID_88654; Strand=-; Position=270-863
TNFNFYRMGPNEEAHKHNSSSTPNRIDSVESDDDEIAGWRAEGWRIGFDVEMRVGVAGVDRPHESAESESDATEDGHNTAFDAENGPSLNCGYVLLPSSAVDDAPPSPPASTPTATSPTHCQSNWLLPAPPPAADLDSIQHKPNDFNLDRVKTEEIKQIMAQMSVSSRKPEWAQQIDDGKLAELVERLKKRKVTEGK

SEQ ID NO: 162232 - protein, 113 aa, Heterodera glycines
  Homolog annotation: Hit_ID=CAE74331.1; Match level="QueryCoverage =100%, HitCoverage=100%, E-value=2e-31, Identity=64%"; Hit description=Hypothetical protein CBG22044 [Caenorhabditis briggsae]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_88655; Strand=+; Position=24-365
MASTQELAVIYAILALQDEELPITAEKVQTMVTAAGVTVEPFWAGLYVKALQGVDVKALLSAVGSPGSGAAAPAGGGAAAAAPAAEAAPAKEEKKKEEVKEESDDDMGFGLFD

SEQ ID NO: 162233 - protein, 280 aa, Heterodera glycines
  Homolog annotation: Hit_ID=CAE59012.1; Match level="QueryCoverage =60%, HitCoverage=65%, E-value=2e-17, Identity=34%"; Hit description =Hypothetical protein CBG02288 [Caenorhabditis briggsae]
  Coding regions on vcDNA: vcDNA=SeqID_88656; Strand=+; Position=2-844
MLFPFRFVLSIRIGAALPHSFCSFSDAFPSSGDRILIRRENFNRNRPRLLKRNEKSLLAENRQGIPTATDCATLVLFCQLGSPSAEESWVLFTQRAKRMKHHANEISFPGGRIEQGESVETAAIREAEEEIGLDRNDVELWGTLRPLFFGEAGVVTPVVATIGQNVEQRLASLRCADAEVQNIFMASVSDLLARIHYTTFRFSGKPSDDKMPFFFRMPIFHSTKPRLLCNSSLVNCPEKFRIWGLTARTLLEALNAFLPEDAKEREASELLRKGKTDNSC

SEQ ID NO: 162234 - protein, 212 aa, Heterodera glycines
  Coding regions on vcDNA: vcDNA=SeqID_88657; Strand=+; Position=1-636
INSKFLLFVKCNSSPFLFLMMGPTQKKARLNFTIDQLIVRPLRDSQRVNVVPPPTVTNAAQQTQQPPLAALQQQTLQQLTNVRWPSLPSSAFRPLFPPPLSAPFAFSPFALPSLFFSSPPFSLPIPSSLPNNLSSSFHPSPFLMLTPPTRAALMAIALRRQQQQHFGSAGSSTGPSSTCSSSQSAGTTECVAIRTENRPCVVSPALRHKNLT

SEQ ID NO: 162235 - protein, 86 aa, Heterodera glycines
  Coding regions on vcDNA: vcDNA=SeqID_88658; Strand=+; Position=3-263
LSVIQLCVTYGNKNLAFRLMDRLNAYEEQVKAYLILGEVKKAATLAVEREDLQMLQSIKCRLAPSSANWEEVKKITDTLLKKAAHA

SEQ ID NO: 162236 - protein, 113 aa, Heterodera glycines
  Homolog annotation: Hit_ID=CAE68486.1; Match level="QueryCoverage =64%, HitCoverage=19%, E-value=9e-15, Identity=57%"; Hit description =Hypothetical protein CBG14288 [Caenorhabditis briggsae]
  Coding regions on vcDNA: vcDNA=SeqID_88659; Strand=+; Position=29-370
IIVIGTQFGHFFHFSIRIHRYFFNFQFASVFQAEADLRVAQAEFDKQLEILRILLESLQTAQNQQSKHLLEFVEAQAQFFSACQQHMADLKREINSASGERFRSNGINGGGGI

SEQ ID NO: 162237 - protein, 141 aa, Heterodera glycines
  Coding regions on vcDNA: vcDNA=SeqID_88660; Strand=-; Position=28-453
NTAFFLSIKSINFFIFNNFLFHFCRQNFVQPGFSLSFFNPFICFFRFCLRIHAQVGGCWPSSKSLSAFNVSSWHSIFFCAGKQSRREEPIGSSVKHLSWFSMPKYFGGNAATPPTHLSTQPMSKRTQKTNGKLKKDFIFYQ
